United States Patent 9,567,581 (SELECTIVE REACTIVATION OF GENES ON THE INACTIVE X CHROMOSOME) - sequence listing, part 33

SEQ ID NO: 3905 - DNA, 110354 bp, human
atgccccaagctgccgcttcggcgccgtggacctcagtgtcctgcggcaggatcccaggcctgccccagaacccagatggctgcactttcatgccgatagcccaggcgatccctctgcaggtggacatggccatggccctgcagcgcgtgaggattgccgagaagtacgggaagaactacctctgcctcctgcaagcagtcttcgtggcaggtaagtcccctcctctcatctcctccccggcggcctcgggctggcttgcccttcttctcagccgctgcctccccagcccggccggcttttctttattttccagtccacacccctccccgcgcgcactttattttccagtctatacaacccccccacctcgcccgcccgcccgcccgccgcgcacacacacactttcctgctgcagtggcgctcccagccacgaactcgctgggtcatccgttctccgttcctctggccagctgccgcgctgcaggcgtgcagctctggtctcagctcgcaggaggtgagatcaggagctctggtcccgcaggaggaccgtgggaaagtgcaggaagcagtatgaaactgtctctgccattgctggttcaggtctcctatccccttctcacccactttggtgcgtccccggagaagtgggaatagagtgtatcttcccacactgcatctcacacaccagaacccagcctctttgaggagtgcacttcccttgtaatattccctgaagttgaaaaagcaatttttttttgtttttgtttttcccataacgcatgtggaggaaaccaagtcaaaaaggcactcaggttcggaaaccagcagcagggccgtggcagggcaggtgggggaggagttgtagggaaacagctgctgccactgacttgggctttgcacccagaaaagcgcatcttttcatcttggtccatgagcttgttgcttccctacaaaggcaaaagctcttgtttgtctggaaggacaaacaaaagcaaagacaagtaactcacaaagtctttacggccgctgccatggtttgattaaggggagtaagtggggtaacatggacttggtcacttgccagtcgtgatacactcacatttagcaagctgaagttgcccagctttggggttgatgtagcagggaggatgctgcaggctgtggggctgcgttcctatggggccattctgactggggcaccggggctgcctcagaacagagtgcaactctgagacctgaagttcagccagagcttttcagagaagtctgcaaggtgctgcaattgatgtgcgcgccttcctgtgcacccaaggtagttttgacttagtaggttctaagccttgcagtggaagttttggtattcaaaaaatagacttggtggcaatttcccacaaatcagatagccacaacacatgttccaaatatacctccctattcagtgctatccacaaatctaaaggaggccatgcaaacatcttcagttagaccagaggaattaattcaaggctgtggtctgtgcatcttcatcacacagaactctttggtcttgcttgttttgttttgagctggtctatattattttctagatgtaataaatcattaagggcaatgtggtgatggggcacaaactagttccggtcttaagagcaatttaaatagtttttggagactacaaaaaaaaatcttgctgaaacattccgtgcagtacagtggaaagtactttgcgttttgttctcatttaccttctgcatcatcttgggagctaaaaaaaaaaaaaaaaaaaaaactcctttggaggaatgcatgcttaatcacaaaggttaaattagttatgctatgaaatgtaagttgatatttttgctgctagtgatttctcttatttctagagttgtgtgatgtgtcatctgttcacacttttgaaggctcctacatgttgacaggcccccattcctgtggcattacaatgtgtcataacacctaaatgacaccagttgctgtgctgtgtttttacctgggcttgcaatacttttgtaccttttcagcatttgccctggaagggatttgtagccatgtgattagagtacacactatagtacaacaattttaaatgtaaaatggatttccatatacttcgaagctatttatatattaaaatatgtttacaaagtttttcattgtggtaaataactttctgaacaatcacgtcaaaaatgaccatttgtggattgctcaggcccagaaattatactacagagtaataagctaatgacatatgtgtgtgcagaatcttccctggggcaaccagaagagaaaatgattggcttcacttagggagttaggggaagacttgatggagagagtgatgcatgagttgaatcttgagagatgcacacaaatgtccagctggacagcgggtggggattgaacgtggtagggataggtgggtgaatggtattccaggcaaggaaataagatatgcaaagacaagcagagagaggagagcagagtaggtttggggaattgtaaattccttttaaatgactggagtgtaaaatatggggggtaaaggagagagagagatttggagaggtaggaggggcctcgtaaggcatgttgagtggttttactttatttccagagcaatcggaagccactggagtgttgtaagcagggcaatagagaaagctgctgcatatgattgaacaggttgtgcactgcaaaacccctggggcctccactgacacagaccacaccaggaatgatgcccttactatggctgtacagtgcacagtatacacagtggtcaacagcagctatgagtgatggaactttttgctttcacaaagatcatccaagttgtgtggaggattcagtgtgtggcttatgccgtggagaggaagaagactggagataaaatgactagttagaacacagttgaagtaagctggctctcagtggatagaggcatggactgtcacttctggggatgaggagaaggggagaggtctgagcggaattaagagggtaaattgatttgacttggtgactagtcgtggtgttcgagggacagggaggagactaggttaatttcaggtttctggttagggtgactgaatggaaagagatgccattaacacagggaatggaagaggaagaggtagtttgattttcaattctgggtatgtggtttctgtggaatattcaggtagagctgacgaatgggtctgcagctgggaagaagtaaatgttatttcttattctcatcatctatagggttcattaaacatctcctggcactgaagttctttccttaaatctacttctccatgggctatattgataactcagcaagtctagtacagaagtaggcacacattataaaattacctttcagacttgttctttatattttccctcacacatttctttacctgatgatgaaaaaaaatgaaaaaaagaaacgtcttgtattcatcacaggaggaaagaatgtaagctattctgatctaatgtaacctcagataacttacataattagttgtgaaaacctgttcactgcaaattttactcatcagagtatagctcagggagatatgtaaatcacaacaaaatttattcagtgtgcattccagtatggtatgaagatttatttcaatgatgatgggtcatctattaggccacacgatactgtgagtgttccacgtaactgatttttctgggtaactgaggttcaacacttttagtgcctgactttttccccttaaaatatgtatccattttggatgagaagcttttcaaaaatactatttaccttcctgacccctgaacctggaaataattgcatccttttttgatgggttaagattgtccttataatagcattagttctttcaatgtgctgtattcagtgctgcctctgggctcctaaactgtggagggctgtttgtccctatactaaatggggacagattgttctgctttttaattttcaatgcctgacttttaccctctaacttttccgtagatttcctctctgttagctgatattttttgctgctgttaatttaactgtttctactggccagttgttattgcctaatcctccatgccccctcctccattgccttctctgagtgttacgaactagggaacaagataatcaagcttgttcgaactgtgtgaaaagtataatagaccatgagtaggcctgtggggaatctacctcaactaatgtatatgagctttagtacatggactctgtgatatctattccaattgcaaaacatctttttcttttctttctttctagttcctttgtgtgttttggagggttgatgcagttaaataagttatcagtaaaaatctatgttctcctgctaatcgaggcataataacatgtgaaattgtaatattttacttccttgtaaaacaaacaagtgtgttcagaatctatcagcaattccacgtgcattttatccactgcatttctcagacatgcctgtgcttggcaccagaaggcacttcattcttaaaatttgcccccaggtttgaaagcaattgtccctgtctctgctcagcatcttcttaagcaagcatcctctgaaggctcaataaacaacttgcaccttacctactctagggcaggagcagaggccaatcccatgaggagagatgccttctatctgatggctgacaaggccagtgcctctttctgttgcttcgacgtcttgttccagagacagttagctcctggccagaggccagtgtcacagaagttacatttattttttcacccaaacttcccctcattgtatgtttatggcagatgtaagaatctgagtgacttcttgttacttccagcactgggaagatgccattgagcaaaatcctgaaggaggtaggaagtgaactaccagaggtgactgggggagagtgtttcaggaagagggggcagtcagtggaaaggccttgagacaagagcatgctgacaagttcaaggaacaagaaagagacgggtatggctgaagcagagtgagtgtttgcatatgtgtgtgtgtgtgtatgtgtgtgtgtgttgtgtgtgtgcatgcgtgcctgcatgagatgaagccatagatgtaataaagtctggatcacatagggcttggtaagaatttaggcttttaacctgagtcagatgatgagccattggaaggttttgagcaaaggagtcacttctgtgttaacagaatccctctggatgctgtgtagagaataggattaaggtcagacaaagatggaagcagtgaaaccagttaagaggctattagcattaatgatggcaacttgaaccagagaggtaatttgtggaggtggtaagagtgatcaaatagattctggatatattttgaggatagagtcagaaggatttgctaatggtttggatatggagtatgagagaaagaggagttaaggataatgctaacatttttggctttagcaagtggatggcagaaattttcatcagtggagatggagatgcctgcaggaggcgtaggtttacggggaaaaattatgaatatcagaagtttggctgtttgaacctgttaactttttttttttccgagatagagtctcactctatcacccaagctggcatgcagtggcacaatctcagctcactgcaacctccgcctcccacgctcaaatgattctctcacctcagcctcccaagtagctgggattacaggtgtgcaccaccacacccagctaatttttgtatttttaatatagaatcatgtcgtctgcaaacagggataatttgacttcctctcttcctattgggatgtcctttattttttttctcttgcctgattgctctggccaggacttccaatactatcttgaataagagtggtgaaaggacatcttttcttgtgccagttttcaaagggagtacttccagcttttgtccattcagtgtgatgtcggctgtgggtttgtcatagatggctcttattattttgaggtacgttccatcaatacctagcttatcgagagtttttttttttttttaacgtgaaggggtgttgaattttgtcaaaagccttttctgcatctattgagataatcatgtggtttttgtttttagttcccatttatgtggtgaatcgcatttattgatttgcatgtcttgaaccaaacttgcgtcccagggataaagcctacttcatcatggtggattagctttttcatatactgctggattctatttgctagcattttgttgagtatttttgcatctctgtttatcaataatattgccctgaagttttagaattgtgtctctgtcaggttttggtttaaggatgatgctagcctcataaaatgaattagggaggagtccattttggaggagtatttagggttttctaggtgtatgattgtagcaggacaagccacagacaaaacccctcagacaccgagttaaagaaggaagcagtttattcggctgggagcatgggcaagactcctgtctcaagagccgagctccccgagtgagcaattcctgtcccttttaagggctgacaactctaagggggtccacttgagagggtcgtgatcgattgagcaagcagggggtacatgactgggggctgcatgcactggtaattagaacggaacagaataggacagggattttcacagtgcttttctatacaatgtctgtaatgtatagataacataaccggttagatcaggggtctatctttaactaccaggcccagggtgtggcgccgggctgtctgcttgtggatttcttttccgccttttagtttttacttcttctttctttggaggcagaaattgggcataagacaatatgaggggtggtctcctcccttatgatcatgtcatcagcaaacagagataatttgacttcctcttttccaatttggatatcttctatttctttgtcttgttttattgttttggctaggatttctagtactatgttgaataggagtgataagagtggacatccttgtcttattctagttcttaagggtaatgttgtcaacttttccccattcagtatgaccttggctatctgtttgtcatatatgagagcctatttttaaaaatagcttttgtagagctataattcacatacaattaacctacttaaagtatgcaattcaatggtttttagtataatcacagagttgtgcaacctttaccacaatctaggtttaaaatattcccatcaccccaaaaagaaaccccatactcgttagcagtcactctccattttctcccaaccacctttttcctcagcccctggcagtcactagtctactttctatttctatagatgtgcctattctggacatttcatatacatagaatcatacaatatgtgatctcttgtgactggcttctttcactgagcgtaatgttttcaatgtccattcatgttgtcgttgtgtcattcttaaaatggctgcatcttattgcagtgcatagatgtgccacattttaattatccaataaaaatgataggcatttgtgtggtttccaccttttggttattatgaataatgttgttatgaacattcttatacaagtttttatgtggacatatgttttcatttccctgtggtatgtatctaggtgtggaaattgctaggtcctagagtaactgtatgtttcatccttgaggaaatcccagaccgtttttcaaagcagctgcacccttttacattcccaccatcaacatatgagggttataatttctctacattcttcctagtacatgttaatctctctttatttcccagccatcctagtgggtgtgaaatagttttttattgtagttttgatttacatttcctgaatgactagtgatgttgagcaccttttcaggtgcttattggccatttatatatcttctttggataaatgtctacatggattatttgcctgatttaagattgggcttttcctcttttactgttgagttttaagagttctctatatactctggaatggagatctttatcagacatttaatgtgcaaatattttctcccactctgtgggttgtctttttacgtacttcatggtttccttgaatcgcaaatatttttaactttgagaaggtcgaatgtatctatttttttcttttattgcttgtactttggatgtcaaatataagaaaacattgcctaatccaaggtcataataaattacaactatgtgtttgtctaagagttttatagttttacttcttatacttagatctttgatccattttgagttgatttttgtgtatagtgtgcggcaaagattcagcttcattcttttccatgtgcacctccaggtttcccaacatcatttattaaaaagaatatcctttccccgttgaaatgtcttggtgccctggatgaaaataaattaaccttcggtacaaagatctatttctggactttcaattatttcccactgatgtatctataagtctatcataatacctatctttattactgtagctttgtactaattttgaaatcagaaaatataaactttccaaatttgtttttctttttcaagattgctttggttattccaggtcccttgcgtatccatatgaattttaagactagcttgaaaatttctgtgcaaaaagccatctgggatgttgctagggatggcattgaatctgtagatgaatttaggaagtaccttaacctcatttttatagtggcacaaattgaggtttcccaaactatggaccattcacatttaacatatttggaattatttactataatggatattggcattctgcccttcagtgctcacattggatagttattcatctttagtttgtcatgaatttacaaagtttatggctgggcgcggtggctctcgcctgtaattccagcacttttggaggcctaggtgggaggattgcttgagcccaagattttgagaccagcctgggcaacatagtgagacctcatatctacaaaatatattttaaaaaattagctgagcatggtggcacactcctgtagtcccagctactcaggaagctgaggtgggaggatcacttaagcccaggatgtcaagactgcagtgagctgtgatctcgccactgcactccagcgtgggtgacagagtgagaccctaactcaaaaaaaaaggagaaagtttgcaacatattcattcctagtatgagaattattctagacactgtgctgaagtcttaaaaggcaagaaggtatcaacctgatctctcccaagggaaaacaataatacaaatgaaaacaacaacatcatcactaactcagtcgcctttgtgtttgtgattcagcatttggcaggcacgtctgtgtaggactggggtgggataacagaagaaatgagaggcatatgtttggataccacactgccacgaatcggcaaaggctttttcatgctggacaagacaatttgtcaatcaagtgtgtagttatcctccctgtggcaggagatattttttaggaaaatagactgcagtggctcgataaatggacttggaccagatctacagtggatttgctgatgctttaagcaggaaaaatatttacttatttctatttttacatattgtaaatcaccacgtatgtagttcttctttacagactgattcagttcctctcaaaatttacctacatgttttggatttctgaataataaattcattcagctgtgattattagggaggttcccaagacaatgtcagctcctgctgctgtacagggaaaacctgccatctctactgaatggtttttaatctgaaggaaggctgaaggaaaaggtttccacagacatgctcttaattaaacacctacaagagatatagtcaaggagcagcaacctgggacactaagcctgtggggggaggtcttctcactgtcacttcccaccagctgtttctcattttttctcatgcatttttcctgccctctctctttcatccttctcttttctcggttcttccccttatttctcccttcttactcctgtcatttcctagtgcctttgagtcttctttttcctgtttttgttttctgtttttggtagggaagtatcttttatttcctcttcttctattcttataattaaattatgtatatgtgatctttgtaaaatatctaaacaaaacaaatgcccataaactaataaatgaaagtcatccatgtgcctagcccagtcctgctccttggtggtaaacactgctaatagtttgtgtgtgaggacataggaggttttctatgaatatagatatatcaattcaattcaaacatttattgatcacctccagtgtgctagacactattgagatattatggtgaacaagtaaataaatctctgccttcagggaacttatttctaatggtgagagcaacaataaaaaatccacatatatctagatattttaccaaactgggatcatacaccatatgttgatctaagacttgtattggaatgtgtgtatttaaaaattacttcattacgaaaattttgatacacataaaataatgcaagaggaaaagtaaagtatataatataaaatcatgatgctaagatattttaaaatttccctttcatagagcacaaagaggctactgtatcttttcagcataaagcatttgcccagttttgtcttaatgggcttatagtagaccctgtagatgctactggaatatgaattttgcataactttgtggctggagggtgtggtagaggttgagctgccctttcataaatgccttgactaggtcagcatcagccgctgctatcagccaagagtattctttacattcaaggatactgagagttctctggtcatcacgtcttcatttgtactcttgtaccattgttaagtggaagcaatagctgttgcatatacactgtgatgagaagaataacctttgagagttattttaaataacattttctctattttaactgaaattgtgtgattaggtatatgtattctgagactctttgatggcaattagaaggaatatgcatatttgggggcatctttgagtttgcaattgcaggctagatcatgggattagccatagagcaaaaagcagtggccctgtttttatttgtaattttgcacttgtcagtttacaaaagagggtcaggtttactttcttcattaacatattcaaaggaccatgaacagatattgtgtgttcttctgcatgcattacaaactaaaataagtcattttaattggatttaccattgcagatgttgtacatttcaaaatgattttatgaacccaagaagaggtgaatagctacagagtaggagatctggcatttagtcacgtctacatggatattgtgagttctgatatcagtgggtcatcttgtctctttttatagcttgtgctttaaatagctgctctcaaaaggtctgatgccataataaaaaattaaataggggttaatgtaaatatttacctattgctaaggtagtatgtttggaaatatttagtggtggctgtggctgtagtggtcagggactagtgtttctttaagctcatgttcaaacatgcccctactcgtttacactgcaagaactgaatggtgattatttgggtgaataaagtaatgccctttcagtgccttttccccacatttctgttgttgaggaatactctggcatattcaaaatgtcggatgaagagatttctttttaactgtgctttgcaaattatccaaggaatctaattctcaaaggcagttatattcatgactacaaaaaattttttaaaaacccacacaattagccggatgtggtggcacttgcctgtagtcctagctactcagaaggcttaggcgggaggatcgcttgagcctaggagtttgaggctgcatgaagctatgattgcaccactgcactccagcttgggtgacagagtgagaccctgtctctaaaaataaataaataaaataataaaaaataagtaaagatggagattaaagttttaaaaccctccattttaaacacttaatattttcatgtctgcacactatatgaatgcacatatacgtgtaaatattgatgtttacaaaaattacagaaatgaatggcttccctttatttgcagcacatacaaacatgtctggcctatgaaaaggcatgtttgaaaagatgagggagctcactatcatattgctctcatccttggaaacaggtcttaattattaatatacttaaggttatattgtaaccttaatataatattgagtcaggacctgaagaggtggaaggtctttcaggtcctgactcaatattatgtgctgaaagcgtcccaggaggtacttggcgtaggttaagtataaaacctttttattttttcatttttttaatacatgatctattttatcagtttagtgctggatgtcctttcactgtgtgctcttggcatcctgggctcaatactactgtaacacttatcactctgggctttcactgcttcctgcctctagatgtagagtcccaggagatccagaccagtgtctaactggtttctgtatctatccccagtgctgcacagggcctgatataagataggagcctaacaaaggtttgttgaaagaacaaattcatgaatgattagagtggctgaaaaacacatggaaaaaaaagttaaagttgtgtggaattgtagattcctgttttgtattcctattctttccttccatcctctcattccttccttacatttcacatcttccttagaattccactttgtgctactgagggtaaaataatcctgtggttccttcctttaaaacacacttaaaagtctgagcatctgagaacagtcagatctgtgcatgtttttttccagatgtggacactattcattattatgtgctctgtaagcacgtggtaaaatgacattgaatgcatagtaggtgctcaggcaaacactaaaagtttgggttgacattgtacatgtctttaatgtgatctcagagttcatttgatctttgttgccacatctaactgattttgtttctccattttagattgtttgtgtcaagtcattcgtatttacccttcagctctagaggggtaaaattctacttgggatgttttctttcagttatgactaaaataattttaaggtggtccttcaaaatggatgttttgtgaaaaatgaaaagtaaacctgtgataagagcaaaatccaaaaccaaaacacatctgtaatgatgttgttgcacatataagtgcttgctattgttagattttttaaaaaatgttgcttaagtggtgagtataaaaggttatcctgctctccttgaaatttacatttcacacactacaaatgcagtggagcatcttttcaagtgttcattggccattcttatttcctcttctgtaaaatgcctgcttgtgttttatttttcatgtatttatgggttgtctttttcttattattgacttataatcttttatatatccttgatattaattactaattctttgtcgttacatgtgttgaaattatcttcagtcaggttttggactgtctcatcactttctttatcatgtattttgaggaaagaaatgaaaaattttaatgtagcataattaatcagtttttttattttatgctttctgcttcttccatcttgctttaaaaagtctatcctacccataggttacacagatatcatactatattttctctgatctgattcccaacagtgtaagatttgaatcctcaccaatgcatgaccattagcgtgaaggtggaaattgttagatatcccaggggtaactgctattatttgttggcttctcccacaagatattcgcctaagtaatgattttggcctctgaggatttgcttgtctttccagccagctcagcgatgcattaaaaaagatttttttttgagacagggtcttggtctgtcacccaagctgtagtgcagtggtggaatcacagctcactgcagcctcgacctcctgggctcaagcgatccttccacctcagcctacccagtagctgggactacaggcgcctgccaccacacttggctgatttttgtatttttagtagagacggagtttcactgtgtcggcccagctgcccttgaactcctgacctcaagtgatctgcacgccttggcctcccaaagtgctgggattacaggtgtgagccatcgtgcctggctgaaaaggatttaatttgatttttcccaccatgtttttgtattttgtactagaaggtttttcaggatttttagttacccatatgaccaagaaggggagctcctccatgtttttcaaacttagacgttcaatgtttagattcaaatatgatatctaatgtaggagtttttcttgtacacaagacgtgagatatggatcgggaaacataacccattaccccatccacagatggcttaaagggggaaaagatgggagtggtgttctggctctggggtcctttgtgattgtttggagaaggtgatgcagaattaaaatctttgcagaactatagtggtaataaactcagcatgttacctgtggcgtattcgtatggtctgcagcaacctcaattcttgcctcctcagaagaaagaattcaactgaaggtcataaggcagaagaagagaccgaggcaagttttagagcaggagtgaaagtttattagaaagctttagagcaggaatgaaaggaagtaaagtacacttggaagagggtcgggtgggcgacttgagagatcaagtgtatggtttgacctttggtcttggggttttatatgttgggatgcttctgggatcttgtgtttcttctcccctgattcttcccttgaggtgggctgttcacacatgcagtggcctgctagcacttgggaggggagcatgcacagtgtgtttactgaaattgtatgcatccttacttgaggcattcttcccttaccagtcaaatgtcctagaaggtcataataccagttaaactccaccacttttcctcttagtgtgcatgcatgagcccacttacccaactcctgagatcttatcaggagctgctgatcaccagtttcagatgtttctgtttattgggagatggcctttccttggcactggctgtgaccaattattatcttagagagacagtttcataactgcctgatcatcacctgttggttgcctgacattcctggtgggaaggtgtccctctcctgccctgctcatgtctgactagctaccctctgtaacaagcattgtctgtgactgcatgaatgctaacttttacatgaaacctttgaaattgtaatgtcattttttctttataacaatggccgacatttatcgagcacttactatacactaaggtaagtgctttgcatgtatgaaaaacttattcattacaataaccctgtgaaataggtgctgccattttttccactttaccaataaaagaaacagacacagattttaagtagcttgcccaaggtcacataactaccaagtggtacagctggaatttgaatccagtcaatctgtttctggagtgagaactcataaggagtatgctatatgacctctataggaaatgcttatttgttcagaaaaataagaatttttttccattccaagatggccaaataggaacggctccagtctgcagctcccagtgtgatcaacacaaaatatgggtgatttctgcatttccaactgaggtacctggttcatctcactgggacttgttggacagtgggtgcagcgcatggagggtgaactgaagcagggtggggcatcacctcacccgggaagcacaaggggtcaggggatttccctttcctagccaagggaagccgtgatagacggcacctggaaaaatgggacactcccgcccaaatactgtgcttttccaatggtcttagcaaatggcgcaccaggagattatatctcacacctggctcagcagatcccaagcccacagagccttgcctactgctaacacagcagtgtcagatcaacctgtgaagcagcagcctagcagggggagggggtccgccattgctgaggcttgagtaggtaaacaaagcagccaggaaagctcaaactgggcagagcccactgcactcagcaaggcctgctgcctctgtagtctccacctctgggggcagggcatagctgaataaaaggcagcagaaactgctgcagacttaaacgtccctgtctgacagctctgaagagagcagtggttctcccagcatggtgtttgagctcggagaacagacggactgcctcctcaagtgggtccctgacctccgtgtagcctaactgggagacacctcccagtaagggcctactgatacctcatacaggcaggtgcccctctgggacaaagcttccggaggaaggatcaggcatcaatatttgctgttctgcaatatatgctgttctgcagcctccgctggtgatacccaggcaaacagagtctggagtggacctccagcaaactccaacagacctgcagctgagggacctgagtcttagaaggaaaactaacaaacagaaaggaatagcgtcaacatcaacaaaaaggacatccacagcaaaacgccatctgtaggtcaccaacattaaagactaaaggtagataaaaccacaaagatggggagaaaccagagcagaaatgctgaaaattctaaaaaccagagagccttttctcctccaaaggattgcatctcctcgccagcaatggaacaaagctggacagagaatgactttgatgagctgacagaagtaggcttcagaaggtcggtaataacaaacttctccaagctaaaggaggatgtttgaacccatagcaaggaagctaaaaccttgaaaaaagattagacgaatggcgaactagaataaacagtgacctgacgagctgaaaaccatggcataagaactacgtgacacatgcacaagctttaatagctgattcgatcatgtggaagaaagggtattaatgattgaagatgaagttaatgaaaccaagcgagaagagaagtttagagaaaaaagagtgaaaacaaacaaagcctccaagaaatatgggactatgtgaaaagaccaaatctacgtttgactggtgtacctgaaagtgacagggagaaagaaccaagttggaaaacactcttcgggatattatccaggagaacttccccaacctagcaaggcaggccaacattcaaattcaggaaatacagagaacaccacaaagataatcctcaagaagagcaaccccaagacacatagttgtcagattcaccaaggttgacatgaaggaaaaaatgttaagagcagccagagagaaaggttgggttacccacaaagggaagcccatcagagtaatagcagatctctcggcagaaactctaccagccagaggagactgggggccaatattcaacatacttaaagaaaataattttcaagccagaatttcatatccagccaaactaagcttcataagtgaaggagaaataaaatcctttacagataagcaaatgctgagagattttgtcaccaccaggcctgccttacaagagctcttgaaggaagcactaaacatggaaaggaacaaccagtatcaaccactgcaaaaaacatgccaaattgtaaagaccatcgatgctaggaagaaactgcatcaattaatgggcaaagtaaccagctaacatcataatgacaggatcaaattcacacataactatattaatcttaaatgtaaatgggctaaatgctccaattaaaagacacagacaggcaaattggataaagagtcaagacccattggtgtgctgtattcaggagacccatctcatgtgcagagacacacataggctcaaaataaagggatggaggaatatttaccaagcaaatagaaagcaaaagaaaaaaaagcaggggttgcaatcctagtctctgataaaacagactttaaaccaacaaagatcaaaagagacaaagaaggccattacataatggtaaagggatcaattcaacaagaagagctaactatcctaaagatatatgcacccgatacaggaacacccagattcataaagcaagtccttagagacctacaaagacacttagattcccacacaataataatgggagactttaacaccccactgtcaatattagacagatcaacgagacagaaggttaacaaggatatccaggacttgaacttagctctacagcaagcagacctaatagacatctacagaactctccaccccaaatcaacagaatatacattcttcacagcaccacatcacatttattccaaaattgaccacatagttggaagtaaagcactcctcagcaaacgtaaaagaacagaaatcacaacaaactgtctctcagaccacagtgcaatcaaattagaactcaggattaagaaactcactcaaaaccgcacaactacatggaaactgaacaacttgctcctggatgaccactgggtaaataatgaaatgaaggcagaaataaagatgttctttgaaaccaatgagaacaaagacacaatgtaccagaatctctgggacacattcaaagcagtgtgtagagggaaatttatagcactaaatgcccacaagagaaagcaggaaagatctaaaatcgacagcctaacatcacaattaaaagaactagagaagcaagagcaaacacattcaaaagctagcagaagacaataaataactaagatcagagcagaactgaaggagatagagatgcaaaaaacccttcaaaaaaatcaatgaatccaggagttggttttttgaaagattgacaaaattgatagactgctagcaagactaataaagaagaaaagagagaagaatcaaatagacgcaataaaaaatgataagggggatatcaccaccgatcccacagaaatacaaactaccattagagaatactacaagcacctctacgcaaataaactagaaaatctagaagaaatggataaattcctcgacacatacaccctcccaagactaaaccaggaagaacttgaatctctgaatagaccaataacaggctctgaaattgaggcaataattagtagcctacgaacaaaaaagagtccaggaccagatggattcacagccgaattctaccagagatacaaggaggagctggtactattccttctgaaactattccaatcaatagaaaaagagggaatcctccctaactcattttatgaggccagcatcatcctgataccaaagcctggcagagacacaacaaaaaaagagaattttaggctaatatccctgatgaatatcgatgtgaaaatcctcaataaaatactggcaaaccgaatccagcagcacatcaaaaagcttgtccaccatgatcaagttggcttcatccctgggatgccagactggttcaacatatgcaaatcaataaacataatccatcacataaacaggaccaacggcaaaaaccatatgattatctcaatagatgcagaaaaggcctttgagaaaattcaacagtgcttcatgctaaaaactctcaataaactaggtattgatggaatgtatctcaaaataataagagctatttttgataaacccacagccaatgtcatactgaatgggcaaaaactggaagcatttcctttgaaaactggcacaacacaggggtgccccctctcaccactcctattcaagatagtgttggaagttctggccagggcaatcaggcaagagaaagaaataaagcgtattcagttaggaaaagaagaagccaaattgtccctgtttgcagatgacatgattgtatatttagaaaacccaattgtctcagcccaaaatctccttcagctgagaagcaacttcagcaaagtcttaggatacaaaatcaatatgcaaaaatcacaagcattcctatacactaagaacaaacaaacagagagccaaatcatgagtgaactcccattcacaattgctacaaagagaataaaatacctaggaatccaacttacaagggatgtgaagtccctcttcaaggagaactacaaaccactgctcagcaaaataaaagaggacacaaacaaatggaagaacattccaagctcatggataggaagaatcagtatcgcgaaaatggccatactgcccaaggtaatttatacattcaatgccatccccatcaagctaccaatgactttcttcacagaattggaaaaaactactttaaagttcatatggaaccaaaaaagagcctccattgcctagacaatcctaagccaaaagaacaaagctggaggcgtcatgctacctgtcttcaaactatattacaaggctacagtaaccaaaacagcatagtactggtaccaaaacagatatatagaccaatggaacagaacagaggcctcagaaataacaccagacatctacaaccatctgatctttgacaaacctgacaaaaacaagaaatggggaaaggattccctatttaataaatggtgctgggaaaactagctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaagggcttcatgactaaaacaccaaaagcaatggcaacaaaagccaaacttgacaaatgagatctaattaaactaaagagcttctgcacagcagaagaaactaccatcagagtgaacaggcagcctacagaatgggagaaaatttttgcaatctacctaactgacaaagggctaatatccagaatctacaaataacttaaacaaatttacaaggaaaaaacaaagaaccccattaaaaagtgggcaaaggatatgaacaggcacttctcaaaagaagacatttatgcagccaacagacacatgaaaaaatgctcatcatccctggccatcagagaaatgcaaatcaaaaccacaatgagataccatctcacacccattagaatggcgatcattaaaaagtcaggaaacaacagatgctggagaggatgtggagcaataggaacacttttacactgttggtgggagtgtaaactacttcaaccattgtggaagacagtgtcacaattcctcaagcatctagaactagaaataccatttgacccagcaatcccattattgggtatatacccaaaggattataaatcatgctactataaagacacatgcacacgtatgtttattgcagcactattcacaatagcaataacttgaaactaagccaaatgtccatcaatggtagactggattaagaaaatttggcacatgtacaccatggaatactatgcagccataaaaagggatgagttcatgtcctgtgcagggacatggatgaagctggaaatcatcattctgagtaaactatcacaaggacagaaaaccaaacaccgcctgttctgacccataggtgggaattgaacaatgagaacacttggacacagggcagggaacatcacaccccggggcctgtggtggggtgggtggaggggggagggatagcattaggagaaatacctaatgtaaatgacgagttaatgggtgcagcaaaccaacatggcacatgtatacctatgtaacaaacctgcagattgtgcacatgtgccctagaacttaaagtataataaaaaaagaattaaatgtgtttaagataataatccccaaatataacatattggtgctgtgatgtcattgcagtcttttttccctagcatacatttccaaaagtgtagcctacttcttatgtttttggtatttttttctttcatatctcttttttaaataattaaatccttttgaaaagataagtggaaaaaagtacattcatcgttcaaatgaacttttttcttataaataccaaatttttccttgagctttttggtaatggcttagttgggatataatacacgtataatacaatttacccatttaaattaaatgtttttagcatattcgcagaggtgtacataaccatcactgcaatcaattttagaacattttgttactccctaaagaaaccctgtatattttagctatcatttccgaagctccctgattcccctagccctaggcaatctctaatctattttctatctttctctctatgcttattctagacatttcatagaaatgaaataacacaatatttggtcttttgtgtctggcttctttcacttagcgtgtttttttcaggattcatccatgttgtaggatgtattagtccttcgtttctttttattgccaaataattttccactgtatggatatgctgcttttgtttacccattctacagttaatggatatttgagttatttccacctttggggttttatgaataatgtggctattaacatttgtgtataagtttttgtgtagtaatatgttttcatttctctttgctgtatatctagaggtagaattgctgggacatgtggtaaatctatgtgtaaccttctgaggaattgcaaaactctattccgtaggggatgaaccattttacattttataataacattttacatttacatgtatgagggttccaatttgtccacgtactaatcaacacttgttcttgtccatcttttttgttacagacatcctcttgggtgtgatgtggtatcattgtggtttccatatacattttcctaatgactaaatgatgttgagcatccttgcatgtgctcatggaccacttgtatatcttctttggagatatgtctattcaaatattttgcccattttaactcaattctttgtctttttgttattgatttataagtgttctttatattctagatacatgtcccttatcagatatacgatttgcaaatatatcctcttattctgtacgtcatcttttcactttcttagtatcttttgaagcacaaagttttaattttgatgaagcccaatttatataattttaaacatttgtacttttgatgtaatgtataaataagaaggttttgccaaatgcaaggtcacaaagatttacttctataatttaatattttgattgttttagctgctacattttggtgtttgatccacttttagttaatttttatatatatacatatatatatgacatatgtagatatcctgttatttcatcactgtttcttgagaatacttttgttttccccagtgaatttatttgttcttgtcaaaagtcatttgagagacgtatcatgatggctgaatagaaacgtttcatacttgccccctccacttagaaaaaccaaaatagcgtatagacaatcacacattttggatacattatccaagaaagaacactgaacttcaacagaagagtgacaggaaacaccaaaatcaaggaaagagaaggaagagaggcagcctgcttggccgggattggcaggcagctgggagtgacttcccaacacagggaaaggttaagtgagagacttttagtgactcacatccccacactggaagcatgcaatcctggccatggaagaggccctctatcttctcaaagcctgaaacaaacataaggagttaccaggagaccgtgagatggaactgctccagggaaggaactagcactaggacccacacctgttctgagtcttgagtggctacatcaagacactatttgcagtcttagcctttaacagactgcacagtatcctggaacccagcggtgttgggactgaggtgttattgctgctggaaactggggaatcagcctgctgataactgccaacattgctgtcagtgtacactaccctggggcacaaagataggcatgctcagagactgggagtgagctgggaatgaacttacgcagctggagctgagaagcaagtgcatgggttgcagctgccggtgctagaaagggaggaccactgggactaagctgggacatgagtgaagcatgagttgtggctgcaactgagtcatggggctcctacagctggggctgaggcacaagctaaaaatgggctaccactatgttgctcaggttagtcccagtcatcagggttcaagtgatcctcctgccttggcctcccaaagcactagcattacaggcatgagccagcatgcccaagcagtatgctaccactgctagagctggggagtgtgccccactgggatcggagtgtgagagttacatgtgctcaccacccaccagcttggactgtggccaccaacagccccaccctctccagtgacagggccttagcatggctgctaccaccctttccccaaacactgcccaaaacctgaagatcacccagatcctacctaccacaagcagtgcctgctctcaccattggagacctgagcatgagcctgcccacaccccctgagacagagcacatagcctggaatcatgagggatgaacaacccaattcaccactttgggcacctgaacattcctcctaggggctggatgtacgacctaaactcctggctactaccacctcagctgacacctacctgcaaatgctacctgcaggcctggagactggcttggccagcacattgcagccaccacctacatcagtgcataccgcttgggcatgctggctcatgcctgtaatgctagtgctttgggaggccaaggcaggaggatcacttgaaccctgatgactgggactaacctgagcaacatagtgagaccctatctcttaaaaaataaaataaaataagccaagcatggtggcacatgcctgtagttctatctgggtaacagagcaagaacctgtcaaaaaaaaaaaaaaaagaattcaaaatattgattttaaagaagctcagtgagatacaggagaattctgaaaaataatacaaagaagtcagaaaaacaatcagggtatgaatgagaagtttaccaaagagatggatattttaaaagagaaccgaatagaaattctagaactcaagaattacttgaaagaaatacaaaatacgtttgaaagcatcaataatacactagatcaggcagaagaaagaatcatggaacatgaagacaggtcttttgaaataacccagatagagaaaataaagagattaggataaaaaaagagcaagcaattttttgggacatttgggacaaaataaagctactgaacatatgaattatcagtatccctgagggcaaagagaaaatgaagagattagaaaatctatttaaagaaataatagatgaaaactttccaaccctagcaagagattttaggtgttcagatgcaggagtctcaatgatccccaggaagatataatgcaaaaggtcttcttaagggcacattatattctgactttcttaagtcaaagataaggagtgaattctaaccacagcaaaagaaaagtgtctagtcacctgtaaaagaaactgcatcagactaacagcagatttctcagcagaaacttcagaggccaatagagaatgggatgatacatgtaaagtgctgaaagaaaaaaaataccagccaagaatactatatccaataaactatcctttataaatgaaggagaaataaagtattttttaaacaagcaaatgctgaggaaattcactttagggccaccagactggccctaaaagaaatgctcaagggagtcctaaacctggacacacatttactggacatacatttactaccataattgaactcataagcatagagagtagaaggatggttaccagaggctgggaagggcatggggtgttgggggagaggtggggatggttaatgtgtacaaaaaaaaaaaagaatgaatgaataagacctactatttgatagcacaatagagtgactatagtcaataataacttaattgtatatttttaaataacttaaagaatgtaattggattatttgtaataataaggataaatgcttgaggggatacatactcctttctccataatgtgcttatttcacattgtatgcctgtatcaaaatatctcatgtgccttgtgtgtgtgtgtatgtgtgtgtgtatatatatgtatatatataatatacatatatatatggtttgtgtgtgtgtgtatatatatatatatatatatatatatatacacacacacctaccatgtacccataaaaatcaaaaggaaaggattataatatccttataaaaaacacatgaaaacacataactcactgataaagcaaacacacaaaggagaaagggacacagatactaatctgaggagcagagcaggatggcagaatagaaggccccaccaatcataccccctgcaggaacaccaaattcaacaactatctacataataaaagcacctcataagaaccaaaaatcaggtgagcattcataataccaggttgaaacttcatatcactgaaagaggcactgaagagggtaggaaagacagtttgaattgccaatgccatccctcccccactaccctgcagtagccacatctctgcagcatggagaaatctgtacacttgggagagggagatcacagaaactgtgggactttgcattgaactcagtgctgccctagtcacagtggaaagcaaaactgggctgaactcagctgatgcccactcacaaagtgagcattcaggccagcttcagccagaggggaataacccatatcagcagtaggaacttgagttccagcaagctcgctgccatggggtgaagtgctctgggaccctcaataaccttgaaaggcagtctaggccacaaggactgcaaatcctagtgtggagttgggttcagagccagtggacttggggaacatgtgactttactgagacaccagccagggaagctaagggagtgcttgtgccacctctctcacaacccaggcaacacagcttgcagctccaaaagagacctcttccttccacttgaggaaaggagagggaagagtaaagatgacttttgtcttatatcttgggtaacaactcagccacagaaggataaaccaccaagcagagtcatgaggcccccattccaggctctagctcccatacggcatttctagacacaccttggaccacaagggaacctactgccttgaaggggaaaagcctatccaggtaggatccatcacttgctgactaaagagaccttgggccctgaataaccagctgtgatacccaggtagtatgccatgggccttgggtgaaactctgagatgtgatggcttcaagtgagacccaacacatttttcagctgtgatggctatggggagagactactgcttgagaaaagcagagggaaaagtaaaggggactttactgtcttccactttaggtactagctcagccacagtgggatagagcaccaagagggctcatgcggtccctgattccaggccttgcctctgggagggcatttctggacatgccctgggccagagggaaacctgttgccctggagggtgattcccaggcatggcaacattcaccacaagctgattaaagatcccttgggccttaagtgaatggaaggacagaagcctgtatggcttcaccttaccagtaaagaaacacatagactcaatgtaaaggaatggacaaaatatattccatgtaaatggaaaccaaaggtgaccaggaatagctgtacatatatcagataaagcagattttacatcaaaaatggttttttttttttgttttttgttttaaaaaggctgggcgcggtggctcaatgcctgtaatcctagcaccttgggaggccgaggcaggcagattacttgaggtcaggagttcgagaccaccctggccaatatggcaaaaccctgtctactaaaaatgcaaaaattagctgagcatgggggcttgtgcctgtagtcccagctacttgggaggctaaggccggagaattgcttgaacctgggaggcagaggttgcagtgagccgaaatcgcaccactgcactccagcctgggtgacagagagagactctgcctcaaaaaacaaaaacaaaaaacaaaacacaaacaaaaaaaagccaccccaaaaaacaaacagtaaaaaaacaaaacaaaacaaaaactggagaaagagaaaggaggtcattatatataattaattggtcaatccagcaagtggatataacaattctaaatatatatttacccaacactaaagcacccaggaccataaagccaatattactagatctaaagagagatatagactgcaatacaataatagtggggcattcaacaccccactctcagcattagacagatcacctagccagaaaatcaacaaagaaacattcgatttaaactgtaaattagtgggagctaaatgataagaacttatgaacgcaaagaaggaaacaacagacattggggtcagcttgagtgggaggatgggaagaggaagaggagccaaaaaaaaaaaaaaaacaaagcaaactattggctattgggcttaaaacctgggtgattaaataatatgtacaacaaacccctgcaacacgtgtttatctatgtaacaaaccttcacatgtacctccaaacctagaataaaagttaaaaaataatgaaaaagtctgtacattagactgaatggacctaacagacacttacagaagattctattccttaactgcaggatatatattcttttcatctacacatggaacattcttcaggatagaccacattttatgccacaaaacaagtatttaacaagtatttaaagggaattcttatatactgcgggtagaaatgtaaactagtacagtcactgtggaaaataccatggagatttctcaaaaaattaaaaatacaattaccatttcatccagcaatcctgctactgggtatctacccaaatgaaaagaaatcagtatatgaataagggatacttgcactcacatgtttattgcagcattattcacgatagaaaaatatggaatcaacctaagtgtccatcaacggatgaatggataaagaaaatgtggcatatatacacaatggaataatatttggtcataaaaaatgaaatcatgtcatttgcagcaacatggatgaaactgtaggtcattattttaagtgaaataaaccaggtttaaaggtaaatattgcatgttgttacttaaatgtgagagctaaaaaattcatcacatggcagtagaccatgaaaagacagataacagagactgaaagggtgaatttggagaagggggagggtgaagagaagtgggtaaaagggtacatacaattagaaggaataaattcagtgtttcatagtagagtagggtgactatagttaacagaaatgtattgtacctgggtacccaagcacttgggtacttgggacaccttaaataccattttgatccctacacattatatacatgtaacaaaattttacatgtaccccattaatttgtacaaaaaaatcaactgaccctcaatatatgggctacttttttggactctccattccattccattgatctttatgtctatccttatgtcagtaccacactgtcttttttattgtagctttgtactaagctttgaaatcgggaactgtgagttctctaactttgtccttttgtttcgagactgttttggttaatttggctcccttgtatttccatatgagttttaggttccacctgttaatttctgtaagaaaaaagcgagctaaaatctttataggggttcttttcaatctgtatatcaatttagggagtattgctacttcaatagtattatattccaagatatgaacatggattggctttcaatttctcagatatttaatttctttcaataatattttatagttttaagagtatgttttccatttatgctttgtacaatagaaataaaattgattcttctatcttgaccttgtatcctgcacccttgctgaatttgttagttgtaacagcttttgtgtgtctgtctgtctgtctgtgtgtaaattccttagtgttttttatgtacaagatcacatcatttataaatagagatagttttactttttcctttggggaagtgactatgagcagtgggttccccaagactatcccaggtaagatggtttatgaggtggactcacatgactcgaacatagttgaactcatggctaatattattacaacaaatatatttatatacatatgtgtcatatatatgtcggttataaaaagactggaatttattttttgaattttctttttctttttttatagttgtatgtgcttggctctaaggtacttaatatagggttttggacagaaaaatgaaaaacaatcaaatgtgatgatggcattcagatctaagatacctccagatttcagaaatgttaacatttgaatagaatagtacttagcatcttagaatagtattcaggacaagttttgtttggagttttataactgataagagagagccttcctcctacttttcctttctccttctccttcccacacattttgttgtatacgtgcttgtacaaaacctgagtcatagggaatcttcagtgaattgcctgaggttatatcaaaagttggtagctaattcactgtagaagccaccagttcttatatccctgccattctgttgtaggcgttgactgcctggacaacatctttgtgttaagtcagtgatgctgaatcagaggctttcaagaagcctgttttcctcctctgtcagcatgcaagatcctacactttctgcttctggtcttgctttctagctttaactagatcatcctatctctatactcaaaccatatcagtccctataaagtccctgattctttcacctactcctatattgatgccttgtttctttcacttgggatgacattctctgttcccctgtccatgtatttgaatcctaatcaattttgaaggctcagcttacatgtctcattatctattaaaccttcccttttctctcatcctcaatttagatgtaatcatttctcctctctccatgctttatattgcatatttctattctagcatgtactataccctgccttatattatggccagtagtttgtatatatttccatcttctcttaatttttatgctttgtgaggtgaggaactctgtttatattcccatgggccacagcacctagcagagaggagcaaatgagaatccagtggatatttgctgaattgaattacacaatggattggaaggcggctccagtaggtgttagcaggaaaaggatttaatatgaatcttggttttattctgttagcacagaattatgaatgccttttatattgtacctttactgcagaacaaagcactgcatagattgttttactgtagtccaatgggaattcattttgtgatggtttcagaattacccttttatttgtttcaccttttaaagcataacatttgtcaagacaacatttcagtttattgcatgtgctaagtcattactatttacagatggtatagagtatcgatgttcagattgaaaggaaaaaaatacacacatagaatcccatctgccttgcacaggatttaggactcaaacaaaacctaattttatctgtcctgcacatcagaagtagggaactttcaaagaaatcattgctaaaagtaagcatcattgttgagaatttcaggctgtaaaaataatggagtttctttcaaaagattgtttataaacattcttgatatagtttgggatgaaacccatcctggaagaaaatgggaggttatggagtcatatctagttagtaatttgcattagagctatttgggtataaccttctgagtacagattttagatgacctatctgaaggttagggaactagatagatgacatggtaaaagctttgctgaatctcctactagattctactttgcatctgaacagtgcctggcacctggcatttgttcagtatgagtctttcaaatgaataagagaagtttgaatgaatggtatgtatgaatggtatgaatgaatgaagtatgaaaggtagcctccctgaggctgttaacttatctgcaagataagtgttttaatatcaaccctggaggattgttgttaggaccagagaaactgcatataaagtgccttgtgtagtgcctggttgatactagttgctcagcaaatggtagcgattgttcatttactacactttctcagtctgttttcatattggtggtggcaatgagtttattgccatggaagagactatctttctggctgacatttccctttctatttttatttgtttgtgctctgtttttacctcttatttatttttaggaaaccatgtgagagtagaggcatttcctcttttaagtagtttatttgctatggctccgtagtgcttggatgacatggcacgtgtgtgcagcctggttcagaactcatatttttctattgtatatgaatagaaaccccagagaggttggataaatggacatgagagagcgtcgctgtgaaataaagttcaagtgttggaattattgctgttacactctgggatctgaagtaaaaaaatgttttctataaaatgggaaagcttatagataccaatttacttaatttttaagctatcattagccccatagaataactaataaacttagtatagtttaaattcctggaatggtgatatgtactcaaatcatgaaggcaaagactctcagagaaatagttttttttttaatttttaaattttttatttttttttttagacgaagtcttgctctgtcaccaggctggagtgcagtggcacgatctcacctcactgcaacctccgcctcccaggtttaagcaattctcctgccgggcctcccgagtagctgggactacaggcacgtgccaccacgcccagctaatttttgtatttttagcagcgacagggtttcaccatgttggccaggatagtctccatctcttgacctcgtgatccgcctgcctcggcctcccaaagtgctgggattacaggcgtgagccaccgcacccagccagaagtagttcttaaaagatcatttgaccgggcctggtggttcacatctgtaatcccaacactttgggaggtcaaggtgggaggatcacttgatcccagagttcgagaccagcctggacaacacagggagacacccccaccccgtctctacaaaaaatagaaaaattagctgggcatagtggtgtgcgcctgtagtcccagttacttgggaggctgaggttggagcatgggttgagcccaggagatgggaggttgcaatgagccaagattacaccactgcactccagcctgggcaacagagtgagaccttgtctcaaaaaaaaaaaaaaaaaaaaaaaaacacatctttttttagcagaggcttcactctgacagggtaggcttaaagaattttgaccctctatttgtaactactcataatgtatcttaaatttcaagtttcttgaactgttaccaaagaaagtttccttgttaataactgcttgtcaggaaatttttattttatatttgtgaacttaatttctgtgttgtcacataatgagacaataggatgttacatagattttctataatctttctggagcatttaacaacgtatctccatacactgatttccatgctgaaaataatttcacaaggaaatcattcattatggggaaaaaaaaaacccacattgcttaatccaatttaatttactgaaggaacaatattcacttaagtccccaatctcttccttcttatagaggactcttggacattgaagatgaacttttacatattcttaaggtaaaaaatataaacaaatcccaaaacaaatgaatatgactcagaattctattaatttcaaatttggaacataaaaactaagttcctcctgcctcccttactgacccctcccaaattcatgagtatatagattttttttgctttcttttcctagaatcacttactgttgctgagaatataccattaaatcttattctaaaagataatctattccagtcaactatatgcttgattttcctctcttttctttaccacagagcagcttggcctttgtttgaatgctattaatgataggaaagggattgtctatcttccatgaaagtcatttcatctacagacagttctgactttagaacaaagtgcttcttcatatggagtctttctagctctctctcttgctttctgtttgtcttctgtctctctctgagggtaaaaaccaaccaatgaacaaccaaccgaccaataaactgactgagcaaacctgatcaataggtttgagaaatactgcatacatagcccatacccaaggagtcacaatgtgtacatgtgtatttactaggaaatattgcagtgtgtttaacccctaatatttcacaaacttacttgattgtgaacttttactttttttcagaacatctgtccaaacacagcttagagcagaatctggcatatagtagacactcaataaatatttgtttaaaaagtgaatgaatgcaaaataaatctttaaaaactttaaagcacatgctgtattgagatgatccatgttctgcatttttacaagtgacacagccagactagagctactgattggatgcgtataccttccttctctatgtgagcctttctaaatcaattatttatttccacacattttagaactttaaaaattcatatttggatttctaagtttgtatcctcattggcacaactaccttttaaataataaaataaatattagtgatgtgtttgcttgactcttttgctttttgatcatatgtaggaatgaattaattggaaatgcttattttgacttttgatttcaatttgtatctgattgtgtttgattgtacaagcacatggattttcagcagaagtcttaaaatgaagatttgctccagtagggtgtttttaagggtgtttatcagattacctgttgagttacagccctttatttggcttctaagtcagctcctttttgggcttagcaacgagtccaatgtaaggagaatgaatcctttttatctgtgagtagttgagttttctacatgagacagcttgacaaccttcctatcaaacgtaaatctagtcaacaaggaacatgctgtaatgtggacttgatccaggtttggtgatctaggctttttatttctcatgctctaagtgaatgcatttaaaaggtcagcaataggaacagtataaattatttgttctcacttttatatttcaggaaaaaatccgtgtggaaattcgagagggtcagctacaaagctgggtgtaactcagtgtcacaactttatctaaagtcagtattttctgtttctctttgttctcagcaacaatcttacctcgtcccttgcagctgctcaattgataactgtgtgtcttctgttgtctttcctgtgttatcttcttccccttcagtctgtttccaacccagaacttgatcatttattaaagtagtaatattttctcttgtaaccgtgatttcatcctttctctttagtgtggaaatgttattttattggcacagttgtgggctacattttatgatagaaaacatcagtctgtttttacatctatggattttacatgttgttggatctcatagaatgtagggtaccttaaaaagcatttactggccgggtgcggtggctcacgcctgtaatcccagcactttgggaggccgaggcgggcggatcacgaggtcaggagatcgagaccatcctggctaacacggtgaaaccccgtctctactaaaaaacacaaaaaattagccaggtatggtggcaggcacctgtagtcccagctactcgggaggctgaggcaggagaatggtgtcaacccgggaggcagagcttgcagtgagccgagatcgcgccactgcacttcagcctgggtgacagagcgagactccgtctcaaaacaaaaacaaaaacaaaacaaacaaacaaaaaaaaacagcatttactgtattgccctcatttctaaagtgggagtaatgaccacagctaatattgtactgaatgtggaaaaattgaaggccttttgtccaagaactggagcaagacaaggatgcccacttttgccacttttattcagcacaacactggaagtcctggccagagaaactaggcaagagaaagaaataaggggcatccatactggaaagaaagaagccttattagttttgtttgtagatgacatgatcttgtacccggaaaaacctaaagactccatcaaaaaactgttagaactctatgagaacacttggacacaggaaggggaacatcacacacaggggtctgctgtgcggtggagggaagggggagtggggagggataacattaggagaaatacctaatgtaaataacgagttaatgggtgcagcacaccaacatggcacatgtatacatatgtaacaaacctgcacgttgtgcgcttgtaccctagaacttaaagtataataataataataaaaaactcttagaactgataaacaaattcagtaaaggtgcagaatacgaaatcaacgtacaaaagtcagtagcatttatatacaccaacagcaaacaatctgtaaaagaaatcaagaaagcaatctgatcacatttacaatagctacaaaaatataaaatacctaggaatcaatctaaccaaaaagtgaaagactataaaatttgatgaaagaaatagaagaggacacacaaaattggaaagatatttcatgatcatggattggaagaattaatattgttaaaatgacaattctacccacagaaatttacagattcgatgcaatctctatcaaattccagggcatgcttcagataaatagtaaaaaattctaataacgtatacagaaccacaaaagacctgaaatggccaaagcagtcctaaccaaaaagaacaaagctgcaggcattgtactaggtaacttcaaaacttgctacaaagctgtattgaccataacagcatgatactggcataaaacagacacatagaccaatggaacagaatagagaacccagatgtaaatccatacatttacagccaagtcatattcgacaaaagtgataagaatctacaatggggaaaggaaatattttcaataaatgatgctggaaaaactggataactgtatgtggaagaatgaaactagatccctatctctcaccatacacaaaaatcaaatcaaaatggattaaagaacttaaattgaagacctgaaactatgaaactactagatgaaaatgttggggaaactttccagaacattggtctgggcagagttttttgtgcaaaacctcaaaagcataggcaaccacagcaaaaatagacaaatgggatcacatcaagctaaaaagcttctgcatagcaaaggaaacaatcaacaaagtgaggagacaattcacagaatgaaagaaaatattcgcaaactatccatttgacaagggattagtaaccagaaaatataaggagctcaaacaactcaatagcaaaggacccaaataattcaatttataaaatgggcaaaagatctgaatagacatttctcaaaagaagacataacaatgaccaacaggtatatgaaaaaatgttcaacatcactaatcatcagaaaaatggaaatcaaaactacaatgacatatctcaccccagttaaaatggcttgtatcaaaaagacaggcaataacagatgctggtgagggtgtggggaaaggggaattcttgcacactgttggtgggaaagtaaactagtacagccactatgaagaacagtatggaggttttgcaaaaaacgaaaaatagaactaccatagaatccaacaattccactctgggtacatattcaaaagaaagaaagtcaatatattgaagagatatttacactcccatgtttattgcagcactatttacaatagccaaaatatggactcaatctaagtgccattcaacagatgaatggataaagaaaatatggtatatatacaccatggaatgttattcatacataaaacagaatgaaatcctcttatttgcagccaaatgaatggaaatggtggcaattatgttaaatgaagtaagccaaacacagaaacacaaatactgcttgttctcactaatatgtgagagctaaaaaaatggatctcatgaagatagagagtagattggtggttaccagaggctgggaagggtagaggggaggggatgaaggggaaaaaagaatgtaaatatatttattaccactgaactgtacacttaaaatggtaaattttgtatgcatattttaccttgataagaaatataaaataaaatggaggtaatgaggtgaggagtggggagtgacttgttgaaaattacagagcagctaagtggtcaagcccacactaggccctggtgctcccactcccagcccacagacttttattttgggtcctgaggcctctctcattacatgagtgcttaaattgtagagtaagtggacatagtttccatagctatgcaagagtctgagtggtatcagagaatcaagttgttcatattaatacttccagatctgccacctgacataaaatgcatcaattcgtctttgtacttgttcctactgatcaaagcaagggagaaatttgggtctcctattatgtaggaatatttttatgtctgatgctttctcatttaaaaagtagaacacattttaactattgccacttttgcaggctcctcaggggagaaagtgttcttgtatcttttgcattaccctcattctcacccttcttccatggctccatgcctgaaaatgtcaatatgtgacacatgtttgtagctgttataaacacattcttttatctgattaaacatctagcatggaaagaataactgcgagtgtaaatgtgcatgccttgatctgaaatatatcgagtctaaatatataaaattacaagacatttttaagaaatgactttatgtattgacaaattagatatttgtaatggcatgtatcttatgaaaataaacatcaattaaaattgctttatgtttctaatcatgtgtcgggggggtgtctataacagataacctattccactgtctattgtggaaccattgagaacttttttttttaattcccttgaggattgtcctttataaaccacatccatgtggtgtgatttgaggagcactgagaagggtaatgcatcatcagcctgacaccaccagagaccaggactttgaaggcactttgtgtcagagagcaggtgaaaaacatggcttcagtaagagatgtgaaaccacaggcattaaaaccgacaagccaaaatagcctagtttgatgacccgttttcttttaaaaagttttccttgttcatggaccagaggcaggtagtgtactttgatttttggcccctatagagttcactagaattgaacattgtaagttaacacttaagatctgggacaatcaaagcacattgaacaatgcatggacattgttccatctgtaatgataaaaaatgagttaatatgctactttttattgaacacttaccattatgccaggtatttcacatttagtttgcatggtaccttgtgaggtagatatcattatgcccagtttatagctgaggaaactaaggtttagagaggctaactaacttgcccgcgtttgcatggccagtaaatgcaacaagctggatttgaatccacgtctatctagactaagaagcctatatggttaaccacttgtaaaatgggataacagtacctaccttagagattttttaaggattcaataagattaaaaaatccaaaaagcactttgtaattgctaataaagctttgtagagtgaaaggcattatcagaagtagaagacaatctgctacagtgtctccccatgaccatctacccttcaaataaatccgaatgtcctggagtttgtgcctttgtccttggctttctggtgagtgagagtagtttatgttttgggcatagattctgagaagtaggtcactggttctacttattcagtgatattttcgagtgtgatttctttgccatgtagttgagaggaggaaagagatcgacagtgtctgtggacacagacctgtggggctcccagaataattttagacacagtgagaaatcatgtgtctaaaatcatgtaaggctgtaccttaacatgtatgtcatttcttctattttcgtttgtcatagaaaccgatctgctcctccgtataaaggacatcagtcatttcttaatgcaagacatcgccttcttgtctggtaagcaaactttcttatatatagtccagatagatatatgacttgattagcagttagtttggtacctattatataaatagctcgctctctatatatagagctattatatatattcatttgagaagcactatttcaataaacatttgtacattgtgcacctagttgctaaacaaatggacatttagagaataattggaggttttaagcattttagatatatgagtaaaaccgaccttaccactcttatacatttgactttcagacgagtcttcagaaatctatgatagttgaaagtagaatatgtctcctaggtggttgcaggctgggtgggaggggagcagctgaggtagcttctttgattactcaaatgtgtattacaaatggtggcaagttgcactaaataatcagcatgcactaagtatttttttttaggatttcatttacacattataaagaaagttgatttttctcaaagatgtatatacacttgtatataatttttagtaattatggtaaaataaatttaacatacaacttatcattttaaccattttgaagagtacagttcagcggcattaagtacgtttacatttttgtgccaccattgccaccaccatctccggagtttcaggtcttgcaaaattgaaactctatatccattaaacaattactccccgtttcattccttcctctctctagcccctgtcaaccgcaattttactttctttctctatgaatttgactatcttaggtacctgatgtaaatgaatcataaggtatgtgtctttttgtgactggcttatttcacttagcataaggtcttcaagtttcatcgatgttgtagcatgtgtcagaacttcctttttaaggctgaataataatccattttatgtatattccacactttgtttatctgttcatccattgatagatactttggttgcttctaccgtttggctattgtgaataatgccgctaaatagcattacccatttttagagacgtaactatggtaaaccatcctgcccctttagcttctggtcagactttggggaaagttttgcttaaaaacaagcaaattactttcaggtattagagtaatttgaattatatcattaaatattacatttagcatattaaacagataaagaaaacttactggtatatattaatacattgtttttataaagacgaatgcttcttaggagtacaagaaactatcttattccttctaaatagtttaattaattctctgaaaaatggcactcacatgctcagtttactaaacaagcttttactttataagtgatcctaattagacacttcaatctggcctctgcttttattatcattattattatttttaaagacaacttcttgctcttttgtccaggctccagtacagtggtacgatcatagctcaatgtaaccttaaactccttggttcaagtgatccttccacctcagcctcctgagtcactggaactataggagtgtgccaccacgcctagctaatttttatatttttgtagcaaaagggttttgctatgttgcctaggctggtcttgaactcctggcctcaagcgatcctcctatcctggcttctcaaagtgctgtgattacaggcatgagccgtcgcacccagcctggcctctgcttttaaatgattataattatacctatgataaagcttaattaaaaatgattctaattagtggtaactgtgaattaatgatgacttaattaatatggctttatgttttattttataagtggcagaaatgtgtgagtgtcagtaaatttagcagtatgttacgttcacttttaagttttggagattttacttaagattatctgtgttttccaaaccgtgttctaaatagaaccatcctcagggcttgctgcacccatccagacccctctctacacctttccttccttaactgctttttgtatttgttttaaaaatgcttctacctatagcttcctttgaagaaagggttcccaatggtaaaaaataattaaaacttcctgatttggaatgtaaatatctcttttgatctcttctcataaagtttactcgtaggacagtacttgtaggtgttcagtggtaataatcatttatagattagtcaatgataatttactcttataggagccttgccacctttcctttgataagtgtagtttgcctaagtgctagatggttctgtccttaactagagtgctcaccagcttgcttggcaagtatgtagttatatttaagatatttattacattatatattacatatcatttatattactagttctataccatactgtatctatagaggccctttgcttaaagattcactaaatctcttggttcagaattgtacagtttctcctttgagttttttaaaaactcttcagtggatgccattattctcagtgattattttcactctactctaattctggaatatcatacagtgaagattaataaccctttgatttaatactttggactagtttgattaaaaaataatttgggaatgaatactgtctctcaagtttcccttggtaaatattgaggcaaataattaatttgatctttttccatgtgcactagagaagaaagtgtattctgcttttgttggatggagtgttctagaaatgtcaattaggtcatgttggttgagactgttgttcaggtatacaatatccttgcaaattctttgtctacttgttctatcaattattgagagatgggtggtgaaatatctgactaaaattgtgaatttgtctatttcctcttgccactctatcagtttttgctttgtgtattttgaagctctgttattaggtgcataagcatttaagattatgtcccattgatgaatcgaccactttatcatgatcaaatgatcattttaatatctggtaatattttcgactctgaaatctactttgtcaaatattagacagctttgttttgattagcactgtcatggtatatctttttctatcctttgcttttaataatttgtacttttatatttaaaatgtgtgtttcttgtgggcagcatataattcagtctttctttttatccagtttgatgatctttgacttttaattgcagtgcctagatcattgacattttatgtgattattcatatggatggatttaaatctaccatcttactatcatataataagcaaaatacaaatagtgagatggtagcttttcccatttgtcccatgtgttctttgttttcctccatttctgtcttcttttgcgttgagtattgttgtgattccattttatatccttttctttttctttctttttggggggggcgtggagagacggggtcttgctctgttgtccaggctggagtgtagtggcatgatcttggctcaccgcaacctttgcctcccaggttcaagcgattctcctgcctcaacctccggagtagctgggattacaggcgtgcaccaccacacccggctaatttttgtatttttggtagagacagggtttcaacatgttggccaggctggtcttgtactcctgacctcaagtgatcctctggcttcggcctcccaaagtgctggggttacaggcatgaaccactgtgcccggcctgtatccttttctattgtcatatttttattgcagattgaattaaaaatatttttacatctttattcacttaaattcagccaaataaaaattacaactgaactaaaaaaatttctattgctgagctaatttcaaaggccaccttgcaactttcctcctaaaataattcttcagattctatttggcacttagtatttattgagcattcgctctctgtgtaggtgctaggctggctgcagatgtgaaccttaaacacatgtaaggctcatctctgcacttaagtggctttcgttttcaatatttctcatccttcaggctgcatagagggctattgggctgggtggagaaacgggtagaaaccaaaatgaaagcccagagctggtgcaatcattccctcaccaagaacccctatgacagttaccattattcctggttcctatggaaatgggcttagggcagcctcacctatgagcactgggatccatgctttccaggagtcaaggtcacccacttggtcaagatactgctggatgcaactgctccaggttaatggctgcatgggtctgcggggagcttccacaaccctacacctctgcctggacccctacccaggctgaacattgaattttgacccacagataatttgtgatctttctttgcattaataaaattcctatgtcattcctgccatcattccttttgttgtttcttccataaacacattagaccatcacctatttcctatagggtgctctgtatcttttcctgctcaccatgacactaagagatcgattatatcaaattttccacttgctgtcaagccatcattcactcattttaaatttaggctcattggtatagaaacagttatttcccaaccccttggttgtccagattggggaatcagctattttccactgtatttattatatgcatttcatgacattttcttctgactatattcattcattttactctctttctttttctttttttattgagaaactactctgccaccttttaaacttaaagtgtcaggaacttggagccattttggttttatgtggagatcatcatctttgcaaaaaagttgtgttgctgcaaaacagtattcaaatctaaaatcctcttcttgcttcgttgttatatacatttttaattcagttgattatttttctattgttgtaggtggccggggaaaggacaatgcttggatcattacgtttccagaaaactgtaattttagatgtataccagaggaagtaatagcaaaagtacttacttacctgacatctattgcaaggtatagtatttcattacatttttttcaattcgctttatatcagatatccatctgaatgtcataacatgaaaatggcttaatatagctattattatcatggtgaataaccaactgacttaacttcagagtagataagaagtacaacttagaaggagaagctggcagctacctaaattgttacaaaaattatcctgagaatctatgaaaataaaattggggatctaggagtatttgttcccatcaaaaagaacataggttgagaacgatggtcatacatatatgctttaatttgcttaaaaggaaatattaccagccaagagtgagtacagccatttttcatttcttctgaatataacacaagaagactgaatcttaagtagattcaatagtggtactgggagatactaggaggaatgtcttgaaattaaaaattatttggaactagaatgctttaaaatggaaagtttaaaaaggtttcttagagattttatgtgtgttaaagacaaaattttcaaaggaagaattttctagttactaaccctgaagaacaagaggacacaaatctaggatgataaaattcaaagtctcatgaacaaaaatcaaatctcagaaaatgaaacttacaatgtacctattgaagcttgaaagtgatatttttagggcaaatagaagttatattttccattaaactgcatttcctcaggagcagactagagttagaaaaatagatttagcagtgtgattttgaatgagtgaatggatcattgactcatgatggattgcatggaaagttaaatctgatatcatgaaggacacttatcttttgagttttcccacacccaagattacagtattctaaatcaattttagtgacctatcttcattacactatcactttcctatttaaaagattgacattaatgctgcaaaagaaattttaaatagtgagtaagggaatatgtattcagattagttttctaagataggactttgtgatagctttccaattccaaatctgtcttcagtcaagacatcaaatgtagatgaaataatcagaaatagaatgaaggcatatataacaaatttgcattattattaagaaaaagttcttatttcttcttatcgttcaggcaaaatggatcagactcccggtttaccattattctggatcgaagattggatacatggtcttctctcaaaatctctctccaaaaaatctcggtaagtatctatgcattatacagtaactttttatttttgttttatattatactttctgttttgggaggtatagattactttggtactgacggagacaataaaaattgatggaatgtgaggagggaaagtagaaggagaggttgtagcagagactgagataaataactctacccaaaataaaacctagtaagaatgagtgagtagtttgtggctccagttatgagtgagaagagattcatggttctatgtgcctttcaggacaaggcaagtttttatggaagctttttaaaattatttatttatttatttattttggtggaaatagctgtgttgcatactcgtatgtgaaaaagtataaagaagaaagtttaaaacaatagtaatccaaccaccccaaaataagcagtttttaacatttcagtgtacaactttctagatttgttttaccctaggatagggtagggagatgagtcacatataaaatgatatataacttccctactggtatctagtccccaggttcccaagacccagagagagaaacattttctctaattaaaataacgagaggtacaattctgcccatgaccaagataatcttttacacttttaggctcacaagggtatcacaaaattgtttgacacttcactttcatagacgaggagggagatgagggacccccagactccttctgagctggcaagatatgggctctctgtggaagtgccatgtggccaacttcctctatcagactagaatagctgggaatcaatatattttttttctttgagattccaacattgccagccatctgaaattcttactttgtctcctgactgattgaggaggtcacgcccaccacaagaacttgatttagttgcaaaggcaaaacaaaaatctaggttgttggacttccaagccaatgttctagcacttgcaaggtaaaatgggtaagatcattattcttttaatactcagaatgaattattcctcactttggacaaataagcaaaaagtggtttcctgtttatttaacagaggtgtttaatcattagcagtggagagaagagttaacattagatatactcaaattactaaaataaaatagaagaaaatttgactttctatagcatattagtgctttttcaaaagcattcacatttattaagtattgttgattctcttcatttcctgattaagtactgcaagtaggtatcactataattgtcttatagatgatgaaatcacattgatatttatactttggaatggctatgtgatgaatccaagctcaaatagccaagtaaccaaaaaagccagagcaagaattgaaatgtcaagaattccagttggtgatggtttctatcattttccaattggcttacaaatagacaaatacattcaatgttatttagataaaggtaaaatttcttttgagagattagatctgtcctccatatacaattgagccttatcagtggggctaaataaagtaaaagctatttcccttgctccggtcttttaggattggtccttgggcttgctgagtagaccttggtttatgctaataattgcttctcttatactaaataaagcacttgttacattagaacattttttatcacccaggtttttttcttttggccaacactgcacccgcctgattaaattaattttcattttgtgactggtttggcacctgacgttagtttttttggtagagttttatttttattattcaaaataggtggcttgtaacagaggttctatttttcataaaagagaaatataagattaggtcatgatcctgtcattttgaagtcaacagagggtaattacttgtctaccggggagtgatactcctctttctgtattcccagggctgctttctcagtggagaattttgacctatgctcagtaaagaacttggatcccagggtccctttattttcataactgccaaattgatcgtgctgggcaagggaggggtacagattctgaccacatgtaactggctataggttgttttaggtgtttcttttttaacatgttaaatgtttttgcttgtggtatagtttctatactcatactcaagagcacattaattacatctcaaccattagtaactgttggttactgtttgaaataaaggtaaatattgaatgcaagctaatttcaagtgcaaaagttggcattcagaaaggatttctagtgaaatctaccattgtgtagctaggtataattgcctgtggtgtattatttcaaacaagtgtctgtgaaataatcatacaattcaatttgaatacctttatttgtagatttcaaaacaaataaaagcatttaggttgtatttcataattaatgagaggagactttattttagttatacattttggggaaaggttaatttgggagagaattgtatccgtcttagaaagtttgcatgttctattctttctagattattaccaggacaaaattttgcaaactatagcctttcacaaggcttaaacccagaatacaataacagagaaaacaaaacagaattgaaatttaagtcacataccagggtaggacgagagtaaaaagcatgagttaatactaccttcacaaagattcttagcattccaccttaaaaatcaaactgcgcagaggagaaagccagtcccatcaagcctgctcctaggaagagagctggtttttttttcctcctccttccactcttaggacatgcctgatcttcttgagcagtccagcacaagctaatccacaaggttcaatcaggctaagtaattggaggaatgtgttaactctgaattacaaggagcagaagggaaggatctgtcagctgactaatcagggatagtggtttttttttttttttcctccccagcattgctgccactgtgctaatggaagcagccacggcagctttgtttgatagagatttttggctgccgtttttaaatactacccaagaagcagctcgtatttcatcaacgttgcgttgacaattggaaaagaaaagtgtaattgcgtacaggcgaaatggcagaagcaaatccccggagaggcaagatgaggttcagaaggaatgcggtaagggctctgtctgcactcctggaaagcctgttcccaagttcaagtgctgggatgctgcagcatggtgctatagcacaaactgctgagtagggtttttaaggacagatggagagaatggagacttatatttgcatggattgcattgatgtgattactgtgatattgacatagggtaattttcaggcaattgagggggtagaatataatttcaaaatctaaatgtcatcaggtttatgaatgagcaccttagtcatgttattcgtttaagactgtatgaacaattttgaatcattggacagcatagctttaaataatgacttaaaacaatatctaacaaaaggattcatcctttctttcaccatgatcaagtagagtatattgccatggataggtctggaggggattccatcatcacttaaaaatgcagcctttcctgggtgttaccgtataagtgaataaatttaaaatctgtaatgatttgaaatccttatggtttcaattcttctccaaactgaaacttcgtaggtacaaaattgtcacctgctgacaacttttttcttttagggaaaaagacagtaactcacttttcaatatagactagaatttggaagtctctcctctcaggtacatttcatgcagtcttttgcctaaattttcccttcattcatttattcatatagtaaattcccagcaaatttctaatgtgatctttagatgtattttggagaaatgttgaaataacactagctaatttaataaaaaactaatcatcaaaaaggctttaaatgccactctttttctttcaaagattaatataatgttattgatgttatggtttaaaatataaacttgctcactaaaaatatcgagataacacacacacacagataagaaggtaaaaattgaccataggaaaaaaatgacagtttgaattaaaattatgataaggaaagtaagacttttattattgttgaatgacagtgaacatcaataggtgtgtaaatgatttattttctaataaagctcttagcacagactgctattttaaaaactatagttggctttattttgacaaaattatatctttggctctatacatgtttttatattatgagaatatagattcagacttttaacagacgatttatggtgcacaagaaatgtttgtgtatgtactttgcagtattgtaggcaactgatattagcacttttgttatcaaaggttaacttaagctttcagaaagttcctaattatatatatacatatatttatatatatatttatatatatatatattctcagtgctgaacttagttttatgtctatacacatgcattaatatacacacaataaatacagcacaggggtactcactgaatagacatatctagcactgtgatatatacaacataagttacaaaggtaaatatggaatggctactgggctgaaggaactctcaatctaatagaaagggtaagacatgttcgtaaatgactattttgaaaagaaattctggctggtggagaaggccttatacaggagatggcatatgtttgggtgttaagtaagagtatatgttgctgttacctttccttgattctttcctgtgtttttttttctcataaatgaattaagtgatatgtaggaacagatatgagtgggattaattggattaattctgaagcctagaactatagtagaagacacatatgctttccttatatggataggacttgaccagagtaaagaatttgaaccttagctagtaaaaaaatggtttcaccttgaagggtctctggaattgggctgattctggaggctgtggacaggtaacatctaaaaggatggtccaatgccacttgaagtccaaaaaaatgtttgaactagttacttggtagaaatttcaatgactgtagctgagtgagagagaggggaggagaatagatatatatgtgacgaaaagggcaaaccacaaggaaggagtattgctttgggctatcctcctgacgtcacttgacaagttgcttgacaactcatactgtctgtactttttaaggtggggatatggggggaagagtgtggaagtggctcatactgttgcaaactattctctatagcttgaggtcatgagatttttttcccaacatattctgcagagatggttcagaccttatgaaagtcaagtgcctgtcagcatctcaacatttgtctgacagtaaattatgatactttccttttggtggactgtatatgctaaattgtttccagcaacttgtttcaaatgttatttgtcccattttggaaacatcaaggtcaaatcatccctgaatggcaaacagtaaatccgagtgtgcattcagtctatgaggtgttaagtgtctagaaagagtttgcccttaggatccagataggccgtactaccgctgcttaccaactgtgcttcagtttgctcctctgtaaaaagggaataatatccagtttactgcaatgttttgaaggctaaataagataatatatatataagaagtctgacacatacataatggcttttagtcaagggtctctcttattgttactgcctttctttaccctaaagattaaataggaaaagctataggaaaataaattatttttatagtaagtaaccaaacttttatgttttataagttactttaaacattctagaaataataactagaataactgaaaagtgtgcatagggtgatgaattgcctcccttagagagcacacacaagagtattaaacaaggttaatttctagacttcggtagtgaaatgatgtatttggtttacgcctgctcttgttgttattgttgttgttactgctgtaagatcatagaactaggcaatctggaagtacgtgtgagtaaaagggagtaaatctgttctctgggagggaaagatgagagggagcttattttgtgctcgttaccttgaagagcctgtaagagctgctgctgagggctggggtgggaccacgtacagtgattggacacatggctccgagtcctatgtgataggcagctggttcgcttttactgagatgtctttaagcagtcacatgctggaactccagaaaaatgtctgcgagaacctaaaaccaatgctgtttcctctctcgtgcaaactatttttttaaaaaagcaaaaacacattgaaataaaacaagactaacctttgcccaaatccctttgcttttttgacaagttctcaaaaatgaattatactttcaaaatctcagtttttattttggggaaaaagaaattgtgctttttcatgtttatataaccatacagattagaggttcttaaagcagcatacccaagaatttagaaatataatattcccaaaccaaaatgggaaagttcactggtcttgaactatatttgctttgatatgtgcatctgataccctatgctgtttgattgttcatttaaatactagctttaaaatggattatcttgagaattttagttgttacaaatattggtatatagagaaaaagtactctctatatatacttatatgtatatcaacatagatacatacaaactaatcttaaatgtatatggcttgtcaggttaaaattgctcaagagtgttctgtcccctctagattctcatagccggcaatcacagataaggacgtgtccatattattgatattgattgatgttcagatctatgaagctttttggttcagaggttgcaaattgtcagtgcacagatgcgttttgtttagagtatgcagcattttaacaaactttcaatttgttttccatctttaaacatctgggctttgcatgacaatctggatttctgtcttctcttgagaaaccaaagagttggcaatgctgggcccaccttgccacatgacaacatgtagctggaactgatttatgagtgaactgacttatgagtgccctctgctttgaatgttctccagttcaccatggtccccaccacttcctgttgctcctcgtcatataggaggagtatgaattgctattttccacctaatttaggctgttctttaattaagcctacttcacatttacattatctccctaacacatggtaggcattcaagtttgtcacctctgctttaggtctcaggtttagattctcaaccaacctgattcttgtgtcatccctgctataacttctgcaaattcctcttgttgactgagtctagttcaacaggcaggtgaagcggggttttaattctgctacttatgtgctagaaggtcttgaaaaattgcctgacctcacaaaacctcaatgtgttagttccctattgctgctgtaatagattactacaaacttagtggcttaaaacagtgaaaatgtatcattacggttctggaggtcagaagtccaagattacccaactgggctaaaaatcaagggtcagcagagctgtgttccttctggagtctctagagaagaatctgtttctttgacttttctagcttgcagagatcgtccacattccttggtttatacccctgcatcactttgacctctgccatcacatcttcttctctgactctcctgcctccctcttatcctaatgattacatcggtcccaccatgataatcccggataatctccccatatcaagatccttaatcacatttataaagtctcttttaccatataagataacatattaccaggttccagggattaggatgtagacatctttgaggataatggcactcagtttctccagttgtgaaatgaggacaaaaatagaacctactgcatgtaaatacttagcacaatgtcataatagtgctctttatgggcataattctagtagtatgcattcaataaatgacatttccacccctgtccaactctccaatctcctttccctaccttaaagctttgagaggtcctgaatatataaatatacataaatatacgtattttttttgctaaagagaagctatgaaaagtagtcataaatgtcatactttaaaagtgtgacagtttggtaggcacctgttatggtctgggttaagtgaatgggagtgggattaaaaattcaggtatgtcttattcacgtgtgggcacgagggatgaaaacaacacacctggtctaaactatatgatttagttttctagaaaaataactgacaaatcagatgaattgtttgagtgccacctgattgctctgattgcttagtagttgtgtagctattgcctacaagttatttagtctcccaaatggctactaaaattgggagtaactattgggttaacagaatccatgtgctctaggaagatatgcaaaaaagattataaaattgtactataaactataacaaaaaatattgtaaatgttattatgtagtcaataaatgaagttttcatcctttgatggtgcattttctttaaaagcccaagtttttctgggctttttgtgacaagtgaattactaaacattttgaaggaattaaggaatgagaaggtatgctaagataatcagaaggttttacttaagaatgaactgattagcatatagaattatctttagaagcaacttatatagccgtcaatgtttgggataatccactttattaaatagagcaataacaggtttaataaacatccaacataaaatccctagcttatgagcagctgaatacccctacccctgcttaaaatcacttccccactcatcttgcagacggtgattttccttctctctcctttctttctactttgttccctgctatgtgatcagctgtctctggacctggctgctggtacagccttgctctcctaggaatggcagagtagagagcagggccttacctcaggcagagagttgctacatagctctctctattcccatagtatcctcccatcccctcctccctcacacataattttggagatgggtgagtacccctggcttgaagtcagccccaggttcttgtatccagataattctagatacaagagaatatgagattaagggaagtcagagagagaaagatgaaaccagatcaacttagaatccatgaaagaataaaagtaattttgctttaaatgttggcaaaagtagggtgctttcaatttcatttaaaagtgaaaaaataaacaggttcaaggcaggtgagtataataatataatgggaatttacccaggtgaagaaaaaggaaaggcttaactcctaaaattaagggagtaaaaatagaatctgtgctttccacttaaaaataggccaaaagttcccacaagtccctgtcagattcttcccttaagctagcctttatccatatccctaaagttttctacccaaacctgcttgttctgacgtccgagaatccaaggcaaaattttaaaactatcttattaatattttttacagtttaaaaagtgccttttcatgtccttggcccactttttaatggggttgtttgtttttctcttgtaaatttgtttaagttccttaaatactgcatgttctcacttataagtgggagctaaataagaagttatgaacacaaagaaggaaacaacagacacgggtctacttgagggtggagggtgggaggagggagaggagcagaaaagatcactattgggtactgagcttaatacctaggtgaaggaataatatgtacaacaacccccactgtgacacgtgtttgtctctgtaacctttgcatatacccccaaacctaaaataaaaattttagaagtgcctttatattcattatttcttttaattcctgtaataactggaaaacatatatatatattttttttcggcagagtctcaccctgttgcccaggctggagtgcagtggcataatctcagatcaccacagcctccacctcctgggttcaagtgattctcatgcttcagcctccccaggagcggggaccacaggcgtgtgccaacacacccggctaattttttgtatttttagtagaaacgggttttcaccatgttggccaggctggtctcgaactcctggcctcaaataatcctcccacctcagcttcccaaagtgctgggattacaggtgtgagccaccgtgtccagctggaaaatacatattatacttaacataaaataaaatatacattacgtacataatagaaggtaggatatacattaccgttggaactctctgtttctctgtctctctctgtttctgtatacatgttaactttattcttttcaatgtttccccagcagcagggctcttggcaatctgctgcttttgaatggcatcctcaaagtttccttcactcagtattcgtttgaaaattctagggcaggacttctttggccctgcttacatcaaatgttcatacttatgttttttctttttcttttttaaaaagatgaggtctcgctctgtcgccatcatggctcactgcaggctcaacttcctgggctcaagtgatcctcccgcctcagcctcctgagtaactggaaccataggcgcatgccaccatgactggataatttttaaattttttgtagagatggggtctcactatgttgtccaagctgttctggaactcctggcctcaagtgatcctccatcctcggtctcctagcctgttgggattacaggcatgaatcaccatgtctggccctaatcatacttctaatcactattaatcattgtgtgttggaagggcagggccgtgtaggaaaataagagttctcatttggaaccaatgtgtagaataatagaagggggagtcgtttctcagatgaagggagagagtaacagtcatggcctcctgggggaattatgagttggacagccatcccaatttatgtatattgataatcattgtttaatttattgatttaattttatgctcttttaatttacttatttgtgcttatcacactcatttctctttcatttactctagttctcattgccacttaacattttatgttttatcaccatctcaaattgaattaggaaaatccccagttttgagcatcatttcccaaagagtctatgttttataccctggtggaagttacttttttcttttattttaaaatagactttatttttttagagcagttttaagttcacaacaaaatttaacaggaagtacagagagttcccataaactccttgccccacagtatcttattcttagtttatagttttgtttaattactagtattgtaatatgcctgaaatataattgcagttggaacatttttcatatattttgctctattatgctctaatctgccatcttgaggctgatggctcctgattctccacttttagcctagacttctttcccttcttaattgtacaaacagctatccgaaggacatcatctggatgtcctgctgacccttccaacctaacgtgtatatgaatggagatcagaatcttgtttcccttcttaaaacctgtttctcttgtgtttcccatctcagtgaaggttgtactattcaaccagttactcaagccccaaatctggagtttgatcctcctagtacctcctttctcggcaagtacatcaagtagttatgtcttgctgattgtgcctcctaaattctactcttattcctggtatcattactttagttcagaaactcatcattcctggcttggattactgtaccagcctcctagctcatctgtctgcttctactcttgttcaaatccagttcttcccaaagccaaagtgatctttctaaaatgcaaatttgaccatgttgttctgatgctcaaaaccttttagagactccccttacctccaggaaaaaaaaacccatgatcctttctgatgtggttctggcccgttttcccaacaccatctcccattgtcccccagtgtcatttcatctagctctcttgactagggccttttcaggaggtggagtagtttagtgattaagagcacagacttaggggcaaatgaaggctttgccagctgggggaaggtatccttaaactctctgagtctcactttctttatttgtaaaagtgagtaacctaactccttcatagaattattatgaaaagaatttatgataatattggcaaaatgctttgcacagagtaagcatttagtacgtggtgatttgttattaaaattgggatatgttactccgttctccacttattttgcaatgtgtcctccttctttgtcttttgaattctttagtgtagcagttatttttgactgcatactatgtgccagcaagttctagacgctggggaaacattggtgaactagaacaacattctgatccagttaactcctcgttatgcttcaagatctttttgaccttcctatgtctcggagagtttgtgctatcatttccccttgtatattattctaattcctttgattacttatcaatttagttaaagaattgctgattagtaatggactctgcagttgaactgttgggtagagattgtgttttcttaatttgtgaacattcaatgcctaacagagcttgatattcatttaaatacatgaagtagacacatagaagatgttcagtaaatattgattggattaaaataaaaatataatcccataataaagttttctttcattgtttagtgtaaatacacagacaaaaaccctttgacttttagggttatcctaggaaactgccacctaattctatttgtttttataggaaataagtgcaatttgagttcaaataactctaaaataagatttagagtctatttcttcataaggttggatctacttctttagtgtgagaaaatttcgtaccagaagtgttgcaaggatctgacctggagccttacattatttttctatttgcatgtttttagattttatcaatatccatttgtaaagtgttggccttttactggcttttatgaatttaaaatttgtttccttcagttacatattttctgatatgtgctcagttgagtgtgtgttgacaattttttttccaatttcttttgttctttctttctacaggcttccttccctgggaacttgcacttggttttggttttacgtcctaccagctttcttcaacgaacgttcacagacattggattttggtttagtcaggaggattttatgcttaaattaccagtaagagtatattatttaaatgttttgttcctctaattctcatgaagacctgtaccatgctgtttatattttacatgtgcccatgtgtcatttaaaagaaaaaaattaaaatgtcttttaaaagtatacatttgaaatgcccaaaagtctttcacttctaccatttgaaaaagaaatcgattcatcaatttataacaaagcaattacttttgcaaaaaatatatgtcatatatgttatatatatgtgtatatatgtatgtgtgcatgtgtgtatatgtatgtgcgtgtatgtgtatataagcaggaaattttatttttagtaaaattgagtgtatgttttatgtatttgaactcccgtgaacttacatcctgagctagtccagagtaccatgactttttaaaaatatttttgtttgtttttaaggttaggaatagggtgctcataaattttgatacttttgaaaaggtcagcccctcctgataaattataacttactacataaagtccttttctttgttgtgagcatagcattcttttagaagctggaccattaacaatgcaaacttttagatggaggaaaattaggcgttttggtttctgtggagattgatttagctttacagaaaatgttttgtaaatagaaactgttattatctgaagaaggtagcgcatacatgtatgggggcatgtacaggagagaactgttaaaaccatttatcagaggtaactttctgctaaatgtatgccaaagttcattttacagtttaatggagggatggcatgaagggcagttaacagtatcttttttgcttatttatataggttgttatgctgagctcagttagtgatttgctgacatacattgatgacaagcaattaacccctgagttaggcggcaccttgcagtactgccacagtgaatggatcatcttcagaaatgtatgttgtctttgcccttactgtagagcctatagttcttcatgttagcctttaaatctagttctagaattctttcctatttgaaaaaaacaaaacaaaacaaaacaaaaaaaccccagctttctgggccctcatttttcacatacatataaattcaacatcttggttttcttccataggcaatatctagaaatgatgagcagtcactgaggatggcaattgaaggagaatcctagggaataaggagatcatactctgcccatcccctcctgtggctatatagtaacttgaagaaatgaagggtttggattcaaatcctggccctgctgatttttagttatatgaccttggtcaatatacataacctctctgagtcttagttttcctaactgcaaaatgggactaataataccttacctcacagggatcttaaaaagactaaatgagatagcaaaagtaaaatgttttacacagtgcctagcatatggcaaaccgtcaataagtgcaaatagtattattaatctcattattctagtgatgcttctgaggcatttaaatttgtagcaaagactgtacttctgttttagaaatttacaaataggcaagggccctgcacctcccaagtatgtctgtggtatatgagtatcttgacttctaatcccagagataggggaacccttctgaagaaattaatgatgtcccattaaattaggattccattttcctcatacttgttcttcactcaacatttcattcattaattcatttaacaatgcattcattcaacaattcattcattcacatgaagatgtattgccaaaattagcaatgcctagcctttaataacctgtaatgctataaataaacaagcaaatattttgatatgcatggttaacagatggtcatatggtctctacattttgcccttctttctcagagtaattgattttagaaacaaaagaaacaacaaaaccgtacttaccattttatggcaacaaaggctttggggccaccattccaaatattctatagtacctgaaatgagttgttgtgactagtttttcccccgtttccttcaattatcaccttgtttggaatgctaatgcttattcacaaatgataataaacaaatataaagtgactttactgttctcatctctcttcagaagtaaggttattataaggcaattttgccaattggagagtttatagaataaggaaaatactgtaattttcaagaaaataaaacaaactactcaatacatggcatctttaagaaatagttttcattagtgtccaagaaataagtcaagaaatttggataaaagatattcaggaagactcttaatcttccttcagtttcttagagttttagatgaagagttacagttgattgccaagagcaatgccatatttctctagcagaggagagttcatagtatatgtgtttgccgttatacccccaataaaaacaaatacacttactgatccagtttttgatatgctcacagagtgaccatataattaaagtaatcaccggctctttgcaggctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaaggtatgtctgatagagttgacaaacaaaagatttccatggtctttatctagagaggtgtttattatctccattttacactgactgttgcataaggggagataaaagacatttatgtaatatatttaaaaactaaaaaaaattatactttataagagaagactgtcctggatatgttagacctaagtgtcccctccgtaaatggtgcattaatttgagaagttatttaaaaacatcttataaatgctgcagaaaaagaaatatagtcttttgttttactatgtgcggtcatgtactgcataaggttgttgtgatcaatgatgaaccacatatatgacagtagtcccatatgattgtaccatatttttactgtaccttttctatgtttagacatgtttagatacacaaacgtataccgttgtgttacaactgcctacagtatgcctacaactgcctacagtatacagtacagtaacatgctgtacaggtttgtagcttaggagcaataggctataccctgtagcctaggtgtccagtaggctatccatctaggtttttgtaaatgcactctgtgatgttcacaaaatgatgaaattgcctaacaatgcatttctcggaacatatccccaacattaagtgatgcatggctgtattttttatttttgaggaggagtcaggaggccgagtttctagtcccatctctgctgtgagctagcattgtgaccaaggctaacattgctcaattgattgtaagttctcttctctgcagaatactaggtcttgatgtttcctacagtagaccaggggttgcaaattgtttgtgctctcctatccaggtctttgtggagtgttgttttgtgaaggattctgaagtgcaattcagataatcagcaagtattttttggatccactttcttcagaaagtttaagaataatctgaacaagcactgggcattcatataacttgtctctctcatctgataatagacatactgtgtgcattagaagattaaagctgtatatagagatatgtgtttaaattaaaaagataaactgagtttttttccaacttttattttaggtccagagggtacatgtgcaggtttgttacatggataaattgtgggatgctgaggtttggtgtacgaatgatcctgtcacccaggtagtgagcatagtaccagataggtagtttttcaacactctgcctcctcccaccctccttcctctagtagtccccactgtctattgttcccatctttatgtccatgtgtacctaatgtttagctcccacttgtgagaacatgcagtatttggtttcctgttcttgcattaatttgcttaggataatggcctacagctgcatccatgttgctgcagaggacatgatctcgttcttttttatgactgtatagtattccatggtgtatgtgtaccacattttctttatacagtccaccattgatgggcacctaggttgattccatgtttctgctgttgtgaatagtgctgcaatgacgtatgagtgcatgtgtcttttggtagaacaatttattttcctttgggtataaacccagtaatggcaatgctgggttgaatggtgttctgttttaagctctttgagaaatctccagactgctttccacagtgactgaactaatttacatccccaacaagtatgtgtcagtgttcccttttctctgtagcctctccagcatctgttattttttgtctttttaataatagtcattatgactggtgtgagatggtatctcattgtggtttgatttgcaagaaactgaccttttgaatcacaatctaaaaacaaagctctgtccaaggaaagaaagctctgtttttcacaaactgcatgttgtcaggcaatttgcttaccttttctgagttgcagtttctgtatctttacagtgaggttggtgatgatgatgatgcatcatacctggtaggattgctgtgaagatgaaatgaggcaaagaaactgatctatgtataacaatgttccgtacatagttggtacttcgtaaatattggcttttaatgttgatattattacccatattggtgatggtgtcatggaatctgtcctcagaataaatgtacaccaaaacttttgcttacaatttcaagggactcttggaccacctgaaagaaatcttaaatcactcttagatgtctgagaaaggtctatattgttacaccacccactgaggttaagcccttctgaatagaggcatatacttcttgatgagttaattaaacctaaatgtgaagtaaaataagacttaaggcagggagtgattggtaacaattaaggattagtagcaaaggcatttaactgtatctgaatatgcattaagtattatttgcaattgtatgctttctactgtggtggtttttattgtgctactactgctttatttgagctcattaaaagtgttagcagaacagtgccaggtgcagtggtacatatttgttgtccctgctacgcgggagcctgaggcaggagaattgcttgagcccaggagtttgtgtccagcctgggcaacatagcaagatcccatctctaaaaaagtaaataaaaataaaatattagcagaataggatggactggattggaactttctaccagttagagaaggaggctacaaatagagcacatggtacttctgcccatgatgatcttataaaaacattaattgcaacgtccatctctaaggcaagggcttcttggatcttcacagcttttagattttgtggcactgagattttgaaattttgtgaattttcagagagctatgaaagcaaaggccattctagaattaactgtttcgattcttcatgccatagttgtatgctcccttcccatcacatcattcaggttggattactaattaggtgatactccttttgtgtctttggacagaatgatattacagctgtaaccaaagaaggaaaaattctgctaacaaatctggaagtgcctgacactgaaggagctgtcagttcaagactagaatgtcatcggcaaataagtggtgactggcaaactattaataagtgagtactctctttttggtttagagttacttattttatatttttgaaaggaaattatacatttttgctgcaatatgttaagtgttaaagtattcctggacctctggaaatctgagaacttatttctaggttgtcctacagagatgattttgcttgtagaagagagtctgtggacattggttgtctctataggtagaaccaagtgtcatgggctatgactttgcctataattcttaatgtccagaccacacttatctacatacttacaaaacagatagttgcttttaggaatttattggagttttctttcttaaggttgctgactcaagtacatgatatggaaacagcttttgatggattttgggaaaaacatcaattaaaaatggagcagtatctgcaactatggaagtttgagcaggattttcaacaggtcagttaaaacatttctttgtataccttttttcattacaccagaggtttttactccttaatcatgagaaatcctgccttgcaagatgcccatttatacctacaaagaaaaaaaaggaggcaaatgtaaatgaaccttggcttagactgaagaaaatctctactaaaattctgagacttctactttttcagcttactcgtttcctttgagaaagtatcaaactgccaatatatatgacagggacaaagttactctctactttggggtttgttattcaaatttatcttagatctaaagggtattcaaggttatgaggtagctttccaagggaataataccaacttccttcttggtttttaaatcccatgtacctatgctgaccatatttaataagacctaacaagcttttatttctgatccaggagtttattcctgtgaaaagcctgagagatgaaattaaataagtttaataaataattaaaaatacattccaattggaccttcctggaaaatccatcatatatggtcaagatgcatagatttagtttcttttccttttgcggtcatgttcaaccttatcacagtctctctcacagtatatacttcaccagaggatccaaggaaaactcacttgttcctcttgcatgtgcccagcttgttttctgcccatgaatggcttacttgctttgtatttcacttgctcatcagagttaggtttcggaggagcactgtactctggacgcggggctcagttaccactagcgttttctctcctttgattcaaacatcttttgaaatgttctgcatgaaaccttccctaaagaaagaataggtcaggttgctcttggtccttctaggtatttgtgtttctccctcgtctccaactgaatacacagaaaatagcacttttcctgaacatacccattatgcttatacttacatattaatttgcatgcataccaaattcttgtcctgtggttatgttctgtttccccaagtcattaattcctgtctttaatcaatattgttgtttgtcttagattataatctcactgacatggtgtgtctcatagtgacatgtcgacaagttctgtatgtctagaaacatgactttttaaaaaaacacgtagaaacataaacttacagaaaaatggcaaatataagaaaaataaaaatacccatataccttcttcccagattaacttaatgacaatattttactccatttgctctattatttttattccctccctcatatatatacagataatatttttttctgatctgacaaataatatattttctgacccatttgagtgtaagttgcacacatgatggccctttccccctaaatgcttccattttttctagtaatagggatattctgttatataaccatagtacagttatcagattcagtacatttaacaatgcaatacttttatattatctaccattggtatttcaattttgtcagttgactcagtcaagtcttttatagcatttatttttccttcagaatcggatcctatatagggtccagtcttgcattaagttgtcttgtgtctttagtgcccttgaatctagaacatttccacagcctttctttgtcttttatgactctgacattttgaagaatatagtcctttttttttttttttgagacagttctgtctcccaggctggagtacagtgacacaatcatagctactgtagcctcaaactcctgggcttaagccatcctcccccctcagcctcccaagtagctgggactacaggtatgcaccaccatgcctggctaactttttaatttttgtggggatggggtctcactgtgttgcccaggctggtctgcaactcctaggctcaaacaatcctcccgcctcagcctcccaaagtgctgggattccaggcatgagctataaggactcatgcccagccatagtcccttttgaaatgcatttttcttcatttggagtttgttggacatcttctcatgattctatttagtatatatgaccagctagaataccacattagtgaagtgtccttcttaaggaatcatatctgcaggtgaatgaagcctacctccctcttattgttgatgtggattctgattacctattcagggtgttgttgaatttctccactgtaaagctacttttactccccttctaactagtaggaaatgtgtggggagaaaatttaaggttatgcaaatatcctccttctcataaaaatttccccgtaaatttagcatcaactgatgatgtttgcctggacaaatctttgctgtgatggttgcaaaataatgattattttcaactcccatgtccagtccacatttatcagtccacactaggcattctactgaagcaagagccttcccttctctccatttatttctttatttgattcaaagatttttacttattggtttttaaaactttcaacttttattttagattcagggcatacacatgcacgtttgttacatgggtatactgttacatgggtatactgttacatttgaggtgtgaatgatgccgttactcaggtagtgagcataatatccaatagttagtttttaagcccttgccttcctcctcttcccccttttggtagtctccagcatttattgttctgtctttatgtctatgtgtaaccaatgcttaacttccacttataagtgacaacatactgtgtttggttttcagtctctgtgttagtttgcttaggataatggcctccagctgcatcatgttgctgcaaaagacatgattttgttttttttatggctgcatagtattccatgatgtatttgtaccacattttctttatccagtccatcattgatgggcacctgggttgattccaagtctttgctattgcgaatagtgctgcagtgaacatacaattgcattgcctttttgatagaatgatttattttccattgggtatatactcagtaatgggattgctgggtcaaatggtagttctgtcttaagttcttaaatattcaggatgccttccacagtggctgaactaatttactttcccaccagcagtgtatcagcgttcccttctctccatagcctcaccagcatctgttcctttttgtctctttaataatagccattctgactgatgtgatatgttatctcatttgatttgcatttctctgatgattagtgatattgagcattttctcctctttgttggaaatctgtatgtcttcttttgagaagtatctgttcatgtcctctgctcactttttagtggagttattagtttttttttattttattattattatactttaagttttagggtacatgagtacaatgtgcaggttcgttacatatgtatacatgtgccatgttggtgtgctacacctattaacttgtcatttagcattaggtatatctcctaatgctatccctcccctcgccccccaccccacaacaggccccagagtgtgatgttcccctttctgtgtccatgtgttctcattgttcaattcccacctatgagtgagaacatgcggtgtttggtttttttgtccttgcgatagtttgctgagaatgatggtttctagcttcatccatgtccctacaaaggacatgaactcatcatattttatggctgcatagtattccatggtgtatatgtgccacattttcttaatccactctatcgttgttggacatttggcttggttccaagtctttgctattgtgaatagtgccacaataaacatacgtgtgcatatgtctttatagcagcaggatttataatcctttgggtatatacccagtaatgggatggctgggtcaaatggtatttctagttctagatccctgaggaatcgccacactgacttccacaatggttgaactagtttacagtcccaccaataatgtaaaagtgttcctatttctccacatcctctccagcacctgttgtttcctgactttttaatgatcgccattctaacttgtgtgagatggtatctcattgtggttttgatttgcatttctctgatggccagtgatgatgagcattttttcatgcgttttttggctgcataaatgtcttcttttgagaagtgtctgttcatatccttcgcccactttttgatggggttgtttgtttttttcttgtaaatttgtttgagttcattgtggattctggatattagccctttgtcagatgagtaggttgcgaaaattttctcccattctgtaggttgcctgttcactctgatgatagtttcttttgctgtgcagaagctctttagtttaattagatcccatttgtcaattttggcttttgttgccattgctttcggtgttttagacatgaagtccttgcccatgcctatgtcctgaatggtattgcctaggttttcttctagggtttttatggttttaggtctaacatgtaagtctttaatccatcttgaattagtttttgtataagatgtaaggaagggatccagtttcagctttctacatatggctagccagttttcccagcaccatttattaaatagggaatcctttccccatttcttgtttttgtcaggtttgtcaaagatcagatggttgtagatatgcggcattatttctgagtgctctgttctgttccattgatctatatctgtgttttgagagttattagttttttgcttgttgaattgtttaagttccttacagattctggatattagatttttgtcagatgcatagtttgtgaatattttctcccattctgtaggttgtctgtttactctgttgatagcttctttggttatgcagaagctctttagtttaattaggtcccacgtatcaatttttgtatttgttgaaattgcttttgaaattttagtcataaattctttcccaaggccaatgtccagattagtgtttcctagcttttctcccaagattcttgtatattgaggtcttgcatttagatctttaatccatccttagttaattgttatatatggtgaaaggtaggggtccagtttcactcttctttatatgattagtcagctatctcagcaccatttgttgaatagggagtcctttcccctttgattattttcgttgatttggtaaaagatctgatggttgtagatgcgtggctttatttctgggttctctattctgttccattggtctaagtgtctgtttttgtaccaggactatgttgttttggtatagtttgatgtcgggtaatatgttatttctgcccttgttctttttgcttatgattgctttggctatttgagctcttttgtggttccatatgaattttagaatagtttttctaattctgtgaaaaaggctgttggtagtttgataggaataacattgaattggcagattattttggacagtatggccatttgaatgatagtgattcttcaaatctatgagcatggaatgttttctccatttgtttgtgtcatgtatgatctatttcagcagtgttttgtaggtctccttatagagatttttctcctccttgggctacatgtattactgggtattttattctttttgtggtcattgtaaatgaaattgcattcttgatttggctttcagcttgaacattattggtgtatagaaatgctactgatttttgtacattgattttgtatcgtaaaactttcctgaagttgtttatcaattctaggagccttttggtagtctttagtgttttctaggtatagaatcatgttgtcagcaaagaaagatgatttgacttcttttctgattcctagttttttgattgtttataatttattagtgttcttgactattgtggtgtttcaaactgctgctgtgtccttgtgacatactccaacatttaaataaatcactttcttactttctggcataaaaatatattccaagttcatcttgtacctattctgcctcaaccctggaatcagttatttccttgaggagccctggtttctttttctgggaaatggtattaaagaccaaggtctgggtgggagatgtgcttattacttctggagggcttttgcttttaggataattcaccagagagctggggaatgatgaaaaaaacacttagatgaaaattctcaggtaagattttgttttagatatttgctatatatatatacacacacacacacacacacacacacacacaaatgtatatatacctatacatacctcacacgtatacatttatgcaaatacatgtcctcatatacgaacctacacatgtacatggtgatcttttatacatcaagagtacacattgatatctatgaggttaaattttaacagattatagctatttctgtgaataaaataaccaaattttttatatgtgtaatttctccatgtcaatatttttgtttaaaagcattttgtataaaacttgatcataaggggataaattttatgtttttaaaacctctttgtttcgtatttttagcttgtgactgaagttgaatttctattaaaccaacaagcagaactggctgatgtaacagggactatagctcaagtaaaacaaaaaataaaaaaattggaaaacttagatgaaaattctcaggtaagattgtattttagatgtctgctatattatacagtataatagtcatgttttggcgggagtaggtagtataaacccttattattaatttctttatttttatttttccataagttactggggtataggtggtatttggttatatgagtaagttctttagtggtgatttgtgagattttggtgcacccatcacccgaacagtatacactgcaccctatttgtagccttttatcgcttgccttcctcccatcataacaacattctgtatatcaggcacaattatattggtctatattctgttttgttcaatgcaggccagaggtgacactacagatatatcatgtagttagttgtaaaaggaggtcactgagacaatggcgtgaactgtttcaagcccaccaataagaacaagggcataaattattttggagaagctagaaaaatgtgtatgaagaatgatatatggtgcttggaaatgatgggaacatacaagaacataattccttaaatgcccactttaggatatatgcagtttaaccaaatggagactcacatagatatttctacttattcttactatctgtgaccttgagtaaattggtttctaatcctcagtgtcttcatctataaactggggataaaatgacctactttgcagagcaattgtgaatattcatttaggtgtatataaagcacctggcacaacactggactatatagtaaccactcaaaagaggcagttttcattatccctgctagtcttaaattttggactagtggctttaatacttaaaaaactcttagcttttatgtgagagcaaggccatgctttttatgtgagagcaaggccacgctttttaagatgaattctcagcatacaaacagatttatgggtgaaccatgagtatgtgaaaacaaatattgaagaagcaacagttatgataactagttctggaattatgcttgtagatctgtgtgatcatgggacactttacatagccctatggtatagtagaaagaggaggcaaactggtttggaaactaagggagacttaatttttttccatttaataatttttcgtttctaattgtggtaaaaacacataacatgaaatttaccgtcttaatcatttttaaatgttcagttcagtagtgataagtaaattcgcgttgttgtgcaacagctccagaactttttcaccttataaaattgaaactgtatacccattagacaacagctctccattttaaacctggttttcccactagatagagaggccagtcatttcctcattctgtgtttgagttttatttattttattttgacaagcatttcttgaacccctactatgttcgagtctctacactggggggagtgagtagttgatggagtggaggcaaggccactaaaggtcattttttgacatagaaaccctgtgacttcaggtatgtgaagtagtccaggtacatgacaactctgatgagatttctaaggctgagatgatatgaaatacacttggctggtgtgtatacctcatttaatataggtggttctattctaaatccacacatattaggagaaaaaatctcacccacattctgtgtgtgatgtgcaattttcagtttctataaccagaaatgcatgagcttctaatgacatcactgctgcagctaattattataactgtaagtttttgtttttgtttttttgtttgtttgtttgtgtttttttttttgcagcctgaagaagtagacatcaaattgtatttttggcaatgtatccttcttgctcaaacattttgcttcttaattattttcttctttttttctctataggaacagagatcatgtattcattattttttgtctttgttataatcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggtagtgtaatgggaaatgatccatttctgaaaaggaacacacatttttttccaggtcctgctagcctgaagcaccttgccctcctgtcgcatggaatacttttcatcttctcagaggttatatggtcagggactggtatagctttggaattaaatttgtaagaagtctgaaggactgagtttgattatgattttttcatccatctaccaatgaactattcatgaaagatccaatatagttcaaattttaccctttgttctaaatattgagattgtggagtaatggcttcctttgtattttcgatacatctctgaagccttcactggtgatggtttgtacttggaacatttttaaaaacctgggggggcattttgctaaagcctgaaactcctttcacatttcatagtacagaaataaaatattaaacagtgactggaaaatattcctccatggcttgtgggtttgacccttttcacgattaggcaatgaattgacaggtcaccgtatggacctggtgttggcagtggaatataaaataggggtatcacttacagacattatatctgaacataaacattttaatctttacatctcattctttgggaaggaaactttattcttgtctttagccatcattaagcatttgtattacactttatatttttctaagaatttcatatttcagttactgattttgggaaagtaacatgcaactaagtgttagtgctgagaaaatggtcggactcctgctgcagaataaattagttgttgtgaaataaatgcagtgtttcccaacctcggctgtgtatcagcagtatctgtggagctctgtaaaagtataaatgcccaacttatggcccagagctactgaatcagaatttctgggggcagaacccagatatcttttttttttttaacagctctgaaagcatttctgactcacggaagccagaggctgagaaccactcacttattggacaaatatgttttctctttattaattcatattttttttttttcttcttgattttcttaccaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggtagaggcttttttattttcaaataaatatttaaagaaaattataattgcagtactgtgggtaggaggagttttactacctcacagctaactttatgtcaaattgcacttacattgtcctcttaggggtgatagtagtgccactgtcaagcatcaaataattcaaaggcatatgtttgctatataatgaagaataatttcctttttgagctccaaatccattattttaaaactcttttatgtgctaggtgttctcacacatattttgttgtgcatcactggagaaaggcccaaagctcttctataacagaatgttgggtccatgtcaagagcactttaccccagacatctttcctttgtgctgcagtgaccatcagcagatgctctgtggatgatgttgctttcctactcagtttgagaatgaaagcataaagataggatttgggtcttcttggagaaggaggagcaggcagaagttggtgttaacagggtggacagctataggttagttcagtactgcccccttggaaatgacatgaagaattttccacattgtagataagagcatttgtgatgctatttgctgctaaaatgtgtagttgactctaagattggagcagtatctagatccatgcttagcggaatatcctaggggatgccccaggaaatcagaaatgcagtcatggcaatagccaagtgattctctggaagcaaccaagcttaactctagctgcctcaaagcatctaggagaggtacaaaggtgtattatccattggtggctctgaggagcctgctgcaacatagaagactataacaagaatgtcctacagggtaaaatgtaacaaaatattataccgatgttattcatttgattgtttttataacttggtggctttcttatgctaaacaggaaagagcaatatgccttctttcccagccattatctgattcagccaatgaaccaatgaagggcaaatcactctatgcagtgaccaatttcatgactgcttcttggtaattttttccctcaggttgttttggttgagattttggttttatatccatgtgaacataatacattaatctgtcttgttatttttctaaatgtcttgtagttatattttaaactctaaattatttttttgaccatctgagtctgagaaatgtaatggggtttgtaatgacctcatttcataaaatatttcctataattcttatacaactcgcaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaaggtaaaatgtcttactttctctgtctctttttttcttgctattgtttatattgttactcttgatgtaaatactgagtttattcttcaatgcggatagatgaaaatttcactttagcatctttggtcatatttatattgtgcaaggcaagagtcagattgaggttattgtacagtactaaaacatagtagtgatatagtacagtacaaggaattgtgaacgtctcagtactgagtactccagccttgaaaatgagtatgaaaattttaccagcatcaaacttgcatttttttccagcaggtgaaggaaagtatatgaagctagtatacacatgtgtgcatgcacacacacacacacacacacacacacacacacatatttactgctactctagataagcaatgatttggttcctttttatttgtataaatgtgggagtacaagtacatagagttttgttacatgaatatattgcatagtggtgaaatatgacttggttcttataagcttctagtaagtgaatggcttagataataaaatggattgccttttctaaataaatgctgttaaatagaataattttgttggtaatttactattacagagttcattttctagttttaatctcctagttttatccatgtaagatctattttctttctaagttctatggaaataataattgtccttataatgtgttgaactactctggatatggatggctcaggggttcccttgagctgcctttggggcttcttagaggagagtaatttggtctttagggccctaagtaagtggaatgggtgaagatgggagtaaatttggtctgtctgatctaaatagagtcagaagcttcattagtgtaggagaactgctttggaattcagagaaggcttgagccaaggataatgagcataaaaataatagcttatatctagcatggatcagattttcaaaaggtgatgaaagcaggtaactaggctaagattatgaaagttacatgtttaatacttatgaaatatataaatatatttacaaataaaactataagcaatgtcttaaatacaatatcaaagatatagcaaagatacagggaatattaaaactactggaaaaagagtaaagataacaaaataaaaaacagtaaggggataaaacccgatagctatgagaataaaactgaaataggttgatattcttgagcagaagacagacctcggttagatttctggctccatgtactggctgtgtgtccttgaacagttcacttagcctctttagcctcagtttccttacctggacaataaggacgataatacctattgactccaacaggttattgtaaagatagggtgaaaaaaattgaagactataaaaaaatacttgataaactggactagtcctttcctctggttaaagctgcttgcttaattgtcctctaaaatctcaactctttctagaggttcttaaagtggtacaccttgggttgaggaacggagttttgaggagactgttacagatccatgcaagtcattagtcactcattagcacattttgttttgtattgtttcatttttttctgatattcttatttaatggcgttacaatttccttctgcagtgggagttggatactctttctttcaagcatgtaaacttttttcaaaaggtacccatctttattatattacttttgccaatacatttttctgagtttgtgtacatgtgaaaaaccagtttggcatctaaaaacagcagcagttcattgttgcattctacctgcaagtaactttttcctgtttttcataataaccatccattattctctttgtattatgcttatgttggaaaatgactatataaaatgtagattatggttctaaattcaatgtctttcataaagtgaccccgcaaaaagaataaagaaaaacaattggcgatgctaaaatgaatcaggccttcttttgtttaagatacttcatgatccaactttttgttaggagtagcttggatttgcttcagtttgagactgcctaatgtatgtatgaggatgaaggcagcttaataaataagtgacatggatggataaatgtttttatctattatacatcatgctttgtaaattaaatcaaaacattatgtatgctacaaaccttgttcatttacctaattgctctgttagtaatagggattataacaatccattccaaacaatttcttaagacttttaatcgctaagccaaatatataaaatttggtcaactcaaaacataagtattaatttctcataaaaatgagtcaaactgtttttttgttctttggttttattttagtttttttttttctttttgcattaaatataattctgcacctagcacagggcctggcacttagcaagatgtaataaatatttgtagaattaacattgaatatagagtgtagttattgagaatgggagatattgacagcgaggaataaaatgtaaaatgtgacttgagctcctaaatctggatctttagcctagatctttcttctaagctttggatctctgtttataatttgcctttttgaatttcccataggcaactcagactcaacatacctcagattaactcatctctcctgcaatctttctactcttcatcttggtgaatggcactatgatttccccagttgcccaagcctgggaccttggttcctcctcacttatgccctacctctaattgatcaaaaattctatatcctgtggatttgtgcctactaagtatctctctcgaatccattcacttttttttttcatccccactgctatccttactgccactttcctaatccgagctaacatcatcctggccttggcaactgtgacagtctttctgtctcttccacttaccctgcccacttcttcttccctttcctaggtgtcttactttgtggacattacacacactgttctctctctggaacactatttcctttcctctccctttcccacatgttagcttctactcctctatcagatttcctatttctaggccacttccttcaggtaagcttttcctccccagatctcctccttccctgcacccctgtttgcttaggtgttcatgctgtgtgataacaagtacccccaaatttcttcttggctttagtagaattgtctgttttctgtctctcttgctaaactaagctctgtaagggcagaaactgtgtgcagttcatctttgtatccctaaacacagagcttagcatatggtgtaggtgctcaatcattttgtatgtatttatattgttaaaaatgaatacatctaccttgctttgaagaataagatgtgtttctcataagttgtgcacatatttattttgtatctcttaacgtatttgcaaagaattaattggcaaaactaacaattgcctcttaagttacctttaaaaataagtttggatctctgtagaacaggtttctttgaagtggagcatattagtattcattgagaaattaattttgtataattcccactgtttaatatatatttacatatatgatgatataaacttgaagtttaggtagaaaatatattttaataagtgaaagtgaagtatggagtctagagaacatagcagcccttcgttttcctgagtgtgcctgtcactggctcctgctgaggagggaaggacaaaaggtttgttcctttcctggagagaggagtctcatgcagcctgtgtgagtaacagccttttcagcagccctgagaattaggatctaaacaatctagtctttggttggaccatgccttcggctttgtaggaacgtctggattccttgcttaataatacagtggctcaccctttttaaactaaacatttaaaaaataaagatgaaagttttgaattttgatgacatgtttaacattttatcatgctttggaaatgtttatatggtggttagaaacattctgagagtagattatatgaatttgaataccacctctgcttcttggacaagatattaaccttaattccttatctagaagatagggatagaagttgttacctacctcttaggatgattttgggtattaaaaaagaagatatatgcatagctcttagaacagtgctcaatatgtagaaagtgccaaacaagtgtagatgctctaattagtagattaaacttagattgttttcaaaattctttttgattgagttaatcaatgagctacaatttgattaaatgtttttgtgtcagaatgaatactaaatctgcaaataattatgagcactaacacctacctcaatgcttggcaagtaagtgaatgtttgatgaatgagagaatgggtgaatacatagcaaaatcatgctcagtaagaagctgaaatcatgtgagtaagtccaaccaaacattatcttctatagtgtgattttaaaatactaatataaacatattggaatattaactcaagttatttaataaatatatatgtatttctattaaaagtgctgactttaattctggtttgaaattcttctttcacatttctctaccagggaagaagacttggagacaaaatcagagcaacttaaaagtaaatatcattaattaattcaaaattgactttattgctttagttgcagagttggtatgagccttaaatcacatgtttcattcactagacaaatattgtgtctttgaaagactatttaaaagaaaaaaagctgctgctgcattgtgtttcactgcattactggcatatccccagatatgccagtttctcagtatgagctgtttctcaagtcctggctcaaggttagaatcatttctgtagaacatcttgtatatgttccagcttctttttaccaccacccaccatcacttcaataatcgtaagtaagcgttgcacctttgtgcagaataaactttctttcatgagcaattccagtcctacaagtatgaagcacacaggacaggttctaatggaccatgcagaggctaactcttagctcaaaaaagatatccattcttttttgttgttgtttttaagtttttttagagacagggtctcactatgttgccaaggctggagtgcagtggccattcacaggggtgaccatagctcactgctgcctctaattcctgggctcatgccacccttccacttcagcctcctgagtagctgggactacaggtgtgcatcactgtgcccaatctacttacttattgttagatacaagattctgttcttctcagttatccatgataatctgatatctgtaaagaagtagactcatcatagctacaacatcccacattttcttttctctctctctttttttttttgagacagggtctcgctctgttgcctaggctggactacagtggtgcgatcatagctcactgcagcctcaaactcttgggctcaagaaatcctaccaccccaggctcctgagtatcttagactacaggcatgggccattatgccaggctaatatttttaacactttttttgatagacagggtcttgctatgttgccaaggctgatcttaaactcctggcctcaggtgatcctcccgccttggtctcccaaagtgttgggattacaggcatgagccactgctcccagtccccaagaccccacattttcttcttgtgttttttgtggtaaataaagatgagaacatatttttaaggggcagtatagcatagtggtacaaattgtaaaactaggctgcctggcttataatcccagttccatcacttactggctatataaacttgggtaagttctctggaactcagtttccatatataaaatgggcataaaaatagaacactctcatcatggagttaaagataaaataatctaatatttgtgaagcaccttgaacatgtgtggcatatgataatgctctaagttttaatataattaatagcagcctagtgaatggtctatactgatacacgaagcctggttattattctgtacggccacaacttctggtttcaagaaagaaacagggtgaatgccaaattctgtagtattacatgttgtaaaatctgtctgagcctcagttttcccatatttaaaatgaggaaaagaatgccattgcttgctaaatgctgtttggattaaatataatatgtgttaagcacctaggactgtggttgcctaatatatagaaagtcataatacatgcttgtttctttcatttgtaataagtaggtcacattttggggaaatatttagctgatagatactgtacttcattttgggttctagttgtcccaaagaaatgttacatttacttggaggtcaggcttttggcaagctcagctgtccaatacagctgagattggataccaggaatacacttcaaatgcttcttaaaagaaataatcatcacaaatcttttgcagttgactcggtaggccagtccaagtcctttagagtctgtaaaataaggcaatttattagaattagggaggcaacttatagcgactaacatgtggcagggagtagagacagagatgtacaggttacagttatttcaagaaagaatagagttctgcaggtatccctgcagcacatcattagattttatcatattcaagcttatgatgatgccatcgaatcattaggaaaaggatcttctagcttgccccagatcttagaaaaaaaaaaaggaaaaggatcagttatgtcgtgtgtctttgattaaagaattcaaggatgcatataatattttctagaaaggtttccatcaaaaatcactatggttaaaaagatgtttggttcttcaatgaataccctttagttatctagaaaattaactttttatgaatcaaccttattttccaagaatgccaaataaataaagagttaatacataaaataagttctaattagtatcttaaatctgttttcttaggcaacttaaatcactttttactagtacgtatcaaagttattttgaaaaaaatcatagttttatttttcaatttatcttcagagttaggacctagaataaacttaatttgagctggatcgccttgaagaaaaattatacctacagaggtgctaatttaacttttattttctgtatttcagattgaagtggtgcctgattgtcaggagaagagaagttctggtccatcctccagtttggacaatggcaatagcttggatgttttaaagaagtatcctttatttattaatataaactcacatacacatctaactgtgggagtctggttcagtgttcaaggccaatgtgattagaaatttgagttcacagaatggggttttactgggtgtcagaagtccaggatttaggcctggccaacctatagcctatttatgtgatttgaagaaaattaactaaactttttcagaatgttggtatcttcttttttttaccccagactgaaataaaatggaggttttcgtttatcattcttaaaaaaagttttattattatttttcattgacacataatcattgtacatatttatggaatacagtgtgaaattttgatacatgtgtacaatgtataatgatcaaatcatggtagttagcttatctattaattcttcagctttattgatatataattgacaaaattatgtatatttaaagtgtacaatgtgatgctttgatatgtgtatatattgtgaaatgattaccatatcaagttagttaacacatctatcacctcacgtagttaccattttttttttgtggtgagaacagttaagatctattctctcagcaaatttcgatatacgaaatgaatagagtggtacatcaaaaattacaaaggattatacagattgatacaatgttattttatagatgttaataattgttttgttcattgttataatggtatattaatattctagacataagaatattcatctttttaatttgatgttacagttgtaattagcaagcattttgcagcaagttgtatgtatacatatgtatgtatgagatacatatatatatatatacagacacatatttatactgtaagactctcaaatgttaaatgctttaatatgcaaaaagaaaaagaaaaaaagccaaaagtataagttaaatcaaatgggttacttatactggggacaagggaaatgagttttaaatatgatgtcaattggaaatcacattgaaaggaaaatatactttattttccagagacagtaaacaaaattattacagaaacaggtggggcgtggttattcacgcctgcaatcccagcatgttgggaggcccaggcgggcggatcacttgaggtcaggagttcgagaccagcctgacaaacatggtgaaaccccgtctctaccaaaaaatacaaaaattagccaggtgtggtggtgagcgcctataatcccagccactagggaggctgaggaaggagaatctcttgaacccgggaggtggaggttgcagtaagccgagattaccccactgcactcaagcctgggtgacagagtgagattccgtctcaaaaatatatttatatacattacggaaatataagtatgacctacacttgaggagaccagggtaaaaaaatctgcggcctcctttagaaaatttcagaacattactttgaaaagggaaaaatagtgcctaaaatgctaatacttattttttagggaaaaaaagggtattaaagttcataaactatgctacccccaaacaataaaaacctcagacatttaggaatagttattgtgagtttttagtacatttattcctaatctcagtgagttagaaataaagttctttaaagctaatagtaacccttgagcatatatatgtgtatatatatgaaagaaagcgggatatatatatatatatatgttatatatataatgaatataaatacaatgtataaaaaccacccataagactatatatatatatagtttttattctagaaaccataaaagtagtttcatattttgatgctaaaacgaaaaccattgataattcctatgcattagctatttttaccttctcatgatgataatacttgaaacattgcaatatagatctcagtaataaaataactgataaatatggtcttttcattttagccacgtactaaatgaactgatacagactgagagagtttatgttcgagaactgtatactgttttgttggtaagcgactcaaattgtatttgccctatcttttcccgaatgatcccttgctacattcattagaaagtgtttaggggcaatcttctacttccgtctccttccttggttgtcatatggcagcagtgggcatttcttttattgtttgatgcagcatgtcggttaaacgtgcacattcaggctctccctcagtaatgggaatgattgattcagaatttattacagaagagaaaatgttctcttagggatacagccgattgttacaattattcccagggtgctatttagagatcgtgatgtaaaaaactgagaatgggataaaatattcttttgacaaaaatgtcatgatattaatttggtctgaaaaaacctaagcacgtattgccaatttaaggagaagctgatgacctgtagtctatgtttttatcttggtttctatcttgtttcctacactacaagctactctgaaggccaaagagctattactttattctgcctatttgattggaaaacttgacttcctttccttgccctgccttctaaaaaaaaaaaaaaaaaagtcatggataactttgggaagtaggagatttgaattgaattaaaattgaaataaaattcaaaaaacttcaccatcaaatcccttaatattctgctgtacctacaccattagtagcccaaccaaatgtgcatgtaattattttaaaatgcatgaatgtatttattttgggtagggttatagagcggagatggataatccagagatgtttgatcttatgccacctctcctgagaaataaaaaggacattctctttggaaacatggcagaaatatatgaattccataacgagtatgtaattgctgaattgaatatttattttttataaaactatttaaagtgctctctttaccagtttattatatttcacataaaatcatgcaattttttttctctgaaattttcacagcattttcttgagcagcctggaaaattgtgctcatgctccagaaagagtgggaccttgtttcctggaaagggttagttaaattattttttaaatatatataaatatgcaccaccaaaatagcaactcacttataagaacagatttggagacaagataggtactttatgtctttatgtttttggagaggacacattactccagcaagtatttaataccaaaccaagttttgctgcagaaatggatgcactgggatatccagagcataaaaataccccttccattctgtggtatcaaatgcttcagtggctcagctcttgaacactgactcctgggtaatcctagtaatccagggaccatcctgactatgaagatgtaagagttgggatcatgataacaaaaccatctggggcttggttaatttttttttttttgcctaaaaaacaccttattatttatattatttgtcttattaaaatacatgtaaagttttagaattggatctagtctgactttcagccatcaaggcatctatcacaggaacttcacagaaacagagagctgtcagttcttttcattcaacaaaagcatttagggaggcccattcctctgtgtcccaagtatggttaatacaattgacttcccaggttagtgatcatactctcctccattagttttcttttagaatattttttgtgtatgcttctctgcttatgcagtttctcttcttcctgaaagatcagttttgtcttgatttaagagttaattcaatagaggtgattgttgaaagcttcaaaatagatgtcttatcccagaaagtgtttatgaaatgagaagagaataaggataagaaagaactgtgtgtcaaccttgctcaacgtgttctaactttatttattttatttttttatttttatttttgagacagtctcactctgtcacccaggctggagttcagtggtgtgatctcggctcactgcaacctccacgtcccgggttcacaccattctcctgcctcagcctcccgagtagctgggactacaggtgcccaccaccacgcccagctaattttttgtatttttagtagagacggggtttcaccgtgttagcgaggatggtctcgatctcctgacctcgtgatctgcccacctcagcctcccaaagtgttgggattacaggcgtgagccaccgtgtccggctaagatgttctaactttaagcatatttaaattatgaccaaattctttcccaacctcatcaagcaatagcagtttatccttcctttagactccatagtatgtaatgtctatcctactcatgggagattttatatttactgtgcttgtgcacctttacatatatacgtgaattttctcccaaacttaatggacagcccttagaacgagagtccatatcctatatattgttgtatctctcattgggttagcagcgttcttagcaaccagttgtggtttaataaatgtttattgatgaattgtttatttattcaacaaccatttactggtcacctactatgcaccaagcattgtgccagataatgtggataccaagcccaaatctatttagatataaaaacagggaaattattaattgtgtagaagatgagttgcattagatttgaaatatacaaatggtcctgggaaaatccagaagaggggcgtcttgcatagaatgggggtataaacaatggttgtatagaagagataactcatgagataaatgttaaataatgagtaggaggtagcccattcatgagggtcagagaaagaggattccagggaaagagaattgcataagtgcctaaatggattatgctacagtgataaagtcccagtgatgaacctaggactgtaggctctaacttggaagtcagctacaagttcattcactagggaatcaagagactaataacagaatatatttcttggcagcctattagttcatcgttatgcaaaaagtaggtttttatagttcagacagagaagcctccatctaagcctcaagcttggcaagtggaagctctgatattacttagataattatgtgtcctcccaccagatgcaatgggcatgctgttcttggaatataaaaaaggcttttgaccagctgctagtacagtaggccctttaggccacatttcctaggatgcttggttacactcttgtttagcctttcttgatggcaaaagtcatattcacaaattagtaatacatttgaatttgttttttatcacagaaggatgattttcagatgtatgcaaaatattgtcagaataagcccagatcagaaacaatttggaggaagtattcagaatgcgcatttttccaggtacagtaattattcaagtattggatatattctttctggaagatattgcggtatttcttaattataaattcattttctactttaagtacgttacatgtgcatatacgtatatgagttaaagagcaaatccaccctcccccccaacacacacaaacacatttgtaacttcccagaggcaaacactttcagcacttttagctacatcctttggtatttacctccatagctccaaatgacatgcttatctttatcctttatactatggaagatgaagatttagctctctttcacgcccctccacccacccaactaccacatatacaaatatacttcttttctttcaaaatctccactatagtcatatcgtaattttggttagattgatatacagtattaaattaagactacgtaatttctttgctcagatgaatcatgtggtataatagggttgcttttcctacccttctgtttgtcttgcagtggtttttttactcagttttctagatacttatcgttattctaccccaacctctcccagatgtgggagttacaaaaatctcttcttattacatttaaacacattctattttctctgaatttcatattcttaaagaaatatctcctggggttttctgtcttgcttgtctagactcactaggcttgttgcgcagctgtcatctggggatcttggtgaacataatttttggaattctcctcacctgtctattgcataggctctcctcattcctaggtgccatgtctttatttttcttgtttacctcccttgtttggtggaacacatcctccagtagttttcccaagaaagtgtacacagtacataaaagtttttgagagtgtatgtgtctgcaaatatctttattctaccctaagacttcattgctagtttggctgtgtatagaattctaggtaagaaataattatactcagaattttgaaggtattgcttgattgtcttctagcttccagtgttgctattcagaaatctgatgccattttaattgttgttcctttgtaggtgacttagtttctgtcctctgaaagcttatgaaaacttattttcagtgttcaaatgttggcactatttttatccattatgctagtattagggtgataactttgaatttggaacctcctgtacaaatttacttggaggttttctttgatttcctccacccaattgtctccattttctctttttggaatttctgttgtacggatattggatatcctggactggtcctctaattatcttatcttttctattttccattctttgtcttattactctactttctagttcttccattgaggtttccatttctgccattgtgtttttaattttgaagagccctcatccttttactgttttttcaatgtttcttttaatagaattctattttcattttatgaattcagtatcttcattcatctatacaaagatgataatagatttttcttttaaaaatggctttcttctccctgcacatcttctgttgtcttcactttgctttttttcttctatttctctttgtttggttcctattacccatgtttgatgctctcctcaaatgtctggtgatacttgtctgtccacttacattaggagtaaacactaaaaagctcattggaagtttccagggcatatgtgggtttattgaccatgatcctcattgttgagttatttgtctcaagctatttgcttgaagggattcccaaatacctgtatctttagagcatttctattaggctggtcagattccttgaactgctaccttgtgtataatgatctggatgctagtgttgtggtagcagagttgggagaaaaggctgagggtcacttgtttgagatataacatggagagtacttgaatatttttcaatatggtactctgccctaagttgaaccttgtatcctttggtccatagggcctgtgttttactctttctagataaacatccatttttctgccaaaggaagggaagagaaggcacccagctgtgcaaagtggtgtggttatctgagagccttattgcttttgtttagattttcatgccatttattttcttcttgtaacagctttattgagctataactaaaatgccatcagttcgcccttttaaagtatacaattcagtggttttactagattcacaaggttgtacaaccatgtttttatcactaaaaagaaaccagtcttaccctcccttttttccccaatctaagcagccctaggcaatcactaatctgcatcctgtcttcaatagatttgcctattctggacatttcatataaatggaatcatacaatatgtggtcttttgtgtttgacttctttctttcatttagcataatagtttagtggttcgtccatgttgtagcatgtattagttttttattcctatttatggttgaataatattccattatatggatgtatagcattttatttatccattcattgattgatgcacatttggcttgtttctaccttttgattattatgaacaatgctgctgagaatgcttttgcataagtttttctgtagacatatattttcattcctcttggctatacacctgggagtgaaagtgctggatcatatagtaactctacatttaactttttgagaaactgctggactcttttccaaagttactgcaccgttttgcatttccaacagcagtgtatgagggtattaattgctccatatcctcaccaacacttgttattatctaattacttcttaaaaagactttcaacaagcatcctttcttgaaccgcacctttacctcccactttcagaggtacttggtgtctataatccctgagactttgtggagggcagggaagagatgtttataacataaattgagttgttccttggctttttcctccaccaacttgaaatccacttttctccagtgtgcttggttgttgaccacttctaagtttggtttccagtttccaaattttgcggaagttttccccttgcttatcttcttcataactttgtgattttgcctagtaaaataacttttccatcattttagttggttgtcatgagtgaggagatctaaacgcatgtatcaagttggtgcaaaagttactgtggtttttgccactgaaagtaatggcaaaaaccacaatcacttttgcaccaacctaatagcagtcccccatctttaagtctcatttgaattagattgtatgttggattttacccatattcagaggagagccatggttcttattcaggcgtatttttccccaatccctttgtgttctatactttctctatgcacatttcatcctaaatatctgcatcttgccctaactatgggcccctacaatgttcccggaacccaacatcatgacccttatatttatagtggcaatgggccaattactgaagtatagcaccagttgatgatggctttttcttgttatattaaaaattttgttctcatatccagtctgatttatattcagcacaaccaatttcttttctgagccttggcttgtagagcttggtctttcgtgaattttcttgaatatattaaagaacgttttaatcatgttaatctatagtcattccctgctttcacaccttttaagcattccacatcaatatgaatttatatttgaaaacttttaaatctttgaaatgttgaaattgtttacctctccaatccttgaaatagtgtttatggtagtttttcagatatattgtgtcttataatttctgtactataacagtgatttttccaataaatattctttgagatgtaagaaacattggggcattaggtttaatcaatgaacacttggcattttcacaggtacatgtcttaatttaattttattgatatttatcttttaatgacaggaatgtcaaagaaagttaaaacacagacttagactggattcctatttactcaaaccagtgcaacgaatcactaaatatcagttattgttgaaggtaattatatgaagcatttgtttgtttctttactttttgagtcagatatgacagagccattaaaaaggaaatagtttactaggaagcactagaaataggtaggctcaatgactgggaaggctggatttggcagaattttgcagtgtgctccatcaattcactgtggctacaaatgccataggcatagatatcaggctgagaatatctgggatcttagctatttaatttttcatacaagttgtgttgatttccgcacaatgttttactgaagaactttaaatattagtaagaagaactaaacaaagcaaatatttcttatagttttgaggctgcatttcataggggccttcctaatgaaaaatgcgaatggcactcccctagtataatgcgaaaggattgctagaatcttgtgttaagtataaatacaatatggcttgttttaaagtgaattttcataatattctatgctatatgcattatgagtgcatcatggctaaaacaaattactgtatgtagaggacaaaagaaccctacatgtaatggctttaaaaattgatctctgatgtgtcttaatagctattatacttcaactccagaagcattaaatgtcctttgttttatactattcagtcactattctacttcctctattttgacagccattaaaaatattactgcagcaaagggcatgtaaaaggaattactccaaaatgtgacattatatttggattccagcttgaaagcatgttagccaaaaacttattcatttcaaccagatattaatatctgcctaatattaattcctgatttctaattacaggagctattaaaatatagcaaagactgtgaaggatctgctctgttgaagaaggcactcgatgcaatgctggatttactgaagtcagttaatgattctatgcatcagattgcaataaatggctatattgtaagcacattttaataattgttggaattttagagggtcggcatctcaacatcccttttcccctcctggaaccaattgagaaataacgtataagaatcagataactggagatcaaaatgttgatgttactactgataatgctaagtggagaattggcttcagatcagcagccaaatggatttatgagatcccccttgtccccaacagtcttcccccaatcccagacctgggagatcctgcttaaggaatgtttgagtcagctaagaaaacgtattgctccataattgctgcttgcccctgtagataggaatagataggaaagaaaagaatcaaatctttagcacttgtgtagccttttaacaggttagctccacccagtgggaaaacttgaactggtatatatcatgcaccaatcaggattgaagaagagatggggagacttaccctagctgaaatacctccagatgatatgaagccagagaaaaggaagtttcttttgtcccccacccccacagtaattttgtacttatgtggtgcatgccatgttttaacatacaaagttaagtttttaaaaaaacataaattattcttcagggtttgagtagcttaagctgaaccctaacatgttggtgtcagagagctgaatgtagctttgctttctactaatgggttttgattttccattctagggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaagtaagacaatttgtatcgggtaatgtagtattgtttcgtgtgtgtgtgtctcccagtttgtacattttttttgtttcaaatgagtaggttttatactttcgctgcacatctttgttttttttaaaaaatcttaagtcttatgtagaagtcagatgaatcataacttctctgcttgaagtgaaggtgaggtaattcagagctttgattcctccctttcttctcactacgatcctaggtattccccaagggggctccctagcgtcctgaagagcacagtttgaaatgataaggagtgtcccagcctcctcataagcactctctttcgagtgacactgggtggagttcttggtcttgttagaaaggagccttatgctacaggagagacagggaggaaagagtttcctccttttcctcaatgcaatttaaaaatgggtaacttttgtgtttagcatgtccccaccttcctttctgtgttcctcctccactccctagctccaccctacctgggtgttcaaagccacctatagctgaatcctttccttatctgtcctgttccgtctttcaaaattactttattctctcctataaacaaaatccccattttgtcctaatattagtttgttattaaaaagagaacagtattgtttggggaagttattgacaacccaatgatacttacagctggtttctccaatagagaagaagaacttccaattcacatgagacccataattgacaaatttgaatttttttacatctaatgcatttcatcttttgaattttaaatttttttttattttttatttttttattttattattattatactttaagttttagggtacatgtgcacaatgtgcaggttagttacatatgtatacatgtgccacgctggtgtgctgcacccattaactcatcatttagcattaggtatatctcctaaagctatccctcccccctccccccaccccacaacagtccccggagtgtgatgttccccttcctgtgtccatgtgttctcattgttcaattcccacctatgagtgagaagatgtggtgtttggttttttgttcttgcgatagtttactgagaatgatgatttccaatttcatccatgtccctacaaaggacatgaactcatcatattttatggctgcatagtattccatggtgtatatgtgccacattttcttaatccagtctatcattgttggacatttgggttgattccaagtctttgctattgtgaatagtgctgcaataaatacatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccactaacagtgtaaaagtgttcctatttctccacatcctctccagcacctgttgtttcctgactttttaatgattgccattctaactggtgtgagatgatatctcattgtggttttgatttgcatttctctgatggccagtgatggtgagcattttgtcatgtgttttttggctgcataaatgtcttcttttgagaagtgtctgttcatgtccttcgcccactttttgatggggttatttgtttttttcttgtaaatttgtttgaattcattgtagattctggatattagccctttgtcaggtgagtaggttgcgaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctaggatttttatagttttaggtctaacatttaagtcttcaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagtgctctgttctgttccattgatctatatctctgttttggcaccagtaccatgctgttttggttagtgtagccttgtagtatagtttgaagtcaggtagcgtgatgcctccagctttgttcttttggcttaggattgacttggcggtgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttctttatatcctcttttatttcattgagcagtggtttgtagttctccttgaagaggtccttcatgtcccttgtaagttggattcctaggtattttattctctttgtagcaattgtgaatgggagttcattcatgatttggctctctgtttgtctgttattggtgtataagaatgcttgtgatttttgtacattgattttgtatcctgagactttgctgaagttgcttatcagcttaaggagattttgggctgagacaatggggttttctagatataatatttctattgagataatcatgtggtttttgtgtttggttctgtttatatgctggattacatttatcgatttgcgtatattgaaccagccttgcatcccagggatgaagcccgcttgatcatggtggataagctttttgatgtgctgctggattcggtttgccagtattttattgaagatttttgcatcaatgttcatcaaggatattggtctaaaattctcttttttggttgtgtctctgcccggctttggtatcaggatgatgctggcctcataaaatgagttagggaggattccttctttttctattgattggaatagtttcagaaggaatggtaccagttcctccttgtacctctggtagaattcggctgtgaatccatctggtcctgggctctttttggttggtaagctattgattattgccccaatttcagagcctgttattggtctattcagagattcaggagctggttttttgaaaggatcaacaaaattgataaactgctagcaagactaataaagaagaaaagagagaagaatcaaatagacgcaataaaaaatgataaaggggatatcactaccaatcccacagaaatacaaactaccatcagagaatactataaacacctctatgcaaataaactagaaaatctagaagaaatggataaattccttgaattttaaattctaaaaccaatataacatttgtcacaaaaaatttcaaaaatagagaaaacgattgtccttaattccccaaccactatcatgttagttacttttcatgagcatgttctttcatagttctcatcaccagtatatttgacaattgatgaaattttcagtagcagttataaagaggacaggcaatatgttttgagacaggcatgaggtatttgtattaggagactacctgtaagcaggccttgcttttgattcttcccataggatcagcagcccctagttgttcccaacaaggttcctgcccagggtcgggtcaaaaagaagtagttcttcctattgtgtattttccctgcttcactctgaacccacagcagcttctttaaaactcttggtttcgtcacaaagggccagttgctcctttgattttagcagtccacctctaagcccccaaatctcaaagggccttctaagtaattaataaacatagattgagaaccataaatttgtaatccatgtcagagagggttcaaatctcttgctgtctgtatacctattccttgggaaggtactttaccttcataggcatatttgacccaaatgcatttgatgtacattttatcatgaggtgacctaatttctacctaatatagtatttctatttcatattaattttctattttacctttaatttgttacaatgatggacatgccaacaaaatgtttcttgagtacattaaagtaagggggatattaggtgattaagtcatgaaaactgaaactgcaataggtaccatggaaacagagaaggtgggatagattcaagaaacatttcaatagaaggtagacagatgggcttgatgacttactagctacaaaaattaaataatacctgacattgaaggaagaaaatctttctgattcttctttggttccccagtaatgccaagtatccttaataaacaatattagccagtgatgcctacaaggctttagaccaggattacttggaaaatggtgataccactaaaaattaggatatttcttagggttcactacgctcacttctgcttgcctgcttatcatgagattccagcattaagcaattgctagcattcctagtcaatgtgttatttaagaatctgggttattagtttcacagtcttacccttggtagagaggatcattgcagatattccactgctgaaccttctctctcacttttttttttaacttttattttagattcagggggtacatctgcaggtttgttacctggctgtattgcatgatgtttaggtttggggcacaaatatcccatcacccaggtactgagcattgtccccaagagttagttttccaacccttgtccctctccctccgtccctcctctggtagtccccagtgtctgttgttgcctttgtctatgtctctcactttaaatgaactcttgttttgactgcaccatacaaagctgggatcccatggcctgaccatgtactttctaattatttatatgttatattttaagttggctgcttatatgcaaggaaaggccctatctaaagtcaaagttgaccagatggggagattcgagtccttcagattccttagttcatgtgtttattatcatcgatttttaaaaattttacaaattgcacatagtccttactatgtgcaacacataatggttagatttccagggcaacttagaaaagttcacttaattgataatgatgtactatatgtttgcaataaaaaaataacaaaacaattgcaacttaaataggggaaagagtagaaagcaaactcacactttagaaagctcattataggatctaagcatttactccatgctatttagtccttatatcaaccctatgaaataggtgttctttctattttatagttgaggaaactgaagtttagaaaagttaagcaacttgcaccaagacacatagctagtgaatggtagagatgtattccaatccagacctctctaacttcaaagcctgtgggccttccagcttatcatgttattaagacaaaaccatgtaatgaaacaaaattaatttttaaaaatattgaatatgagattactattcatcttaaattgtgatatttgagcagaagtaggttagttggaatgatggagtgagaatataaagatagtttgggacattgtgaaaataacttcttactacgttcagggtggatgttacaggttctttcattaatatgttatgttaaattacatttctaagcataagtgcttttcttctccttggtatggcgatctccctagcactatctttaatgcttattagctctaataagggccatttggggggctcataactagaacagagagtgagatactcctttagataattaggttaagaattgaaagaaaagaggaaggcagaaaggaactaaaagaatgtttgtgcaaaggagtgagattgcccaaaatgcaattagccaagctgttagcagaaaatgatgaaagaaaatggaagagtttatgacttgcacaatcacgctgaggaaaagaaaaaattgtggtaaggaataaggaagagatattgtgtacagaagtttcactgggtacaaaaagacaacaatgtcccattacatattattattattattttttttttagaaaggccaagggattggtggaaaatagagagatccttgtgtacctggctggttctctcctgtcccatgaattagatgtttataacttgtaggacttctatcaaaataaattataatttgtaggattaagtggtctgtcaaatgattattctaaataactatttaaattaattttcagtggcttttctttattgatgtttaatgacttctgtgtttgactcaataatttgttttaatagtgtactattaatttataacataattagatcttagatgggctacttggatgttcagatttataacatttgtgtcaaccactgaaatgaagcgtgcaatctgaactataaagtgcatagttcaatgaaaacatttaaatactctcgtctatgattgtaattactatttcatattcatttaatataacatgtatttttctgcccaagagaaattctgtttcacttagaatatgatagggtagatttaatgtaatttcatattcaaaataaaatgctcatgaaaattttgacttatttattatagatggatgaagttggaatcactgaatatgtaaaaggtgataaccgcaagtttgaaatctggtatggtgaaaaggaagaagtttatattgtccaggttggtcatttgaaaattcttctagaaacccaaacctgcattgaaatacaaaagcccgaatttataaacaaaaataattttggtcgcatttcaaaatttccacccctttcatgtaggtcagttaaatattatttgaatattctttgtgatgtatttaaatgttttctagtagttacattgagatatgcctgtggtgttctctagggcttcaagttttcacaactacataagagacttatcaactagagctgacagcttggcaggtacttctctgtccccatcaaatttccaagttatggaattataatagttctgagttcctcttatgctaagcattctaggggtacctgattatgagacatggggatgtgacagttcagacttgctttctgcttctaaagaacatggttaaagccctggccagttgtatagggtccaacatgtttcagggaagggaagaggaatcagaacatttcaagaggatgttgtcattgcaataaatatttgtatctggagttgtcaatgtgctgttatctgttaaaaatgctcagtgttttttgtttgttgtaattctttactaggtgactgcaatctataaaaatatgttttcttggcttgcttaagatataatatttggtatcatttaacaaacatcttgtaagtgatgggaggatatttaaggaggatttcatgttaccatcagtcaccaaggttattctgcaatagatggccttttcagaaatagtagagcttgttttattttactaaaattaaacatcaaaatgttatattttaaaaagaatcctcctgtaaagacaaaataagtgaaattatatttcacagtttcatccaagcattattttaccattatttaagggcaatttcaaaatggattttttttttttgagacagcgtctcaccctgttgctcaggctggagtgcagtggtgtgatctcggctcacttcaacctctgcctcccaggctcaagcgattctcccacctcaccctctcaagtagctgggactacaggcacatgccaccacacctggctaattattattattattattagtagtagtagtagtagtagagatggggtttccctatgttccccaggctggtctcaaactcctgggctcaagagatctgcccaccttggcctcccaaagtcctgggattacagcaaaaatggttctgactgtattatttcatctaatctgatagcaaattatttgcttcataaaaattttaacaatcaaacggttaagatttgagtatggtgttatagggagtagatcatattttatgtacacaattacatttgttttattatagtacatcctttttaaaaggaaatgtgtaccacctccctcccgctttttttttaatctttaggcttctaatgtagatgtgaagatgacgtggctaaaagaaataagaaatattttgttgaagcagcaggaacttttgacaggtaaattcaagcctgcattcttcagaacaagaagtatagtaacagcttattgactcagatttttaaattatttttccagagaatggggctgatatttactttatactattacaatgagaagatttgttaatttaattagtaggagattgagattcagaggattgtttaaactattttgaagaatgaactttacactagaaaatgaacccttgtgcttaagaagcagttgagaagcaacacagtgaactgattgtggtaatccccagtcctttccatgaggtgactctgcttaatatctcgagtaatcattgctctataatgatggaatgggagccagttctacttctaaacttgaacttcttgaataaaatattatatggtccagacctttccaaattcaaacttgagactggccttccctctgattatttcaagtctgtgaagcttaagtctaatggcaaggatgcgtgtgtgtgtgtgtgtgtgtgtgtgagagagagaaagtcattggccttcaaggaagtaagaagtgtgacttctgaatgataatatgctttgttttatttctcagttaaaaaaagaaagcaacaggatcaattaacagaacgggataagtttcagatttctcttcagcagaatgatgagtaagtgattattctttaagaaataccactcctgcaatcttttgttttctgtatgtaacatgaagcaatgtaattaaagtatctctgacaagaaccatccaccaatttagcaataactcatcaaattccataaacatcattttctgaggtccagccttatactggaggctgatagttcttaatagttatcccttgggttgatttctaaacatgattgaaaatgctttatttttaatatatcattggaagaattacatgtaggctgacaggaaaggaggctgtgctcataagctttttttttcaaagtatttttggtcacctttgatctgactggaaaaagagggttgtaagaatatgggaatagagcaaatgaaggactggctcacagttttacagtcccttgatggggacctcttgctggtgatttggcctctctctacatagagagaaggtatggatcctgggagggaactgagcctggacacaaccaggagtcattaaggaagcctctagaaattccaaaaggtggagttctcgctgaacatttgcatatatacagaaagaattctctcattgattctgaaggcctggcacagagattcaccacacagcatctgcttgctgtggtgatcattgaatgacttattagaaatactgttttttccttcgctgcatgtcatctttctgaggtagctaaaatcagatgaaacatatggtggttcacgtggagatttaggagaaccatttaaaagttgcagataaagtctttatctttcagagttcaaaaagctccatcttttatcgtacattataggagtaacatctttaggttttatgcagtaattgacttaatagtagctggtacatactcaacaatatgaatcagttgaaggtttcatcttcatttatatacaacaacttacctaattcattaatgttataagtccacagagcaacggggattgtatacaatacccttactttgggtctagaagggagtagtttttctccttacataatagagaacctgctggcttggatctgagatttaagcttttgtatattataacctattgccacacagatttaaatagggagtattggctgtttggatggattctcagcatgttcttaacacttggtatcaatggaagaaataccactttaaatttctttttacttgtaaactgtacaaaagctcacttagttttatacatcactatttcagaaagcaacagggagcttttataagtactgaggaaactgaattggaacacaccagcactgtggtggaggtctgtgaggcaattgcgtcagttcaggcagaagcaaatacaggtatgtgtcatggtcatcttaagacgagactcatgggtgtgcaaatttttacctcgtattattaatttggaaatctacccacttggtatttttgtataaacaaaatacagttaacccatttttataaggctctcatgtcttgcatatgcaggacactctgatgggcactagagagtattggttgtcaaagtgtggtccctggaccactagaatcaacatcacctggaaacttttacagaagacaaattctcttgctctattcagaccttctggatcagaaactctgggaacaaggcccagccacttgagttttaacaggctctctctgtgattttgatgcatggtcaagtttgggaacccctgctataaaggatatagtgatgaataaaacatatatactggcttcaaggaatgcgcatttcacttaccgttggtttaatgaatagagaagagtcattaacagccgaaatatttattcttcctctgtgaatggttttatttgaagtgattttaaatactttatttaattcaacaaatattgacatagcatgatctgcattccaggagttatgcaaagtgctaggcatatagtctaactaggatacactcagctgccatcctcatgaagctaggagaatagaaagatagttaaacaagcaattaaaagtaaatttggcgagtgttacagcagggaagtacgaagtgctgtagaagcatacatgaggatcacctaaacaactctaggatcaacagcatagacttctttggagaaatgcctaacagagtgcctgatactcaacactttaatatgatgatccttaatatggaagagttctctactggttgaggagaaaaaggtaatgatagccttgtagagtttccatttatccaattaaaggtcacttccctcaggtcatctatgctgtggcccccaaagaagtaaggagagagcatagtactaatgccttcatttgacaggtgaggaaaccaagttagaaaaagatgacaatgacttttcccaggttgcatgaatagtttaatgtggccaggatgagatctgttaatttgctgcttacattagattggttaatccatttttttaaattcaactttttaaaggattacagctagttttacttctcaccttgtggtaaattagcaccatgaagtaactgccacattccacacttttcttatagtttggactgaggcatcacaatctgcagaaatctctgaagaacctgcggaatggtcaagcaactatttctaccctacttatgatgaaaatgaagaagaaaataggcccctcatggttagtaataatatagtaaattaaaattattgaggcagttttactgatgaaatataggtggagcacataggggcaatcttttgtcagcatccttgaggccattaggagtaagccattgctaaaatagttgaaataaatcttattatgaacatcaggaagcacttctgtctttaagtagaacctgtttgacctatacatagagcttctgctgatgttgatgaaatagatagtcaatctttccaaatctctaaaatcccagttttatctttagtagagcttcaccactgtgttttccatccaggcatgtgaaataaaatcagagaacaaaggggcttcaaatacactttaaaaaccagtttggattccagattagaaaataaaggaaataagcattatacattaaaaacgatttaataacatctgggggatatattttagtgtgttctcaaaaatacactaatgatataaaatctcagcatattagagcaagggagcaccctgtaaaattaaaggaggttgctttaaggttaaagtgtttatagaaggaatagtttgcaagttggtaggataccagtgggctattaaagaggaggtaggactgtttgggagtaaatccctacttttctaaagtcaccagcttggaaggtaggagtgatgcttggaggtagagtgctccttggtgcccttcagaggaatcaattacatttggcagttctactgttagtataagagggtaaacctcgtctctactaaaaatacaaaattaggcggttgtggtggcgcatgcctgtaatcccagctattcaggaggctgaggcaggagaatcgcttgaacccaggaggtgcaggttgcagtgagctgagatagtgcccttgcactccagcctgggcaacaagagcgaaactctgtctcaaaaaaaaaaaaaaaaaaaaaaaaggataatggcatggataatcacaaagctgtacagcattgactctgaaatgcagtctttaaaaaagtagatattgtttctcctaatactatgatgaccataatacatatttgtgtgatagtttaccgtttcccaaatgatttctcaattaatattcacagtattagtatgaaaaagagcgggctttattaccttcaatttacagaggaggaaactgagacttagatctggtaagatatttgtccagagttaattgtctatacctgcagttcccaaactttttaatgaaagaagcctttacatccttgaaaattgaaaaccccaaagaactcttgtttatgtaggttatatcttttaaaaaatactttcaacttttattttagattcaggaggtacatgtgtaaggttttgttacatgggaatactgcgtgatgctgagatttggagtatgaatggtcctgtcacccaggtagtgagcatagtacccaacatgtagtttttcagcccttctgccaaccctctttcctccctctagtagtccccagtgttcattgtgcccatctttgtgtccacgtgtacccaatgcttagcccccacttataagtgagaacacgtggtatttggttttctgttcctgcgttaatttgcttaggataacggtttccagctgcatccaccttgctgcaaaggacatgattgcatttctttttatggctgcagagtattccatggtatataggttacatctattgatatttaccatgtgataaaactaagaaatacaaaattttgaatgtaataattgtttaaaaatattaataaacccattgtaagtttatatcaataagatttttgtttaaaaagttacatttttcaaaataaaaatcagtgagaagactgatttaaatacttaaatacttacaaaagaaatacttttgtaaatcactttaacttctggctcagtaaaaggtgaattctcatatccacttttgcattcaatttgttgtgctaccatacacctagtatcctctagaaaactccactgtgtacttgtgagaggatgagagtgaaaaaggcaaatagtgtcttaatgtaggttgaccttgcagaccccttgaaagggtctcaggaacccacaacagtctgtctcccacactttgggaatctcaggcttagactaataataaaaagaagtttaatttctttaattaatgttagctggggatggaatggatagtagtagttgttaaatgcgagcaaaaagtcagaggaagccagtttgtgtttaaccgtttgctgtagatgatctatgaaggcattgtaaagaactcagttttaagtaggcatttttttttctagctatggtatcagaagataaagtaaatatgcaaaattgaagaatgctttaatcacagaggatgggaatatagaaaaacctattagtttctctctctttgtccaataattctctgagatgtgctactaaggaaaacatataaaagagcaacacaatgtattccatacacccttcttccctgccaaaacaagaagctggaatgacctgctcttttggcttcacttggtcaagttgtaaactgagcaataatgggtgctgcttcccttgtagagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagtttattaatgaattaagtcaaaattacggctgcaaaatggctaaggtcaagtaaagcacaacattatgatttaatatgcttttgttgaaaccacagcttttgtgcccattgttttaacttgtgtgaaacaatacaaagcccagaaattcttttcggggcatgagtaaattttgttcagggctactgtctgtatgtgcccagataaaattttcatgagagtagtttacaaaagccgtatttaaaagttaatattttcacactttttttctggatttctgcttataattaatgtaacttaaattagttgtgctctgctattttctgtatatttcatgttgtaattctttttttcaaataaaaattaattcttcaggt

SEQ ID NO: 3906 - DNA, 126445 bp, human
catgttaagagcaagaaggcttttgttcttggagcaggcagagagtattgtacattcttttggccgaggaaacagaatgagctgcgacagtcttaaggacaaacatttgtggtaagtatttctttaccttagagtaatataagaaatggattggggcaatgagtgggtcagtcttggaatatttttatagatagcatcccccatagccagtcattttcattcttgtagtagtttccccttttccccagaatcccccatttctaggaccaatgatttgcaggacacagtgcagttcttgtaaaggtgtatctgtccatacagaccgcaatagcctgctttgggtttctctgacagttctttgtctactgttcagttttttctaaaataattaggattcccaagtaaaggcaggtgggaatttctcaactctggattagaacttcaccactgtaaacctggaactattagtataacaaatctggtgtgcacctgggcttcatgggatggctgtaccttggtgtggttcctatgcaatgtatgggcctcagtctctgagccgtctagggattaggacttgagaaattgccttgtgaacttgcatatggttggcttataaatttggacagcagattatttattttcagtgggtaaaagaccattccattatttgtgtccagttctttttaagcacgcaaattttccagaccaagaagaactaccttggtccccagaaggtagccggggggatgtagacttggagagcaaagaaaaatgggaggtcttgagggcaatcttccaaaagaatatggtgatgtttctcacattttttaaagcagggtctctagtgaggcaaaaccacattttattcttgcctctatagtatttatttgtggaggtagaaagtttctggggaaggagtgggactgtttatatgaagaacctagaggtcttctcagaatgaaaggattggaaactccaaccctttttttctctgatatgcaaggttcttgaaagttgcttgaggggcccaaaaagatcctaaggaaaactcaccaaacttggtgagaaagaggtagaaagggatgggagcagctccctcccagagccctccatccttcttttttcatctgagctggttactctgccggctagctgcacatctctttctgaaattccctttgtctgtgctcctgtatcggatcattatttcctagattcattgtcttgctcttcattgatgtacttcatcatttttttggggaatacattctctactaacttctttatatgggttataaacttttattaataataataataataataattatgtctgaaaatatcttagacaacctttatttttgtttgagagtctgacgcagtataaagttccaagctgaaaaaccttttcccccctgattttgtgtttatttttccattagtttgtagaatccagtgttgctattgagaagttcaatgtcattttgtttcattttttttcaactttaattttagataagggggtacatgtgcagatttgtcatatgggaatattacatgatgctgaggcttaaggtacagatcctgtcatcctggtagtgagcatagtacccaatagttgtttttttttttatcctccccacctccctgcaccctctagtagtccacaatatctgttgttcccatattaatgtccatgtgtgctcaatgcttagctcccttcataaatgagaacatgtggtatttggttttctgttcctgcactaacttgcttagaattatggcctccagctccgtgcatgttgctgcaaagaatgatttctttcttttttatggctgcctagtattccataatgtatatgtagcacattttctttatcccatttaccactgatgggaacctgggttgactccatgtctttgctattgtgaacagtgcagtgatgaacatacaagtgcatgtgtctttttggtagaataatttcttttgggtacatacccagtaatgggattgctgtgtccagtggtagaattgttttaagttctttcagaaatctccagactgctttccacagcggctggactaatttacatttccaccaacagtgtataagtgtttgcttttctctgctgccttgccagccagcatctgttgttttttgactttttagtaatagccattctgactggtgtgagatggtatctcattgtggttttgatttgcatttctctgatgatagtgatgctgagtattgtttcatatatttgttggccatttgtatgtcttctttcgaaaagtgcctgttcatgtcatttgcccactttttaatggtgttatttggtttttacttgttaattttttcaagttccctatagattctgagtattagacctttgtcagatacatagtttgcaaatatcttctcccattctgtaggttgtctgtttgctctgctgatagtttcttttgctgtacagaagctctttagtttaatgaggtcccactggtctatttctggttttattgcaattgcttttagggacttagccaaaaattctttaccaaggccaatgtcgaaaagagtatttcctaggttttcttccaggatttctatagtttgagatcttacattaaaatctttaatccatttttagttaatttttgcatatggagaaaggtatgggcccagcttcaatcttctgcatatggctagccagttatctcagcaccatttactgaatatggaattgttttcccactgcttgttttggttggccttgtcaaagatcagatggttgtagctgtgcagctttatttctgagttctctattctgttccattggtctatgtgtctgtttttgtaccactaccaagctgtctttatttgtttgtttgtttgtttttgagactgagtctcactctgtcgcctaggctggagtgcaatggtgtgatctcagctcactgcaacctatgcccctggattcaagcaattctcctgcctcagcctccccagtagctggaattacaggtgcccgccaccacgcctggctgatttgtgtatgttttagtagagatggggtttcaccatgttggccaggctggtttcaaactcctgacctcaagtgatctggccacctcagcctcccaaagtgctgggattacagatgtgagccactgtgcccagccacccaagttgttttgtttactgtggctttatagtgtagtttgaagttgggtagtgtgatgcctccgtctttgttctttttgctttggattgctttggttatttgggctcttttttggtttcatgtgaattttagaatagttttttttttttctaattgtgtgaagaatgccattagcagtttgataggaatagcactgaatctgtagattgctttgggcagtatggccatttttatgatattgattcttccaatccatgaacatggaatgtttttccatttatttgtgtcattcctgatttctttcatcagtgttttgtagttctctttgtggagacttttcacctccttggttaggtgtatttctaggtatttcattttctttgtggctgttgtgagtgagactgtgttctttatttttgtttaatttttcatttccacaggttattggggaactggtggtgttttgttacatgagtaagttctttagtggtgatttttgagattttggggactgtgttcttgatttcactctcagcctggatgttgttgatgcatagaaatggtactgatttttgtacattaattttgtatcctgcaactttacttaagctgtccaaatttataagccaatcatatgcaagttcacaaggcaatttctaggagccttttggcagcatctttaaaattttctaagtatagattcatatcatcaaggaaaagagattgtgtgacttcttttcatacgtggatgctttttatttctttctcttgcctgactgctctggctaggacttccagtactatgttgaataggagtggagagagggcatccttatcttgttctggttctcaaggtgaatggttccaaattttgcccattcgatatgatgtttactgtgggtttgtcataaatggctgttattattttgacgtatgtttttttttgatacctagtctgttgaggggttttatcatgaagggatgttggaagttattgaaagctttctctgtgcctattgatcctctgtaacagatttgcttctttccagctataaatatttaagttctctttcatgtctgtggtgtacttcaaaattcataaggatgtataccagtgtggttatttttgaataatctcattttgcatttgataggcccttttaatacaaatattcttgttcttcagttccagaaattttttttctatttcttctattatttctttgaaatatccttccccattttcccttgtgtgtgttttttgttttttgttggtttgtttgtttgtttgttttgacagagtctcgctctgtcactcaggctggagtgcaatggcacaatcttggctcactgcaacctccacctcctaggtttaagcaattctcctgcctcagcctcccaggtagctggtattacaggcacccgccatcatgcccagctaatttttgtatttttgtagagatggggtttcaccatgttggctaggctggtcttgaactcctgacctcaggtgacacccctcctcggcctgccaaattgctgggattacaggcatgagccaccgtgcccagcctatcctttcctattttctctgttctttttttctcctggattcctgtgtgatattggacctcctgaatttattcttcatgtctcttatctttttttctcactcaacactgagacaattccactatactttgctagaaactcaatttctcactctaaaataacaatttcacccttcccttgtatcctcaaatttcctacactcactcctctctcttctcctgatcactatcatctaatgacttcaattcatgacttagaagagaaaatagatacagaaggtgtattagggcacattactgggattaacacatgcagaagagcagggaagagaaggaagaaggcttcgtgacagaagcctcatgcaaccttacaagaagttctgaagattggataatttgccgcagtggtccccatttgggaccagggaactggcccctgataccccaagttgttcagtcatttaatgtgggatgcctttggaaggggctatgaccttggctaggtagctcttttcagctgaggcaatccctgaataaggctgacagccaaagacttatctggcagccttctcaacagatggggtaataagtccttcattcctgagggaggatccgaagggcacattacagtgtctaccacatcagctacctgcacctatcagtgttgtcctgatattggctcgaaccagctagtgagggccagctctgcacttcccttcccaattttgtattcagtgacattgtgttggtaacttaggacttttctgtggaagttttaaagtttcaccaatctttttcaggtctgaaagctctctttctttttctccaattgttctttgttcacagtattccgttattgtttatggattataataatgatttgaatctttcagtgtgtaaccaattagcattgtttttaaagttcactgttccctgaactacgtctgtttctttcagagattttttttccatttatcattccttccatatatcatctcttcaactcttaaaggaccaggcactgtgttaggtgatggggacacaatagtgaacaagacacgaatagatccttctttagttcataagcatgatgattgggttttcatgtacatgtgtgagatgtgcctccctcaaaacttgttacaacattggcacattacctgtctgacatgaagggaaaaaaagacgtaaagggttcctgttgtagacatttttttcttgtcacagaaaaaactagtaaatatacaaataaataatattatttaaggaagttgtcattgctatgaacgaacaaaattcagtggatggagcatatgggagtagggggatgtctgttttaaagaataggctgggaccatgtctctgctgtgatagtacttgaacagagacctgaatacaatctggatagcaggccaggtaaaccattgcagtgggaggcagccccaggggtgatagactctgagaaaagaacaagcactctgtgttccaggaacaccaagaaggccagcgcggttggagcaaagtgtacaaggttaagtttgacaaagcaggcagggcccagatcattttcactgtttgtcttggtcttcttttgcatttggtgacttctgtctgttggggttctacccgagaaacaagaactagtaaaatttgtacatgtatatgtagaatcttatgtgtgtgctttacatttgtgtatttgtgtatttttaaattgtgtattatatacattatatacatgcctgtataatctattgacagagtgagacacacagaggcagagaaagatagagacagagaaagggtgtttttgtagtaggtaggtggttatttcaagaaattgattttcaggatcatggggtgctggctaggcaagtttgaaatatataaagcaggccagcaggctggaaattctcaggcaggagttggcacttcagacttgaggcagaatttcttctccttcagggaaattttagttttgctgttaagaccttccaactgactgggtgagctatggttttcatggataatctcctttgtttaaagtcaactgactgtagaagttaatcatatctacaaaaaccttacagcgacacccagattagtgtttgattgattaattatagcctagccaagttgacacgtaaaagtaaccatcacagtgacttacctcaaacatttggtgatcttagcctgcctgttcatatttaagggtgagatctagaaaaactggtgggggtatttataggagaagattgccaactggaaatcattgctttagggtgaccaagaggaggtatagaatcttataatgggaaacccctaaataccagattgggaagtttttccctccagagggccttcaatttcccctgaaaagtctctactcccttgggaggaggggatgtgctatgtgtgggtgctgtccttcgataatgagtggatctggggaggcaggagggacttttcccacattagagtcttttaatgaatgtcactgtttttaggcatgagcctcactcctacccttcacagcacctggtgtctccaaatcgcaaggcttccctttggtccatattcctttctgtgagcctatctcccacctcatcctaagctggggttccctgaacatttactcatgactttatctacttttgaccttccaaaaatagtggaaatagtgtgtttcatctgccatttcaaactacacagactaattattgcatgaaacagcctttaaacattgaagggaagggaaggaaggaagtgtctttctttgtatcctgaagaaccacagtggcctgggagaggtctgaaatagcaacagccacagagccagtgactgagatgtagcccaaatgctatagacctctgggtttcagtggacccccaaggtccctggatccatggcttggtctgaatatgggcagtggcggtgaaactctcctccaactacaagggtatttccagtcatgccaaaatatcaatattctattaaaatggagatatcgttatcttcttcttcccaatattataacgtgctgttcctcctgggggaggctcagatgaggctgttctgtccttctgggttgagtgcctccagacaggatgattgagaatgaagattctgggtcgaacaaattatcacaggaggggtaggctcctaagaaaagaaatctggcttggatggaaaaggaggaaggaagcagaaggaacctaaaccagagaaaaggaagtggtcaggttaaagggaaaacgttggaaattgggcctaagaatctcccagcacctattctctcctctcatcatcctccatcacaacttcgttctcatgcccccattttaatgcccacaccctagtctaaatttattccatcagggtcctctgaaagaagaccaaggacacaaacagactctgaaagaacacataaatgactaggaaacagaaaaagatgctcgaccacacaagtaacccagaactagctatttcaacaacaataagaggccttggaaagtttgtcctgagaatactttcaaaatgagtgtatctctagcttgaaattttaatacaggatattctctgtgcacatccaaagattagatttcagatgaaaatgacaacgttctcaggagaaaaaatatcgtgttagttttaaaatatcagggtttcaatatttctatatttaaaaaacatggtatctatcaactgatgaatgaataaacaaaatatggtctagccatacaatgaagtattattcagccttaaaaaggaatgaaatactaatacatgctacagcatggtttaacctggagaacatgctaagtgaaagaatccaaatataaaagttacatattacaggattccatctacatgaaatgtccagaataggtagatccattgagacagaaaatagattagtggtttcctagggctggtggtgatgtggggccttaagaagtgacagctaaagggtacaggtttcttttggggacgatgagatgttctaaaattagattgtgatggttgtacatctctgtgaatatattaaaaccattgaattgtacactttaaatgggagaattgtatggcatgtgcattctatctcaataatgctgttacaataaaaactatgatactctggaatactggaatccttaaaattgatacagtaattgctaagaggtgaatctcttcattgattgggagactagactttataagctttaaaagcactaagattcccttaagacagaggaagactgagaattacagaattttgttctggcgtaatgttaacaagctgcagatctgcaaaattataattcattgatacggttattttcatttcagaaatgctaggattagagtcagccaacttacagtctagatctagttatgctttggacaaatggcacaaacttgggcaactcagctcctcaaaacctcagtctcctcacctggaatgtggcaataaataaactgggccttccttgtacatgttttgggaggatcaaatgagatgacagaagaaaaagtgcttacaaacattatgcaaatgaagatggtatacttattattaattttgtaattattagtagtaacagcaactgtatatcaaattaagatggtaaactgctcatcatgtaaagacttgattctttaaatttgtccttatatgaactaaacaacatgtcttacatactaagtcctctttgtacatttcttattggtcatcgttgcctaagaatatatatttttgagaaataaccaggtcatatgtacaattatggaccttagcgtgagtctattacctatacttttatcttcatgtgacctatataaccagtctggtaaaactagttttgttaggtcaagctgtttaacttggtcatctagctgtttaacttggtcatcttttcagatggcagtcttcagtcccaattcatgtcagtaaatatttgattgggtggcacagaaattcagaaagaaacaagctattcccatttcactgagcctaaactcatcatgcctaatgtggaaagaggcagttctagctaaaaattaaagaaagagttgggaagttatgattccaaactcctattcctgactctaattttgccccaagcagttaacatttacatttccaatatatcatcatcgtttgagcaagtactcaaagcatttcatttacagaagtagttgtttgctctattacaagtataattgcattggaaatattcttaaactttttacacagcctttggccatcagaacagagcaaggatttttatttttatttttattttgagacagggtctcactttgtcaccaaggctagagtgcagtggcacaatcgtggctcactgcagcctcaatccctgacctccaaccaggctcaggtgagcctcccacttcagaccccagagtagctgggactacagggatgcaccactacacccggctaatttttgtattttttatagagacagggtctccctttgttgctcaggctggtcttgaacttctgggctcaagtaatcctcctaccttgaccttccaaagtactgggattacaggcgtgagccaccgcgtctgacccaaagcaagttttaaaggggctacttcttttaaagcacaacagaaatcatatttacctctgaaacaatattttcttctgaaaggaaagttttggcctttaaaatggcaacaaattgaagatctataaatggcaacatataagaataaaatttctgaggaatttcctgagaaggggtaaacatcaagtcaatgtcagggcctggattcaggtcaattcattgaccaatctctttgggcttacttagctgagggtgtcaaagtgactcccttgcatttaacatacttttcaggatttttacatacatctaagaagcctccatgatgccaatctggagttagattataatgtattcatcataacgtattagtttggatttttttggttgcaaatgatagaaccccaactgtaagctagtttaagcacaaaagaaaatttattgatctatgtaactgaaaaatctagtgggtggatatttcttcagtcatggctggatccagatgttcaaataatatcattaggaatctgtctctttacatgtatcagccctgttttcatgatattggtttcattttcaggcagcctgtctttgcggccttaggtttacctcatctttgtaactaacaattcagtgaagataatctctacctttcattggttccagaaattactgggattgtgtatcattgcttcaaacttatcacagtggccatggggacagaatacactcatttatttggcctggactaccctcctgccctgaagcaggggtttgctggaagtctcatctgtgtcacatggatttagaatggaatagggagactctccatgggaatgttgaagtacatagatgccaactaggcaggcaaaaactaccaatgtcccctgcatacatggcaaagaacctaatgtttgaaacttgatatagtcctttatataatcttaagtaatttatataaattgtgaggttgctattatccttattctataaatgaggagttttcatttggtaaccccctcacatgtcaatagacttcctgaattctgtagaacctctcaaaatcaaaggtagtaaggatatttttacttttattgcctatctccattttcagcatttcagaggttctggtttctcaaaacctatgcctaatttactataatgaaataatattccaggccacggtgggcagatcacttgaggacaggagttggggactagcctggccaacatggcgaaaccccgtctctactaaaaaaaaaatagaaaaattagccaggcatggtggcatgcaactgtaatctcacctacttgggaggctgaggcatgagaatcgcttgagcccgggtggtggaggttgcagtgagctgagattgcgccactgcgctccagcctgggtgacagagcaagactctgtctcaaacaaaaacaaaagactctgtctcaaacaaaaagaaaagaagaggagacgagatgagaagagaggagaggagaggagaggagaggagaggagaggagagaagagaaagaaggaaggaaggaaagaaagaaaagaaagaaaaagaaaggaaggaaggaagggagggagggagggaagggagggagggtattccctcttactcaaattccctgtgtcctactcaggagtggtaagatttaggcagatggtgtaacaccttaccacatcacattagagagaggaatttggtataaggctggtttatccttagacttcatccaagggcattaatgaaataataccaaagggccttatttccaaaagagttagttacattgtaaggccccaaaaactgtattatagagtagtgtagatgaatctgaatgtgctatgcaaattagagactgagttacagctatgcatctttttcttcagacctgaaaaaccctgaggttagtgttctttccaataagggttggcagtaaaattaagactgatgttcactcattgttactttattcacccattcaggtaacccacattttgagggcccactatatgccaagccctggaagacagtgcttaataagacatttcttctggcatcaagggcctcagaatatttctgagtgatagacctgcaaacaattgcaacacatgataagaatcagcttgagaaaggtaggatgaacgggcatgaaagaaggtgtttggttcagggagtctagcaaaacttcagagaagaggtaattattttcaatgactgcataattaatgattttatggatgacacagaaggagctcatgtgagcttaggctttctctccctctctcatatttggctgtcatctatccatccactccatgttttttccagcattctttcaatgcttatagatggcatgtagttgaaattatactacatattcatcttgcatgcagataagtcaatcaacataaggtcatgatcattttctcatgttcttaaaaatccttcaataatttcattttaaaaattagacttttaaagataattctagattcataagcagctgtaagaaataatacacagaggctgggcgcgatggctcacgcctgtaatctcaacactttgggaggccgaggcgggcagatcaccttaggtcaggagtttgagaccagcttggccaacatggcaaaaccccatctctactaaaaatacaaaaattagccagtgtggtggcacgtgcctgtaatcccagctactcaggaggctgaggcagcagaattgcttgaacccaggaggcagaggttgcagtgagctgaaatcgtgccactgcactccagcctgggtgaagagcagactccaactcaataaaaaaaaaaaaaaagaaagaatacagagagatcctgtataccctttaccaagtttcccccaatggtaacatcttgcaaaactacagtacaatatcacaagcagaatattggcattgatagaattaaatacagaacagttccatcactacaaggaatggcatttttgataactgatatgcttaacaatccattttatgcatttatggataaaaaatccataaaatccattatggataatggatttatggatatccatttatggatgtatcataatttattatctgctattgtttgtcatgtgggttgcttccaatttggggctataattaataatgctttgcatacaaacttttgtcaaaaacctctgattatttctgtaggagagatcctcaagttaaagggtatgtatattttaaggttcacaatttgttgaaaagactattctttctccattgaattgtcttggcaccatggtcaaaaataatttaccttagatgcaagggttttctctggattcacagttctattctattgatctataagtctatccttatattagtatcacactgatttgattattgcagctttgtagtaaggtttgaaatcaggaagtgtgagtcctctttgttttttttttttttcaagattgttttggctattctcgatcccttgaaggatattatttttttggttaccttatttctttgtaaataacctcccatttgtgatttgacttttgtttatgtttttaattatacagaagtttaaattttttcttctttgatttttgtatttttcacatacgtagaaaacattcttttatattgttaagtttctaatagctttctaaacctaaagttatttttccatttatttccttcttttttaaaaaatggaattacaaaaataacagttgctcactgtaaaaagtttaacataattacttattgggcaaaaaacatgagatttctcctataaccaagtgctttccaatttcactttacagagatcaacactggtagcagtttgtatccttcccaatcattttctatccccatacacatgtatagtgtttaaaataagggatcaaacaataaatattgttttgcatcttacttttttacacttgacaacatagcagggcatctgtccatatgcagatcaatctcatttttaaattatgctatggaaactctttcccattgttagattttaaaaatgtcttcctaggttgttatttagtacttttatagactacccctcatttgtgtcttatttatttttaacttattttacaacaactgccacattggtagaattcttaatgtcatactacccacagtagtgcggaaattttaactatttgctcctctaccctgtgcacatattcaagagagaggctggcaaacattctgcctggttgacttaacacattcaaatagcttacacattcagataaaaatatgtaaatcaactccgagaagttgaaaaagcaaggctaggggaagaggtgtgtgcttgtaggggggacatgtgtgtgtgtgtgtgtgtgtgtgtgtgtgttcctcccctactcactctgccttttgcacttgcctatccccactttcctcaggtataaattggcgattcctcataagagatctacttggaatgattggcctgtataatattaatccactctcctgccagaaaattttgaaaaggataagtattaaagaaaaaagtgggatgtggcatttgcaattcacatcaggacttctaagcattagagcaaaattggggcgaatccctatggcattagctcagcttcagacacacattttttttaaatgctaacacccctggcctctcctcagccagctactgcttcacaagcagggctccctcaggtcctgcatacccttttccttccaggcactgcggagctccatcttccctcggcccagtccctgagtgctttgggttcagggcaaggaaggagctctagctcctttcattttccatttggcttcttaaacgggttgcctcctcttgcctttccgttttctcgtgtcctctctaaagcgtgtcaagtctcccatgcccatggcagatggcagctcaagtgtctatacaggaggcttggcgtttgggacctgaagggcgtgggacttggcatatccaaagactgagatcagagtatgtctgtgtgtttgtttgcatcctcggaggacatatttcggcttcagcacaggacctctcagactattcagggctagtattctcttcgggcaaagacagcagccctgacagggccacctgcatgtgctcacacagtgtaactcccttgcgccgagtctttgcccaggtggatactggccagaatgctaagaaaccgccaagacttgcatgagttgccatgagagtgcgaggctgggctgtctcctcccaccacaagtgctagcctaggttggcctttcgtccctcgaaaatgggaatctctgcagaaattctctcttttagctccttgcgtccctcctccacagcccccgcctcctttcatccaccggtggctaagcgggggcgtgggtgtgcgcacccagggagagttgccctcgcagcggcgggggccagagcgctccgccagagccccaaactcttaacaagttcctggactccgcgcgcgcggagctctcgggcctctgcgcctctgtccctactaggggggctccggaggactggcggccgcggcgcagctgggctgagcggggccaggggctgtacccctccggcagtgcctgagtgcccagcggcggcgcgcgggtcagagctgggcagctgctggctggagtagcggccctgcccggctctccagcgtgaggatggcagcggcaggggcccggccctacctgggttcgccaaggcgggcggccaggcacatgccccaagctgccgcttcggcgccgtggacctcagtgtcctgcggcaggatcccaggcctgccccagaacccagatggctgcactttcatgccgatagcccaggcgatccctctgcaggtggacatggccatggccctgcagcgcgtgaggattgccgagaagtacgggaagaactacctctgcctcctgcaagcagtcttcgtggcaggtaagtcccctcctctcatctcctccccggcggcctcgggctggcttgcccttcttctcagccgctgcctccccagcccggccggcttttctttattttccagtccacacccctccccgcgcgcactttattttccagtctatacaacccccccacctcgcccgcccgcccgcccgccgcgcacacacacactttcctgctgcagtggcgctcccagccacgaactcgctgggtcatccgttctccgttcctctggccagctgccgcgctgcaggcgtgcagctctggtctcagctcgcaggaggtgagatcaggagctctggtcccgcaggaggaccgtgggaaagtgcaggaagcagtatgaaactgtctctgccattgctggttcaggtctcctatccccttctcacccactttggtgcgtccccggagaagtgggaatagagtgtatcttcccacactgcatctcacacaccagaacccagcctctttgaggagtgcacttcccttgtaatattccctgaagttgaaaaagcaatttttttttgtttttgtttttcccataacgcatgtggaggaaaccaagtcaaaaaggcactcaggttcggaaaccagcagcagggccgtggcagggcaggtgggggaggagttgtagggaaacagctgctgccactgacttgggctttgcacccagaaaagcgcatcttttcatcttggtccatgagcttgttgcttccctacaaaggcaaaagctcttgtttgtctggaaggacaaacaaaagcaaagacaagtaactcacaaagtctttacggccgctgccatggtttgattaaggggagtaagtggggtaacatggacttggtcacttgccagtcgtgatacactcacatttagcaagctgaagttgcccagctttggggttgatgtagcagggaggatgctgcaggctgtggggctgcgttcctatggggccattctgactggggcaccggggctgcctcagaacagagtgcaactctgagacctgaagttcagccagagcttttcagagaagtctgcaaggtgctgcaattgatgtgcgcgccttcctgtgcacccaaggtagttttgacttagtaggttctaagccttgcagtggaagttttggtattcaaaaaatagacttggtggcaatttcccacaaatcagatagccacaacacatgttccaaatatacctccctattcagtgctatccacaaatctaaaggaggccatgcaaacatcttcagttagaccagaggaattaattcaaggctgtggtctgtgcatcttcatcacacagaactctttggtcttgcttgttttgttttgagctggtctatattattttctagatgtaataaatcattaagggcaatgtggtgatggggcacaaactagttccggtcttaagagcaatttaaatagtttttggagactacaaaaaaaaatcttgctgaaacattccgtgcagtacagtggaaagtactttgcgttttgttctcatttaccttctgcatcatcttgggagctaaaaaaaaaaaaaaaaaaaaaactcctttggaggaatgcatgcttaatcacaaaggttaaattagttatgctatgaaatgtaagttgatatttttgctgctagtgatttctcttatttctagagttgtgtgatgtgtcatctgttcacacttttgaaggctcctacatgttgacaggcccccattcctgtggcattacaatgtgtcataacacctaaatgacaccagttgctgtgctgtgtttttacctgggcttgcaatacttttgtaccttttcagcatttgccctggaagggatttgtagccatgtgattagagtacacactatagtacaacaattttaaatgtaaaatggatttccatatacttcgaagctatttatatattaaaatatgtttacaaagtttttcattgtggtaaataactttctgaacaatcacgtcaaaaatgaccatttgtggattgctcaggcccagaaattatactacagagtaataagctaatgacatatgtgtgtgcagaatcttccctggggcaaccagaagagaaaatgattggcttcacttagggagttaggggaagacttgatggagagagtgatgcatgagttgaatcttgagagatgcacacaaatgtccagctggacagcgggtggggattgaacgtggtagggataggtgggtgaatggtattccaggcaaggaaataagatatgcaaagacaagcagagagaggagagcagagtaggtttggggaattgtaaattccttttaaatgactggagtgtaaaatatggggggtaaaggagagagagagatttggagaggtaggaggggcctcgtaaggcatgttgagtggttttactttatttccagagcaatcggaagccactggagtgttgtaagcagggcaatagagaaagctgctgcatatgattgaacaggttgtgcactgcaaaacccctggggcctccactgacacagaccacaccaggaatgatgcccttactatggctgtacagtgcacagtatacacagtggtcaacagcagctatgagtgatggaactttttgctttcacaaagatcatccaagttgtgtggaggattcagtgtgtggcttatgccgtggagaggaagaagactggagataaaatgactagttagaacacagttgaagtaagctggctctcagtggatagaggcatggactgtcacttctggggatgaggagaaggggagaggtctgagcggaattaagagggtaaattgatttgacttggtgactagtcgtggtgttcgagggacagggaggagactaggttaatttcaggtttctggttagggtgactgaatggaaagagatgccattaacacagggaatggaagaggaagaggtagtttgattttcaattctgggtatgtggtttctgtggaatattcaggtagagctgacgaatgggtctgcagctgggaagaagtaaatgttatttcttattctcatcatctatagggttcattaaacatctcctggcactgaagttctttccttaaatctacttctccatgggctatattgataactcagcaagtctagtacagaagtaggcacacattataaaattacctttcagacttgttctttatattttccctcacacatttctttacctgatgatgaaaaaaaatgaaaaaaagaaacgtcttgtattcatcacaggaggaaagaatgtaagctattctgatctaatgtaacctcagataacttacataattagttgtgaaaacctgttcactgcaaattttactcatcagagtatagctcagggagatatgtaaatcacaacaaaatttattcagtgtgcattccagtatggtatgaagatttatttcaatgatgatgggtcatctattaggccacacgatactgtgagtgttccacgtaactgatttttctgggtaactgaggttcaacacttttagtgcctgactttttccccttaaaatatgtatccattttggatgagaagcttttcaaaaatactatttaccttcctgacccctgaacctggaaataattgcatccttttttgatgggttaagattgtccttataatagcattagttctttcaatgtgctgtattcagtgctgcctctgggctcctaaactgtggagggctgtttgtccctatactaaatggggacagattgttctgctttttaattttcaatgcctgacttttaccctctaacttttccgtagatttcctctctgttagctgatattttttgctgctgttaatttaactgtttctactggccagttgttattgcctaatcctccatgccccctcctccattgccttctctgagtgttacgaactagggaacaagataatcaagcttgttcgaactgtgtgaaaagtataatagaccatgagtaggcctgtggggaatctacctcaactaatgtatatgagctttagtacatggactctgtgatatctattccaattgcaaaacatctttttcttttctttctttctagttcctttgtgtgttttggagggttgatgcagttaaataagttatcagtaaaaatctatgttctcctgctaatcgaggcataataacatgtgaaattgtaatattttacttccttgtaaaacaaacaagtgtgttcagaatctatcagcaattccacgtgcattttatccactgcatttctcagacatgcctgtgcttggcaccagaaggcacttcattcttaaaatttgcccccaggtttgaaagcaattgtccctgtctctgctcagcatcttcttaagcaagcatcctctgaaggctcaataaacaacttgcaccttacctactctagggcaggagcagaggccaatcccatgaggagagatgccttctatctgatggctgacaaggccagtgcctctttctgttgcttcgacgtcttgttccagagacagttagctcctggccagaggccagtgtcacagaagttacatttattttttcacccaaacttcccctcattgtatgtttatggcagatgtaagaatctgagtgacttcttgttacttccagcactgggaagatgccattgagcaaaatcctgaaggaggtaggaagtgaactaccagaggtgactgggggagagtgtttcaggaagagggggcagtcagtggaaaggccttgagacaagagcatgctgacaagttcaaggaacaagaaagagacgggtatggctgaagcagagtgagtgtttgcatatgtgtgtgtgtgtgtatgtgtgtgtgtgttgtgtgtgtgcatgcgtgcctgcatgagatgaagccatagatgtaataaagtctggatcacatagggcttggtaagaatttaggcttttaacctgagtcagatgatgagccattggaaggttttgagcaaaggagtcacttctgtgttaacagaatccctctggatgctgtgtagagaataggattaaggtcagacaaagatggaagcagtgaaaccagttaagaggctattagcattaatgatggcaacttgaaccagagaggtaatttgtggaggtggtaagagtgatcaaatagattctggatatattttgaggatagagtcagaaggatttgctaatggtttggatatggagtatgagagaaagaggagttaaggataatgctaacatttttggctttagcaagtggatggcagaaattttcatcagtggagatggagatgcctgcaggaggcgtaggtttacggggaaaaattatgaatatcagaagtttggctgtttgaacctgttaactttttttttttccgagatagagtctcactctatcacccaagctggcatgcagtggcacaatctcagctcactgcaacctccgcctcccacgctcaaatgattctctcacctcagcctcccaagtagctgggattacaggtgtgcaccaccacacccagctaatttttgtatttttaatatagaatcatgtcgtctgcaaacagggataatttgacttcctctcttcctattgggatgtcctttattttttttctcttgcctgattgctctggccaggacttccaatactatcttgaataagagtggtgaaaggacatcttttcttgtgccagttttcaaagggagtacttccagcttttgtccattcagtgtgatgtcggctgtgggtttgtcatagatggctcttattattttgaggtacgttccatcaatacctagcttatcgagagtttttttttttttttaacgtgaaggggtgttgaattttgtcaaaagccttttctgcatctattgagataatcatgtggtttttgtttttagttcccatttatgtggtgaatcgcatttattgatttgcatgtcttgaaccaaacttgcgtcccagggataaagcctacttcatcatggtggattagctttttcatatactgctggattctatttgctagcattttgttgagtatttttgcatctctgtttatcaataatattgccctgaagttttagaattgtgtctctgtcaggttttggtttaaggatgatgctagcctcataaaatgaattagggaggagtccattttggaggagtatttagggttttctaggtgtatgattgtagcaggacaagccacagacaaaacccctcagacaccgagttaaagaaggaagcagtttattcggctgggagcatgggcaagactcctgtctcaagagccgagctccccgagtgagcaattcctgtcccttttaagggctgacaactctaagggggtccacttgagagggtcgtgatcgattgagcaagcagggggtacatgactgggggctgcatgcactggtaattagaacggaacagaataggacagggattttcacagtgcttttctatacaatgtctgtaatgtatagataacataaccggttagatcaggggtctatctttaactaccaggcccagggtgtggcgccgggctgtctgcttgtggatttcttttccgccttttagtttttacttcttctttctttggaggcagaaattgggcataagacaatatgaggggtggtctcctcccttatgatcatgtcatcagcaaacagagataatttgacttcctcttttccaatttggatatcttctatttctttgtcttgttttattgttttggctaggatttctagtactatgttgaataggagtgataagagtggacatccttgtcttattctagttcttaagggtaatgttgtcaacttttccccattcagtatgaccttggctatctgtttgtcatatatgagagcctatttttaaaaatagcttttgtagagctataattcacatacaattaacctacttaaagtatgcaattcaatggtttttagtataatcacagagttgtgcaacctttaccacaatctaggtttaaaatattcccatcaccccaaaaagaaaccccatactcgttagcagtcactctccattttctcccaaccacctttttcctcagcccctggcagtcactagtctactttctatttctatagatgtgcctattctggacatttcatatacatagaatcatacaatatgtgatctcttgtgactggcttctttcactgagcgtaatgttttcaatgtccattcatgttgtcgttgtgtcattcttaaaatggctgcatcttattgcagtgcatagatgtgccacattttaattatccaataaaaatgataggcatttgtgtggtttccaccttttggttattatgaataatgttgttatgaacattcttatacaagtttttatgtggacatatgttttcatttccctgtggtatgtatctaggtgtggaaattgctaggtcctagagtaactgtatgtttcatccttgaggaaatcccagaccgtttttcaaagcagctgcacccttttacattcccaccatcaacatatgagggttataatttctctacattcttcctagtacatgttaatctctctttatttcccagccatcctagtgggtgtgaaatagttttttattgtagttttgatttacatttcctgaatgactagtgatgttgagcaccttttcaggtgcttattggccatttatatatcttctttggataaatgtctacatggattatttgcctgatttaagattgggcttttcctcttttactgttgagttttaagagttctctatatactctggaatggagatctttatcagacatttaatgtgcaaatattttctcccactctgtgggttgtctttttacgtacttcatggtttccttgaatcgcaaatatttttaactttgagaaggtcgaatgtatctatttttttcttttattgcttgtactttggatgtcaaatataagaaaacattgcctaatccaaggtcataataaattacaactatgtgtttgtctaagagttttatagttttacttcttatacttagatctttgatccattttgagttgatttttgtgtatagtgtgcggcaaagattcagcttcattcttttccatgtgcacctccaggtttcccaacatcatttattaaaaagaatatcctttccccgttgaaatgtcttggtgccctggatgaaaataaattaaccttcggtacaaagatctatttctggactttcaattatttcccactgatgtatctataagtctatcataatacctatctttattactgtagctttgtactaattttgaaatcagaaaatataaactttccaaatttgtttttctttttcaagattgctttggttattccaggtcccttgcgtatccatatgaattttaagactagcttgaaaatttctgtgcaaaaagccatctgggatgttgctagggatggcattgaatctgtagatgaatttaggaagtaccttaacctcatttttatagtggcacaaattgaggtttcccaaactatggaccattcacatttaacatatttggaattatttactataatggatattggcattctgcccttcagtgctcacattggatagttattcatctttagtttgtcatgaatttacaaagtttatggctgggcgcggtggctctcgcctgtaattccagcacttttggaggcctaggtgggaggattgcttgagcccaagattttgagaccagcctgggcaacatagtgagacctcatatctacaaaatatattttaaaaaattagctgagcatggtggcacactcctgtagtcccagctactcaggaagctgaggtgggaggatcacttaagcccaggatgtcaagactgcagtgagctgtgatctcgccactgcactccagcgtgggtgacagagtgagaccctaactcaaaaaaaaaggagaaagtttgcaacatattcattcctagtatgagaattattctagacactgtgctgaagtcttaaaaggcaagaaggtatcaacctgatctctcccaagggaaaacaataatacaaatgaaaacaacaacatcatcactaactcagtcgcctttgtgtttgtgattcagcatttggcaggcacgtctgtgtaggactggggtgggataacagaagaaatgagaggcatatgtttggataccacactgccacgaatcggcaaaggctttttcatgctggacaagacaatttgtcaatcaagtgtgtagttatcctccctgtggcaggagatattttttaggaaaatagactgcagtggctcgataaatggacttggaccagatctacagtggatttgctgatgctttaagcaggaaaaatatttacttatttctatttttacatattgtaaatcaccacgtatgtagttcttctttacagactgattcagttcctctcaaaatttacctacatgttttggatttctgaataataaattcattcagctgtgattattagggaggttcccaagacaatgtcagctcctgctgctgtacagggaaaacctgccatctctactgaatggtttttaatctgaaggaaggctgaaggaaaaggtttccacagacatgctcttaattaaacacctacaagagatatagtcaaggagcagcaacctgggacactaagcctgtggggggaggtcttctcactgtcacttcccaccagctgtttctcattttttctcatgcatttttcctgccctctctctttcatccttctcttttctcggttcttccccttatttctcccttcttactcctgtcatttcctagtgcctttgagtcttctttttcctgtttttgttttctgtttttggtagggaagtatcttttatttcctcttcttctattcttataattaaattatgtatatgtgatctttgtaaaatatctaaacaaaacaaatgcccataaactaataaatgaaagtcatccatgtgcctagcccagtcctgctccttggtggtaaacactgctaatagtttgtgtgtgaggacataggaggttttctatgaatatagatatatcaattcaattcaaacatttattgatcacctccagtgtgctagacactattgagatattatggtgaacaagtaaataaatctctgccttcagggaacttatttctaatggtgagagcaacaataaaaaatccacatatatctagatattttaccaaactgggatcatacaccatatgttgatctaagacttgtattggaatgtgtgtatttaaaaattacttcattacgaaaattttgatacacataaaataatgcaagaggaaaagtaaagtatataatataaaatcatgatgctaagatattttaaaatttccctttcatagagcacaaagaggctactgtatcttttcagcataaagcatttgcccagttttgtcttaatgggcttatagtagaccctgtagatgctactggaatatgaattttgcataactttgtggctggagggtgtggtagaggttgagctgccctttcataaatgccttgactaggtcagcatcagccgctgctatcagccaagagtattctttacattcaaggatactgagagttctctggtcatcacgtcttcatttgtactcttgtaccattgttaagtggaagcaatagctgttgcatatacactgtgatgagaagaataacctttgagagttattttaaataacattttctctattttaactgaaattgtgtgattaggtatatgtattctgagactctttgatggcaattagaaggaatatgcatatttgggggcatctttgagtttgcaattgcaggctagatcatgggattagccatagagcaaaaagcagtggccctgtttttatttgtaattttgcacttgtcagtttacaaaagagggtcaggtttactttcttcattaacatattcaaaggaccatgaacagatattgtgtgttcttctgcatgcattacaaactaaaataagtcattttaattggatttaccattgcagatgttgtacatttcaaaatgattttatgaacccaagaagaggtgaatagctacagagtaggagatctggcatttagtcacgtctacatggatattgtgagttctgatatcagtgggtcatcttgtctctttttatagcttgtgctttaaatagctgctctcaaaaggtctgatgccataataaaaaattaaataggggttaatgtaaatatttacctattgctaaggtagtatgtttggaaatatttagtggtggctgtggctgtagtggtcagggactagtgtttctttaagctcatgttcaaacatgcccctactcgtttacactgcaagaactgaatggtgattatttgggtgaataaagtaatgccctttcagtgccttttccccacatttctgttgttgaggaatactctggcatattcaaaatgtcggatgaagagatttctttttaactgtgctttgcaaattatccaaggaatctaattctcaaaggcagttatattcatgactacaaaaaattttttaaaaacccacacaattagccggatgtggtggcacttgcctgtagtcctagctactcagaaggcttaggcgggaggatcgcttgagcctaggagtttgaggctgcatgaagctatgattgcaccactgcactccagcttgggtgacagagtgagaccctgtctctaaaaataaataaataaaataataaaaaataagtaaagatggagattaaagttttaaaaccctccattttaaacacttaatattttcatgtctgcacactatatgaatgcacatatacgtgtaaatattgatgtttacaaaaattacagaaatgaatggcttccctttatttgcagcacatacaaacatgtctggcctatgaaaaggcatgtttgaaaagatgagggagctcactatcatattgctctcatccttggaaacaggtcttaattattaatatacttaaggttatattgtaaccttaatataatattgagtcaggacctgaagaggtggaaggtctttcaggtcctgactcaatattatgtgctgaaagcgtcccaggaggtacttggcgtaggttaagtataaaacctttttattttttcatttttttaatacatgatctattttatcagtttagtgctggatgtcctttcactgtgtgctcttggcatcctgggctcaatactactgtaacacttatcactctgggctttcactgcttcctgcctctagatgtagagtcccaggagatccagaccagtgtctaactggtttctgtatctatccccagtgctgcacagggcctgatataagataggagcctaacaaaggtttgttgaaagaacaaattcatgaatgattagagtggctgaaaaacacatggaaaaaaaagttaaagttgtgtggaattgtagattcctgttttgtattcctattctttccttccatcctctcattccttccttacatttcacatcttccttagaattccactttgtgctactgagggtaaaataatcctgtggttccttcctttaaaacacacttaaaagtctgagcatctgagaacagtcagatctgtgcatgtttttttccagatgtggacactattcattattatgtgctctgtaagcacgtggtaaaatgacattgaatgcatagtaggtgctcaggcaaacactaaaagtttgggttgacattgtacatgtctttaatgtgatctcagagttcatttgatctttgttgccacatctaactgattttgtttctccattttagattgtttgtgtcaagtcattcgtatttacccttcagctctagaggggtaaaattctacttgggatgttttctttcagttatgactaaaataattttaaggtggtccttcaaaatggatgttttgtgaaaaatgaaaagtaaacctgtgataagagcaaaatccaaaaccaaaacacatctgtaatgatgttgttgcacatataagtgcttgctattgttagattttttaaaaaatgttgcttaagtggtgagtataaaaggttatcctgctctccttgaaatttacatttcacacactacaaatgcagtggagcatcttttcaagtgttcattggccattcttatttcctcttctgtaaaatgcctgcttgtgttttatttttcatgtatttatgggttgtctttttcttattattgacttataatcttttatatatccttgatattaattactaattctttgtcgttacatgtgttgaaattatcttcagtcaggttttggactgtctcatcactttctttatcatgtattttgaggaaagaaatgaaaaattttaatgtagcataattaatcagtttttttattttatgctttctgcttcttccatcttgctttaaaaagtctatcctacccataggttacacagatatcatactatattttctctgatctgattcccaacagtgtaagatttgaatcctcaccaatgcatgaccattagcgtgaaggtggaaattgttagatatcccaggggtaactgctattatttgttggcttctcccacaagatattcgcctaagtaatgattttggcctctgaggatttgcttgtctttccagccagctcagcgatgcattaaaaaagatttttttttgagacagggtcttggtctgtcacccaagctgtagtgcagtggtggaatcacagctcactgcagcctcgacctcctgggctcaagcgatccttccacctcagcctacccagtagctgggactacaggcgcctgccaccacacttggctgatttttgtatttttagtagagacggagtttcactgtgtcggcccagctgcccttgaactcctgacctcaagtgatctgcacgccttggcctcccaaagtgctgggattacaggtgtgagccatcgtgcctggctgaaaaggatttaatttgatttttcccaccatgtttttgtattttgtactagaaggtttttcaggatttttagttacccatatgaccaagaaggggagctcctccatgtttttcaaacttagacgttcaatgtttagattcaaatatgatatctaatgtaggagtttttcttgtacacaagacgtgagatatggatcgggaaacataacccattaccccatccacagatggcttaaagggggaaaagatgggagtggtgttctggctctggggtcctttgtgattgtttggagaaggtgatgcagaattaaaatctttgcagaactatagtggtaataaactcagcatgttacctgtggcgtattcgtatggtctgcagcaacctcaattcttgcctcctcagaagaaagaattcaactgaaggtcataaggcagaagaagagaccgaggcaagttttagagcaggagtgaaagtttattagaaagctttagagcaggaatgaaaggaagtaaagtacacttggaagagggtcgggtgggcgacttgagagatcaagtgtatggtttgacctttggtcttggggttttatatgttgggatgcttctgggatcttgtgtttcttctcccctgattcttcccttgaggtgggctgttcacacatgcagtggcctgctagcacttgggaggggagcatgcacagtgtgtttactgaaattgtatgcatccttacttgaggcattcttcccttaccagtcaaatgtcctagaaggtcataataccagttaaactccaccacttttcctcttagtgtgcatgcatgagcccacttacccaactcctgagatcttatcaggagctgctgatcaccagtttcagatgtttctgtttattgggagatggcctttccttggcactggctgtgaccaattattatcttagagagacagtttcataactgcctgatcatcacctgttggttgcctgacattcctggtgggaaggtgtccctctcctgccctgctcatgtctgactagctaccctctgtaacaagcattgtctgtgactgcatgaatgctaacttttacatgaaacctttgaaattgtaatgtcattttttctttataacaatggccgacatttatcgagcacttactatacactaaggtaagtgctttgcatgtatgaaaaacttattcattacaataaccctgtgaaataggtgctgccattttttccactttaccaataaaagaaacagacacagattttaagtagcttgcccaaggtcacataactaccaagtggtacagctggaatttgaatccagtcaatctgtttctggagtgagaactcataaggagtatgctatatgacctctataggaaatgcttatttgttcagaaaaataagaatttttttccattccaagatggccaaataggaacggctccagtctgcagctcccagtgtgatcaacacaaaatatgggtgatttctgcatttccaactgaggtacctggttcatctcactgggacttgttggacagtgggtgcagcgcatggagggtgaactgaagcagggtggggcatcacctcacccgggaagcacaaggggtcaggggatttccctttcctagccaagggaagccgtgatagacggcacctggaaaaatgggacactcccgcccaaatactgtgcttttccaatggtcttagcaaatggcgcaccaggagattatatctcacacctggctcagcagatcccaagcccacagagccttgcctactgctaacacagcagtgtcagatcaacctgtgaagcagcagcctagcagggggagggggtccgccattgctgaggcttgagtaggtaaacaaagcagccaggaaagctcaaactgggcagagcccactgcactcagcaaggcctgctgcctctgtagtctccacctctgggggcagggcatagctgaataaaaggcagcagaaactgctgcagacttaaacgtccctgtctgacagctctgaagagagcagtggttctcccagcatggtgtttgagctcggagaacagacggactgcctcctcaagtgggtccctgacctccgtgtagcctaactgggagacacctcccagtaagggcctactgatacctcatacaggcaggtgcccctctgggacaaagcttccggaggaaggatcaggcatcaatatttgctgttctgcaatatatgctgttctgcagcctccgctggtgatacccaggcaaacagagtctggagtggacctccagcaaactccaacagacctgcagctgagggacctgagtcttagaaggaaaactaacaaacagaaaggaatagcgtcaacatcaacaaaaaggacatccacagcaaaacgccatctgtaggtcaccaacattaaagactaaaggtagataaaaccacaaagatggggagaaaccagagcagaaatgctgaaaattctaaaaaccagagagccttttctcctccaaaggattgcatctcctcgccagcaatggaacaaagctggacagagaatgactttgatgagctgacagaagtaggcttcagaaggtcggtaataacaaacttctccaagctaaaggaggatgtttgaacccatagcaaggaagctaaaaccttgaaaaaagattagacgaatggcgaactagaataaacagtgacctgacgagctgaaaaccatggcataagaactacgtgacacatgcacaagctttaatagctgattcgatcatgtggaagaaagggtattaatgattgaagatgaagttaatgaaaccaagcgagaagagaagtttagagaaaaaagagtgaaaacaaacaaagcctccaagaaatatgggactatgtgaaaagaccaaatctacgtttgactggtgtacctgaaagtgacagggagaaagaaccaagttggaaaacactcttcgggatattatccaggagaacttccccaacctagcaaggcaggccaacattcaaattcaggaaatacagagaacaccacaaagataatcctcaagaagagcaaccccaagacacatagttgtcagattcaccaaggttgacatgaaggaaaaaatgttaagagcagccagagagaaaggttgggttacccacaaagggaagcccatcagagtaatagcagatctctcggcagaaactctaccagccagaggagactgggggccaatattcaacatacttaaagaaaataattttcaagccagaatttcatatccagccaaactaagcttcataagtgaaggagaaataaaatcctttacagataagcaaatgctgagagattttgtcaccaccaggcctgccttacaagagctcttgaaggaagcactaaacatggaaaggaacaaccagtatcaaccactgcaaaaaacatgccaaattgtaaagaccatcgatgctaggaagaaactgcatcaattaatgggcaaagtaaccagctaacatcataatgacaggatcaaattcacacataactatattaatcttaaatgtaaatgggctaaatgctccaattaaaagacacagacaggcaaattggataaagagtcaagacccattggtgtgctgtattcaggagacccatctcatgtgcagagacacacataggctcaaaataaagggatggaggaatatttaccaagcaaatagaaagcaaaagaaaaaaaagcaggggttgcaatcctagtctctgataaaacagactttaaaccaacaaagatcaaaagagacaaagaaggccattacataatggtaaagggatcaattcaacaagaagagctaactatcctaaagatatatgcacccgatacaggaacacccagattcataaagcaagtccttagagacctacaaagacacttagattcccacacaataataatgggagactttaacaccccactgtcaatattagacagatcaacgagacagaaggttaacaaggatatccaggacttgaacttagctctacagcaagcagacctaatagacatctacagaactctccaccccaaatcaacagaatatacattcttcacagcaccacatcacatttattccaaaattgaccacatagttggaagtaaagcactcctcagcaaacgtaaaagaacagaaatcacaacaaactgtctctcagaccacagtgcaatcaaattagaactcaggattaagaaactcactcaaaaccgcacaactacatggaaactgaacaacttgctcctggatgaccactgggtaaataatgaaatgaaggcagaaataaagatgttctttgaaaccaatgagaacaaagacacaatgtaccagaatctctgggacacattcaaagcagtgtgtagagggaaatttatagcactaaatgcccacaagagaaagcaggaaagatctaaaatcgacagcctaacatcacaattaaaagaactagagaagcaagagcaaacacattcaaaagctagcagaagacaataaataactaagatcagagcagaactgaaggagatagagatgcaaaaaacccttcaaaaaaatcaatgaatccaggagttggttttttgaaagattgacaaaattgatagactgctagcaagactaataaagaagaaaagagagaagaatcaaatagacgcaataaaaaatgataagggggatatcaccaccgatcccacagaaatacaaactaccattagagaatactacaagcacctctacgcaaataaactagaaaatctagaagaaatggataaattcctcgacacatacaccctcccaagactaaaccaggaagaacttgaatctctgaatagaccaataacaggctctgaaattgaggcaataattagtagcctacgaacaaaaaagagtccaggaccagatggattcacagccgaattctaccagagatacaaggaggagctggtactattccttctgaaactattccaatcaatagaaaaagagggaatcctccctaactcattttatgaggccagcatcatcctgataccaaagcctggcagagacacaacaaaaaaagagaattttaggctaatatccctgatgaatatcgatgtgaaaatcctcaataaaatactggcaaaccgaatccagcagcacatcaaaaagcttgtccaccatgatcaagttggcttcatccctgggatgccagactggttcaacatatgcaaatcaataaacataatccatcacataaacaggaccaacggcaaaaaccatatgattatctcaatagatgcagaaaaggcctttgagaaaattcaacagtgcttcatgctaaaaactctcaataaactaggtattgatggaatgtatctcaaaataataagagctatttttgataaacccacagccaatgtcatactgaatgggcaaaaactggaagcatttcctttgaaaactggcacaacacaggggtgccccctctcaccactcctattcaagatagtgttggaagttctggccagggcaatcaggcaagagaaagaaataaagcgtattcagttaggaaaagaagaagccaaattgtccctgtttgcagatgacatgattgtatatttagaaaacccaattgtctcagcccaaaatctccttcagctgagaagcaacttcagcaaagtcttaggatacaaaatcaatatgcaaaaatcacaagcattcctatacactaagaacaaacaaacagagagccaaatcatgagtgaactcccattcacaattgctacaaagagaataaaatacctaggaatccaacttacaagggatgtgaagtccctcttcaaggagaactacaaaccactgctcagcaaaataaaagaggacacaaacaaatggaagaacattccaagctcatggataggaagaatcagtatcgcgaaaatggccatactgcccaaggtaatttatacattcaatgccatccccatcaagctaccaatgactttcttcacagaattggaaaaaactactttaaagttcatatggaaccaaaaaagagcctccattgcctagacaatcctaagccaaaagaacaaagctggaggcgtcatgctacctgtcttcaaactatattacaaggctacagtaaccaaaacagcatagtactggtaccaaaacagatatatagaccaatggaacagaacagaggcctcagaaataacaccagacatctacaaccatctgatctttgacaaacctgacaaaaacaagaaatggggaaaggattccctatttaataaatggtgctgggaaaactagctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaagggcttcatgactaaaacaccaaaagcaatggcaacaaaagccaaacttgacaaatgagatctaattaaactaaagagcttctgcacagcagaagaaactaccatcagagtgaacaggcagcctacagaatgggagaaaatttttgcaatctacctaactgacaaagggctaatatccagaatctacaaataacttaaacaaatttacaaggaaaaaacaaagaaccccattaaaaagtgggcaaaggatatgaacaggcacttctcaaaagaagacatttatgcagccaacagacacatgaaaaaatgctcatcatccctggccatcagagaaatgcaaatcaaaaccacaatgagataccatctcacacccattagaatggcgatcattaaaaagtcaggaaacaacagatgctggagaggatgtggagcaataggaacacttttacactgttggtgggagtgtaaactacttcaaccattgtggaagacagtgtcacaattcctcaagcatctagaactagaaataccatttgacccagcaatcccattattgggtatatacccaaaggattataaatcatgctactataaagacacatgcacacgtatgtttattgcagcactattcacaatagcaataacttgaaactaagccaaatgtccatcaatggtagactggattaagaaaatttggcacatgtacaccatggaatactatgcagccataaaaagggatgagttcatgtcctgtgcagggacatggatgaagctggaaatcatcattctgagtaaactatcacaaggacagaaaaccaaacaccgcctgttctgacccataggtgggaattgaacaatgagaacacttggacacagggcagggaacatcacaccccggggcctgtggtggggtgggtggaggggggagggatagcattaggagaaatacctaatgtaaatgacgagttaatgggtgcagcaaaccaacatggcacatgtatacctatgtaacaaacctgcagattgtgcacatgtgccctagaacttaaagtataataaaaaaagaattaaatgtgtttaagataataatccccaaatataacatattggtgctgtgatgtcattgcagtcttttttccctagcatacatttccaaaagtgtagcctacttcttatgtttttggtatttttttctttcatatctcttttttaaataattaaatccttttgaaaagataagtggaaaaaagtacattcatcgttcaaatgaacttttttcttataaataccaaatttttccttgagctttttggtaatggcttagttgggatataatacacgtataatacaatttacccatttaaattaaatgtttttagcatattcgcagaggtgtacataaccatcactgcaatcaattttagaacattttgttactccctaaagaaaccctgtatattttagctatcatttccgaagctccctgattcccctagccctaggcaatctctaatctattttctatctttctctctatgcttattctagacatttcatagaaatgaaataacacaatatttggtcttttgtgtctggcttctttcacttagcgtgtttttttcaggattcatccatgttgtaggatgtattagtccttcgtttctttttattgccaaataattttccactgtatggatatgctgcttttgtttacccattctacagttaatggatatttgagttatttccacctttggggttttatgaataatgtggctattaacatttgtgtataagtttttgtgtagtaatatgttttcatttctctttgctgtatatctagaggtagaattgctgggacatgtggtaaatctatgtgtaaccttctgaggaattgcaaaactctattccgtaggggatgaaccattttacattttataataacattttacatttacatgtatgagggttccaatttgtccacgtactaatcaacacttgttcttgtccatcttttttgttacagacatcctcttgggtgtgatgtggtatcattgtggtttccatatacattttcctaatgactaaatgatgttgagcatccttgcatgtgctcatggaccacttgtatatcttctttggagatatgtctattcaaatattttgcccattttaactcaattctttgtctttttgttattgatttataagtgttctttatattctagatacatgtcccttatcagatatacgatttgcaaatatatcctcttattctgtacgtcatcttttcactttcttagtatcttttgaagcacaaagttttaattttgatgaagcccaatttatataattttaaacatttgtacttttgatgtaatgtataaataagaaggttttgccaaatgcaaggtcacaaagatttacttctataatttaatattttgattgttttagctgctacattttggtgtttgatccacttttagttaatttttatatatatacatatatatatgacatatgtagatatcctgttatttcatcactgtttcttgagaatacttttgttttccccagtgaatttatttgttcttgtcaaaagtcatttgagagacgtatcatgatggctgaatagaaacgtttcatacttgccccctccacttagaaaaaccaaaatagcgtatagacaatcacacattttggatacattatccaagaaagaacactgaacttcaacagaagagtgacaggaaacaccaaaatcaaggaaagagaaggaagagaggcagcctgcttggccgggattggcaggcagctgggagtgacttcccaacacagggaaaggttaagtgagagacttttagtgactcacatccccacactggaagcatgcaatcctggccatggaagaggccctctatcttctcaaagcctgaaacaaacataaggagttaccaggagaccgtgagatggaactgctccagggaaggaactagcactaggacccacacctgttctgagtcttgagtggctacatcaagacactatttgcagtcttagcctttaacagactgcacagtatcctggaacccagcggtgttgggactgaggtgttattgctgctggaaactggggaatcagcctgctgataactgccaacattgctgtcagtgtacactaccctggggcacaaagataggcatgctcagagactgggagtgagctgggaatgaacttacgcagctggagctgagaagcaagtgcatgggttgcagctgccggtgctagaaagggaggaccactgggactaagctgggacatgagtgaagcatgagttgtggctgcaactgagtcatggggctcctacagctggggctgaggcacaagctaaaaatgggctaccactatgttgctcaggttagtcccagtcatcagggttcaagtgatcctcctgccttggcctcccaaagcactagcattacaggcatgagccagcatgcccaagcagtatgctaccactgctagagctggggagtgtgccccactgggatcggagtgtgagagttacatgtgctcaccacccaccagcttggactgtggccaccaacagccccaccctctccagtgacagggccttagcatggctgctaccaccctttccccaaacactgcccaaaacctgaagatcacccagatcctacctaccacaagcagtgcctgctctcaccattggagacctgagcatgagcctgcccacaccccctgagacagagcacatagcctggaatcatgagggatgaacaacccaattcaccactttgggcacctgaacattcctcctaggggctggatgtacgacctaaactcctggctactaccacctcagctgacacctacctgcaaatgctacctgcaggcctggagactggcttggccagcacattgcagccaccacctacatcagtgcataccgcttgggcatgctggctcatgcctgtaatgctagtgctttgggaggccaaggcaggaggatcacttgaaccctgatgactgggactaacctgagcaacatagtgagaccctatctcttaaaaaataaaataaaataagccaagcatggtggcacatgcctgtagttctatctgggtaacagagcaagaacctgtcaaaaaaaaaaaaaaaagaattcaaaatattgattttaaagaagctcagtgagatacaggagaattctgaaaaataatacaaagaagtcagaaaaacaatcagggtatgaatgagaagtttaccaaagagatggatattttaaaagagaaccgaatagaaattctagaactcaagaattacttgaaagaaatacaaaatacgtttgaaagcatcaataatacactagatcaggcagaagaaagaatcatggaacatgaagacaggtcttttgaaataacccagatagagaaaataaagagattaggataaaaaaagagcaagcaattttttgggacatttgggacaaaataaagctactgaacatatgaattatcagtatccctgagggcaaagagaaaatgaagagattagaaaatctatttaaagaaataatagatgaaaactttccaaccctagcaagagattttaggtgttcagatgcaggagtctcaatgatccccaggaagatataatgcaaaaggtcttcttaagggcacattatattctgactttcttaagtcaaagataaggagtgaattctaaccacagcaaaagaaaagtgtctagtcacctgtaaaagaaactgcatcagactaacagcagatttctcagcagaaacttcagaggccaatagagaatgggatgatacatgtaaagtgctgaaagaaaaaaaataccagccaagaatactatatccaataaactatcctttataaatgaaggagaaataaagtattttttaaacaagcaaatgctgaggaaattcactttagggccaccagactggccctaaaagaaatgctcaagggagtcctaaacctggacacacatttactggacatacatttactaccataattgaactcataagcatagagagtagaaggatggttaccagaggctgggaagggcatggggtgttgggggagaggtggggatggttaatgtgtacaaaaaaaaaaaagaatgaatgaataagacctactatttgatagcacaatagagtgactatagtcaataataacttaattgtatatttttaaataacttaaagaatgtaattggattatttgtaataataaggataaatgcttgaggggatacatactcctttctccataatgtgcttatttcacattgtatgcctgtatcaaaatatctcatgtgccttgtgtgtgtgtgtatgtgtgtgtgtatatatatgtatatatataatatacatatatatatggtttgtgtgtgtgtgtatatatatatatatatatatatatatatacacacacacctaccatgtacccataaaaatcaaaaggaaaggattataatatccttataaaaaacacatgaaaacacataactcactgataaagcaaacacacaaaggagaaagggacacagatactaatctgaggagcagagcaggatggcagaatagaaggccccaccaatcataccccctgcaggaacaccaaattcaacaactatctacataataaaagcacctcataagaaccaaaaatcaggtgagcattcataataccaggttgaaacttcatatcactgaaagaggcactgaagagggtaggaaagacagtttgaattgccaatgccatccctcccccactaccctgcagtagccacatctctgcagcatggagaaatctgtacacttgggagagggagatcacagaaactgtgggactttgcattgaactcagtgctgccctagtcacagtggaaagcaaaactgggctgaactcagctgatgcccactcacaaagtgagcattcaggccagcttcagccagaggggaataacccatatcagcagtaggaacttgagttccagcaagctcgctgccatggggtgaagtgctctgggaccctcaataaccttgaaaggcagtctaggccacaaggactgcaaatcctagtgtggagttgggttcagagccagtggacttggggaacatgtgactttactgagacaccagccagggaagctaagggagtgcttgtgccacctctctcacaacccaggcaacacagcttgcagctccaaaagagacctcttccttccacttgaggaaaggagagggaagagtaaagatgacttttgtcttatatcttgggtaacaactcagccacagaaggataaaccaccaagcagagtcatgaggcccccattccaggctctagctcccatacggcatttctagacacaccttggaccacaagggaacctactgccttgaaggggaaaagcctatccaggtaggatccatcacttgctgactaaagagaccttgggccctgaataaccagctgtgatacccaggtagtatgccatgggccttgggtgaaactctgagatgtgatggcttcaagtgagacccaacacatttttcagctgtgatggctatggggagagactactgcttgagaaaagcagagggaaaagtaaaggggactttactgtcttccactttaggtactagctcagccacagtgggatagagcaccaagagggctcatgcggtccctgattccaggccttgcctctgggagggcatttctggacatgccctgggccagagggaaacctgttgccctggagggtgattcccaggcatggcaacattcaccacaagctgattaaagatcccttgggccttaagtgaatggaaggacagaagcctgtatggcttcaccttaccagtaaagaaacacatagactcaatgtaaaggaatggacaaaatatattccatgtaaatggaaaccaaaggtgaccaggaatagctgtacatatatcagataaagcagattttacatcaaaaatggttttttttttttgttttttgttttaaaaaggctgggcgcggtggctcaatgcctgtaatcctagcaccttgggaggccgaggcaggcagattacttgaggtcaggagttcgagaccaccctggccaatatggcaaaaccctgtctactaaaaatgcaaaaattagctgagcatgggggcttgtgcctgtagtcccagctacttgggaggctaaggccggagaattgcttgaacctgggaggcagaggttgcagtgagccgaaatcgcaccactgcactccagcctgggtgacagagagagactctgcctcaaaaaacaaaaacaaaaaacaaaacacaaacaaaaaaaagccaccccaaaaaacaaacagtaaaaaaacaaaacaaaacaaaaactggagaaagagaaaggaggtcattatatataattaattggtcaatccagcaagtggatataacaattctaaatatatatttacccaacactaaagcacccaggaccataaagccaatattactagatctaaagagagatatagactgcaatacaataatagtggggcattcaacaccccactctcagcattagacagatcacctagccagaaaatcaacaaagaaacattcgatttaaactgtaaattagtgggagctaaatgataagaacttatgaacgcaaagaaggaaacaacagacattggggtcagcttgagtgggaggatgggaagaggaagaggagccaaaaaaaaaaaaaaaacaaagcaaactattggctattgggcttaaaacctgggtgattaaataatatgtacaacaaacccctgcaacacgtgtttatctatgtaacaaaccttcacatgtacctccaaacctagaataaaagttaaaaaataatgaaaaagtctgtacattagactgaatggacctaacagacacttacagaagattctattccttaactgcaggatatatattcttttcatctacacatggaacattcttcaggatagaccacattttatgccacaaaacaagtatttaacaagtatttaaagggaattcttatatactgcgggtagaaatgtaaactagtacagtcactgtggaaaataccatggagatttctcaaaaaattaaaaatacaattaccatttcatccagcaatcctgctactgggtatctacccaaatgaaaagaaatcagtatatgaataagggatacttgcactcacatgtttattgcagcattattcacgatagaaaaatatggaatcaacctaagtgtccatcaacggatgaatggataaagaaaatgtggcatatatacacaatggaataatatttggtcataaaaaatgaaatcatgtcatttgcagcaacatggatgaaactgtaggtcattattttaagtgaaataaaccaggtttaaaggtaaatattgcatgttgttacttaaatgtgagagctaaaaaattcatcacatggcagtagaccatgaaaagacagataacagagactgaaagggtgaatttggagaagggggagggtgaagagaagtgggtaaaagggtacatacaattagaaggaataaattcagtgtttcatagtagagtagggtgactatagttaacagaaatgtattgtacctgggtacccaagcacttgggtacttgggacaccttaaataccattttgatccctacacattatatacatgtaacaaaattttacatgtaccccattaatttgtacaaaaaaatcaactgaccctcaatatatgggctacttttttggactctccattccattccattgatctttatgtctatccttatgtcagtaccacactgtcttttttattgtagctttgtactaagctttgaaatcgggaactgtgagttctctaactttgtccttttgtttcgagactgttttggttaatttggctcccttgtatttccatatgagttttaggttccacctgttaatttctgtaagaaaaaagcgagctaaaatctttataggggttcttttcaatctgtatatcaatttagggagtattgctacttcaatagtattatattccaagatatgaacatggattggctttcaatttctcagatatttaatttctttcaataatattttatagttttaagagtatgttttccatttatgctttgtacaatagaaataaaattgattcttctatcttgaccttgtatcctgcacccttgctgaatttgttagttgtaacagcttttgtgtgtctgtctgtctgtctgtgtgtaaattccttagtgttttttatgtacaagatcacatcatttataaatagagatagttttactttttcctttggggaagtgactatgagcagtgggttccccaagactatcccaggtaagatggtttatgaggtggactcacatgactcgaacatagttgaactcatggctaatattattacaacaaatatatttatatacatatgtgtcatatatatgtcggttataaaaagactggaatttattttttgaattttctttttctttttttatagttgtatgtgcttggctctaaggtacttaatatagggttttggacagaaaaatgaaaaacaatcaaatgtgatgatggcattcagatctaagatacctccagatttcagaaatgttaacatttgaatagaatagtacttagcatcttagaatagtattcaggacaagttttgtttggagttttataactgataagagagagccttcctcctacttttcctttctccttctccttcccacacattttgttgtatacgtgcttgtacaaaacctgagtcatagggaatcttcagtgaattgcctgaggttatatcaaaagttggtagctaattcactgtagaagccaccagttcttatatccctgccattctgttgtaggcgttgactgcctggacaacatctttgtgttaagtcagtgatgctgaatcagaggctttcaagaagcctgttttcctcctctgtcagcatgcaagatcctacactttctgcttctggtcttgctttctagctttaactagatcatcctatctctatactcaaaccatatcagtccctataaagtccctgattctttcacctactcctatattgatgccttgtttctttcacttgggatgacattctctgttcccctgtccatgtatttgaatcctaatcaattttgaaggctcagcttacatgtctcattatctattaaaccttcccttttctctcatcctcaatttagatgtaatcatttctcctctctccatgctttatattgcatatttctattctagcatgtactataccctgccttatattatggccagtagtttgtatatatttccatcttctcttaatttttatgctttgtgaggtgaggaactctgtttatattcccatgggccacagcacctagcagagaggagcaaatgagaatccagtggatatttgctgaattgaattacacaatggattggaaggcggctccagtaggtgttagcaggaaaaggatttaatatgaatcttggttttattctgttagcacagaattatgaatgccttttatattgtacctttactgcagaacaaagcactgcatagattgttttactgtagtccaatgggaattcattttgtgatggtttcagaattacccttttatttgtttcaccttttaaagcataacatttgtcaagacaacatttcagtttattgcatgtgctaagtcattactatttacagatggtatagagtatcgatgttcagattgaaaggaaaaaaatacacacatagaatcccatctgccttgcacaggatttaggactcaaacaaaacctaattttatctgtcctgcacatcagaagtagggaactttcaaagaaatcattgctaaaagtaagcatcattgttgagaatttcaggctgtaaaaataatggagtttctttcaaaagattgtttataaacattcttgatatagtttgggatgaaacccatcctggaagaaaatgggaggttatggagtcatatctagttagtaatttgcattagagctatttgggtataaccttctgagtacagattttagatgacctatctgaaggttagggaactagatagatgacatggtaaaagctttgctgaatctcctactagattctactttgcatctgaacagtgcctggcacctggcatttgttcagtatgagtctttcaaatgaataagagaagtttgaatgaatggtatgtatgaatggtatgaatgaatgaagtatgaaaggtagcctccctgaggctgttaacttatctgcaagataagtgttttaatatcaaccctggaggattgttgttaggaccagagaaactgcatataaagtgccttgtgtagtgcctggttgatactagttgctcagcaaatggtagcgattgttcatttactacactttctcagtctgttttcatattggtggtggcaatgagtttattgccatggaagagactatctttctggctgacatttccctttctatttttatttgtttgtgctctgtttttacctcttatttatttttaggaaaccatgtgagagtagaggcatttcctcttttaagtagtttatttgctatggctccgtagtgcttggatgacatggcacgtgtgtgcagcctggttcagaactcatatttttctattgtatatgaatagaaaccccagagaggttggataaatggacatgagagagcgtcgctgtgaaataaagttcaagtgttggaattattgctgttacactctgggatctgaagtaaaaaaatgttttctataaaatgggaaagcttatagataccaatttacttaatttttaagctatcattagccccatagaataactaataaacttagtatagtttaaattcctggaatggtgatatgtactcaaatcatgaaggcaaagactctcagagaaatagttttttttttaatttttaaattttttatttttttttttagacgaagtcttgctctgtcaccaggctggagtgcagtggcacgatctcacctcactgcaacctccgcctcccaggtttaagcaattctcctgccgggcctcccgagtagctgggactacaggcacgtgccaccacgcccagctaatttttgtatttttagcagcgacagggtttcaccatgttggccaggatagtctccatctcttgacctcgtgatccgcctgcctcggcctcccaaagtgctgggattacaggcgtgagccaccgcacccagccagaagtagttcttaaaagatcatttgaccgggcctggtggttcacatctgtaatcccaacactttgggaggtcaaggtgggaggatcacttgatcccagagttcgagaccagcctggacaacacagggagacacccccaccccgtctctacaaaaaatagaaaaattagctgggcatagtggtgtgcgcctgtagtcccagttacttgggaggctgaggttggagcatgggttgagcccaggagatgggaggttgcaatgagccaagattacaccactgcactccagcctgggcaacagagtgagaccttgtctcaaaaaaaaaaaaaaaaaaaaaaaaacacatctttttttagcagaggcttcactctgacagggtaggcttaaagaattttgaccctctatttgtaactactcataatgtatcttaaatttcaagtttcttgaactgttaccaaagaaagtttccttgttaataactgcttgtcaggaaatttttattttatatttgtgaacttaatttctgtgttgtcacataatgagacaataggatgttacatagattttctataatctttctggagcatttaacaacgtatctccatacactgatttccatgctgaaaataatttcacaaggaaatcattcattatggggaaaaaaaaaacccacattgcttaatccaatttaatttactgaaggaacaatattcacttaagtccccaatctcttccttcttatagaggactcttggacattgaagatgaacttttacatattcttaaggtaaaaaatataaacaaatcccaaaacaaatgaatatgactcagaattctattaatttcaaatttggaacataaaaactaagttcctcctgcctcccttactgacccctcccaaattcatgagtatatagattttttttgctttcttttcctagaatcacttactgttgctgagaatataccattaaatcttattctaaaagataatctattccagtcaactatatgcttgattttcctctcttttctttaccacagagcagcttggcctttgtttgaatgctattaatgataggaaagggattgtctatcttccatgaaagtcatttcatctacagacagttctgactttagaacaaagtgcttcttcatatggagtctttctagctctctctcttgctttctgtttgtcttctgtctctctctgagggtaaaaaccaaccaatgaacaaccaaccgaccaataaactgactgagcaaacctgatcaataggtttgagaaatactgcatacatagcccatacccaaggagtcacaatgtgtacatgtgtatttactaggaaatattgcagtgtgtttaacccctaatatttcacaaacttacttgattgtgaacttttactttttttcagaacatctgtccaaacacagcttagagcagaatctggcatatagtagacactcaataaatatttgtttaaaaagtgaatgaatgcaaaataaatctttaaaaactttaaagcacatgctgtattgagatgatccatgttctgcatttttacaagtgacacagccagactagagctactgattggatgcgtataccttccttctctatgtgagcctttctaaatcaattatttatttccacacattttagaactttaaaaattcatatttggatttctaagtttgtatcctcattggcacaactaccttttaaataataaaataaatattagtgatgtgtttgcttgactcttttgctttttgatcatatgtaggaatgaattaattggaaatgcttattttgacttttgatttcaatttgtatctgattgtgtttgattgtacaagcacatggattttcagcagaagtcttaaaatgaagatttgctccagtagggtgtttttaagggtgtttatcagattacctgttgagttacagccctttatttggcttctaagtcagctcctttttgggcttagcaacgagtccaatgtaaggagaatgaatcctttttatctgtgagtagttgagttttctacatgagacagcttgacaaccttcctatcaaacgtaaatctagtcaacaaggaacatgctgtaatgtggacttgatccaggtttggtgatctaggctttttatttctcatgctctaagtgaatgcatttaaaaggtcagcaataggaacagtataaattatttgttctcacttttatatttcaggaaaaaatccgtgtggaaattcgagagggtcagctacaaagctgggtgtaactcagtgtcacaactttatctaaagtcagtattttctgtttctctttgttctcagcaacaatcttacctcgtcccttgcagctgctcaattgataactgtgtgtcttctgttgtctttcctgtgttatcttcttccccttcagtctgtttccaacccagaacttgatcatttattaaagtagtaatattttctcttgtaaccgtgatttcatcctttctctttagtgtggaaatgttattttattggcacagttgtgggctacattttatgatagaaaacatcagtctgtttttacatctatggattttacatgttgttggatctcatagaatgtagggtaccttaaaaagcatttactggccgggtgcggtggctcacgcctgtaatcccagcactttgggaggccgaggcgggcggatcacgaggtcaggagatcgagaccatcctggctaacacggtgaaaccccgtctctactaaaaaacacaaaaaattagccaggtatggtggcaggcacctgtagtcccagctactcgggaggctgaggcaggagaatggtgtcaacccgggaggcagagcttgcagtgagccgagatcgcgccactgcacttcagcctgggtgacagagcgagactccgtctcaaaacaaaaacaaaaacaaaacaaacaaacaaaaaaaaacagcatttactgtattgccctcatttctaaagtgggagtaatgaccacagctaatattgtactgaatgtggaaaaattgaaggccttttgtccaagaactggagcaagacaaggatgcccacttttgccacttttattcagcacaacactggaagtcctggccagagaaactaggcaagagaaagaaataaggggcatccatactggaaagaaagaagccttattagttttgtttgtagatgacatgatcttgtacccggaaaaacctaaagactccatcaaaaaactgttagaactctatgagaacacttggacacaggaaggggaacatcacacacaggggtctgctgtgcggtggagggaagggggagtggggagggataacattaggagaaatacctaatgtaaataacgagttaatgggtgcagcacaccaacatggcacatgtatacatatgtaacaaacctgcacgttgtgcgcttgtaccctagaacttaaagtataataataataataaaaaactcttagaactgataaacaaattcagtaaaggtgcagaatacgaaatcaacgtacaaaagtcagtagcatttatatacaccaacagcaaacaatctgtaaaagaaatcaagaaagcaatctgatcacatttacaatagctacaaaaatataaaatacctaggaatcaatctaaccaaaaagtgaaagactataaaatttgatgaaagaaatagaagaggacacacaaaattggaaagatatttcatgatcatggattggaagaattaatattgttaaaatgacaattctacccacagaaatttacagattcgatgcaatctctatcaaattccagggcatgcttcagataaatagtaaaaaattctaataacgtatacagaaccacaaaagacctgaaatggccaaagcagtcctaaccaaaaagaacaaagctgcaggcattgtactaggtaacttcaaaacttgctacaaagctgtattgaccataacagcatgatactggcataaaacagacacatagaccaatggaacagaatagagaacccagatgtaaatccatacatttacagccaagtcatattcgacaaaagtgataagaatctacaatggggaaaggaaatattttcaataaatgatgctggaaaaactggataactgtatgtggaagaatgaaactagatccctatctctcaccatacacaaaaatcaaatcaaaatggattaaagaacttaaattgaagacctgaaactatgaaactactagatgaaaatgttggggaaactttccagaacattggtctgggcagagttttttgtgcaaaacctcaaaagcataggcaaccacagcaaaaatagacaaatgggatcacatcaagctaaaaagcttctgcatagcaaaggaaacaatcaacaaagtgaggagacaattcacagaatgaaagaaaatattcgcaaactatccatttgacaagggattagtaaccagaaaatataaggagctcaaacaactcaatagcaaaggacccaaataattcaatttataaaatgggcaaaagatctgaatagacatttctcaaaagaagacataacaatgaccaacaggtatatgaaaaaatgttcaacatcactaatcatcagaaaaatggaaatcaaaactacaatgacatatctcaccccagttaaaatggcttgtatcaaaaagacaggcaataacagatgctggtgagggtgtggggaaaggggaattcttgcacactgttggtgggaaagtaaactagtacagccactatgaagaacagtatggaggttttgcaaaaaacgaaaaatagaactaccatagaatccaacaattccactctgggtacatattcaaaagaaagaaagtcaatatattgaagagatatttacactcccatgtttattgcagcactatttacaatagccaaaatatggactcaatctaagtgccattcaacagatgaatggataaagaaaatatggtatatatacaccatggaatgttattcatacataaaacagaatgaaatcctcttatttgcagccaaatgaatggaaatggtggcaattatgttaaatgaagtaagccaaacacagaaacacaaatactgcttgttctcactaatatgtgagagctaaaaaaatggatctcatgaagatagagagtagattggtggttaccagaggctgggaagggtagaggggaggggatgaaggggaaaaaagaatgtaaatatatttattaccactgaactgtacacttaaaatggtaaattttgtatgcatattttaccttgataagaaatataaaataaaatggaggtaatgaggtgaggagtggggagtgacttgttgaaaattacagagcagctaagtggtcaagcccacactaggccctggtgctcccactcccagcccacagacttttattttgggtcctgaggcctctctcattacatgagtgcttaaattgtagagtaagtggacatagtttccatagctatgcaagagtctgagtggtatcagagaatcaagttgttcatattaatacttccagatctgccacctgacataaaatgcatcaattcgtctttgtacttgttcctactgatcaaagcaagggagaaatttgggtctcctattatgtaggaatatttttatgtctgatgctttctcatttaaaaagtagaacacattttaactattgccacttttgcaggctcctcaggggagaaagtgttcttgtatcttttgcattaccctcattctcacccttcttccatggctccatgcctgaaaatgtcaatatgtgacacatgtttgtagctgttataaacacattcttttatctgattaaacatctagcatggaaagaataactgcgagtgtaaatgtgcatgccttgatctgaaatatatcgagtctaaatatataaaattacaagacatttttaagaaatgactttatgtattgacaaattagatatttgtaatggcatgtatcttatgaaaataaacatcaattaaaattgctttatgtttctaatcatgtgtcgggggggtgtctataacagataacctattccactgtctattgtggaaccattgagaacttttttttttaattcccttgaggattgtcctttataaaccacatccatgtggtgtgatttgaggagcactgagaagggtaatgcatcatcagcctgacaccaccagagaccaggactttgaaggcactttgtgtcagagagcaggtgaaaaacatggcttcagtaagagatgtgaaaccacaggcattaaaaccgacaagccaaaatagcctagtttgatgacccgttttcttttaaaaagttttccttgttcatggaccagaggcaggtagtgtactttgatttttggcccctatagagttcactagaattgaacattgtaagttaacacttaagatctgggacaatcaaagcacattgaacaatgcatggacattgttccatctgtaatgataaaaaatgagttaatatgctactttttattgaacacttaccattatgccaggtatttcacatttagtttgcatggtaccttgtgaggtagatatcattatgcccagtttatagctgaggaaactaaggtttagagaggctaactaacttgcccgcgtttgcatggccagtaaatgcaacaagctggatttgaatccacgtctatctagactaagaagcctatatggttaaccacttgtaaaatgggataacagtacctaccttagagattttttaaggattcaataagattaaaaaatccaaaaagcactttgtaattgctaataaagctttgtagagtgaaaggcattatcagaagtagaagacaatctgctacagtgtctccccatgaccatctacccttcaaataaatccgaatgtcctggagtttgtgcctttgtccttggctttctggtgagtgagagtagtttatgttttgggcatagattctgagaagtaggtcactggttctacttattcagtgatattttcgagtgtgatttctttgccatgtagttgagaggaggaaagagatcgacagtgtctgtggacacagacctgtggggctcccagaataattttagacacagtgagaaatcatgtgtctaaaatcatgtaaggctgtaccttaacatgtatgtcatttcttctattttcgtttgtcatagaaaccgatctgctcctccgtataaaggacatcagtcatttcttaatgcaagacatcgccttcttgtctggtaagcaaactttcttatatatagtccagatagatatatgacttgattagcagttagtttggtacctattatataaatagctcgctctctatatatagagctattatatatattcatttgagaagcactatttcaataaacatttgtacattgtgcacctagttgctaaacaaatggacatttagagaataattggaggttttaagcattttagatatatgagtaaaaccgaccttaccactcttatacatttgactttcagacgagtcttcagaaatctatgatagttgaaagtagaatatgtctcctaggtggttgcaggctgggtgggaggggagcagctgaggtagcttctttgattactcaaatgtgtattacaaatggtggcaagttgcactaaataatcagcatgcactaagtatttttttttaggatttcatttacacattataaagaaagttgatttttctcaaagatgtatatacacttgtatataatttttagtaattatggtaaaataaatttaacatacaacttatcattttaaccattttgaagagtacagttcagcggcattaagtacgtttacatttttgtgccaccattgccaccaccatctccggagtttcaggtcttgcaaaattgaaactctatatccattaaacaattactccccgtttcattccttcctctctctagcccctgtcaaccgcaattttactttctttctctatgaatttgactatcttaggtacctgatgtaaatgaatcataaggtatgtgtctttttgtgactggcttatttcacttagcataaggtcttcaagtttcatcgatgttgtagcatgtgtcagaacttcctttttaaggctgaataataatccattttatgtatattccacactttgtttatctgttcatccattgatagatactttggttgcttctaccgtttggctattgtgaataatgccgctaaatagcattacccatttttagagacgtaactatggtaaaccatcctgcccctttagcttctggtcagactttggggaaagttttgcttaaaaacaagcaaattactttcaggtattagagtaatttgaattatatcattaaatattacatttagcatattaaacagataaagaaaacttactggtatatattaatacattgtttttataaagacgaatgcttcttaggagtacaagaaactatcttattccttctaaatagtttaattaattctctgaaaaatggcactcacatgctcagtttactaaacaagcttttactttataagtgatcctaattagacacttcaatctggcctctgcttttattatcattattattatttttaaagacaacttcttgctcttttgtccaggctccagtacagtggtacgatcatagctcaatgtaaccttaaactccttggttcaagtgatccttccacctcagcctcctgagtcactggaactataggagtgtgccaccacgcctagctaatttttatatttttgtagcaaaagggttttgctatgttgcctaggctggtcttgaactcctggcctcaagcgatcctcctatcctggcttctcaaagtgctgtgattacaggcatgagccgtcgcacccagcctggcctctgcttttaaatgattataattatacctatgataaagcttaattaaaaatgattctaattagtggtaactgtgaattaatgatgacttaattaatatggctttatgttttattttataagtggcagaaatgtgtgagtgtcagtaaatttagcagtatgttacgttcacttttaagttttggagattttacttaagattatctgtgttttccaaaccgtgttctaaatagaaccatcctcagggcttgctgcacccatccagacccctctctacacctttccttccttaactgctttttgtatttgttttaaaaatgcttctacctatagcttcctttgaagaaagggttcccaatggtaaaaaataattaaaacttcctgatttggaatgtaaatatctcttttgatctcttctcataaagtttactcgtaggacagtacttgtaggtgttcagtggtaataatcatttatagattagtcaatgataatttactcttataggagccttgccacctttcctttgataagtgtagtttgcctaagtgctagatggttctgtccttaactagagtgctcaccagcttgcttggcaagtatgtagttatatttaagatatttattacattatatattacatatcatttatattactagttctataccatactgtatctatagaggccctttgcttaaagattcactaaatctcttggttcagaattgtacagtttctcctttgagttttttaaaaactcttcagtggatgccattattctcagtgattattttcactctactctaattctggaatatcatacagtgaagattaataaccctttgatttaatactttggactagtttgattaaaaaataatttgggaatgaatactgtctctcaagtttcccttggtaaatattgaggcaaataattaatttgatctttttccatgtgcactagagaagaaagtgtattctgcttttgttggatggagtgttctagaaatgtcaattaggtcatgttggttgagactgttgttcaggtatacaatatccttgcaaattctttgtctacttgttctatcaattattgagagatgggtggtgaaatatctgactaaaattgtgaatttgtctatttcctcttgccactctatcagtttttgctttgtgtattttgaagctctgttattaggtgcataagcatttaagattatgtcccattgatgaatcgaccactttatcatgatcaaatgatcattttaatatctggtaatattttcgactctgaaatctactttgtcaaatattagacagctttgttttgattagcactgtcatggtatatctttttctatcctttgcttttaataatttgtacttttatatttaaaatgtgtgtttcttgtgggcagcatataattcagtctttctttttatccagtttgatgatctttgacttttaattgcagtgcctagatcattgacattttatgtgattattcatatggatggatttaaatctaccatcttactatcatataataagcaaaatacaaatagtgagatggtagcttttcccatttgtcccatgtgttctttgttttcctccatttctgtcttcttttgcgttgagtattgttgtgattccattttatatccttttctttttctttctttttggggggggcgtggagagacggggtcttgctctgttgtccaggctggagtgtagtggcatgatcttggctcaccgcaacctttgcctcccaggttcaagcgattctcctgcctcaacctccggagtagctgggattacaggcgtgcaccaccacacccggctaatttttgtatttttggtagagacagggtttcaacatgttggccaggctggtcttgtactcctgacctcaagtgatcctctggcttcggcctcccaaagtgctggggttacaggcatgaaccactgtgcccggcctgtatccttttctattgtcatatttttattgcagattgaattaaaaatatttttacatctttattcacttaaattcagccaaataaaaattacaactgaactaaaaaaatttctattgctgagctaatttcaaaggccaccttgcaactttcctcctaaaataattcttcagattctatttggcacttagtatttattgagcattcgctctctgtgtaggtgctaggctggctgcagatgtgaaccttaaacacatgtaaggctcatctctgcacttaagtggctttcgttttcaatatttctcatccttcaggctgcatagagggctattgggctgggtggagaaacgggtagaaaccaaaatgaaagcccagagctggtgcaatcattccctcaccaagaacccctatgacagttaccattattcctggttcctatggaaatgggcttagggcagcctcacctatgagcactgggatccatgctttccaggagtcaaggtcacccacttggtcaagatactgctggatgcaactgctccaggttaatggctgcatgggtctgcggggagcttccacaaccctacacctctgcctggacccctacccaggctgaacattgaattttgacccacagataatttgtgatctttctttgcattaataaaattcctatgtcattcctgccatcattccttttgttgtttcttccataaacacattagaccatcacctatttcctatagggtgctctgtatcttttcctgctcaccatgacactaagagatcgattatatcaaattttccacttgctgtcaagccatcattcactcattttaaatttaggctcattggtatagaaacagttatttcccaaccccttggttgtccagattggggaatcagctattttccactgtatttattatatgcatttcatgacattttcttctgactatattcattcattttactctctttctttttctttttttattgagaaactactctgccaccttttaaacttaaagtgtcaggaacttggagccattttggttttatgtggagatcatcatctttgcaaaaaagttgtgttgctgcaaaacagtattcaaatctaaaatcctcttcttgcttcgttgttatatacatttttaattcagttgattatttttctattgttgtaggtggccggggaaaggacaatgcttggatcattacgtttccagaaaactgtaattttagatgtataccagaggaagtaatagcaaaagtacttacttacctgacatctattgcaaggtatagtatttcattacatttttttcaattcgctttatatcagatatccatctgaatgtcataacatgaaaatggcttaatatagctattattatcatggtgaataaccaactgacttaacttcagagtagataagaagtacaacttagaaggagaagctggcagctacctaaattgttacaaaaattatcctgagaatctatgaaaataaaattggggatctaggagtatttgttcccatcaaaaagaacataggttgagaacgatggtcatacatatatgctttaatttgcttaaaaggaaatattaccagccaagagtgagtacagccatttttcatttcttctgaatataacacaagaagactgaatcttaagtagattcaatagtggtactgggagatactaggaggaatgtcttgaaattaaaaattatttggaactagaatgctttaaaatggaaagtttaaaaaggtttcttagagattttatgtgtgttaaagacaaaattttcaaaggaagaattttctagttactaaccctgaagaacaagaggacacaaatctaggatgataaaattcaaagtctcatgaacaaaaatcaaatctcagaaaatgaaacttacaatgtacctattgaagcttgaaagtgatatttttagggcaaatagaagttatattttccattaaactgcatttcctcaggagcagactagagttagaaaaatagatttagcagtgtgattttgaatgagtgaatggatcattgactcatgatggattgcatggaaagttaaatctgatatcatgaaggacacttatcttttgagttttcccacacccaagattacagtattctaaatcaattttagtgacctatcttcattacactatcactttcctatttaaaagattgacattaatgctgcaaaagaaattttaaatagtgagtaagggaatatgtattcagattagttttctaagataggactttgtgatagctttccaattccaaatctgtcttcagtcaagacatcaaatgtagatgaaataatcagaaatagaatgaaggcatatataacaaatttgcattattattaagaaaaagttcttatttcttcttatcgttcaggcaaaatggatcagactcccggtttaccattattctggatcgaagattggatacatggtcttctctcaaaatctctctccaaaaaatctcggtaagtatctatgcattatacagtaactttttatttttgttttatattatactttctgttttgggaggtatagattactttggtactgacggagacaataaaaattgatggaatgtgaggagggaaagtagaaggagaggttgtagcagagactgagataaataactctacccaaaataaaacctagtaagaatgagtgagtagtttgtggctccagttatgagtgagaagagattcatggttctatgtgcctttcaggacaaggcaagtttttatggaagctttttaaaattatttatttatttatttattttggtggaaatagctgtgttgcatactcgtatgtgaaaaagtataaagaagaaagtttaaaacaatagtaatccaaccaccccaaaataagcagtttttaacatttcagtgtacaactttctagatttgttttaccctaggatagggtagggagatgagtcacatataaaatgatatataacttccctactggtatctagtccccaggttcccaagacccagagagagaaacattttctctaattaaaataacgagaggtacaattctgcccatgaccaagataatcttttacacttttaggctcacaagggtatcacaaaattgtttgacacttcactttcatagacgaggagggagatgagggacccccagactccttctgagctggcaagatatgggctctctgtggaagtgccatgtggccaacttcctctatcagactagaatagctgggaatcaatatattttttttctttgagattccaacattgccagccatctgaaattcttactttgtctcctgactgattgaggaggtcacgcccaccacaagaacttgatttagttgcaaaggcaaaacaaaaatctaggttgttggacttccaagccaatgttctagcacttgcaaggtaaaatgggtaagatcattattcttttaatactcagaatgaattattcctcactttggacaaataagcaaaaagtggtttcctgtttatttaacagaggtgtttaatcattagcagtggagagaagagttaacattagatatactcaaattactaaaataaaatagaagaaaatttgactttctatagcatattagtgctttttcaaaagcattcacatttattaagtattgttgattctcttcatttcctgattaagtactgcaagtaggtatcactataattgtcttatagatgatgaaatcacattgatatttatactttggaatggctatgtgatgaatccaagctcaaatagccaagtaaccaaaaaagccagagcaagaattgaaatgtcaagaattccagttggtgatggtttctatcattttccaattggcttacaaatagacaaatacattcaatgttatttagataaaggtaaaatttcttttgagagattagatctgtcctccatatacaattgagccttatcagtggggctaaataaagtaaaagctatttcccttgctccggtcttttaggattggtccttgggcttgctgagtagaccttggtttatgctaataattgcttctcttatactaaataaagcacttgttacattagaacattttttatcacccaggtttttttcttttggccaacactgcacccgcctgattaaattaattttcattttgtgactggtttggcacctgacgttagtttttttggtagagttttatttttattattcaaaataggtggcttgtaacagaggttctatttttcataaaagagaaatataagattaggtcatgatcctgtcattttgaagtcaacagagggtaattacttgtctaccggggagtgatactcctctttctgtattcccagggctgctttctcagtggagaattttgacctatgctcagtaaagaacttggatcccagggtccctttattttcataactgccaaattgatcgtgctgggcaagggaggggtacagattctgaccacatgtaactggctataggttgttttaggtgtttcttttttaacatgttaaatgtttttgcttgtggtatagtttctatactcatactcaagagcacattaattacatctcaaccattagtaactgttggttactgtttgaaataaaggtaaatattgaatgcaagctaatttcaagtgcaaaagttggcattcagaaaggatttctagtgaaatctaccattgtgtagctaggtataattgcctgtggtgtattatttcaaacaagtgtctgtgaaataatcatacaattcaatttgaatacctttatttgtagatttcaaaacaaataaaagcatttaggttgtatttcataattaatgagaggagactttattttagttatacattttggggaaaggttaatttgggagagaattgtatccgtcttagaaagtttgcatgttctattctttctagattattaccaggacaaaattttgcaaactatagcctttcacaaggcttaaacccagaatacaataacagagaaaacaaaacagaattgaaatttaagtcacataccagggtaggacgagagtaaaaagcatgagttaatactaccttcacaaagattcttagcattccaccttaaaaatcaaactgcgcagaggagaaagccagtcccatcaagcctgctcctaggaagagagctggtttttttttcctcctccttccactcttaggacatgcctgatcttcttgagcagtccagcacaagctaatccacaaggttcaatcaggctaagtaattggaggaatgtgttaactctgaattacaaggagcagaagggaaggatctgtcagctgactaatcagggatagtggtttttttttttttttcctccccagcattgctgccactgtgctaatggaagcagccacggcagctttgtttgatagagatttttggctgccgtttttaaatactacccaagaagcagctcgtatttcatcaacgttgcgttgacaattggaaaagaaaagtgtaattgcgtacaggcgaaatggcagaagcaaatccccggagaggcaagatgaggttcagaaggaatgcggtaagggctctgtctgcactcctggaaagcctgttcccaagttcaagtgctgggatgctgcagcatggtgctatagcacaaactgctgagtagggtttttaaggacagatggagagaatggagacttatatttgcatggattgcattgatgtgattactgtgatattgacatagggtaattttcaggcaattgagggggtagaatataatttcaaaatctaaatgtcatcaggtttatgaatgagcaccttagtcatgttattcgtttaagactgtatgaacaattttgaatcattggacagcatagctttaaataatgacttaaaacaatatctaacaaaaggattcatcctttctttcaccatgatcaagtagagtatattgccatggataggtctggaggggattccatcatcacttaaaaatgcagcctttcctgggtgttaccgtataagtgaataaatttaaaatctgtaatgatttgaaatccttatggtttcaattcttctccaaactgaaacttcgtaggtacaaaattgtcacctgctgacaacttttttcttttagggaaaaagacagtaactcacttttcaatatagactagaatttggaagtctctcctctcaggtacatttcatgcagtcttttgcctaaattttcccttcattcatttattcatatagtaaattcccagcaaatttctaatgtgatctttagatgtattttggagaaatgttgaaataacactagctaatttaataaaaaactaatcatcaaaaaggctttaaatgccactctttttctttcaaagattaatataatgttattgatgttatggtttaaaatataaacttgctcactaaaaatatcgagataacacacacacacagataagaaggtaaaaattgaccataggaaaaaaatgacagtttgaattaaaattatgataaggaaagtaagacttttattattgttgaatgacagtgaacatcaataggtgtgtaaatgatttattttctaataaagctcttagcacagactgctattttaaaaactatagttggctttattttgacaaaattatatctttggctctatacatgtttttatattatgagaatatagattcagacttttaacagacgatttatggtgcacaagaaatgtttgtgtatgtactttgcagtattgtaggcaactgatattagcacttttgttatcaaaggttaacttaagctttcagaaagttcctaattatatatatacatatatttatatatatatttatatatatatatattctcagtgctgaacttagttttatgtctatacacatgcattaatatacacacaataaatacagcacaggggtactcactgaatagacatatctagcactgtgatatatacaacataagttacaaaggtaaatatggaatggctactgggctgaaggaactctcaatctaatagaaagggtaagacatgttcgtaaatgactattttgaaaagaaattctggctggtggagaaggccttatacaggagatggcatatgtttgggtgttaagtaagagtatatgttgctgttacctttccttgattctttcctgtgtttttttttctcataaatgaattaagtgatatgtaggaacagatatgagtgggattaattggattaattctgaagcctagaactatagtagaagacacatatgctttccttatatggataggacttgaccagagtaaagaatttgaaccttagctagtaaaaaaatggtttcaccttgaagggtctctggaattgggctgattctggaggctgtggacaggtaacatctaaaaggatggtccaatgccacttgaagtccaaaaaaatgtttgaactagttacttggtagaaatttcaatgactgtagctgagtgagagagaggggaggagaatagatatatatgtgacgaaaagggcaaaccacaaggaaggagtattgctttgggctatcctcctgacgtcacttgacaagttgcttgacaactcatactgtctgtactttttaaggtggggatatggggggaagagtgtggaagtggctcatactgttgcaaactattctctatagcttgaggtcatgagatttttttcccaacatattctgcagagatggttcagaccttatgaaagtcaagtgcctgtcagcatctcaacatttgtctgacagtaaattatgatactttccttttggtggactgtatatgctaaattgtttccagcaacttgtttcaaatgttatttgtcccattttggaaacatcaaggtcaaatcatccctgaatggcaaacagtaaatccgagtgtgcattcagtctatgaggtgttaagtgtctagaaagagtttgcccttaggatccagataggccgtactaccgctgcttaccaactgtgcttcagtttgctcctctgtaaaaagggaataatatccagtttactgcaatgttttgaaggctaaataagataatatatatataagaagtctgacacatacataatggcttttagtcaagggtctctcttattgttactgcctttctttaccctaaagattaaataggaaaagctataggaaaataaattatttttatagtaagtaaccaaacttttatgttttataagttactttaaacattctagaaataataactagaataactgaaaagtgtgcatagggtgatgaattgcctcccttagagagcacacacaagagtattaaacaaggttaatttctagacttcggtagtgaaatgatgtatttggtttacgcctgctcttgttgttattgttgttgttactgctgtaagatcatagaactaggcaatctggaagtacgtgtgagtaaaagggagtaaatctgttctctgggagggaaagatgagagggagcttattttgtgctcgttaccttgaagagcctgtaagagctgctgctgagggctggggtgggaccacgtacagtgattggacacatggctccgagtcctatgtgataggcagctggttcgcttttactgagatgtctttaagcagtcacatgctggaactccagaaaaatgtctgcgagaacctaaaaccaatgctgtttcctctctcgtgcaaactatttttttaaaaaagcaaaaacacattgaaataaaacaagactaacctttgcccaaatccctttgcttttttgacaagttctcaaaaatgaattatactttcaaaatctcagtttttattttggggaaaaagaaattgtgctttttcatgtttatataaccatacagattagaggttcttaaagcagcatacccaagaatttagaaatataatattcccaaaccaaaatgggaaagttcactggtcttgaactatatttgctttgatatgtgcatctgataccctatgctgtttgattgttcatttaaatactagctttaaaatggattatcttgagaattttagttgttacaaatattggtatatagagaaaaagtactctctatatatacttatatgtatatcaacatagatacatacaaactaatcttaaatgtatatggcttgtcaggttaaaattgctcaagagtgttctgtcccctctagattctcatagccggcaatcacagataaggacgtgtccatattattgatattgattgatgttcagatctatgaagctttttggttcagaggttgcaaattgtcagtgcacagatgcgttttgtttagagtatgcagcattttaacaaactttcaatttgttttccatctttaaacatctgggctttgcatgacaatctggatttctgtcttctcttgagaaaccaaagagttggcaatgctgggcccaccttgccacatgacaacatgtagctggaactgatttatgagtgaactgacttatgagtgccctctgctttgaatgttctccagttcaccatggtccccaccacttcctgttgctcctcgtcatataggaggagtatgaattgctattttccacctaatttaggctgttctttaattaagcctacttcacatttacattatctccctaacacatggtaggcattcaagtttgtcacctctgctttaggtctcaggtttagattctcaaccaacctgattcttgtgtcatccctgctataacttctgcaaattcctcttgttgactgagtctagttcaacaggcaggtgaagcggggttttaattctgctacttatgtgctagaaggtcttgaaaaattgcctgacctcacaaaacctcaatgtgttagttccctattgctgctgtaatagattactacaaacttagtggcttaaaacagtgaaaatgtatcattacggttctggaggtcagaagtccaagattacccaactgggctaaaaatcaagggtcagcagagctgtgttccttctggagtctctagagaagaatctgtttctttgacttttctagcttgcagagatcgtccacattccttggtttatacccctgcatcactttgacctctgccatcacatcttcttctctgactctcctgcctccctcttatcctaatgattacatcggtcccaccatgataatcccggataatctccccatatcaagatccttaatcacatttataaagtctcttttaccatataagataacatattaccaggttccagggattaggatgtagacatctttgaggataatggcactcagtttctccagttgtgaaatgaggacaaaaatagaacctactgcatgtaaatacttagcacaatgtcataatagtgctctttatgggcataattctagtagtatgcattcaataaatgacatttccacccctgtccaactctccaatctcctttccctaccttaaagctttgagaggtcctgaatatataaatatacataaatatacgtattttttttgctaaagagaagctatgaaaagtagtcataaatgtcatactttaaaagtgtgacagtttggtaggcacctgttatggtctgggttaagtgaatgggagtgggattaaaaattcaggtatgtcttattcacgtgtgggcacgagggatgaaaacaacacacctggtctaaactatatgatttagttttctagaaaaataactgacaaatcagatgaattgtttgagtgccacctgattgctctgattgcttagtagttgtgtagctattgcctacaagttatttagtctcccaaatggctactaaaattgggagtaactattgggttaacagaatccatgtgctctaggaagatatgcaaaaaagattataaaattgtactataaactataacaaaaaatattgtaaatgttattatgtagtcaataaatgaagttttcatcctttgatggtgcattttctttaaaagcccaagtttttctgggctttttgtgacaagtgaattactaaacattttgaaggaattaaggaatgagaaggtatgctaagataatcagaaggttttacttaagaatgaactgattagcatatagaattatctttagaagcaacttatatagccgtcaatgtttgggataatccactttattaaatagagcaataacaggtttaataaacatccaacataaaatccctagcttatgagcagctgaatacccctacccctgcttaaaatcacttccccactcatcttgcagacggtgattttccttctctctcctttctttctactttgttccctgctatgtgatcagctgtctctggacctggctgctggtacagccttgctctcctaggaatggcagagtagagagcagggccttacctcaggcagagagttgctacatagctctctctattcccatagtatcctcccatcccctcctccctcacacataattttggagatgggtgagtacccctggcttgaagtcagccccaggttcttgtatccagataattctagatacaagagaatatgagattaagggaagtcagagagagaaagatgaaaccagatcaacttagaatccatgaaagaataaaagtaattttgctttaaatgttggcaaaagtagggtgctttcaatttcatttaaaagtgaaaaaataaacaggttcaaggcaggtgagtataataatataatgggaatttacccaggtgaagaaaaaggaaaggcttaactcctaaaattaagggagtaaaaatagaatctgtgctttccacttaaaaataggccaaaagttcccacaagtccctgtcagattcttcccttaagctagcctttatccatatccctaaagttttctacccaaacctgcttgttctgacgtccgagaatccaaggcaaaattttaaaactatcttattaatattttttacagtttaaaaagtgccttttcatgtccttggcccactttttaatggggttgtttgtttttctcttgtaaatttgtttaagttccttaaatactgcatgttctcacttataagtgggagctaaataagaagttatgaacacaaagaaggaaacaacagacacgggtctacttgagggtggagggtgggaggagggagaggagcagaaaagatcactattgggtactgagcttaatacctaggtgaaggaataatatgtacaacaacccccactgtgacacgtgtttgtctctgtaacctttgcatatacccccaaacctaaaataaaaattttagaagtgcctttatattcattatttcttttaattcctgtaataactggaaaacatatatatatattttttttcggcagagtctcaccctgttgcccaggctggagtgcagtggcataatctcagatcaccacagcctccacctcctgggttcaagtgattctcatgcttcagcctccccaggagcggggaccacaggcgtgtgccaacacacccggctaattttttgtatttttagtagaaacgggttttcaccatgttggccaggctggtctcgaactcctggcctcaaataatcctcccacctcagcttcccaaagtgctgggattacaggtgtgagccaccgtgtccagctggaaaatacatattatacttaacataaaataaaatatacattacgtacataatagaaggtaggatatacattaccgttggaactctctgtttctctgtctctctctgtttctgtatacatgttaactttattcttttcaatgtttccccagcagcagggctcttggcaatctgctgcttttgaatggcatcctcaaagtttccttcactcagtattcgtttgaaaattctagggcaggacttctttggccctgcttacatcaaatgttcatacttatgttttttctttttcttttttaaaaagatgaggtctcgctctgtcgccatcatggctcactgcaggctcaacttcctgggctcaagtgatcctcccgcctcagcctcctgagtaactggaaccataggcgcatgccaccatgactggataatttttaaattttttgtagagatggggtctcactatgttgtccaagctgttctggaactcctggcctcaagtgatcctccatcctcggtctcctagcctgttgggattacaggcatgaatcaccatgtctggccctaatcatacttctaatcactattaatcattgtgtgttggaagggcagggccgtgtaggaaaataagagttctcatttggaaccaatgtgtagaataatagaagggggagtcgtttctcagatgaagggagagagtaacagtcatggcctcctgggggaattatgagttggacagccatcccaatttatgtatattgataatcattgtttaatttattgatttaattttatgctcttttaatttacttatttgtgcttatcacactcatttctctttcatttactctagttctcattgccacttaacattttatgttttatcaccatctcaaattgaattaggaaaatccccagttttgagcatcatttcccaaagagtctatgttttataccctggtggaagttacttttttcttttattttaaaatagactttatttttttagagcagttttaagttcacaacaaaatttaacaggaagtacagagagttcccataaactccttgccccacagtatcttattcttagtttatagttttgtttaattactagtattgtaatatgcctgaaatataattgcagttggaacatttttcatatattttgctctattatgctctaatctgccatcttgaggctgatggctcctgattctccacttttagcctagacttctttcccttcttaattgtacaaacagctatccgaaggacatcatctggatgtcctgctgacccttccaacctaacgtgtatatgaatggagatcagaatcttgtttcccttcttaaaacctgtttctcttgtgtttcccatctcagtgaaggttgtactattcaaccagttactcaagccccaaatctggagtttgatcctcctagtacctcctttctcggcaagtacatcaagtagttatgtcttgctgattgtgcctcctaaattctactcttattcctggtatcattactttagttcagaaactcatcattcctggcttggattactgtaccagcctcctagctcatctgtctgcttctactcttgttcaaatccagttcttcccaaagccaaagtgatctttctaaaatgcaaatttgaccatgttgttctgatgctcaaaaccttttagagactccccttacctccaggaaaaaaaaacccatgatcctttctgatgtggttctggcccgttttcccaacaccatctcccattgtcccccagtgtcatttcatctagctctcttgactagggccttttcaggaggtggagtagtttagtgattaagagcacagacttaggggcaaatgaaggctttgccagctgggggaaggtatccttaaactctctgagtctcactttctttatttgtaaaagtgagtaacctaactccttcatagaattattatgaaaagaatttatgataatattggcaaaatgctttgcacagagtaagcatttagtacgtggtgatttgttattaaaattgggatatgttactccgttctccacttattttgcaatgtgtcctccttctttgtcttttgaattctttagtgtagcagttatttttgactgcatactatgtgccagcaagttctagacgctggggaaacattggtgaactagaacaacattctgatccagttaactcctcgttatgcttcaagatctttttgaccttcctatgtctcggagagtttgtgctatcatttccccttgtatattattctaattcctttgattacttatcaatttagttaaagaattgctgattagtaatggactctgcagttgaactgttgggtagagattgtgttttcttaatttgtgaacattcaatgcctaacagagcttgatattcatttaaatacatgaagtagacacatagaagatgttcagtaaatattgattggattaaaataaaaatataatcccataataaagttttctttcattgtttagtgtaaatacacagacaaaaaccctttgacttttagggttatcctaggaaactgccacctaattctatttgtttttataggaaataagtgcaatttgagttcaaataactctaaaataagatttagagtctatttcttcataaggttggatctacttctttagtgtgagaaaatttcgtaccagaagtgttgcaaggatctgacctggagccttacattatttttctatttgcatgtttttagattttatcaatatccatttgtaaagtgttggccttttactggcttttatgaatttaaaatttgtttccttcagttacatattttctgatatgtgctcagttgagtgtgtgttgacaattttttttccaatttcttttgttctttctttctacaggcttccttccctgggaacttgcacttggttttggttttacgtcctaccagctttcttcaacgaacgttcacagacattggattttggtttagtcaggaggattttatgcttaaattaccagtaagagtatattatttaaatgttttgttcctctaattctcatgaagacctgtaccatgctgtttatattttacatgtgcccatgtgtcatttaaaagaaaaaaattaaaatgtcttttaaaagtatacatttgaaatgcccaaaagtctttcacttctaccatttgaaaaagaaatcgattcatcaatttataacaaagcaattacttttgcaaaaaatatatgtcatatatgttatatatatgtgtatatatgtatgtgtgcatgtgtgtatatgtatgtgcgtgtatgtgtatataagcaggaaattttatttttagtaaaattgagtgtatgttttatgtatttgaactcccgtgaacttacatcctgagctagtccagagtaccatgactttttaaaaatatttttgtttgtttttaaggttaggaatagggtgctcataaattttgatacttttgaaaaggtcagcccctcctgataaattataacttactacataaagtccttttctttgttgtgagcatagcattcttttagaagctggaccattaacaatgcaaacttttagatggaggaaaattaggcgttttggtttctgtggagattgatttagctttacagaaaatgttttgtaaatagaaactgttattatctgaagaaggtagcgcatacatgtatgggggcatgtacaggagagaactgttaaaaccatttatcagaggtaactttctgctaaatgtatgccaaagttcattttacagtttaatggagggatggcatgaagggcagttaacagtatcttttttgcttatttatataggttgttatgctgagctcagttagtgatttgctgacatacattgatgacaagcaattaacccctgagttaggcggcaccttgcagtactgccacagtgaatggatcatcttcagaaatgtatgttgtctttgcccttactgtagagcctatagttcttcatgttagcctttaaatctagttctagaattctttcctatttgaaaaaaacaaaacaaaacaaaacaaaaaaaccccagctttctgggccctcatttttcacatacatataaattcaacatcttggttttcttccataggcaatatctagaaatgatgagcagtcactgaggatggcaattgaaggagaatcctagggaataaggagatcatactctgcccatcccctcctgtggctatatagtaacttgaagaaatgaagggtttggattcaaatcctggccctgctgatttttagttatatgaccttggtcaatatacataacctctctgagtcttagttttcctaactgcaaaatgggactaataataccttacctcacagggatcttaaaaagactaaatgagatagcaaaagtaaaatgttttacacagtgcctagcatatggcaaaccgtcaataagtgcaaatagtattattaatctcattattctagtgatgcttctgaggcatttaaatttgtagcaaagactgtacttctgttttagaaatttacaaataggcaagggccctgcacctcccaagtatgtctgtggtatatgagtatcttgacttctaatcccagagataggggaacccttctgaagaaattaatgatgtcccattaaattaggattccattttcctcatacttgttcttcactcaacatttcattcattaattcatttaacaatgcattcattcaacaattcattcattcacatgaagatgtattgccaaaattagcaatgcctagcctttaataacctgtaatgctataaataaacaagcaaatattttgatatgcatggttaacagatggtcatatggtctctacattttgcccttctttctcagagtaattgattttagaaacaaaagaaacaacaaaaccgtacttaccattttatggcaacaaaggctttggggccaccattccaaatattctatagtacctgaaatgagttgttgtgactagtttttcccccgtttccttcaattatcaccttgtttggaatgctaatgcttattcacaaatgataataaacaaatataaagtgactttactgttctcatctctcttcagaagtaaggttattataaggcaattttgccaattggagagtttatagaataaggaaaatactgtaattttcaagaaaataaaacaaactactcaatacatggcatctttaagaaatagttttcattagtgtccaagaaataagtcaagaaatttggataaaagatattcaggaagactcttaatcttccttcagtttcttagagttttagatgaagagttacagttgattgccaagagcaatgccatatttctctagcagaggagagttcatagtatatgtgtttgccgttatacccccaataaaaacaaatacacttactgatccagtttttgatatgctcacagagtgaccatataattaaagtaatcaccggctctttgcaggctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaaggtatgtctgatagagttgacaaacaaaagatttccatggtctttatctagagaggtgtttattatctccattttacactgactgttgcataaggggagataaaagacatttatgtaatatatttaaaaactaaaaaaaattatactttataagagaagactgtcctggatatgttagacctaagtgtcccctccgtaaatggtgcattaatttgagaagttatttaaaaacatcttataaatgctgcagaaaaagaaatatagtcttttgttttactatgtgcggtcatgtactgcataaggttgttgtgatcaatgatgaaccacatatatgacagtagtcccatatgattgtaccatatttttactgtaccttttctatgtttagacatgtttagatacacaaacgtataccgttgtgttacaactgcctacagtatgcctacaactgcctacagtatacagtacagtaacatgctgtacaggtttgtagcttaggagcaataggctataccctgtagcctaggtgtccagtaggctatccatctaggtttttgtaaatgcactctgtgatgttcacaaaatgatgaaattgcctaacaatgcatttctcggaacatatccccaacattaagtgatgcatggctgtattttttatttttgaggaggagtcaggaggccgagtttctagtcccatctctgctgtgagctagcattgtgaccaaggctaacattgctcaattgattgtaagttctcttctctgcagaatactaggtcttgatgtttcctacagtagaccaggggttgcaaattgtttgtgctctcctatccaggtctttgtggagtgttgttttgtgaaggattctgaagtgcaattcagataatcagcaagtattttttggatccactttcttcagaaagtttaagaataatctgaacaagcactgggcattcatataacttgtctctctcatctgataatagacatactgtgtgcattagaagattaaagctgtatatagagatatgtgtttaaattaaaaagataaactgagtttttttccaacttttattttaggtccagagggtacatgtgcaggtttgttacatggataaattgtgggatgctgaggtttggtgtacgaatgatcctgtcacccaggtagtgagcatagtaccagataggtagtttttcaacactctgcctcctcccaccctccttcctctagtagtccccactgtctattgttcccatctttatgtccatgtgtacctaatgtttagctcccacttgtgagaacatgcagtatttggtttcctgttcttgcattaatttgcttaggataatggcctacagctgcatccatgttgctgcagaggacatgatctcgttcttttttatgactgtatagtattccatggtgtatgtgtaccacattttctttatacagtccaccattgatgggcacctaggttgattccatgtttctgctgttgtgaatagtgctgcaatgacgtatgagtgcatgtgtcttttggtagaacaatttattttcctttgggtataaacccagtaatggcaatgctgggttgaatggtgttctgttttaagctctttgagaaatctccagactgctttccacagtgactgaactaatttacatccccaacaagtatgtgtcagtgttcccttttctctgtagcctctccagcatctgttattttttgtctttttaataatagtcattatgactggtgtgagatggtatctcattgtggtttgatttgcaagaaactgaccttttgaatcacaatctaaaaacaaagctctgtccaaggaaagaaagctctgtttttcacaaactgcatgttgtcaggcaatttgcttaccttttctgagttgcagtttctgtatctttacagtgaggttggtgatgatgatgatgcatcatacctggtaggattgctgtgaagatgaaatgaggcaaagaaactgatctatgtataacaatgttccgtacatagttggtacttcgtaaatattggcttttaatgttgatattattacccatattggtgatggtgtcatggaatctgtcctcagaataaatgtacaccaaaacttttgcttacaatttcaagggactcttggaccacctgaaagaaatcttaaatcactcttagatgtctgagaaaggtctatattgttacaccacccactgaggttaagcccttctgaatagaggcatatacttcttgatgagttaattaaacctaaatgtgaagtaaaataagacttaaggcagggagtgattggtaacaattaaggattagtagcaaaggcatttaactgtatctgaatatgcattaagtattatttgcaattgtatgctttctactgtggtggtttttattgtgctactactgctttatttgagctcattaaaagtgttagcagaacagtgccaggtgcagtggtacatatttgttgtccctgctacgcgggagcctgaggcaggagaattgcttgagcccaggagtttgtgtccagcctgggcaacatagcaagatcccatctctaaaaaagtaaataaaaataaaatattagcagaataggatggactggattggaactttctaccagttagagaaggaggctacaaatagagcacatggtacttctgcccatgatgatcttataaaaacattaattgcaacgtccatctctaaggcaagggcttcttggatcttcacagcttttagattttgtggcactgagattttgaaattttgtgaattttcagagagctatgaaagcaaaggccattctagaattaactgtttcgattcttcatgccatagttgtatgctcccttcccatcacatcattcaggttggattactaattaggtgatactccttttgtgtctttggacagaatgatattacagctgtaaccaaagaaggaaaaattctgctaacaaatctggaagtgcctgacactgaaggagctgtcagttcaagactagaatgtcatcggcaaataagtggtgactggcaaactattaataagtgagtactctctttttggtttagagttacttattttatatttttgaaaggaaattatacatttttgctgcaatatgttaagtgttaaagtattcctggacctctggaaatctgagaacttatttctaggttgtcctacagagatgattttgcttgtagaagagagtctgtggacattggttgtctctataggtagaaccaagtgtcatgggctatgactttgcctataattcttaatgtccagaccacacttatctacatacttacaaaacagatagttgcttttaggaatttattggagttttctttcttaaggttgctgactcaagtacatgatatggaaacagcttttgatggattttgggaaaaacatcaattaaaaatggagcagtatctgcaactatggaagtttgagcaggattttcaacaggtcagttaaaacatttctttgtataccttttttcattacaccagaggtttttactccttaatcatgagaaatcctgccttgcaagatgcccatttatacctacaaagaaaaaaaaggaggcaaatgtaaatgaaccttggcttagactgaagaaaatctctactaaaattctgagacttctactttttcagcttactcgtttcctttgagaaagtatcaaactgccaatatatatgacagggacaaagttactctctactttggggtttgttattcaaatttatcttagatctaaagggtattcaaggttatgaggtagctttccaagggaataataccaacttccttcttggtttttaaatcccatgtacctatgctgaccatatttaataagacctaacaagcttttatttctgatccaggagtttattcctgtgaaaagcctgagagatgaaattaaataagtttaataaataattaaaaatacattccaattggaccttcctggaaaatccatcatatatggtcaagatgcatagatttagtttcttttccttttgcggtcatgttcaaccttatcacagtctctctcacagtatatacttcaccagaggatccaaggaaaactcacttgttcctcttgcatgtgcccagcttgttttctgcccatgaatggcttacttgctttgtatttcacttgctcatcagagttaggtttcggaggagcactgtactctggacgcggggctcagttaccactagcgttttctctcctttgattcaaacatcttttgaaatgttctgcatgaaaccttccctaaagaaagaataggtcaggttgctcttggtccttctaggtatttgtgtttctccctcgtctccaactgaatacacagaaaatagcacttttcctgaacatacccattatgcttatacttacatattaatttgcatgcataccaaattcttgtcctgtggttatgttctgtttccccaagtcattaattcctgtctttaatcaatattgttgtttgtcttagattataatctcactgacatggtgtgtctcatagtgacatgtcgacaagttctgtatgtctagaaacatgactttttaaaaaaacacgtagaaacataaacttacagaaaaatggcaaatataagaaaaataaaaatacccatataccttcttcccagattaacttaatgacaatattttactccatttgctctattatttttattccctccctcatatatatacagataatatttttttctgatctgacaaataatatattttctgacccatttgagtgtaagttgcacacatgatggccctttccccctaaatgcttccattttttctagtaatagggatattctgttatataaccatagtacagttatcagattcagtacatttaacaatgcaatacttttatattatctaccattggtatttcaattttgtcagttgactcagtcaagtcttttatagcatttatttttccttcagaatcggatcctatatagggtccagtcttgcattaagttgtcttgtgtctttagtgcccttgaatctagaacatttccacagcctttctttgtcttttatgactctgacattttgaagaatatagtcctttttttttttttttgagacagttctgtctcccaggctggagtacagtgacacaatcatagctactgtagcctcaaactcctgggcttaagccatcctcccccctcagcctcccaagtagctgggactacaggtatgcaccaccatgcctggctaactttttaatttttgtggggatggggtctcactgtgttgcccaggctggtctgcaactcctaggctcaaacaatcctcccgcctcagcctcccaaagtgctgggattccaggcatgagctataaggactcatgcccagccatagtcccttttgaaatgcatttttcttcatttggagtttgttggacatcttctcatgattctatttagtatatatgaccagctagaataccacattagtgaagtgtccttcttaaggaatcatatctgcaggtgaatgaagcctacctccctcttattgttgatgtggattctgattacctattcagggtgttgttgaatttctccactgtaaagctacttttactccccttctaactagtaggaaatgtgtggggagaaaatttaaggttatgcaaatatcctccttctcataaaaatttccccgtaaatttagcatcaactgatgatgtttgcctggacaaatctttgctgtgatggttgcaaaataatgattattttcaactcccatgtccagtccacatttatcagtccacactaggcattctactgaagcaagagccttcccttctctccatttatttctttatttgattcaaagatttttacttattggtttttaaaactttcaacttttattttagattcagggcatacacatgcacgtttgttacatgggtatactgttacatgggtatactgttacatttgaggtgtgaatgatgccgttactcaggtagtgagcataatatccaatagttagtttttaagcccttgccttcctcctcttcccccttttggtagtctccagcatttattgttctgtctttatgtctatgtgtaaccaatgcttaacttccacttataagtgacaacatactgtgtttggttttcagtctctgtgttagtttgcttaggataatggcctccagctgcatcatgttgctgcaaaagacatgattttgttttttttatggctgcatagtattccatgatgtatttgtaccacattttctttatccagtccatcattgatgggcacctgggttgattccaagtctttgctattgcgaatagtgctgcagtgaacatacaattgcattgcctttttgatagaatgatttattttccattgggtatatactcagtaatgggattgctgggtcaaatggtagttctgtcttaagttcttaaatattcaggatgccttccacagtggctgaactaatttactttcccaccagcagtgtatcagcgttcccttctctccatagcctcaccagcatctgttcctttttgtctctttaataatagccattctgactgatgtgatatgttatctcatttgatttgcatttctctgatgattagtgatattgagcattttctcctctttgttggaaatctgtatgtcttcttttgagaagtatctgttcatgtcctctgctcactttttagtggagttattagtttttttttattttattattattatactttaagttttagggtacatgagtacaatgtgcaggttcgttacatatgtatacatgtgccatgttggtgtgctacacctattaacttgtcatttagcattaggtatatctcctaatgctatccctcccctcgccccccaccccacaacaggccccagagtgtgatgttcccctttctgtgtccatgtgttctcattgttcaattcccacctatgagtgagaacatgcggtgtttggtttttttgtccttgcgatagtttgctgagaatgatggtttctagcttcatccatgtccctacaaaggacatgaactcatcatattttatggctgcatagtattccatggtgtatatgtgccacattttcttaatccactctatcgttgttggacatttggcttggttccaagtctttgctattgtgaatagtgccacaataaacatacgtgtgcatatgtctttatagcagcaggatttataatcctttgggtatatacccagtaatgggatggctgggtcaaatggtatttctagttctagatccctgaggaatcgccacactgacttccacaatggttgaactagtttacagtcccaccaataatgtaaaagtgttcctatttctccacatcctctccagcacctgttgtttcctgactttttaatgatcgccattctaacttgtgtgagatggtatctcattgtggttttgatttgcatttctctgatggccagtgatgatgagcattttttcatgcgttttttggctgcataaatgtcttcttttgagaagtgtctgttcatatccttcgcccactttttgatggggttgtttgtttttttcttgtaaatttgtttgagttcattgtggattctggatattagccctttgtcagatgagtaggttgcgaaaattttctcccattctgtaggttgcctgttcactctgatgatagtttcttttgctgtgcagaagctctttagtttaattagatcccatttgtcaattttggcttttgttgccattgctttcggtgttttagacatgaagtccttgcccatgcctatgtcctgaatggtattgcctaggttttcttctagggtttttatggttttaggtctaacatgtaagtctttaatccatcttgaattagtttttgtataagatgtaaggaagggatccagtttcagctttctacatatggctagccagttttcccagcaccatttattaaatagggaatcctttccccatttcttgtttttgtcaggtttgtcaaagatcagatggttgtagatatgcggcattatttctgagtgctctgttctgttccattgatctatatctgtgttttgagagttattagttttttgcttgttgaattgtttaagttccttacagattctggatattagatttttgtcagatgcatagtttgtgaatattttctcccattctgtaggttgtctgtttactctgttgatagcttctttggttatgcagaagctctttagtttaattaggtcccacgtatcaatttttgtatttgttgaaattgcttttgaaattttagtcataaattctttcccaaggccaatgtccagattagtgtttcctagcttttctcccaagattcttgtatattgaggtcttgcatttagatctttaatccatccttagttaattgttatatatggtgaaaggtaggggtccagtttcactcttctttatatgattagtcagctatctcagcaccatttgttgaatagggagtcctttcccctttgattattttcgttgatttggtaaaagatctgatggttgtagatgcgtggctttatttctgggttctctattctgttccattggtctaagtgtctgtttttgtaccaggactatgttgttttggtatagtttgatgtcgggtaatatgttatttctgcccttgttctttttgcttatgattgctttggctatttgagctcttttgtggttccatatgaattttagaatagtttttctaattctgtgaaaaaggctgttggtagtttgataggaataacattgaattggcagattattttggacagtatggccatttgaatgatagtgattcttcaaatctatgagcatggaatgttttctccatttgtttgtgtcatgtatgatctatttcagcagtgttttgtaggtctccttatagagatttttctcctccttgggctacatgtattactgggtattttattctttttgtggtcattgtaaatgaaattgcattcttgatttggctttcagcttgaacattattggtgtatagaaatgctactgatttttgtacattgattttgtatcgtaaaactttcctgaagttgtttatcaattctaggagccttttggtagtctttagtgttttctaggtatagaatcatgttgtcagcaaagaaagatgatttgacttcttttctgattcctagttttttgattgtttataatttattagtgttcttgactattgtggtgtttcaaactgctgctgtgtccttgtgacatactccaacatttaaataaatcactttcttactttctggcataaaaatatattccaagttcatcttgtacctattctgcctcaaccctggaatcagttatttccttgaggagccctggtttctttttctgggaaatggtattaaagaccaaggtctgggtgggagatgtgcttattacttctggagggcttttgcttttaggataattcaccagagagctggggaatgatgaaaaaaacacttagatgaaaattctcaggtaagattttgttttagatatttgctatatatatatacacacacacacacacacacacacacacacaaatgtatatatacctatacatacctcacacgtatacatttatgcaaatacatgtcctcatatacgaacctacacatgtacatggtgatcttttatacatcaagagtacacattgatatctatgaggttaaattttaacagattatagctatttctgtgaataaaataaccaaattttttatatgtgtaatttctccatgtcaatatttttgtttaaaagcattttgtataaaacttgatcataaggggataaattttatgtttttaaaacctctttgtttcgtatttttagcttgtgactgaagttgaatttctattaaaccaacaagcagaactggctgatgtaacagggactatagctcaagtaaaacaaaaaataaaaaaattggaaaacttagatgaaaattctcaggtaagattgtattttagatgtctgctatattatacagtataatagtcatgttttggcgggagtaggtagtataaacccttattattaatttctttatttttatttttccataagttactggggtataggtggtatttggttatatgagtaagttctttagtggtgatttgtgagattttggtgcacccatcacccgaacagtatacactgcaccctatttgtagccttttatcgcttgccttcctcccatcataacaacattctgtatatcaggcacaattatattggtctatattctgttttgttcaatgcaggccagaggtgacactacagatatatcatgtagttagttgtaaaaggaggtcactgagacaatggcgtgaactgtttcaagcccaccaataagaacaagggcataaattattttggagaagctagaaaaatgtgtatgaagaatgatatatggtgcttggaaatgatgggaacatacaagaacataattccttaaatgcccactttaggatatatgcagtttaaccaaatggagactcacatagatatttctacttattcttactatctgtgaccttgagtaaattggtttctaatcctcagtgtcttcatctataaactggggataaaatgacctactttgcagagcaattgtgaatattcatttaggtgtatataaagcacctggcacaacactggactatatagtaaccactcaaaagaggcagttttcattatccctgctagtcttaaattttggactagtggctttaatacttaaaaaactcttagcttttatgtgagagcaaggccatgctttttatgtgagagcaaggccacgctttttaagatgaattctcagcatacaaacagatttatgggtgaaccatgagtatgtgaaaacaaatattgaagaagcaacagttatgataactagttctggaattatgcttgtagatctgtgtgatcatgggacactttacatagccctatggtatagtagaaagaggaggcaaactggtttggaaactaagggagacttaatttttttccatttaataatttttcgtttctaattgtggtaaaaacacataacatgaaatttaccgtcttaatcatttttaaatgttcagttcagtagtgataagtaaattcgcgttgttgtgcaacagctccagaactttttcaccttataaaattgaaactgtatacccattagacaacagctctccattttaaacctggttttcccactagatagagaggccagtcatttcctcattctgtgtttgagttttatttattttattttgacaagcatttcttgaacccctactatgttcgagtctctacactggggggagtgagtagttgatggagtggaggcaaggccactaaaggtcattttttgacatagaaaccctgtgacttcaggtatgtgaagtagtccaggtacatgacaactctgatgagatttctaaggctgagatgatatgaaatacacttggctggtgtgtatacctcatttaatataggtggttctattctaaatccacacatattaggagaaaaaatctcacccacattctgtgtgtgatgtgcaattttcagtttctataaccagaaatgcatgagcttctaatgacatcactgctgcagctaattattataactgtaagtttttgtttttgtttttttgtttgtttgtttgtgtttttttttttgcagcctgaagaagtagacatcaaattgtatttttggcaatgtatccttcttgctcaaacattttgcttcttaattattttcttctttttttctctataggaacagagatcatgtattcattattttttgtctttgttataatcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggtagtgtaatgggaaatgatccatttctgaaaaggaacacacatttttttccaggtcctgctagcctgaagcaccttgccctcctgtcgcatggaatacttttcatcttctcagaggttatatggtcagggactggtatagctttggaattaaatttgtaagaagtctgaaggactgagtttgattatgattttttcatccatctaccaatgaactattcatgaaagatccaatatagttcaaattttaccctttgttctaaatattgagattgtggagtaatggcttcctttgtattttcgatacatctctgaagccttcactggtgatggtttgtacttggaacatttttaaaaacctgggggggcattttgctaaagcctgaaactcctttcacatttcatagtacagaaataaaatattaaacagtgactggaaaatattcctccatggcttgtgggtttgacccttttcacgattaggcaatgaattgacaggtcaccgtatggacctggtgttggcagtggaatataaaataggggtatcacttacagacattatatctgaacataaacattttaatctttacatctcattctttgggaaggaaactttattcttgtctttagccatcattaagcatttgtattacactttatatttttctaagaatttcatatttcagttactgattttgggaaagtaacatgcaactaagtgttagtgctgagaaaatggtcggactcctgctgcagaataaattagttgttgtgaaataaatgcagtgtttcccaacctcggctgtgtatcagcagtatctgtggagctctgtaaaagtataaatgcccaacttatggcccagagctactgaatcagaatttctgggggcagaacccagatatcttttttttttttaacagctctgaaagcatttctgactcacggaagccagaggctgagaaccactcacttattggacaaatatgttttctctttattaattcatattttttttttttcttcttgattttcttaccaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggtagaggcttttttattttcaaataaatatttaaagaaaattataattgcagtactgtgggtaggaggagttttactacctcacagctaactttatgtcaaattgcacttacattgtcctcttaggggtgatagtagtgccactgtcaagcatcaaataattcaaaggcatatgtttgctatataatgaagaataatttcctttttgagctccaaatccattattttaaaactcttttatgtgctaggtgttctcacacatattttgttgtgcatcactggagaaaggcccaaagctcttctataacagaatgttgggtccatgtcaagagcactttaccccagacatctttcctttgtgctgcagtgaccatcagcagatgctctgtggatgatgttgctttcctactcagtttgagaatgaaagcataaagataggatttgggtcttcttggagaaggaggagcaggcagaagttggtgttaacagggtggacagctataggttagttcagtactgcccccttggaaatgacatgaagaattttccacattgtagataagagcatttgtgatgctatttgctgctaaaatgtgtagttgactctaagattggagcagtatctagatccatgcttagcggaatatcctaggggatgccccaggaaatcagaaatgcagtcatggcaatagccaagtgattctctggaagcaaccaagcttaactctagctgcctcaaagcatctaggagaggtacaaaggtgtattatccattggtggctctgaggagcctgctgcaacatagaagactataacaagaatgtcctacagggtaaaatgtaacaaaatattataccgatgttattcatttgattgtttttataacttggtggctttcttatgctaaacaggaaagagcaatatgccttctttcccagccattatctgattcagccaatgaaccaatgaagggcaaatcactctatgcagtgaccaatttcatgactgcttcttggtaattttttccctcaggttgttttggttgagattttggttttatatccatgtgaacataatacattaatctgtcttgttatttttctaaatgtcttgtagttatattttaaactctaaattatttttttgaccatctgagtctgagaaatgtaatggggtttgtaatgacctcatttcataaaatatttcctataattcttatacaactcgcaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaaggtaaaatgtcttactttctctgtctctttttttcttgctattgtttatattgttactcttgatgtaaatactgagtttattcttcaatgcggatagatgaaaatttcactttagcatctttggtcatatttatattgtgcaaggcaagagtcagattgaggttattgtacagtactaaaacatagtagtgatatagtacagtacaaggaattgtgaacgtctcagtactgagtactccagccttgaaaatgagtatgaaaattttaccagcatcaaacttgcatttttttccagcaggtgaaggaaagtatatgaagctagtatacacatgtgtgcatgcacacacacacacacacacacacacacacacacatatttactgctactctagataagcaatgatttggttcctttttatttgtataaatgtgggagtacaagtacatagagttttgttacatgaatatattgcatagtggtgaaatatgacttggttcttataagcttctagtaagtgaatggcttagataataaaatggattgccttttctaaataaatgctgttaaatagaataattttgttggtaatttactattacagagttcattttctagttttaatctcctagttttatccatgtaagatctattttctttctaagttctatggaaataataattgtccttataatgtgttgaactactctggatatggatggctcaggggttcccttgagctgcctttggggcttcttagaggagagtaatttggtctttagggccctaagtaagtggaatgggtgaagatgggagtaaatttggtctgtctgatctaaatagagtcagaagcttcattagtgtaggagaactgctttggaattcagagaaggcttgagccaaggataatgagcataaaaataatagcttatatctagcatggatcagattttcaaaaggtgatgaaagcaggtaactaggctaagattatgaaagttacatgtttaatacttatgaaatatataaatatatttacaaataaaactataagcaatgtcttaaatacaatatcaaagatatagcaaagatacagggaatattaaaactactggaaaaagagtaaagataacaaaataaaaaacagtaaggggataaaacccgatagctatgagaataaaactgaaataggttgatattcttgagcagaagacagacctcggttagatttctggctccatgtactggctgtgtgtccttgaacagttcacttagcctctttagcctcagtttccttacctggacaataaggacgataatacctattgactccaacaggttattgtaaagatagggtgaaaaaaattgaagactataaaaaaatacttgataaactggactagtcctttcctctggttaaagctgcttgcttaattgtcctctaaaatctcaactctttctagaggttcttaaagtggtacaccttgggttgaggaacggagttttgaggagactgttacagatccatgcaagtcattagtcactcattagcacattttgttttgtattgtttcatttttttctgatattcttatttaatggcgttacaatttccttctgcagtgggagttggatactctttctttcaagcatgtaaacttttttcaaaaggtacccatctttattatattacttttgccaatacatttttctgagtttgtgtacatgtgaaaaaccagtttggcatctaaaaacagcagcagttcattgttgcattctacctgcaagtaactttttcctgtttttcataataaccatccattattctctttgtattatgcttatgttggaaaatgactatataaaatgtagattatggttctaaattcaatgtctttcataaagtgaccccgcaaaaagaataaagaaaaacaattggcgatgctaaaatgaatcaggccttcttttgtttaagatacttcatgatccaactttttgttaggagtagcttggatttgcttcagtttgagactgcctaatgtatgtatgaggatgaaggcagcttaataaataagtgacatggatggataaatgtttttatctattatacatcatgctttgtaaattaaatcaaaacattatgtatgctacaaaccttgttcatttacctaattgctctgttagtaatagggattataacaatccattccaaacaatttcttaagacttttaatcgctaagccaaatatataaaatttggtcaactcaaaacataagtattaatttctcataaaaatgagtcaaactgtttttttgttctttggttttattttagtttttttttttctttttgcattaaatataattctgcacctagcacagggcctggcacttagcaagatgtaataaatatttgtagaattaacattgaatatagagtgtagttattgagaatgggagatattgacagcgaggaataaaatgtaaaatgtgacttgagctcctaaatctggatctttagcctagatctttcttctaagctttggatctctgtttataatttgcctttttgaatttcccataggcaactcagactcaacatacctcagattaactcatctctcctgcaatctttctactcttcatcttggtgaatggcactatgatttccccagttgcccaagcctgggaccttggttcctcctcacttatgccctacctctaattgatcaaaaattctatatcctgtggatttgtgcctactaagtatctctctcgaatccattcacttttttttttcatccccactgctatccttactgccactttcctaatccgagctaacatcatcctggccttggcaactgtgacagtctttctgtctcttccacttaccctgcccacttcttcttccctttcctaggtgtcttactttgtggacattacacacactgttctctctctggaacactatttcctttcctctccctttcccacatgttagcttctactcctctatcagatttcctatttctaggccacttccttcaggtaagcttttcctccccagatctcctccttccctgcacccctgtttgcttaggtgttcatgctgtgtgataacaagtacccccaaatttcttcttggctttagtagaattgtctgttttctgtctctcttgctaaactaagctctgtaagggcagaaactgtgtgcagttcatctttgtatccctaaacacagagcttagcatatggtgtaggtgctcaatcattttgtatgtatttatattgttaaaaatgaatacatctaccttgctttgaagaataagatgtgtttctcataagttgtgcacatatttattttgtatctcttaacgtatttgcaaagaattaattggcaaaactaacaattgcctcttaagttacctttaaaaataagtttggatctctgtagaacaggtttctttgaagtggagcatattagtattcattgagaaattaattttgtataattcccactgtttaatatatatttacatatatgatgatataaacttgaagtttaggtagaaaatatattttaataagtgaaagtgaagtatggagtctagagaacatagcagcccttcgttttcctgagtgtgcctgtcactggctcctgctgaggagggaaggacaaaaggtttgttcctttcctggagagaggagtctcatgcagcctgtgtgagtaacagccttttcagcagccctgagaattaggatctaaacaatctagtctttggttggaccatgccttcggctttgtaggaacgtctggattccttgcttaataatacagtggctcaccctttttaaactaaacatttaaaaaataaagatgaaagttttgaattttgatgacatgtttaacattttatcatgctttggaaatgtttatatggtggttagaaacattctgagagtagattatatgaatttgaataccacctctgcttcttggacaagatattaaccttaattccttatctagaagatagggatagaagttgttacctacctcttaggatgattttgggtattaaaaaagaagatatatgcatagctcttagaacagtgctcaatatgtagaaagtgccaaacaagtgtagatgctctaattagtagattaaacttagattgttttcaaaattctttttgattgagttaatcaatgagctacaatttgattaaatgtttttgtgtcagaatgaatactaaatctgcaaataattatgagcactaacacctacctcaatgcttggcaagtaagtgaatgtttgatgaatgagagaatgggtgaatacatagcaaaatcatgctcagtaagaagctgaaatcatgtgagtaagtccaaccaaacattatcttctatagtgtgattttaaaatactaatataaacatattggaatattaactcaagttatttaataaatatatatgtatttctattaaaagtgctgactttaattctggtttgaaattcttctttcacatttctctaccagggaagaagacttggagacaaaatcagagcaacttaaaagtaaatatcattaattaattcaaaattgactttattgctttagttgcagagttggtatgagccttaaatcacatgtttcattcactagacaaatattgtgtctttgaaagactatttaaaagaaaaaaagctgctgctgcattgtgtttcactgcattactggcatatccccagatatgccagtttctcagtatgagctgtttctcaagtcctggctcaaggttagaatcatttctgtagaacatcttgtatatgttccagcttctttttaccaccacccaccatcacttcaataatcgtaagtaagcgttgcacctttgtgcagaataaactttctttcatgagcaattccagtcctacaagtatgaagcacacaggacaggttctaatggaccatgcagaggctaactcttagctcaaaaaagatatccattcttttttgttgttgtttttaagtttttttagagacagggtctcactatgttgccaaggctggagtgcagtggccattcacaggggtgaccatagctcactgctgcctctaattcctgggctcatgccacccttccacttcagcctcctgagtagctgggactacaggtgtgcatcactgtgcccaatctacttacttattgttagatacaagattctgttcttctcagttatccatgataatctgatatctgtaaagaagtagactcatcatagctacaacatcccacattttcttttctctctctctttttttttttgagacagggtctcgctctgttgcctaggctggactacagtggtgcgatcatagctcactgcagcctcaaactcttgggctcaagaaatcctaccaccccaggctcctgagtatcttagactacaggcatgggccattatgccaggctaatatttttaacactttttttgatagacagggtcttgctatgttgccaaggctgatcttaaactcctggcctcaggtgatcctcccgccttggtctcccaaagtgttgggattacaggcatgagccactgctcccagtccccaagaccccacattttcttcttgtgttttttgtggtaaataaagatgagaacatatttttaaggggcagtatagcatagtggtacaaattgtaaaactaggctgcctggcttataatcccagttccatcacttactggctatataaacttgggtaagttctctggaactcagtttccatatataaaatgggcataaaaatagaacactctcatcatggagttaaagataaaataatctaatatttgtgaagcaccttgaacatgtgtggcatatgataatgctctaagttttaatataattaatagcagcctagtgaatggtctatactgatacacgaagcctggttattattctgtacggccacaacttctggtttcaagaaagaaacagggtgaatgccaaattctgtagtattacatgttgtaaaatctgtctgagcctcagttttcccatatttaaaatgaggaaaagaatgccattgcttgctaaatgctgtttggattaaatataatatgtgttaagcacctaggactgtggttgcctaatatatagaaagtcataatacatgcttgtttctttcatttgtaataagtaggtcacattttggggaaatatttagctgatagatactgtacttcattttgggttctagttgtcccaaagaaatgttacatttacttggaggtcaggcttttggcaagctcagctgtccaatacagctgagattggataccaggaatacacttcaaatgcttcttaaaagaaataatcatcacaaatcttttgcagttgactcggtaggccagtccaagtcctttagagtctgtaaaataaggcaatttattagaattagggaggcaacttatagcgactaacatgtggcagggagtagagacagagatgtacaggttacagttatttcaagaaagaatagagttctgcaggtatccctgcagcacatcattagattttatcatattcaagcttatgatgatgccatcgaatcattaggaaaaggatcttctagcttgccccagatcttagaaaaaaaaaaaggaaaaggatcagttatgtcgtgtgtctttgattaaagaattcaaggatgcatataatattttctagaaaggtttccatcaaaaatcactatggttaaaaagatgtttggttcttcaatgaataccctttagttatctagaaaattaactttttatgaatcaaccttattttccaagaatgccaaataaataaagagttaatacataaaataagttctaattagtatcttaaatctgttttcttaggcaacttaaatcactttttactagtacgtatcaaagttattttgaaaaaaatcatagttttatttttcaatttatcttcagagttaggacctagaataaacttaatttgagctggatcgccttgaagaaaaattatacctacagaggtgctaatttaacttttattttctgtatttcagattgaagtggtgcctgattgtcaggagaagagaagttctggtccatcctccagtttggacaatggcaatagcttggatgttttaaagaagtatcctttatttattaatataaactcacatacacatctaactgtgggagtctggttcagtgttcaaggccaatgtgattagaaatttgagttcacagaatggggttttactgggtgtcagaagtccaggatttaggcctggccaacctatagcctatttatgtgatttgaagaaaattaactaaactttttcagaatgttggtatcttcttttttttaccccagactgaaataaaatggaggttttcgtttatcattcttaaaaaaagttttattattatttttcattgacacataatcattgtacatatttatggaatacagtgtgaaattttgatacatgtgtacaatgtataatgatcaaatcatggtagttagcttatctattaattcttcagctttattgatatataattgacaaaattatgtatatttaaagtgtacaatgtgatgctttgatatgtgtatatattgtgaaatgattaccatatcaagttagttaacacatctatcacctcacgtagttaccattttttttttgtggtgagaacagttaagatctattctctcagcaaatttcgatatacgaaatgaatagagtggtacatcaaaaattacaaaggattatacagattgatacaatgttattttatagatgttaataattgttttgttcattgttataatggtatattaatattctagacataagaatattcatctttttaatttgatgttacagttgtaattagcaagcattttgcagcaagttgtatgtatacatatgtatgtatgagatacatatatatatatatacagacacatatttatactgtaagactctcaaatgttaaatgctttaatatgcaaaaagaaaaagaaaaaaagccaaaagtataagttaaatcaaatgggttacttatactggggacaagggaaatgagttttaaatatgatgtcaattggaaatcacattgaaaggaaaatatactttattttccagagacagtaaacaaaattattacagaaacaggtggggcgtggttattcacgcctgcaatcccagcatgttgggaggcccaggcgggcggatcacttgaggtcaggagttcgagaccagcctgacaaacatggtgaaaccccgtctctaccaaaaaatacaaaaattagccaggtgtggtggtgagcgcctataatcccagccactagggaggctgaggaaggagaatctcttgaacccgggaggtggaggttgcagtaagccgagattaccccactgcactcaagcctgggtgacagagtgagattccgtctcaaaaatatatttatatacattacggaaatataagtatgacctacacttgaggagaccagggtaaaaaaatctgcggcctcctttagaaaatttcagaacattactttgaaaagggaaaaatagtgcctaaaatgctaatacttattttttagggaaaaaaagggtattaaagttcataaactatgctacccccaaacaataaaaacctcagacatttaggaatagttattgtgagtttttagtacatttattcctaatctcagtgagttagaaataaagttctttaaagctaatagtaacccttgagcatatatatgtgtatatatatgaaagaaagcgggatatatatatatatatatgttatatatataatgaatataaatacaatgtataaaaaccacccataagactatatatatatatagtttttattctagaaaccataaaagtagtttcatattttgatgctaaaacgaaaaccattgataattcctatgcattagctatttttaccttctcatgatgataatacttgaaacattgcaatatagatctcagtaataaaataactgataaatatggtcttttcattttagccacgtactaaatgaactgatacagactgagagagtttatgttcgagaactgtatactgttttgttggtaagcgactcaaattgtatttgccctatcttttcccgaatgatcccttgctacattcattagaaagtgtttaggggcaatcttctacttccgtctccttccttggttgtcatatggcagcagtgggcatttcttttattgtttgatgcagcatgtcggttaaacgtgcacattcaggctctccctcagtaatgggaatgattgattcagaatttattacagaagagaaaatgttctcttagggatacagccgattgttacaattattcccagggtgctatttagagatcgtgatgtaaaaaactgagaatgggataaaatattcttttgacaaaaatgtcatgatattaatttggtctgaaaaaacctaagcacgtattgccaatttaaggagaagctgatgacctgtagtctatgtttttatcttggtttctatcttgtttcctacactacaagctactctgaaggccaaagagctattactttattctgcctatttgattggaaaacttgacttcctttccttgccctgccttctaaaaaaaaaaaaaaaaaagtcatggataactttgggaagtaggagatttgaattgaattaaaattgaaataaaattcaaaaaacttcaccatcaaatcccttaatattctgctgtacctacaccattagtagcccaaccaaatgtgcatgtaattattttaaaatgcatgaatgtatttattttgggtagggttatagagcggagatggataatccagagatgtttgatcttatgccacctctcctgagaaataaaaaggacattctctttggaaacatggcagaaatatatgaattccataacgagtatgtaattgctgaattgaatatttattttttataaaactatttaaagtgctctctttaccagtttattatatttcacataaaatcatgcaattttttttctctgaaattttcacagcattttcttgagcagcctggaaaattgtgctcatgctccagaaagagtgggaccttgtttcctggaaagggttagttaaattattttttaaatatatataaatatgcaccaccaaaatagcaactcacttataagaacagatttggagacaagataggtactttatgtctttatgtttttggagaggacacattactccagcaagtatttaataccaaaccaagttttgctgcagaaatggatgcactgggatatccagagcataaaaataccccttccattctgtggtatcaaatgcttcagtggctcagctcttgaacactgactcctgggtaatcctagtaatccagggaccatcctgactatgaagatgtaagagttgggatcatgataacaaaaccatctggggcttggttaatttttttttttttgcctaaaaaacaccttattatttatattatttgtcttattaaaatacatgtaaagttttagaattggatctagtctgactttcagccatcaaggcatctatcacaggaacttcacagaaacagagagctgtcagttcttttcattcaacaaaagcatttagggaggcccattcctctgtgtcccaagtatggttaatacaattgacttcccaggttagtgatcatactctcctccattagttttcttttagaatattttttgtgtatgcttctctgcttatgcagtttctcttcttcctgaaagatcagttttgtcttgatttaagagttaattcaatagaggtgattgttgaaagcttcaaaatagatgtcttatcccagaaagtgtttatgaaatgagaagagaataaggataagaaagaactgtgtgtcaaccttgctcaacgtgttctaactttatttattttatttttttatttttatttttgagacagtctcactctgtcacccaggctggagttcagtggtgtgatctcggctcactgcaacctccacgtcccgggttcacaccattctcctgcctcagcctcccgagtagctgggactacaggtgcccaccaccacgcccagctaattttttgtatttttagtagagacggggtttcaccgtgttagcgaggatggtctcgatctcctgacctcgtgatctgcccacctcagcctcccaaagtgttgggattacaggcgtgagccaccgtgtccggctaagatgttctaactttaagcatatttaaattatgaccaaattctttcccaacctcatcaagcaatagcagtttatccttcctttagactccatagtatgtaatgtctatcctactcatgggagattttatatttactgtgcttgtgcacctttacatatatacgtgaattttctcccaaacttaatggacagcccttagaacgagagtccatatcctatatattgttgtatctctcattgggttagcagcgttcttagcaaccagttgtggtttaataaatgtttattgatgaattgtttatttattcaacaaccatttactggtcacctactatgcaccaagcattgtgccagataatgtggataccaagcccaaatctatttagatataaaaacagggaaattattaattgtgtagaagatgagttgcattagatttgaaatatacaaatggtcctgggaaaatccagaagaggggcgtcttgcatagaatgggggtataaacaatggttgtatagaagagataactcatgagataaatgttaaataatgagtaggaggtagcccattcatgagggtcagagaaagaggattccagggaaagagaattgcataagtgcctaaatggattatgctacagtgataaagtcccagtgatgaacctaggactgtaggctctaacttggaagtcagctacaagttcattcactagggaatcaagagactaataacagaatatatttcttggcagcctattagttcatcgttatgcaaaaagtaggtttttatagttcagacagagaagcctccatctaagcctcaagcttggcaagtggaagctctgatattacttagataattatgtgtcctcccaccagatgcaatgggcatgctgttcttggaatataaaaaaggcttttgaccagctgctagtacagtaggccctttaggccacatttcctaggatgcttggttacactcttgtttagcctttcttgatggcaaaagtcatattcacaaattagtaatacatttgaatttgttttttatcacagaaggatgattttcagatgtatgcaaaatattgtcagaataagcccagatcagaaacaatttggaggaagtattcagaatgcgcatttttccaggtacagtaattattcaagtattggatatattctttctggaagatattgcggtatttcttaattataaattcattttctactttaagtacgttacatgtgcatatacgtatatgagttaaagagcaaatccaccctcccccccaacacacacaaacacatttgtaacttcccagaggcaaacactttcagcacttttagctacatcctttggtatttacctccatagctccaaatgacatgcttatctttatcctttatactatggaagatgaagatttagctctctttcacgcccctccacccacccaactaccacatatacaaatatacttcttttctttcaaaatctccactatagtcatatcgtaattttggttagattgatatacagtattaaattaagactacgtaatttctttgctcagatgaatcatgtggtataatagggttgcttttcctacccttctgtttgtcttgcagtggtttttttactcagttttctagatacttatcgttattctaccccaacctctcccagatgtgggagttacaaaaatctcttcttattacatttaaacacattctattttctctgaatttcatattcttaaagaaatatctcctggggttttctgtcttgcttgtctagactcactaggcttgttgcgcagctgtcatctggggatcttggtgaacataatttttggaattctcctcacctgtctattgcataggctctcctcattcctaggtgccatgtctttatttttcttgtttacctcccttgtttggtggaacacatcctccagtagttttcccaagaaagtgtacacagtacataaaagtttttgagagtgtatgtgtctgcaaatatctttattctaccctaagacttcattgctagtttggctgtgtatagaattctaggtaagaaataattatactcagaattttgaaggtattgcttgattgtcttctagcttccagtgttgctattcagaaatctgatgccattttaattgttgttcctttgtaggtgacttagtttctgtcctctgaaagcttatgaaaacttattttcagtgttcaaatgttggcactatttttatccattatgctagtattagggtgataactttgaatttggaacctcctgtacaaatttacttggaggttttctttgatttcctccacccaattgtctccattttctctttttggaatttctgttgtacggatattggatatcctggactggtcctctaattatcttatcttttctattttccattctttgtcttattactctactttctagttcttccattgaggtttccatttctgccattgtgtttttaattttgaagagccctcatccttttactgttttttcaatgtttcttttaatagaattctattttcattttatgaattcagtatcttcattcatctatacaaagatgataatagatttttcttttaaaaatggctttcttctccctgcacatcttctgttgtcttcactttgctttttttcttctatttctctttgtttggttcctattacccatgtttgatgctctcctcaaatgtctggtgatacttgtctgtccacttacattaggagtaaacactaaaaagctcattggaagtttccagggcatatgtgggtttattgaccatgatcctcattgttgagttatttgtctcaagctatttgcttgaagggattcccaaatacctgtatctttagagcatttctattaggctggtcagattccttgaactgctaccttgtgtataatgatctggatgctagtgttgtggtagcagagttgggagaaaaggctgagggtcacttgtttgagatataacatggagagtacttgaatatttttcaatatggtactctgccctaagttgaaccttgtatcctttggtccatagggcctgtgttttactctttctagataaacatccatttttctgccaaaggaagggaagagaaggcacccagctgtgcaaagtggtgtggttatctgagagccttattgcttttgtttagattttcatgccatttattttcttcttgtaacagctttattgagctataactaaaatgccatcagttcgcccttttaaagtatacaattcagtggttttactagattcacaaggttgtacaaccatgtttttatcactaaaaagaaaccagtcttaccctcccttttttccccaatctaagcagccctaggcaatcactaatctgcatcctgtcttcaatagatttgcctattctggacatttcatataaatggaatcatacaatatgtggtcttttgtgtttgacttctttctttcatttagcataatagtttagtggttcgtccatgttgtagcatgtattagttttttattcctatttatggttgaataatattccattatatggatgtatagcattttatttatccattcattgattgatgcacatttggcttgtttctaccttttgattattatgaacaatgctgctgagaatgcttttgcataagtttttctgtagacatatattttcattcctcttggctatacacctgggagtgaaagtgctggatcatatagtaactctacatttaactttttgagaaactgctggactcttttccaaagttactgcaccgttttgcatttccaacagcagtgtatgagggtattaattgctccatatcctcaccaacacttgttattatctaattacttcttaaaaagactttcaacaagcatcctttcttgaaccgcacctttacctcccactttcagaggtacttggtgtctataatccctgagactttgtggagggcagggaagagatgtttataacataaattgagttgttccttggctttttcctccaccaacttgaaatccacttttctccagtgtgcttggttgttgaccacttctaagtttggtttccagtttccaaattttgcggaagttttccccttgcttatcttcttcataactttgtgattttgcctagtaaaataacttttccatcattttagttggttgtcatgagtgaggagatctaaacgcatgtatcaagttggtgcaaaagttactgtggtttttgccactgaaagtaatggcaaaaaccacaatcacttttgcaccaacctaatagcagtcccccatctttaagtctcatttgaattagattgtatgttggattttacccatattcagaggagagccatggttcttattcaggcgtatttttccccaatccctttgtgttctatactttctctatgcacatttcatcctaaatatctgcatcttgccctaactatgggcccctacaatgttcccggaacccaacatcatgacccttatatttatagtggcaatgggccaattactgaagtatagcaccagttgatgatggctttttcttgttatattaaaaattttgttctcatatccagtctgatttatattcagcacaaccaatttcttttctgagccttggcttgtagagcttggtctttcgtgaattttcttgaatatattaaagaacgttttaatcatgttaatctatagtcattccctgctttcacaccttttaagcattccacatcaatatgaatttatatttgaaaacttttaaatctttgaaatgttgaaattgtttacctctccaatccttgaaatagtgtttatggtagtttttcagatatattgtgtcttataatttctgtactataacagtgatttttccaataaatattctttgagatgtaagaaacattggggcattaggtttaatcaatgaacacttggcattttcacaggtacatgtcttaatttaattttattgatatttatcttttaatgacaggaatgtcaaagaaagttaaaacacagacttagactggattcctatttactcaaaccagtgcaacgaatcactaaatatcagttattgttgaaggtaattatatgaagcatttgtttgtttctttactttttgagtcagatatgacagagccattaaaaaggaaatagtttactaggaagcactagaaataggtaggctcaatgactgggaaggctggatttggcagaattttgcagtgtgctccatcaattcactgtggctacaaatgccataggcatagatatcaggctgagaatatctgggatcttagctatttaatttttcatacaagttgtgttgatttccgcacaatgttttactgaagaactttaaatattagtaagaagaactaaacaaagcaaatatttcttatagttttgaggctgcatttcataggggccttcctaatgaaaaatgcgaatggcactcccctagtataatgcgaaaggattgctagaatcttgtgttaagtataaatacaatatggcttgttttaaagtgaattttcataatattctatgctatatgcattatgagtgcatcatggctaaaacaaattactgtatgtagaggacaaaagaaccctacatgtaatggctttaaaaattgatctctgatgtgtcttaatagctattatacttcaactccagaagcattaaatgtcctttgttttatactattcagtcactattctacttcctctattttgacagccattaaaaatattactgcagcaaagggcatgtaaaaggaattactccaaaatgtgacattatatttggattccagcttgaaagcatgttagccaaaaacttattcatttcaaccagatattaatatctgcctaatattaattcctgatttctaattacaggagctattaaaatatagcaaagactgtgaaggatctgctctgttgaagaaggcactcgatgcaatgctggatttactgaagtcagttaatgattctatgcatcagattgcaataaatggctatattgtaagcacattttaataattgttggaattttagagggtcggcatctcaacatcccttttcccctcctggaaccaattgagaaataacgtataagaatcagataactggagatcaaaatgttgatgttactactgataatgctaagtggagaattggcttcagatcagcagccaaatggatttatgagatcccccttgtccccaacagtcttcccccaatcccagacctgggagatcctgcttaaggaatgtttgagtcagctaagaaaacgtattgctccataattgctgcttgcccctgtagataggaatagataggaaagaaaagaatcaaatctttagcacttgtgtagccttttaacaggttagctccacccagtgggaaaacttgaactggtatatatcatgcaccaatcaggattgaagaagagatggggagacttaccctagctgaaatacctccagatgatatgaagccagagaaaaggaagtttcttttgtcccccacccccacagtaattttgtacttatgtggtgcatgccatgttttaacatacaaagttaagtttttaaaaaaacataaattattcttcagggtttgagtagcttaagctgaaccctaacatgttggtgtcagagagctgaatgtagctttgctttctactaatgggttttgattttccattctagggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaagtaagacaatttgtatcgggtaatgtagtattgtttcgtgtgtgtgtgtctcccagtttgtacattttttttgtttcaaatgagtaggttttatactttcgctgcacatctttgttttttttaaaaaatcttaagtcttatgtagaagtcagatgaatcataacttctctgcttgaagtgaaggtgaggtaattcagagctttgattcctccctttcttctcactacgatcctaggtattccccaagggggctccctagcgtcctgaagagcacagtttgaaatgataaggagtgtcccagcctcctcataagcactctctttcgagtgacactgggtggagttcttggtcttgttagaaaggagccttatgctacaggagagacagggaggaaagagtttcctccttttcctcaatgcaatttaaaaatgggtaacttttgtgtttagcatgtccccaccttcctttctgtgttcctcctccactccctagctccaccctacctgggtgttcaaagccacctatagctgaatcctttccttatctgtcctgttccgtctttcaaaattactttattctctcctataaacaaaatccccattttgtcctaatattagtttgttattaaaaagagaacagtattgtttggggaagttattgacaacccaatgatacttacagctggtttctccaatagagaagaagaacttccaattcacatgagacccataattgacaaatttgaatttttttacatctaatgcatttcatcttttgaattttaaatttttttttattttttatttttttattttattattattatactttaagttttagggtacatgtgcacaatgtgcaggttagttacatatgtatacatgtgccacgctggtgtgctgcacccattaactcatcatttagcattaggtatatctcctaaagctatccctcccccctccccccaccccacaacagtccccggagtgtgatgttccccttcctgtgtccatgtgttctcattgttcaattcccacctatgagtgagaagatgtggtgtttggttttttgttcttgcgatagtttactgagaatgatgatttccaatttcatccatgtccctacaaaggacatgaactcatcatattttatggctgcatagtattccatggtgtatatgtgccacattttcttaatccagtctatcattgttggacatttgggttgattccaagtctttgctattgtgaatagtgctgcaataaatacatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccactaacagtgtaaaagtgttcctatttctccacatcctctccagcacctgttgtttcctgactttttaatgattgccattctaactggtgtgagatgatatctcattgtggttttgatttgcatttctctgatggccagtgatggtgagcattttgtcatgtgttttttggctgcataaatgtcttcttttgagaagtgtctgttcatgtccttcgcccactttttgatggggttatttgtttttttcttgtaaatttgtttgaattcattgtagattctggatattagccctttgtcaggtgagtaggttgcgaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctaggatttttatagttttaggtctaacatttaagtcttcaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagtgctctgttctgttccattgatctatatctctgttttggcaccagtaccatgctgttttggttagtgtagccttgtagtatagtttgaagtcaggtagcgtgatgcctccagctttgttcttttggcttaggattgacttggcggtgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttctttatatcctcttttatttcattgagcagtggtttgtagttctccttgaagaggtccttcatgtcccttgtaagttggattcctaggtattttattctctttgtagcaattgtgaatgggagttcattcatgatttggctctctgtttgtctgttattggtgtataagaatgcttgtgatttttgtacattgattttgtatcctgagactttgctgaagttgcttatcagcttaaggagattttgggctgagacaatggggttttctagatataatatttctattgagataatcatgtggtttttgtgtttggttctgtttatatgctggattacatttatcgatttgcgtatattgaaccagccttgcatcccagggatgaagcccgcttgatcatggtggataagctttttgatgtgctgctggattcggtttgccagtattttattgaagatttttgcatcaatgttcatcaaggatattggtctaaaattctcttttttggttgtgtctctgcccggctttggtatcaggatgatgctggcctcataaaatgagttagggaggattccttctttttctattgattggaatagtttcagaaggaatggtaccagttcctccttgtacctctggtagaattcggctgtgaatccatctggtcctgggctctttttggttggtaagctattgattattgccccaatttcagagcctgttattggtctattcagagattcaggagctggttttttgaaaggatcaacaaaattgataaactgctagcaagactaataaagaagaaaagagagaagaatcaaatagacgcaataaaaaatgataaaggggatatcactaccaatcccacagaaatacaaactaccatcagagaatactataaacacctctatgcaaataaactagaaaatctagaagaaatggataaattccttgaattttaaattctaaaaccaatataacatttgtcacaaaaaatttcaaaaatagagaaaacgattgtccttaattccccaaccactatcatgttagttacttttcatgagcatgttctttcatagttctcatcaccagtatatttgacaattgatgaaattttcagtagcagttataaagaggacaggcaatatgttttgagacaggcatgaggtatttgtattaggagactacctgtaagcaggccttgcttttgattcttcccataggatcagcagcccctagttgttcccaacaaggttcctgcccagggtcgggtcaaaaagaagtagttcttcctattgtgtattttccctgcttcactctgaacccacagcagcttctttaaaactcttggtttcgtcacaaagggccagttgctcctttgattttagcagtccacctctaagcccccaaatctcaaagggccttctaagtaattaataaacatagattgagaaccataaatttgtaatccatgtcagagagggttcaaatctcttgctgtctgtatacctattccttgggaaggtactttaccttcataggcatatttgacccaaatgcatttgatgtacattttatcatgaggtgacctaatttctacctaatatagtatttctatttcatattaattttctattttacctttaatttgttacaatgatggacatgccaacaaaatgtttcttgagtacattaaagtaagggggatattaggtgattaagtcatgaaaactgaaactgcaataggtaccatggaaacagagaaggtgggatagattcaagaaacatttcaatagaaggtagacagatgggcttgatgacttactagctacaaaaattaaataatacctgacattgaaggaagaaaatctttctgattcttctttggttccccagtaatgccaagtatccttaataaacaatattagccagtgatgcctacaaggctttagaccaggattacttggaaaatggtgataccactaaaaattaggatatttcttagggttcactacgctcacttctgcttgcctgcttatcatgagattccagcattaagcaattgctagcattcctagtcaatgtgttatttaagaatctgggttattagtttcacagtcttacccttggtagagaggatcattgcagatattccactgctgaaccttctctctcacttttttttttaacttttattttagattcagggggtacatctgcaggtttgttacctggctgtattgcatgatgtttaggtttggggcacaaatatcccatcacccaggtactgagcattgtccccaagagttagttttccaacccttgtccctctccctccgtccctcctctggtagtccccagtgtctgttgttgcctttgtctatgtctctcactttaaatgaactcttgttttgactgcaccatacaaagctgggatcccatggcctgaccatgtactttctaattatttatatgttatattttaagttggctgcttatatgcaaggaaaggccctatctaaagtcaaagttgaccagatggggagattcgagtccttcagattccttagttcatgtgtttattatcatcgatttttaaaaattttacaaattgcacatagtccttactatgtgcaacacataatggttagatttccagggcaacttagaaaagttcacttaattgataatgatgtactatatgtttgcaataaaaaaataacaaaacaattgcaacttaaataggggaaagagtagaaagcaaactcacactttagaaagctcattataggatctaagcatttactccatgctatttagtccttatatcaaccctatgaaataggtgttctttctattttatagttgaggaaactgaagtttagaaaagttaagcaacttgcaccaagacacatagctagtgaatggtagagatgtattccaatccagacctctctaacttcaaagcctgtgggccttccagcttatcatgttattaagacaaaaccatgtaatgaaacaaaattaatttttaaaaatattgaatatgagattactattcatcttaaattgtgatatttgagcagaagtaggttagttggaatgatggagtgagaatataaagatagtttgggacattgtgaaaataacttcttactacgttcagggtggatgttacaggttctttcattaatatgttatgttaaattacatttctaagcataagtgcttttcttctccttggtatggcgatctccctagcactatctttaatgcttattagctctaataagggccatttggggggctcataactagaacagagagtgagatactcctttagataattaggttaagaattgaaagaaaagaggaaggcagaaaggaactaaaagaatgtttgtgcaaaggagtgagattgcccaaaatgcaattagccaagctgttagcagaaaatgatgaaagaaaatggaagagtttatgacttgcacaatcacgctgaggaaaagaaaaaattgtggtaaggaataaggaagagatattgtgtacagaagtttcactgggtacaaaaagacaacaatgtcccattacatattattattattattttttttttagaaaggccaagggattggtggaaaatagagagatccttgtgtacctggctggttctctcctgtcccatgaattagatgtttataacttgtaggacttctatcaaaataaattataatttgtaggattaagtggtctgtcaaatgattattctaaataactatttaaattaattttcagtggcttttctttattgatgtttaatgacttctgtgtttgactcaataatttgttttaatagtgtactattaatttataacataattagatcttagatgggctacttggatgttcagatttataacatttgtgtcaaccactgaaatgaagcgtgcaatctgaactataaagtgcatagttcaatgaaaacatttaaatactctcgtctatgattgtaattactatttcatattcatttaatataacatgtatttttctgcccaagagaaattctgtttcacttagaatatgatagggtagatttaatgtaatttcatattcaaaataaaatgctcatgaaaattttgacttatttattatagatggatgaagttggaatcactgaatatgtaaaaggtgataaccgcaagtttgaaatctggtatggtgaaaaggaagaagtttatattgtccaggttggtcatttgaaaattcttctagaaacccaaacctgcattgaaatacaaaagcccgaatttataaacaaaaataattttggtcgcatttcaaaatttccacccctttcatgtaggtcagttaaatattatttgaatattctttgtgatgtatttaaatgttttctagtagttacattgagatatgcctgtggtgttctctagggcttcaagttttcacaactacataagagacttatcaactagagctgacagcttggcaggtacttctctgtccccatcaaatttccaagttatggaattataatagttctgagttcctcttatgctaagcattctaggggtacctgattatgagacatggggatgtgacagttcagacttgctttctgcttctaaagaacatggttaaagccctggccagttgtatagggtccaacatgtttcagggaagggaagaggaatcagaacatttcaagaggatgttgtcattgcaataaatatttgtatctggagttgtcaatgtgctgttatctgttaaaaatgctcagtgttttttgtttgttgtaattctttactaggtgactgcaatctataaaaatatgttttcttggcttgcttaagatataatatttggtatcatttaacaaacatcttgtaagtgatgggaggatatttaaggaggatttcatgttaccatcagtcaccaaggttattctgcaatagatggccttttcagaaatagtagagcttgttttattttactaaaattaaacatcaaaatgttatattttaaaaagaatcctcctgtaaagacaaaataagtgaaattatatttcacagtttcatccaagcattattttaccattatttaagggcaatttcaaaatggattttttttttttgagacagcgtctcaccctgttgctcaggctggagtgcagtggtgtgatctcggctcacttcaacctctgcctcccaggctcaagcgattctcccacctcaccctctcaagtagctgggactacaggcacatgccaccacacctggctaattattattattattattagtagtagtagtagtagtagagatggggtttccctatgttccccaggctggtctcaaactcctgggctcaagagatctgcccaccttggcctcccaaagtcctgggattacagcaaaaatggttctgactgtattatttcatctaatctgatagcaaattatttgcttcataaaaattttaacaatcaaacggttaagatttgagtatggtgttatagggagtagatcatattttatgtacacaattacatttgttttattatagtacatcctttttaaaaggaaatgtgtaccacctccctcccgctttttttttaatctttaggcttctaatgtagatgtgaagatgacgtggctaaaagaaataagaaatattttgttgaagcagcaggaacttttgacaggtaaattcaagcctgcattcttcagaacaagaagtatagtaacagcttattgactcagatttttaaattatttttccagagaatggggctgatatttactttatactattacaatgagaagatttgttaatttaattagtaggagattgagattcagaggattgtttaaactattttgaagaatgaactttacactagaaaatgaacccttgtgcttaagaagcagttgagaagcaacacagtgaactgattgtggtaatccccagtcctttccatgaggtgactctgcttaatatctcgagtaatcattgctctataatgatggaatgggagccagttctacttctaaacttgaacttcttgaataaaatattatatggtccagacctttccaaattcaaacttgagactggccttccctctgattatttcaagtctgtgaagcttaagtctaatggcaaggatgcgtgtgtgtgtgtgtgtgtgtgtgtgagagagagaaagtcattggccttcaaggaagtaagaagtgtgacttctgaatgataatatgctttgttttatttctcagttaaaaaaagaaagcaacaggatcaattaacagaacgggataagtttcagatttctcttcagcagaatgatgagtaagtgattattctttaagaaataccactcctgcaatcttttgttttctgtatgtaacatgaagcaatgtaattaaagtatctctgacaagaaccatccaccaatttagcaataactcatcaaattccataaacatcattttctgaggtccagccttatactggaggctgatagttcttaatagttatcccttgggttgatttctaaacatgattgaaaatgctttatttttaatatatcattggaagaattacatgtaggctgacaggaaaggaggctgtgctcataagctttttttttcaaagtatttttggtcacctttgatctgactggaaaaagagggttgtaagaatatgggaatagagcaaatgaaggactggctcacagttttacagtcccttgatggggacctcttgctggtgatttggcctctctctacatagagagaaggtatggatcctgggagggaactgagcctggacacaaccaggagtcattaaggaagcctctagaaattccaaaaggtggagttctcgctgaacatttgcatatatacagaaagaattctctcattgattctgaaggcctggcacagagattcaccacacagcatctgcttgctgtggtgatcattgaatgacttattagaaatactgttttttccttcgctgcatgtcatctttctgaggtagctaaaatcagatgaaacatatggtggttcacgtggagatttaggagaaccatttaaaagttgcagataaagtctttatctttcagagttcaaaaagctccatcttttatcgtacattataggagtaacatctttaggttttatgcagtaattgacttaatagtagctggtacatactcaacaatatgaatcagttgaaggtttcatcttcatttatatacaacaacttacctaattcattaatgttataagtccacagagcaacggggattgtatacaatacccttactttgggtctagaagggagtagtttttctccttacataatagagaacctgctggcttggatctgagatttaagcttttgtatattataacctattgccacacagatttaaatagggagtattggctgtttggatggattctcagcatgttcttaacacttggtatcaatggaagaaataccactttaaatttctttttacttgtaaactgtacaaaagctcacttagttttatacatcactatttcagaaagcaacagggagcttttataagtactgaggaaactgaattggaacacaccagcactgtggtggaggtctgtgaggcaattgcgtcagttcaggcagaagcaaatacaggtatgtgtcatggtcatcttaagacgagactcatgggtgtgcaaatttttacctcgtattattaatttggaaatctacccacttggtatttttgtataaacaaaatacagttaacccatttttataaggctctcatgtcttgcatatgcaggacactctgatgggcactagagagtattggttgtcaaagtgtggtccctggaccactagaatcaacatcacctggaaacttttacagaagacaaattctcttgctctattcagaccttctggatcagaaactctgggaacaaggcccagccacttgagttttaacaggctctctctgtgattttgatgcatggtcaagtttgggaacccctgctataaaggatatagtgatgaataaaacatatatactggcttcaaggaatgcgcatttcacttaccgttggtttaatgaatagagaagagtcattaacagccgaaatatttattcttcctctgtgaatggttttatttgaagtgattttaaatactttatttaattcaacaaatattgacatagcatgatctgcattccaggagttatgcaaagtgctaggcatatagtctaactaggatacactcagctgccatcctcatgaagctaggagaatagaaagatagttaaacaagcaattaaaagtaaatttggcgagtgttacagcagggaagtacgaagtgctgtagaagcatacatgaggatcacctaaacaactctaggatcaacagcatagacttctttggagaaatgcctaacagagtgcctgatactcaacactttaatatgatgatccttaatatggaagagttctctactggttgaggagaaaaaggtaatgatagccttgtagagtttccatttatccaattaaaggtcacttccctcaggtcatctatgctgtggcccccaaagaagtaaggagagagcatagtactaatgccttcatttgacaggtgaggaaaccaagttagaaaaagatgacaatgacttttcccaggttgcatgaatagtttaatgtggccaggatgagatctgttaatttgctgcttacattagattggttaatccatttttttaaattcaactttttaaaggattacagctagttttacttctcaccttgtggtaaattagcaccatgaagtaactgccacattccacacttttcttatagtttggactgaggcatcacaatctgcagaaatctctgaagaacctgcggaatggtcaagcaactatttctaccctacttatgatgaaaatgaagaagaaaataggcccctcatggttagtaataatatagtaaattaaaattattgaggcagttttactgatgaaatataggtggagcacataggggcaatcttttgtcagcatccttgaggccattaggagtaagccattgctaaaatagttgaaataaatcttattatgaacatcaggaagcacttctgtctttaagtagaacctgtttgacctatacatagagcttctgctgatgttgatgaaatagatagtcaatctttccaaatctctaaaatcccagttttatctttagtagagcttcaccactgtgttttccatccaggcatgtgaaataaaatcagagaacaaaggggcttcaaatacactttaaaaaccagtttggattccagattagaaaataaaggaaataagcattatacattaaaaacgatttaataacatctgggggatatattttagtgtgttctcaaaaatacactaatgatataaaatctcagcatattagagcaagggagcaccctgtaaaattaaaggaggttgctttaaggttaaagtgtttatagaaggaatagtttgcaagttggtaggataccagtgggctattaaagaggaggtaggactgtttgggagtaaatccctacttttctaaagtcaccagcttggaaggtaggagtgatgcttggaggtagagtgctccttggtgcccttcagaggaatcaattacatttggcagttctactgttagtataagagggtaaacctcgtctctactaaaaatacaaaattaggcggttgtggtggcgcatgcctgtaatcccagctattcaggaggctgaggcaggagaatcgcttgaacccaggaggtgcaggttgcagtgagctgagatagtgcccttgcactccagcctgggcaacaagagcgaaactctgtctcaaaaaaaaaaaaaaaaaaaaaaaaggataatggcatggataatcacaaagctgtacagcattgactctgaaatgcagtctttaaaaaagtagatattgtttctcctaatactatgatgaccataatacatatttgtgtgatagtttaccgtttcccaaatgatttctcaattaatattcacagtattagtatgaaaaagagcgggctttattaccttcaatttacagaggaggaaactgagacttagatctggtaagatatttgtccagagttaattgtctatacctgcagttcccaaactttttaatgaaagaagcctttacatccttgaaaattgaaaaccccaaagaactcttgtttatgtaggttatatcttttaaaaaatactttcaacttttattttagattcaggaggtacatgtgtaaggttttgttacatgggaatactgcgtgatgctgagatttggagtatgaatggtcctgtcacccaggtagtgagcatagtacccaacatgtagtttttcagcccttctgccaaccctctttcctccctctagtagtccccagtgttcattgtgcccatctttgtgtccacgtgtacccaatgcttagcccccacttataagtgagaacacgtggtatttggttttctgttcctgcgttaatttgcttaggataacggtttccagctgcatccaccttgctgcaaaggacatgattgcatttctttttatggctgcagagtattccatggtatataggttacatctattgatatttaccatgtgataaaactaagaaatacaaaattttgaatgtaataattgtttaaaaatattaataaacccattgtaagtttatatcaataagatttttgtttaaaaagttacatttttcaaaataaaaatcagtgagaagactgatttaaatacttaaatacttacaaaagaaatacttttgtaaatcactttaacttctggctcagtaaaaggtgaattctcatatccacttttgcattcaatttgttgtgctaccatacacctagtatcctctagaaaactccactgtgtacttgtgagaggatgagagtgaaaaaggcaaatagtgtcttaatgtaggttgaccttgcagaccccttgaaagggtctcaggaacccacaacagtctgtctcccacactttgggaatctcaggcttagactaataataaaaagaagtttaatttctttaattaatgttagctggggatggaatggatagtagtagttgttaaatgcgagcaaaaagtcagaggaagccagtttgtgtttaaccgtttgctgtagatgatctatgaaggcattgtaaagaactcagttttaagtaggcatttttttttctagctatggtatcagaagataaagtaaatatgcaaaattgaagaatgctttaatcacagaggatgggaatatagaaaaacctattagtttctctctctttgtccaataattctctgagatgtgctactaaggaaaacatataaaagagcaacacaatgtattccatacacccttcttccctgccaaaacaagaagctggaatgacctgctcttttggcttcacttggtcaagttgtaaactgagcaataatgggtgctgcttcccttgtagagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagtttattaatgaattaagtcaaaattacggctgcaaaatggctaaggtcaagtaaagcacaacattatgatttaatatgcttttgttgaaaccacagcttttgtgcccattgttttaacttgtgtgaaacaatacaaagcccagaaattcttttcggggcatgagtaaattttgttcagggctactgtctgtatgtgcccagataaaattttcatgagagtagtttacaaaagccgtatttaaaagttaatattttcacactttttttctggatttctgcttataattaatgtaacttaaattagttgtgctctgctattttctgtatatttcatgttgtaattctttttttcaaataaaaattaattcttcaggt

SEQ ID NO: 3907 - DNA, 142974 bp, human
tgggcaatctatatgtatttatgtacacacacagtcaaggaagtagctttactctgaattttaatgaaacgtacaatgtaagtactcatttgatgggtttcttttgttgttgggtgttctctgttcccctcaggattgattaggaagattctcataagccactggtgcagtagtccagagtgggggggtgggtggagtaagaaggaggtgttgaaaattgaaaggtgagcccactggggcagagaccttcccacaaatgtaaaacagaaggtattgcacagaatacttggcagtcacttacgaggtgtcattcaagaggcagtaggtcagtgaacacactcaaaaagcttacttattgatacttgaggtctcatcatcatagacccagcattgctcattccctgtggttcttataaacattcacacacttttagaagtcctcaaattcttaaattgaagaggtttatcagatctcattcctcaactcataagggcagaggggattgcagaagagccctgtacacttgaggcagtagctagaaaaaggcagtgataaaaggagggaggcaggagtttgagaagctctagtagatacctattgtgatggacggcttgctcacctctatttcctgttttgatgggagctctctttttaagaagaatctcctggtttgctgatgaattctagtggagatgaaatgtctacccaggtaggatgacacagctgctggtcacaaactgagtgttatctgatctggctggccacacaggctggtatgctcagtgatatttcatcatcttgtggaaggtgtatatgtgggaaaaggccttttttttttttttgagatggagttttgctctgttgtctaggctggagtgcagtggcatgatcttggctcactgcaacctccgcctcccaggttcaagagattcttcacctcagcctcaggcactcaccaccacgcccgactaatttttgtatttttagtagagacagggtttcaccatgttggccaggctggtctcaaactcctgacctcaagtgatctgcccgctttggccttccaaagtattgggattacaggcgtgagccaccgcgcctggccaaaataagttagtttcataagcaagtggtccaggctcccatggcactttctcctgccatattgctgcccctccctaaatccataccagtggccttatggcgagtcacctatgaccaaatgactgaagaaaaaaataaatacacgaggctggtttacacacaactttgcacagttaaggtggcaggcaccatctgaaagcggcagactgcaccactggaagcccaccatgggatgcccataaaggacaatggaagagacaaattttcccatgtggacagaactttcgagtagcacatttagttgcttattatgtctacgagagatgacctgaggtacagatctactctgactcacaggcagtagccaaggagttggccaggaatttagaaaatgtttctaacagcaatctaaatattgctatttggaaacctaaaattatatccactttaaagtggcatgtaaaatccacacaatttcaatcagaagcaatttaatgtcatccaatcccctcattttcacatgggaaaatagggtccagcgagtataagtgatttgtctgggaaaaactctagttaacaggtacaactgacatctcctggatctcagttcagggctgtctccttaacagcacatagataaccattcatttgttgtcagcattccctgagcttcaacattgtgccatgttcttccctgggaaatgggacaaagataaataaggcatagtccctgccctgaagaagctcttgcgtttgttctgttttgtgcatgttggtgtatttttggtgcatgttggtgttatttgtgcacagttatatcctgtgacaagaagtaactggaaccaaaatggcaaacacgttttcaagtaaggcagactaaatacttgctgaagagtgccaaatggagttacaaaatgctagaaattgagccagtaagaactatatggcttaaaaataaaacagacaccaacagagatattaattaattcaaggttggatttgattgttaaggagagtttgcatctctatcactgctgggaagagagccatttttaatggattttgatggcatcctgcctgagtcttagtacctaaatgttggcctgggtgagataaaatttgaattaattgatcaggaagactggaggatggtgcaatctgctattattttaaaacagtagaaagtggttgaaatagggctgtggagtaccaaaagttttgctaattttcaactctgaacctcaaactgtattctttgattccttctgaaaccccatcccctttcccgattgcccattctcataaaaactaagctttgctcaaaagatagagaccacatactcacatgcattttcttcacctaagaccacttgatttgctttttcttctctcagccttctttatagtcttaaggaagagcaccccctcctcctctctcaaatctgagccgtgtgttctctagttcatccctttctacctcatttcacacctagcttcctcaattatcttctttagcttctcctttctacagaatctttccttttctacttttaaacacgtgtaggtctcctctagtttggaaaagaaaagttgtttaaccctgctgacagccctcctaagctattgtacgacctttttttctttcttccaccatcaagctttgcaaattaacagtttatacctataaactcctgcaatctggcttccagcccagctaacactgaaactgtgcttttaaagctcatgcagaatttctgaagcattaaatgaaatagcttttctgaattctgatttcccttgaccaggaatagatttttgaggtttagagcatcttatactaagctgtaacaccacattttccatgcatactgtgcattttttatttgaacaccctattattacttcaacatagttaaaaatgaactcataattttctccactgaggttcccctgagtgattttcctatggatgacagacaataagctctatgagagcagggatcgtatcatatttctcacattcattgctatatttccaccaaattactcggatgtagtcgatattcagtaaatatttgttaaaatgaataaatgaatgaacatcattttcctagtaagctttaatttcttagagttattttggattcatccctctctgttctataaattatttcagtgattaaatcttgtcaattatgcctcaaaacatagtggctgagagtatggatttgttgtcttttttttttttttgagatggagtctctctctgtcaccctggctggagtgcagtggtgtgatctcggctcactgcaacctctacctcatgggttcaaggaattctcctgcctcagcttcccaaggagctgtgattacaggggcatgccactatgcccagctaatttttgtatttttagtagagacagggtttcaccatgttggccaggctggtcttgaactcctgacctcagctgatccgcctgcctgggcctcccaaagtgctgggattacaggcatgagcaaccacatccagcactttgctctgctactttctagctgtgactttgagcacaactttgagttttgttccataacctctcagtttctttacctataagatggaagataatagtagtacttcccttattgggttagtgagtaaatgagtgatatagtgtgtacaaagtgactagcacagtgtctgcacatagcaagtactaaataaatgacagctattaaaattacctttgactactcctcaatgtggactctcgcttccctagggaggtctacttagttttttctgtttcatgtctttgctgtttctcttggctgaaatattctccttcccttctgcccattcaaaatgccatttattctcatttattaatttttatttattgaaagtaatgcatattcatagtaaaaagttaaatatatttaaatggcttataaagaaaaagagcatgtggccaggagaggtggctcacgcctgtaatcccaggattttgggaggcccaggtgggcagatcacttgaggccaggagttcgagactagcctgtccaacatggagagaccctgtctctactaaaaatacaaaaaaaatttagctgggtatggtggtgcatgcctgtaatcccagctactcgggaggctgaggcaggagaatcgcttgaacctgggaggtggaggtcgcagtgagccgagatcctggcattgcactccagcctgggcgacagagtgagactccatctcaaaaaaaaaaataaaaaaaaaagcaaagcaaagaaaagagaaacgaaaaagagcagatgcctactctatctctcccaacttctgatctgcactactagagaaaccacttttaatagttttaactgtttcttctagtattaacttccatatttcttctcgtggtttttcttttttctttttcttttttttggaggcagagtcttgttttgtcacccaggctggagtgcagtggcacgatctcagctcactgcaacatacgcctcctgggctcaagagatcctcctgcctcggcctcccaagtagctgggattacaggtgcccaccaccacgcctagctaatttttgtatttttagtagagacggggtttcgccacgttggtcaggctggtctctgattcctgacctcatgctatccacatgccccggcctcctaagtgctaggattacaggcgtgagccactgtgcacccggccaggctaatttttttttcttttttttttttgacagagtctcgctctgtcgcccaggctggagtgcagtggtgtgatcttggctcattgcagtttctgcctcctgggttcaagggattctcctgcctcagcctcccaagtatctgggacttcaggcgcgcactaacatgcccggctaatttttgtaggtttttttgttttttttttttagtagagacaggttttcaccatgttggtcaggctggtttcaaactcctgacctcaagtgatccacccatcttggactcccaaagtgctgggattacaggcgtgaacaaccgcgcctggctttttttgtatttttagtagaaatagggtctcaccatgttgcccagactggtctcaaactcctgagctcaggcaatctgcccactttggtgttccaacatgctgggattacaggcgagccactgcgcccggccccatatttctatataatgtacttatatggatatttcttaatctttcaatttgtagatactacttattttctttgtattatggaaaacaaagacttagatctcttacaacaaagctccctccaacttgttctccctttatcctacaaaaaagttttaattttgtaaaccaagaatatagtgttttgattgctatgactatgtgaatgtctgtcactgtggagtcagggagtattttatcataactcatttactttcttgagcaactgtttctttttcttagcattaacagctgccttggttttcgttacttagtttgctttactttctatgtgtttatcactaaggtttcactaattttcccacaatactgtaaaacctttctgaatactattctccacatggtcaaacacattgagtaatgtatcagttgtttttctattttctctaaagacatcccttcttgattcctctatcttcctactcccctctgacctctctaggtgtgctacacagctgtctaccttgaattttcattcattatcatctggggaattccctactcctctctttcatgttcatcccattttctggattccatgtcttcctctctcttagtttattctctcatttggtagaatgcatattccagtggcttactgagaatcaaagttaaaattttataccatctactacttgtaacccccaaaaatctgagacaggtctcagttaatttagaaagtttattttgccaaggtggaggacacgtgcccgtgacacagcctcaggaggtcctgatgacatgtgcccaaggtggtaggggcacagcttttatacactttagggtgacacgagacatcagtcaatatgtgtaatatgtacaatggttcagtccggaaaggtgggaaaactcgaagtggggagggggcttccaggtcataggtagatactagacaaatggttgcattcttttgagcttctgactagcttctccaaatgaggcgatcagatatgcatttatctcagggagcagaggggtgactttgaatagaatgggaggcaggtttgccctaagcagttcccagcttgagcaattttggggccccaagacttattttcctttcacacactcctcagtatggaccgttgcttttctagacaggtctacttactatttactgaagtattttttcacttccacatctttgccatttccttggctataatgctctcctactccctgtttttgtgtccaaatgctatttgtattttaaactaatttttatgaaaataacgtgtgtacacagtttaaaaagtagaacagttacaaggcttataaagaaaaaaacgtcctttatcccgttcttccctactctagatttgtgttcccaaaggcaagttgtttttgttatttcagttgtttcttctatttacctcctcatttctaaatacaataattatattaatatatctggacaataaccaataacttcttattattggggataaagatttagtcttttttttttttttttgagaaggagtcttgttctcttgcccaggctggagtgcagtggcaagatcttggtccactgcaacctctgcctcctgggttcaagcaattctctgcctcagcctcccaagtagctgggattacaggcacccgccaccacgccctaatttttgtatttttagtagagacggggtttcaccatcttggccaggctggtcttgaactcctgacctcatgattcacctgccttggcctcccaaagtgctgggattacaatcatgaagatttagtctttttatgccatatctttctaacctcttctctatcctctcaatatagttttgtaggatgttaaattctgaattagaaatttcttggccaggtgtggtggctcacgcctgtaatcccagcactttgggaggctgaggcaggtggatcacttgaggtcaggagttcgagaccagcctggccaacatggcgaaagcccgtctctactaaaaatacaaaacttagtagggcgtggtggtgggtgcctataatcccagctactcaggaggctgaagcaggagaattgcttgaacccgggaggcggaggttgcagtgagccacgatcgtgcaactgcattccagcctgggcgagagagtgagacttggcctcgaaaaaaaaaaagaagtaatttctacagaatcttgaaggccaaacttcacctcagtgaacttattgtggctcctagcgattgcctcttcccttccacggtgatttttaaaaaaacaaaactatccttttaatggtcagttatagaaccttacctgccttcaatattatgattactagaatatatcttcttcctctttttgaaaaacaagacaatattagataatcactcagtccctttggacttctgccattctccatgattactaacctcatctgtcagtaccctaggatgtaattaatatgggctatttggagggcaataacagggagccctgatgtcatctgaggaagtgacatttaagctgagagctgaaggatgaatagcaacggtgggtgaaagcgttccagcagagactgttgcctgtgcaaaagctgtcaagaaagaaggagctttgggaactcaaggaacgtaagcagacgcgtgggatagagcctggtgagaggaaaagtcgtctacctgaggttagagagggaaggcagaggtcagagaattcagggttcttgttggtgatgttaaggcaggattttgaacttatgctaagagagtgggaagctactgaaaagtcctaagcaggggagtgatttgatctgacttgcttgccatagatttctgtggttgcagtgtacagaatgaattggaggggcccaaaaggaagatacaggtaaaactgatcataaataaacatcaaggctagccttgaaagggggaaataaatttcaaatgggcaaaagatagtcttaccagatatgtttggaagctcagacagacagttgaattccttcgatttgctaatgatggggtgatttagatgctaatacaacagcctcaattttttctttcttcttttttctttttttggtattagatggaagtgactccttcgcaccgctcccctcctgccagattacttgaattgctgaccgacccacagatcccagaagcagtttgcgctccttcgtcacaggtgtggcctacatcctatgctctagtggttgttttgctcacttgccatggtgagatttctgaggggttgaggtagaaggtatggaagattgggggtggggacaatagggaagaagagctcctgggtaattagtacagaaatggtgcaacagaactgaaaggattgagaaagcactccttcccttctctccctcaggtagcaagcattatctagtcaagttggtaataaggacagaaacaagactgtttcctctgaattcctacctgtggggcttctttctgttgcagttagctgatccaccagaagaggtggtgttatgtttcaggggttctgacagtttaggcaggaggaagttcatttttgcagttctgttcaatggagttgtcccaatgaaaatgctggctgagggcctactttacatagtcacagacaacagctttctacaacacctgggttttctttggaaactgtgaggaggcactaaaaagaaccaaaatcttttttcttgtcttaaaaaaactcacaaaggagtgactctgaaggatgtgtgtgagagtagctctaatttcaggttgagtttggatacagaaaaaatcaccttgcataatttcatgttttgctgagtatattttgatttgtatggaattgcattaaaaaaaaataaagatgaggtcttgctatgttgcccaggctggactcaaactcctggactcaagcgattctcctaccttcgccttccaaagtgctgggataacaggtgtgagccatcctgcccccagaattgcatttttttttttttgagacggagtctcgctctgttgcccaggcttgagtgtactggcgcgatcttggctcactgcaacctccacctcccgggttcgagtgattctcctgcctcagcctcccgatcccgagtagctgggattacaggtgcgtgccaccacgcccagctaatttttgtatttttagtagagacagggtttcgctatgttgttcaggctggtttcaaactcctgacttcaggtaatctgcctgcctcggcctcccataaaaatacctggaataaaaatcccataaaaatgcctggaattgcatttttatagttgagcaaattagactggacccatgagtataggtggcgtattgaaataaattgagagaataaatagcagaattataacaaataaaaatcaacaatactgctatatcttttttggggggtggggatggagttttgctcttgtcacccaggctggagtgcagtggtgcgatctcggctcactgcaacctacacctcccaggttcaagcgattcaattgtcctgtcttagcctcctgagtagctgggactacaggcatccgccaccacacctggataatttttgtattttcagtagatacagggtttcaccatgttgcccaggctggtctcgaactcctgacctcaggtgatccactcaccttggcctcccaaagtgctgggattacaggtgtgagccaccgcgcctggcccaatactgctatatcttgaggaatcttaaaattcctgtgattaggctgcagtaacatgacaatgggtatgtatgagagcataatgcaaacaaaaaaaaatttcaggtctctaatattttttaaagttgatctgtttgaatctataagcaaagtacattttttccacttgtttaacagaattgaatttggaacgatattatttactattcactagcaagcacttgtatccccaaatgtctaaattagtttattattttattgataaggatgtattttggtaagaattctagacttatacctagaactaaagacaataacctcctccacctcccaattccagtatctagaataatgtctgccacatagcagtcgttcaacaaataaactagtgaagaaattacagtatttgctgtgttcaataaaagtaaagctagaggccgggcatggtggctcacgcctgtaatcctagcactttgggaggccgaggcgggtggatcacctgaggtcaggagatcgagacctgggcaagatggtgaaaccccgtctctactaaaaatacaaaaattagccgggtgtggtggcaggcatctgtaatcccagctacttgggaggctgaggcacgagaatcacttgaacccaggaggcagaggctgcagtgagccaagatcgcgccactgcactccagcctgggtgacagagtgagactgtctcaaaaaaaaaaaaaaaaaaaaggtaaagctagaaagctagaaaataactctatttgaaaatctttaaagcagtagagagcaaaactttagatctcttttgtcaataaaatatcataatatctgattaatataaatataaatttaacataaatcttaaaaatcattagatacaggctcaactgtgagcagagaaggaatcataagaggggaagaattgaaaacggttggttttacttcttggcagttaggacagtttgggaacaaaccttaggtctcctgcatttgcattttattgggagatgggcttctcgttgatcgcagaatgaagttcaaacttcgtaacatgtttttgaagagttttagattttagctttcgttcgagccgcccttacctacacgtcctgggcgtctgccactacagcgtgatctctttcttagtttgtcctgcgctttttcaccgacctctccctctaccctggactttgtccccttgggctcagtcaggtccctctaaagccttcccacgtttcaagggctagtttaatctccagggcttttaggaaaacttcccaaaccccattttcagatgcaatgtcgctctcccctatttctctagcactttgaactctagctattattaaattctaacgtggcattttcgcttgtttgtatcccccaaccagattgcgaccaccctgttggggaggtcttttaagaaatcgctgtgtccagccctggcacagtgcctggtacaaagaaaattcccagcaaaggtttgttgaaatgaatccgaactccggagggtaaaggagaagcgcctatgcctagtagtaaaggcctattcgcgacctttgggaaggcctgtggtgtggctgggccctgtccccagctctaaactggcaggagaacgcggcgaggcggaagactcgtgtaagagtctctgaactccctttccttctttttgacttttatagaagaatctgcaagttcttctccaacagccttgggccccgccttaaggggcggtgaaaaggggtggggttgtggtagttgggagggatgcccagcctcgtggcaattctggactcgcttttcttttgtaatttttaaagtttcgcaaattccagctctaagctgggggccgagggtgtagagggtttcctgatgcgcacattttgcgttccagggaaagctcccaggattcggagctttgcctaatttagccttctcacatgtcccaccgctaggaaggctaccgagtgcgcccggcctccacacccagccggccggcgtggagaacccgctgttcagcccgcgcttccttcttcaaccctctgggcaaacccgggactagcgtgtgggggagctcccagcccgcggtaccaggcgaagtagggggacggttggactacaactcccaggctgccccgggagcaaggagggggagggggcgagcgggaggggcctgggtggggcggggtgggggtcagggaaatcccgccccgctgcgcagcagcaacgacacaaagcctgactttacaacctcagagaaagtggaagtaagaaggcttaggtgggcaggcaggacgagagaaagactgagaggagggaaagccgcgtaggtgggagtacagcggcgcgagggtcgagggggaaccctcgtcggtgcagatgaggagggtgggctttcagaactagtcccccctcgcaccccgccccgcccctcccgcgctggggtcttcacggtgccctgcctcagagcccggctccaccacgcccggaagagggagtctggccgtcggctggctcagggcgggccggttggctgtacccaggctccctggcccgagtgcgggaccagagcgcggggcggcgcggcagccgcggaccgaggaggggctgcgagcgaaacggcgcggcgcggcacggcggacgagttagggccggggcgagggaggctgtggctcccgacagagacaggggagtagtgtcgggctgaggcgaggtgaggcgcggggtgcctcgggagggttccccgtgccccgaggggggcggccgcggagtccagcggggaggcgggcggtggtgccgcgtcggggaagagcgcatcccgcggggtgccgagcccggcgctggcggagagacgggggcgccccctccccacaggaggagcctcgcgctcctccgccatccttcccccgcgcggcgggctcgccttctcagtgggtgctgcgcgagctgccggcccggggtgccggggccagataagggcgatccgcggggccgccgcccccgggtcaggcaggccgggggcgggccgcgagtgaggcggggcggcggctaggctgcgggcggctggggggcgggggagcgcggagagccgaggggggcaggcggcgagcgggtggcccggccgcccgcctcgctgctccgcttggcgccgccggcccacgccgcagtgtgttttgtggacggcgccttcccagacagcccggtagagcccagctcagcgcccggcagccttcgacgcgatgttccgccggagcttgaatcgttttgtaagtacactcgctgcggctccgcgcgtgccggtttgcttgctcgccagccccttcgccgggtccctcacaacaattttctgagggggcagttacgtctctgggagacaccaccacccctcttcttccttttcaccgaaacacggtgcccaggcggccggggaggggaggcaggtagggctctcggggtatcccaccctcgcccccaggacaattcgaccagggcttcccggagctgttacaaactctgcctgaaactgggggccgccttcgggctgggtggtgggggggactcgtggggggaccgacccggggacccctcagtttgccaattagtcgaagatggcgttttattctcagggaggttgctttcttttgtttcctctgccacgagcacatggaggtaaacctagacctgtcacggtggcccaaaagaagagctgggggctgagggagccggagactagggcaagactcagccttgcctagggctcagccagcgggcggcttctgaccggaggccgggcaaactttggagacccagcctacaaagctcacctttagggtgtttgaaaggcgagcgtgattgtcagggtgggccgggtggatgtgcagccgcgaggaggctgcgccgccactgcccgtgctgccgatctctggtctgaagcctcgcggaggactgagcactccagaccttgaacccatgggagaaggcggactgtgactggactcctccgtccacgtttacccccttcagaatccccagaaaagggaatttcattttcatgggagttagccatagggaaaatcgctttctggctactgacttttttgagtaacctgtttactcctagagggtacattaagaatggagcgaaacaggaccatttacgttccgtgctgctatttgtagcaacttccttaattgcaagaggtggtggcgggaataggattttatttctgccaatgatgtggaagaaagggttcatctgcaaattttgatttttctgtagttaggaaaaagggttgaaagctgagtgctttcctctacctgccttaaaatatatcttttgagaacatgtcgatttggttttattcatgcaattattcctaatcaaaacgttgctaacatttttcatacatcggatatatttgctctcatttttccttcatttgaaactttcacaagtgtacactggctaaaagtaatacttgcacatccctttttagaatagtgctgtgttaatggttttctaaatgttgaccccacccaggaacatgcagtatgaaattggaacagattattacctgtggcatagagcagtagaggttgtacatatcaatcatcttgaaatccgtaggtgatggcttgtactgatagctttgctgaagcaagtgactaaaattggtttctcacatttagcctgagaatgcaagcgggtattgttcttaatagctgtttcacatagattcttgtgatcttggagtgttgcgtgggggtgacaaaaagggaaaggtggcaatgaaagctaattgtatttaggaaaaggataatcttttcacgtggcactcttatggtggaaaacaactgggctctgaatcataataaaatcattaaacttaagttgttgaaatcctttttttttttttttaaggatttgaacatttgaaaccgaacaactcaagtattggtctaaaagcccattgcttcccttttgcgaaaagtgatctgcatcgtatcagagtctagtaattaagcagtgctggcccaggaagccagggcatgcagtagaatttgcagcagttgttgaggtgccagcctgcaggtttgaggctagtactttgcatccccgaccaagatctcagcagagaatcacttttgctaatactgaaatgagctttgaccttattgttgcagctggaatattcagctgttcacattttcctgcgcagccatgactgtggtaagtatcaggaatttgtaccagtgcggtaagctggaaggttcttaggagttgtgtctgagccctaggcccagggcaaggaattaatctgcataccgttggactgaatgtgaaaattactatcaaataatcattgctaaaaaacggcttcaaaatttgggggaggggggcaatttttccatctcttagatcagtaaaccatgcgctgttctcctcttttgcctgacaaattctttgaggggtacttccatttgaattactagaagactagaattaaagatttgagtggaactttgagactttcacagcagtatagatgtagtcaaggttgtgagttgtcttatgattgttttaatattttagaaatagagctatgaattcctttcaaaatgagttgtttttttagtgtacctgtacgtgtctgatattggttttgattgtgaaataaattacagtggtgttgattgtagttgttggttattgaaaactagactacatattagagaagtgcttcctttatattttaaacctgacgtggaagaatcccttaggattcttacaagcatcatcttctatagctcagttgtgtttgctgaatcatttttgaaatgccatttatttttcgagttttccaatttcaagctaaaagaaaatagtgattcattgtatttttttaaatacatggtcttgacttctttgccattaataactgtgttcctttctttctgatgaattatgactttccttttgacagttttgaggtggaaagaaattggtggatttggtgtatagcattttagggttgaggcatgtagagggtgtcctaaaggatttaagagttggatgtctctgagtgcaataaaagcaccacctgttctcaagtcaacatctccataaatacagtaaataagtaataataactctgtctgtacaatttattttcttcaaaggcatatttaatcagaagtctggactagttgagatttaagggtcatggacttttatgttatcctgtcttgttttattcttaatgcaattcctagtgactatagtaacgtgttctcttgggtttaaagatttattgaaagtctaaaaacaattcccccctctttttggcttatgaaattattttatactaaagattcaaaataagagatttcttgataaagtaggttgggggcttggtcaagaggatgctgtcagtttagcttgtcagtgatagttaacaggtatgcatttctagacctttgatacatgaaagcttaattgtgagtgtgaaatactggagtacatttaaatctctgattctagaagcccttaaactgctttggtttcataaagcatgtagcatataatcataatatcacacagaagatgcccaggactaggaagaaattagactgcataaggaagaatggaaatttaaaataagactaaaaaatacaaaataagaattaatgaaataggtagctaatttattgctttgagtccaaggcaaggctagtctaatgaagcaatatatggaggcaattaagaaaatagttcaggtaattgctttgttttttccccaggagcaagaaggtttttagtttcccctttaaactatcagagtaattaaacatttttttttttctgtttcactttactaataatcctggcctgacattgacgagcgggaaaatattgattttattttactgtgtttagaaatatatctgtatgtatgtattgcaatatttttacatttgcacaactattacaaatggtctgtgtatctcggctcccacatggctgttcatagaggtctaggtttagcagttgaacttgaccatacttaaaagcaactttttttttttaaatcatattgtgttataattgccttttaacttgtatggctccctagtctttctcaacatggagagaattggcactgatgccctaggacatgcattgttagtaataaattaacattttcctgcgcagctggagtgaaggaaccctaattgagaaaggctgtcctagacagggacagttcacagtgtgttcttagctcctagcacagtgcctggtccctagtaggtgttcagtaaaatattttttgaaagaacaacttttgtatgtatcccataaataataacctttacttacagatagtgattattgtaaacccgctcttatgcagaatgagcaaagaatgagttcttgttagttggggtataccgtatacattactagtattctaagaattagaataaatacatctaatgccgaaagctatactgaccatagtataatctttttttttttccttttttttgagatttattatgggaattggatcatgcagttacagaggctgagaagtcccaggatctgccatctgcatgagcccggccacaaaatatccccttcttttatttatttttatttttattgttattttttttgagacagagtcttactcttgtcatccaggctggagtgcaatggcacgatcttggctcactgcaacctccgcctcacgagttcaagcgattctcctgcctcagcccccctagtagctgggattacaggcgcctgccaccacgcctggctaattttttgtattttttagtagaaacggggtttcaccatgttggccaggctagtctcgagctcttgacctcaggcgatttccctacctcggcctcccaaagtgctggaattacaggcaagagccagcatgcctggcctctttcttagatgattaaggcattgtatggttttgcagagcaattatcattcagcaaatattcactgagcacctactatgtgctgggcactgcagtcaatcctggggtcgtagatgagcaagacagacaaggttcctgtcttcctgagctgtaattatcattacatacacaactatagatatagagggcatggtaactgcattgcattgaatacatttgtgacataccatgaaatttgatctttgtgaataagttactattacatacttgtcatttttctttctactaaaaatagattgtacaatatcagttattttctggttgtttggatgtcagttaaaaaggagtttcttgcatttgtctcctttcatctgacctacgcatggcaaactgctcttttgcaaatagatgctaggctgaccccacgcaaggtgggaaacttatttagaaatgaaccactgtaacttgaaataaatctttacacaagtgaaagcaggttttgtcttcttttttcctgatctaccttttagtgactaagcaacataaaactctgaatgtgtcctgaatactttctgtaagtgtttactgtttgttccttttgtttatgcttattgctaataattcagccatttagtgagtaatattgagtgcctatataccaggtagtttccagtgttcctaattaacttttagctgaattgagatttgggcaggtgaagctggccatttttatattgatgcaactgttcaaaagagcttgttttttcaaaaagctgccagtttaccacctgctgagcagtgggttctaggaggtaaaggatggccagtggcccctgaaagaaccataactaaccttgctgtgtctgcatgatgtgcaaagaactagcccactgagtgaaatcaaatactggtttgttgagtgatggaaaaaatcaaggctcattgcttgtctaacatggttattcagttctctcaaagagggtgaatgcatgggatataaaaaaaaaatactatttttttcttcaaggtggtggaatttcctgtacatctgtagtgctttatacagatgaaccttttacatctggaaccctcgagactgggggagtttttctggttaggtggagggaggttctgggcttccacaaatgaattaggtgctggctctcgagtttatttcctttcacttaacatttaccttcttggcctggtataagggtagattagcggtgatcgtaaaacaaaacatactggcacaactgcagcatatgttaacactgctgcagcttaatgatgaatgagtgctcagcactgcagatatgggcacaggatgccctatgcccacacattggcagacagcccctcaattattgcagtgtatggacggattactgggtcggctgacttcttgataatagaagatgtgatttataaatgataatggaccgtggatttccagatttagaaggttaacctgtatttgtgaagtagaaatcattgatttcttgtgccatatgtatttaatggaatatgggaggattggtgatgttgatgatattgctgttcaagcagatatcatcatttgttttttagacgtctctattatatgttgtcataaagtattaatgtggcaatgttttcctagtccctttctctttaccaaggtattcttggaaaaatcagaagtgttcttgaaaatgatcttgcagttagcacagcatcaggtaaacagtagatgttcaattaatacttgtttaattgttttgagctgaattggtaacacagtctgagtcagtaataacagatgaagaatgatcagtttaggaagcagccaccaagaagcttatgcatttcagactgggctacaaaattagccaggagtggtagcacaggcctgtaatcccagctacttgagaggctgaggcgggagaatcacttgaacctgggaggcagaggttgcactgagccgagatcgtgccattgcactccagcctgggcaacaagagcaaaactccatctcaaataataataatcctgtatgcttactataaatacagattcctgggccttgaacttactgaatccaagtcttgggtgacagactccaagaaactgtttttaacaagcattccaagtggttcttaggttcactaaaatttgagaacagcaatatataatatagtaaacacggaaatatttattttctgggcacactctctgttcacctttttgaacttcagtttcttcatcgatagaatgggaataataatacctatttcacaagactgttgaaaaaaacgtttggtagactattcaacactataccaattgtgacagaggtcctcaaaaccggcctaggtttgttgattcactggcagaactcagtacatagaaacgcttgcggatgtgatttattatagcaaaaggatacagagcaaagtcagtaacgggaaaaggctcattggggccaagtctggaggaaaccatgtgcaagcttccagtcctctttcactgaaatcacacaggtcatgcttaattcctctagcaaatgagttttgacaacttgtgtgaaatgtctactagggaagcttattagagattcagtacccagggtttttagtgggagctggtcacacaggcaccctccacctggtacacagcaaaattccagaccccaaggaggaaagcaggtattcagtgtaaaccctattgtttacacagcttaagcagagtgagccactcttatcagggtgatggaaaccctcccaaaatccaagtccccagacaccagccaaggaccaaccttgcaaacaggccttactaagaatagcagtgtcaggcctgctatgttaactctttccatcacgcaaatattgtgaaacactggtattttttcagtgaaaggaaatgacttgtccaagatcattaagctaatcagcagtacagctgagacagactcccagcaatcacatcttttctttgctgcccatagccatgcttctagattatgggtcattccttttcatactgtcattgaaagcacttactgtttgtcacttgaagcagaagagcagcctgccggtggtaaattgatgcacccagtgggggagccaggaagtattgatgtttctgccagtttagcgtcaacacttgctggtttcctctctggagcatcgccaagttcgtggattttcatttttcctgacttttggacttttgttactgctcccattcatttgctcatagtcctaatactcatttgcatcatcacttcatcccattctataccttttgggtaacacaatttccaaatggtgggaatactgcagtattttgtcaaagaagactatataggaaaaaaaaaattctgagcaatgaattttatggcaatatttacaaatattggtttatatcctggattgtcttttgagttttatagtcatggaaaaccctagggatatctctggttatttggagtttcagccatttttactgttataaaggaaaattaacaaatttgttatgattggagcaaggaataaggaaatcatactggatggtgcagtaatcccacatatcgacagggagtagaagccaggagggaattgccacaagtaagtaacagctgggtagagcagattatgtaagctacacctgttgtgtaagcagtggggacgttctttaagcttcacaattaatgtattttgcagtaataaggattaagggatctatagtatagtgtacaatttattctggcttcttttctgaaaacattcatgtgaatcacagctttcttggaacactcatcccctatttggtgctgtagaggtgtgtaaggtacagccctgctcaccagtagcctgcagtttggtagaagagagagaagaccagcacacaggaccatcctccacacaaggccagtaggtcaccagagccatccttttgaaggacatacacagtaagtgcagtaggcattcagaaggaggcactggctctctggcttcatttcttggggagagctttatggaggaagtagcctgtcaactgggcctctggggacccaaagggctgaaggttctgagattttagggatgggcagtctcattacaggaggaggcaattacctgagcaatggtgcagggtcattgttgtacttaaagcatgggaaccagtcaatttagagaacatacatgccaaccccaaatgagtttgagctgttataaaaaaaagtataacaggtggggctcagtggctcacgcctgtaatcccagcactttgggaggctgaggcaggtggatcatttgaggtcaggagttcaaaaccaggctggccaacatggtgaaaccccatctctactaaaaacaaaaattagccaggtgtgatggagagcacctgtaatcccagctactcgggaggctgaggctggagaactgcttgagccagggaggtggaggttgcagtgagcagagatggcaccactgcactccagcctgagtaatagagcgagactctgcctcaaaaaaacaaaacaaaacaaataaaaagtataacatagattcagtggcttatgcacaacagaaatttatttctcacaatcctggaacttggaagtccaagatcaggatgccagcatggttgggtactggtgagggggcttcacgtcgcagactggtgacttattgtatcttcacatggcagaaaaagagtgaaatgagctccctagggcactaatcccatttatgagggctccaccttcatggcctgatcacctgtcagatgcctcacctcctagtactgtcaccttggaagttaggatttccacataagaattttaggggaacacaaacatcctgtccatgacacagcagaaacaccaaaacctcgatcttcaatgccttacgtttgctgtagtaattttgattttaaaaaaggagatgctaaaaacaggtggctttaggtctccacaacaatagctataggaatcttcccatacatagatgctcttttctgaaacctatgactccagtaaatttatgtcatttaaaaaaaatgcatatatatatatatatatatatatatatatatatatatatatatatttagagaaggagagagagagagagacagtcttgctctgttgcccaggctggagtgcagtggcacaatctcggctcactgcaacctctgcctcctgggttcaagtgattctcctgcctcagcctcctgagtagctgagactacaggcgtgtgccaccacacctggctaatttttgtatttttaggagagacagggtttcaccatgttggccaggctggtcttgaactcctgacctcaagtgatccacctgactcagcctcccaaagtgctgggattactggcgtgagctgccatgcccggccttatttggtgcagagacagtaaggcagagaccaggatgaaatatatatttggggtaatatatcatgacactacttcatatattattataggactgcttacttagttaccctgcttaaattatgggtacacatttctggtaactttcactacacatgggagacaggatggcagttcattttcttgagtactagtggtcatttatttaaaaagctggagatcaggccttttttcaggagcacattccttaccaacacatttatagttcactgctattagataagaaagcttttgatagactttcagatctgactgcatcattcggacttaccagaacatgaattgcatctcattccctctgtattagtctattttcatactgctttaaagaactgcctgagattgggtaatttataaaggaaagaggtttaatggactcacagttccacatggctggggaggcctcaggaaacttccaatcatggcagaaggcaattaggacgcaagacaccctcacaaggtggcaggaaggagaagtgccgagtgaaggggggaagaggcccttatgaaaccgtcagatctcgtgagactcactcactatcacgagaacatggggaaaaccacccccatgattcagttgcctccacctggtctctcccttgacaggtgggtattatggggattataattcaagatgagatttgggtggggacacatatcaccctcataaccagttcatcacgacaccatgcttagtcagtgccacttttctttatcatcatgactgccaccctcgtctaagtcattagcatctctccactttcatatttgttcctcctccagttttcccgttcagtaaatggcaccatccccctcctagtagctcaagctaaaaacctagcagtcatacttaatactaacctttcccttcatcacatttgtcagagaatccagtaggttctatttctgaaaatgctgtcacatccatccacctttcttcatgcccacacctaccaccattcaagtttaagctactgctgtcatttacctggacctttgcaattgattattttattatccacctttgccctctcctatctgtcttccacacagctccagggggatcttttacagacgcacaccaggagcacttcattgactttcgactgatttctggttaaatactttgctggtattgctctctctctttcactttttttcattcacttttaaaaactgagataattcacctaacataaaattcaccactttaaagtatacacttaagtggatttaaatttcctatgctgtgtaactatcacagctatctaattccagcacatttccactacctcaaaaagaaaccccatccgttagctcttagtcccagtcctctatccttcagcccttggcaaccacccatctactttcttatctctggattgccagtggaatcatacaatatgtgttcctttgtgactgaattctttggtgtagcatagtaatattttcaagatttgttcatgttgtagcatgtatcagtatcagtacttaattcttttttttttttttttgaggtggagtctgtcacccaggctggagtgcagtggtatgatctcggctcactgcaacctgtgcctcctgggttcaagcgattctcatgcctcagcctccaaagtagcttggactacaggcacgcaccaccacactcgactaatttttgtatttttagtagagacggggttttgctatgttggctaggctggtcttgaactgacctcaggtcatccgcccggctcggcctcccaaagtgctgggattataggcgtgagccaccgcgcccggactcattccttttgaaggcagagaatactccgttttatggagagagcacattttatttatctgttcatcagctgatggacatttgggttgttcgcactttttgactcttgtgaaaaatgtttcttcgaacatttttgtcctttcttttttatttttttattgagacagagtctcactctgttgcccaggctggagtgcagtggcgccatcatggcacattgcagcctccgcctcccaggttcaagcaattctcctgcctcagcctcctgagtagctgggacaacaggcgtgcaccaccacacccggctatttttgtatttttagtagatatggggtttcaccatattggccaggcttgtctcgaactcttggccttaggtcatccgcccaccttggcctcccaaagtgccggaattacaggtgtgagccactgtgcctggcacatttttttgctttttaaaatgaatatgtttttacttgagtatatattagtggaattgctgggtcatatggtaattgtatgtttaaacttttcaggaactaccaaactgctttcttcagttcttcctcacttaaataagtagtttgtgtgtgtgtgtgtgtgtgtgtgtgtgtgtgtgtgtgtgtgtgtgtgtttaagtttgagtgcagtgctgcgatctctgctcactgcaacctccgcctcccgggttcaagccattctcttctcagcctcctgagtagctgggattacaggtgcccgccaccacgcagctaatttttgtatttttagtagagatagggttttcctgggattataggtgagagccactacgccagccatgtgtgtgtttttttgagacagagtcttgctctgtcgccccggctggagtgcagtggtgtgatctcggctcactgccatgtctgcctcccgggttcaagctattctcgtgcctcagcctcctgagcagctggaattacaggcacacgccaccatgcctggctaatttaaaaatatttttattagagacagggtttcgccatgttggccaggctggtcttgaactcccaacctcaggtgatgcaccctcctcagcctcccaaagtgctggaattacaggtgtgagccacagcacccggccaataactagtatttttaattgtaaagaaaacacctaaaacttaccatctttctttaaagcatagagtagtgcaaattgtattcacattgtatgcaacagatctctagaactttttcatcttgcaaaactgaaactccatacccattaaacaacagctcccccacttcatgcagtattggtctttttgtgactggcttatttcacttagcataaagtcctccaggattctccatgttgtagcatgtgagaggattttcttccctttttttttttttttttttttgaaatggggtttcagtctgtcacccaggctggagtgaagtggagtggtttcgctttgtcacccaggctggagtgaagtggagtggtcttggctcactgcaacctctgtccccacccccacccccgccccgggttcaagcaattctcctgcctcagcctcccgagtagctgggattatatgggattatagttacccaccactatgcccagctaatttttgtatttttagtagagacggggtttcgccatgttggccaggctggtctggaacttctgacttcaggtgatccacccgcctcggcctcccaaagtgctgggattacaggcgtgagccacatgcctggcctgattttcttccttttaaagactggattatgtttcattgcgtatatatatattttgtttatacattcatctgtagatagtcatttggattgcttccacctcttggctattgtgaataatgctgctatgaacatcagtgtgcaaatatctctcttcgagattgtgctttcaattctttggatatatacccagaaatgagactgctgtgcatgtggtaattctgtgtttaattttttgaggaacttctgtactgttttcaacagtggctacatcattttacattcccattaagggttctagtttctccatatactcaccaacaattgctatattttttatagtaactgtctttttttttttttttttttttttttttgagacaaagcctggctctgctgcccaggctgaagtgcagtattgcgatctctgctcactgcaatctctgcttcccaggttcaagtgattctcctgcctcagcctcccgaatagctggaattacaggcgtgtaccaccatgcccagctaatttttgtctttttggtagagactgggtttcaccatgttggccaggctggtctcgaactcctgaccttatgtgatccccctgccttggcctcccacgtgctgggattacaagtgggaaccaccacgcctgacctataatagctgtcttaatgggtgtgaggttacatcttattgtgattttgatttgcatttcttggatgattagtgatgtgagcatcatttcctatgttttttggccatttgtatgtcatcttttgagaaatgtctacctaagtcctttacccattttggttgcgggggggttatttccttttttgttgttgctcagttgtaggagttatttacatattctggataatatttccttatgaaatatatgatttgcaaatattttcccacattccataggttgccttttcattgtgatgattacttactttgatgaacagaagtattaaagtttgatgtagtctcatcatttgtctgtttatgctttcgttgcctgtgcttttaatgtcatatccatgaaatcactgtcaaatccaaatgtcatgagtcttttcccctctgttttcttctaggagttgcatatttttaagtttaattgatagtttataagtcttacatgtagatcttcaatcgactttgagttaatttttgtatgtagtataagataagggtccaacttcattcttttgcatgttgatgtccagttttcctggcaccatttatttgaagactctcccagcatcgtaggacagggtaagaaaaaaagagaagactcttttcccccactgagtggttttggcacccttgttaaagatcatttgaccatgtacatgagagtttacttctgagatatttatttttattctgtttgcctgtgtgtctgtctttacgccagtgtcacgtggttttgattactttgattacatattgttttgtaatatgttttgaaatcaggagttgcaagacccccaactttgctctttttcaagattgttttggctatttggggtgccttaagattccatatggattttatggtggatatatattttttttaatttctgcaaaaaaccttcctcattttttgtgttccatctgccacaggaccgttgtatatactgtatattcctggtacacttctctcctgtagtcagttgtctcaactcttacttatttctgagagctcagcttaatcatcacttccctaaggaagctgttcctgatccttccctcagacaatgccaggttctcatgttactatgaacctgtccttcatactctttttgtagttgactttacatttgcatactgtatttggtaacttacttagtgtctagatttcctctatatagtatgctccatgaaggtaagacctgtgactatttttgctcattgctatatccctaatgcctcactgcctgacataatatgtgctcattaaatgcttgctgaataagtgaaatacgatttctatttgcatttctaatcttcccatttataattatagacttgtagtgcttgactgagagatcaaagactaagtgatgtccagtcttttttttttttttttaagacagagtcttgctctgttacccaggctggaatgcagtggtgtgatctcggctcactgcaacctctgcctcctgggttcaagcgatgctcttgcctcagcctcccgagtagctgggattacaggtgtgtgccaccacgcacagctaatttttgtatttttagtagagacagggtttcaccatgttgggcaggctggtctcgaactcctgacctcaggtaatctgtctgcctcggcctcccaaaatgctgagattacagacgtgagccaccgtgctggccacatgttgtgttttataatacatacatcatgcctttttaaattatgattttagttatttaatattctgtgatgtagttaatgaattaactctataagcttcactgtggtttcatacacatttacaacattgattttcttcagcaatttgctattatattttcaaagtacttaacgtactcctaaaatatgtacaactattatatatcaattaaaaaatactccagtataaataccaaatgaagtgtttattaatcaaatatttttttttctttttctttttctttttttgagatagagtcttgctctgtcacccaggctggagtggagtggctcactgtaacctctgcctcctgggttcaaattattttcgtgcctcagcctcccgagtagctaggattacagacgtgcaccaccatgcctggctaaattttgcatttttagtagagtcagggtttcactgtgttgaccaggctggtctgaaactcctggcctcatttgatcctcctgcctcggcctcccaaagtgctgagattataggtgtgagccactacgccaggtgtaatttttaagtccttttgataactttttgtctatgtgtttttcaaattcttgtttcaaaatttgtttttaaacagctttatcgaggtgcaagtacttttaatgttattatttttgtgagtttattgcaactttagggggtaccagatattcagcaatgatagtagtgtctcatttaagtccttattgcacaaagatggagctaatctaattattttatatgggtcaagatttgaaatttttaaaaatcttttttaaaattttactttaggtgtaggcatttgtgttttgtaggatatcttgaattgctgatccatgatttcattgatatgttgcaggtttatggaattgttatagttgtaagctgtttttctttgccttttaatcatcataacagcaaaacctagagtggtaagttccaggaactgttttaagtgctgtataagcattagtttattatacacatttggttattaggattctccagagaaacagaaccaataggatatatacaagaagtgatttatcataaggaattggctcatgggtttatgtagcttgacaagacccaagatctgcagtctgcaagttggagacccagaagaactgatggtgtaagttccagtctgaagactggtaggttcaagactcaggaagagtcactattcaattctgaaggcaggaaaatgcaggaggagttattccttagctgagggaaggggaagggcagcctttttgttctactcaggccttacactgatttgatgaggcccacccacattatggagggcaatctgctttactcagtcttctgattcaaatgttaatctcatccagaaacaccttggcggacacatctagaataatgcttggccaaatacctgagcatgctgtggcctagtcaagttgacacataaaattaactgtcacatttatgtcctaggatcatgtgaagatgaatgaacaaatctaaagtgtctataggccaggaatggcagactctactataaataattgtagtttgctagacttcccatctgtaaaataaagggcttgggctgctagatggtctgtaaggctcagtgaatcctagaactattaaagaaccttagaggccatttagtagtccaacatcttcattatagctgggaaaatggactgagagagggtaagtggcttttccaagattattcagtgaattgagaattcagaaatatggaattccaggctcagttctattgcccttgtcttcagtttccttatctgtgaactgcatgggctcctgggatgatatatatctaagttatttcccagctttataattctgtactatgtgtttaggcttagagtctacgagtgagcgaatcttttgactattttctgttgggtttttatctgttttactctttgggtctccatctcttgattgcacatttgacggtattctaccccaaatttcagtttcccctttaatagtaatgagtttgaactgaattttatatactttggatgggaacattgacaaattttaggaagtactgtttcactcgcgtccgtgtgaagagatcaccaaacagacttcgtgtgagcaacaaggctgttcatttcacctgggtgcaggcgggctgagtccaaaaagagagtcaacgaagggagataggggtgggactgttttataggatttgggtaggtaaaggaaaattacagtcaaagggggttgttctctggccggtaggggcgggggacacaaggtgctcagtgggggagcttttgagccaggatgagccaggagaaggaatttcacaaggtaatgtcatcagttaaggcaggaacaggccatttaaatttcacttcttgtgtgattcttcagttacttcaggccatctggatgtatacctacaggtcacagggggatatgatggcttagcttgggctcagaggcctgacactgtttatgggtttttaataggggtatactgtttagttttacactgatctgaatgattgaggatctaatgtagacccatgccttggttggtaactatgctctagaattaattaaactcaaatctaattatattaatcttttagctaacagcactaatggaggagaggatttttgttgatgctggaatattacgggcaagcttcctgggaatcaacactgcctttgccagtggtcacctgccattatttttcaaaagcactcttactcatctctacttatgaatacaattaattagttgcagaatgttagatagagtggcagtccttggacaggctgagtgacagctgctagaagacagtaggaggcaataagtagacaattcatgtgtatatacttgagaacaagtggtaatttggtcgagctgaattgggtgccatgtttattacagccagtgattcaacctaaggctgagagccctagcaagggagcagtttcagaaaattgagtctgtaaataaagtctattttaaaagtcataatcatttgttaggttagaccccagaccttgattaaaagtatcaggagaacatatatccctgttttgaaatttcaggcagtgcaattaaaatattcctgtaaaaattcagacatattacttattaaagatactaatgaaggcagtgcaatcaaaaatcatacgtaatcaaatcagaagatttattaatggatttatagaatccatgtttgaaattgatgattttaagtagtcatgaaattcaatgtgcattaacaagtatctgtttatttcctaatatgtacctcacattgtggaagttttttgaggtatgggggtgggaacttctttgttatggtgcctctactaatgagcagtgtagccttggaaaaatcacttccttttaaaagaaactgtcatttaaaaatgtaatattctatgcaaatagaatagatataaaatatgtgcataataataaaataaacccctgcatacccactacccaacttgagaattataacattagcaatacaattctacctatgtactacttccctatctcctctccttgccttcccaccaccgtgtaaccattagccttatttttgtaataatcattctattttatagttctaacatgtatgtatgcaaacttagatatttagctttcttattttgagctttataaaaatggtttgtatattgttttttactcaatattgtattgctaagtttttttttttttttttttttgagacagagtcttactctgtctctcaggctggagtgcagtggggtgatcttggcttactgcaccctctgactcctgggttcaagcgattcgcctgcctcagcctcccaactagctgagactacgggcatatgccaccatgcttggctgatttttgtattttagtagagacggggtcttgccatggccaggctggtcttgaactcctggcctcaagtgatccgccctccctcggcctcccaaagtgctgagattattacaggcgtgatccaccgtgcctggcctgctaagattctttttaaggttttatgtaggcataattcattcattgtcactgctgaataatatttcaccttgggagtttactagagtttatccattctcctgtcgatgggcctttgggttgttcacaggattttttattttcctggcatgatcagtgctgctaagaacaatatgtatcttttggtgtgtgtgtatttattaaaggatatttctcttgtggggtgtgtgtgtgtgtaggatttgcatatacatagaaacacaaaactgtatgtataggaagtctcacatacgtaatcataggtcttggaatgtgcatctttacaaaaggaggtaaaattgttacccagagtagttgtaccaatgggcattctcactagcaatatatgagtttccattgatttatattttctcaacacttgctattgtttgagttctttctttttgccaatctattgtgtgtgaaattttatttcacgatgatattaatttgcatttctctgattactaatgaagttaaacatttttgcatatgtttatgggccatttatgtttctctccttatctacttgtttatttccttttactattttctattgggttatctttctcatactaactttaagagtccttttcatattcaaaacactaaagctttgtggttatctatgttgcagatatcttctctaagatactttgccttctgcttttactattttttttttggtaccttttgataaacaagttcttaattttaatgtagttaaatttttctgtctttttctttatggttagtgctttatgtatcttgtttaagcaatctttctctatgccaatgttgggaagctagtctcctgtttcttttttctaaaacttttaacattttgcaaattattttttgagcctcacttttcaggtctttagaatgcaggtatggaactagatgttccttaacatatgttctggtctcttactctttgacactgtgacctgaagtagatttcggatatgtgactgtgttttcagaatatgcagtgttcttttttattttttaaagagggttttttttttatcatgtatctgtaacgttaggcaaaattatttaaagtcaataaatttttattcaaggaattccatgttgtgatttcttccactgtccatcaaggtcactttagatctcctaaagagctggagtcaaaagatttatcttcaagttagccgtttttaatgaaactgatgcttattttaatccagttgtcctgtcagcccataattctttttttttttttgagacagagtctcactctgtcacccaggctggagtgcaatggcagaatctcggctcactgcaacctctgccccctgggttcaagcgattctccagcctcagcctcttgagtagctgggattgtaggcacctgccaccatgcccggctaattttttgtatgtttagtagagattggatttcaccatgttagccaggatggtcttgatctcctgacctcgtgatctgcccgcctcggcctcccaaagtgctgggattacaggcagcccataattcttttattttggcttctgtcatctccttttaatatggatatactgatgaagacttcaaaattcaccaagaatctttgggatctaatttcttcaatttagggtcatttttactgtaggtggtggatctgcctggttctcaatttgacaccctctcttaacatgagttcaaatcatattcattcctaagtgatcacactcaagaatagtacagatgtgtggaatatgccaatacctgaggtaaaaaagtagattatcaggtctttcatacgtttagtaactgtctttttcaaacttttagcaactgtcttatagttctttcccatagatctagcaatagtcctgtgagtaaagtaaaaccacagttactttatgaggtgtttctaaggacgtgcaggctacaggaatgcagtgttcttttagtaacctttcccactatgaagtttcatatttactcctacttctctttctctcatttccccagcgtcttccttcctgttttcttcagaaaagtaaccagctgaattctgtagtatcctagagtttctgtgttgaaacagcatttttgatgtaaaattttattgagatatttatggatacacatggaattgtaagaaaaaatgcagagagatcccacgtactctacccaatttctccccagtggtaacatcttgtaaaattgcactataatgccacaaccaagatactgatgttgatgccgtccaccaatgtttttcagattttccatattttgtattcacttgtgtgtgtgtgcatggggtgtgtgtgtgtgtgtgtatgtgtttagttctatgcagttttatcccatgcataagtttgtgtatccaccatcacatcacagaccagatacagaaggaaagaaatgttatttaaaaacagtgtgggccgggcgcaataactcactcatgtaatcccagcaatttgggaagccgaggcgggtggatcacctgaggtcaggagtttgagaccagcctggccaacatgatgaagcccgtctttactaaaaatacaaaaaaattagccaggcgtggtggcaggtgcctgtaatcccagccactcgggaggctgaggtaggagaattgcttgaacctgggaggtggaggttgcagtgagccaagatcgcgccactgcactccagcctgggcaataagagtgaaactctgtctcaaaacaaaacaaaacaaaataaaaaaaaccccaaaagcagtgtggtttaaagtctctgtcactgagtacccccagattgttccatgtgcccagtttggctggtgcccatacagttttagagagcaatctcaggttacataatttagaagcaaattgattaactgaaactttgacctgagaaagcagaggagctttagtcctgggtcctgggaggccagttggcatggtcctaaagtataataatcatttattttaaattatatccccatgtgagcctgcattggaaacatcctagtaaaagctacttagtccatcataccaataggagtcattaaaattctacctgcttattagcaactaaaagctagtagtggaaagagggagtgataatccttctaagaaagcaataaaaaatctgccaggttgtgcattggtttatagccccataaatagaaacttatgttattgtcaggaaggtagtcaaggacatttgaatactgtatttatggagagctacatatgctttaagtaactcatatccaccccaacatacttaaacatgcaacatctttagtgaagttcatttgtttactcctttattacctatttataaccagctaggcactatatgctaggcaatggggaccaagtggtaaataaaaacaaaagtggttcatgtcctgatggaccttataatccagtttagaatggaaaacccaacacattttttatttactcattttcataagtgttatgaataaaatgaataggatacagagatagcagaaataggatatgttttgatagggtaacatgaaagttctgtcagaggagatgacatttaagcagataactgaaggaatgaggactacttctgcaaaggggtttgggagtagttactggaaccagcttgcacaaagaccctgagttgggcaagagtcaggcacattggagaagcttaaaggaggctagtggggctgaagggcacactcagtggaaccgggggaagatggcagtgaatgggatataggaacttctggggagcatttggattttgtaatctaatttctggtagccatgaaggtgatctggagatggggagggcgatgataataaagttgtctatttaatccattcacacatatttattgagtatcctatcacatgccagacactgttctacttggtagggatggactgatgagcaaaacagacaggaatctctgacctttttgtctctacattctaatgtaggaagctgttgttagggtacagggtaaaataatgtaacaaagagctccaaaatacagtggccaaaaaattatagacgtttggttctctggcgtgtaacaacccagagaaggtaagcagtctcttttctttttcttttcttttttttttgagacagagtgtcgctctgtctcccaggccggagtgcagtggcgcaatctcggctcactgtaacctccgcctcctgggttcaagcgattctcctgccttagcctctcaagtagctgggactacaggcacccaccaccatgcccggctaattttttgtatttttagtagaaacggggtttcaccgtgttagccaggatggtctcgatctcctgacctcgtgatgtgccccgctcagcctcccaaagtgctgggattacaggtgtgagccaccgtgcccggccagcagcttcttttctatgaggccatccaccattccaggctgtgttggtcaattctgtctttcacagcatttgatttttaaagttccagccagcatgaaggaaagggagtccaggagaagcttctttaggaaggtgacagaaactttcacatattacttttgcgcacatgccattggagaaatcttagtcatgtggccctccctagccacaagggagacagggaaatgtagtttctggttggaaagtgaggtgttcaggaagaaaggaagaacagatttgggaggacaatccagtggacagggagacaggcagtaaacaacataattgtaatatctcctgtgatgagtgataaaggaaagataaagcagagaatgatgatagaaagtgtcaggggtgagggttgcagtttttcaaagggtgaagaaggcctcactgagaaggtgtcatttgaataaatccccaaatgaagttttgtgagcaagaaataccattttgggttgttatgaagcctataagaatgcatggttggttttaacatgcttgagtctaggaccttatcagaccccatcagaaagtagttagcgtggaaagacaccattgtgccacatattcacctactgcaagcaatacaaggccttaatgaatttttgttgttgttgttgttgtttgttttgtttttttttttgagacagagtctcactctgttgcccaggctggagtgcagtggtatgatctcggctcactgcaacctctgctccccgggttcaagtgattctcctgcctcagcctcctgagtagctgggattacaggtgcctgctacggcaccgggctaatttttgtatttttagtagagacggggttttaccatcttggccaggctggtcttgaactcctgacctcgtgatctacccgccttggcttcccaaagtgctgggattacggctgtgagccaccatgcccggccaatgaatgttaaattaatgagttatgctaggacctggactgaggtatctgattttttcttgactttttttttttcgttttttttggagacagtgtcttgccctgtcaccaaggctggagtacaatggtgcaaccacagcccactgcaacctcaacctcccgggctcaagcgattctcccacctcagcctcccaagtagctaggactacaggtatatgccatgaccccagctaatttttttttttttgtagagatggggtctcactctacaggttggtcttgaactcctgggctcaagctacatatgctttaagtaactcatgtccacctgcctcagcctcccaaagtgctgagattataggcatgagccactatgcccagccttggctttttcttagatggaaagcttagctcccaaagaagggagggactaagattcttctgccacacacagttaagagtgttgcacatacttggactgtagaggtgtttgttgtgggggcggtgggaggggagatagatttttgctaagggtagaaattatttatggtctgagtttgctgtagagctctagttaacttcaattagccattgtcagtgcggtttaaggatgtggtgacatgaaagagtggaagtattttcatttttgcccttgatcttccattcatttttgcccttgatcttccaaatcttgcttagtagcctttccaattacagcaggcaatattttccaaccttttactattttctttaattatatttgattgctgctttaaacatttttacataaaatacgtaagtactttaaaaaaaaaacttttcctgtgtcacttttttaaggataactcatttgtttaatgagccaaaagaaaataattttctgcctattttttctctaatccccttcctacttacaacatccctaggttggagtacatagattgtctttgggatttcttatttttgtggtaaattatgtttcactagggaacttacagttttagaagggagataagaaacattgttatataatgaaaatacaagacagaaagtgacaaatgctatgagaaggtaaaagtaagatgctcctatagttcagagactatggcatgagatgaataatcctgtcagtctgcttccacaaatgtgaaaggagacattaaagctacctacgagcttaatatataatgctctcaaaaggaattttccattcttggaaaagggaaacatttgatctgtcatcctactgtttatttttgtaagccccgtcttttcccaggcacagataaaatccattgttttcctctcacactatgccatagggaaaaattcaattcagattggaaaaagcactgctaatcacttcacaacattttgtagagttagccttgaatctttcttcctttccctcactccgtcttacccagtccatcacccaattccacagattgtggtcccctgaattgtttttttggatccactcttgctactcttattccatctctgcaaagcagctaggctgactctttttgaaacatacattaagttagtttctagctaagaatccctagtagctccgttcatacttagagcacgattcagactccttactctacctgctaggctctgcatgcctgcctgcaacagtatctctggccttctctgagggatctaccctcctactgtattctgtttctactgtgtgcggtcttcccactatatggaatgctctctccccgaggaccccatttctgctcctccttcagaactaagttcaagtgtcttttccttaaagaagccttccctgacccaggctaatgtcagaccacccaatcttacagggcctcatagtaccttgtacttctcttatgtacctcttcctgcaattgtaattaatgaattacgagactagttattagcccccctctacctgtagaacaacatctaaaaaataaaaaagcatattattttttcgagatggagtttcgctcttgtcgcccagtctggagtgcagtggtgtgatctcggctcactgcaacctctgcttgctgggttcaagctattctcctgcctcaacctcccgagtagctggattacaggtgcccaccaccacgccaagctaattttttgtatttttggtagagatggggtttcaccatgttggccaggctgatctcgaactcccgacctcaggtgatccacccacctcggcctcccaaagtgttgggattacaggcgtgagccaccgtgcccggccaaaagcatgcgtgttttagtttactcagtactccacccagtgccagtgtccagtctagttctgggcactggaataaatgctcaaaaaatatttgttgcaaaagaaaaagcagaaaattcacaaattatgtaaatttagttttgaattttgtttaggtccttacatttgatcgtaggttttctaattttgttagagtgtttacaaaagacaagacagtgtatcacatcacctgggagctgttagaaatgcaattctcaggcccctgattcagacgtactaccccagaaactctgggtagggcctggcaatctgtattctaacaaaccctccaggtgatggtgaggcataataaaatttgaaaaccggtgttctataaaaatattgagtgaaggttgtctttgccctagttcaggctgctataacagaataccacagactgggtagcttaaacaacccagaaatttacttttcaaagttctagagcctggtaagtccaagatgaaggctctggcagataggatgtctggtgagggcactcttcccggtttgcagacgctgtcttctggttgaaatcagagagagggatagcaaactctttggccttaaaaaaattttttttatagttaatttttttttttttaatgcttaccggtttattataaagggtactacagaggatacagttgaagagacacatagggtgagatatgggagaagaagctcagagcttccaggcccttcctggggttgccaccctccaggaacctccacgtgtcagctatctggaagcttactgaaccctgaccccttgggtttttatggaagcttcaagacatcagcattccttcccccagggtatagggtgggacccttgcatggaaggctcttaagacctacaataagaaaggagggcaggaaaaggtcagaggcctgccccctgagtcctaacacacccaacattataacaaaatgctgtaacaagggctatggaagttatgagccaggaaccgtggatgaaaaccagtatataccataataccacaggccaccccctggtttttgactatggatttttcacataaaagtatatactatgcacaatcattaataattacttcagcccatcatagtatatgaatgtcttccaagatgaggccactcctgtttgtgggtttcttctcaatcttgtcagcttccaaaagcaggagtggccttggtaaatatatatagctttaccctttcaggcatctgggattattgagcttatagacaatgttatctcttgctctgagactcttgagttggtaacataatatttaattttcctcaatatcccatttattcatttctttaatttcagctagtatttctccttctctccgttggtacactaactttttcaacattggaagagacattagaattgtcactgtgctggtctagatagcaggcagcagtacaagtctggcaagtacctcctcctcagtctactcagacagggtaaggttacaaaggtgtagaactagtgagctatttttaccaccaggcaatatagctgcaatcacagttagccccaattttgctagatggattgaaggcacaatccatcatgaccttaggaattttgacgtaaggtttaaaaacatagtttgttttttgcttagaaatcatccctgctgttctaacacttgtacttgcagccctggtcctagggccattgcatcaggtaggggagaaaaaattaatatttttttcctgaggtgatttgaggaagaaagaacaaactatagtcgttatgttagtgtagtcctcccttggcaggaactacatagtcatatcagtgtgaaccccagatatctgagataggtccagttaatttaggaagtttattttgccaaagttaaggatggtctgtgacagcctcaggaggtcctgatgatatgtgtgcaaggtggtcggggtacagcttggttttacacattttagggagacctgagacatcaatcaatatgtacctcggtttagttgggaaaggcgggacaacttgaagctgggaggggcctttcaggtcataggtagataagagacaaaagattgcattcttttgagtttctgattatcctttccaaaggaagtaatcagatacacattcatctcagtgagcagagggatgactttgaatagaatgggaggcaggtttgccctaagcagtccccagtttgacttttccctttagcttagtgattttggggttccaagatttaatttctttcatactggcatcttccccaccccctcttccccagataaaccagaaaaacagaggaaaaaaaaatctatcagggacactctagtcccattcatgttgaggtgtgagcacacactcatgaaggtgtgtaagccagcccttcatgcttttatctccccgttttagacaaccaaggtttcagttgcccattctacttctctgtcaaactgttacactaaggatatcttgctactcattgttggactttgtgggctgtacagtgtgttccttggtctgaaaaaatgatggccagccatccaaatctatacaatatcttctatatttttttatggtactctgagcattttcatcttccattagataagcaaagcccactccagagtcagtgtttattcctgtcaggtcccatttttagcctccccacggggctaccagcattagtctcagttgccagctatgttcagggccttcccaccagagaatctgccccgcagccatcagcaatctctgtctcttttgctgagaaacagaacagttctttctggcattttgtgcctgagagggtgcaaaaggaacatgtctagattcagcccatcactgtagtgctacaatacccccatatccactcatttcatgggcccaggtggccacttcaagggagcacacagggatatctacttgtcgattccagtcaacttccaaacctggaagggagttctgatgggcactgacttactctcctttaatgccccctcacgtctccacagggccatgcttcatttgggcattcttttgatagtccaggtgtccatggccctcttgtctgagtgtatggctaggccattggtcactgcccatgagtcagtaaaaacccaaacccaggggtttgcaccattgttcaattctttcatcactgttagaaaaactgcatgtaattcagcccactgagtggatctgtttttaccttctttgatctaagtagcagccttccaaacaggatggtgtccattcactttggaactgtctggcttcttttaagggcactaactcctccaggcttcactgccatgatctaatcacctctcaaaggccctaccttctaataccatattgaaggttaggatttcaatattaagaacttggggttggagggggaacccaaacattcataacacttggtaagtaaaatataaagtccagtttacacctccttacctatttacaaaattaagtgcattgtttcttaccaacactgggtaatgaacttctttttgccccctccccattttatcagttgatgtcttcagatgttacccggaatgtaaacaagctctgcttgaccaactgaactgtaaacaagtctactcaaacctgaactttaaaaaataagggttctccaacttctgcctcctgaattcctgacttttatatactgccatataagtccaggattctatagtaactgttggagggttttaatttttttcaaaaatgtttattgtaaaaggacaaaacttttttttccctctaaagcttagatggtagtttctgattttgtatctaaagctttgtgaagcattagcaattttttttttttttttttttttttgagacggagtctcgctctgttgccaggctggagtgcagtggcaagatcatggctcactgtaacctccacctcccgggatcaggtgattctcctgcctcagcctcccaagtagctgggactacaggcgcatgccaccacaccccgctaatttttgtattttttgtagagacggggtttcatcatgttggccaggatggtctcgatctctcgacttcgtgatccacctgccttggcctcccaaagtgctgggattacaggcatgagccaccgcgcccggccagcattagcaatttttgaatgtgcatatccttggctgttcaggctccaggattgtgctacacaatcaagttgttattgctgatggattgaccacattgttaaaataggtcgctcatccccgattttgccgctggctcttaattcacttcatgtttgactcaaagacactattttgacaaaactacttccatctgatgactattagatgagccataggaaattaattgcaggtttctttcttgtacaacaggtgtccagggctcattgattctctttctgatatgtggttagaagcagagtttggggattctttcttgagataaccaagaaatctttttaaatgtttaaaaaaaatttttattttagaatcattttaaatttacagaaaagttataaagatcgtgtagtttccatatatcctgcacccattttccctattgttaacatcttgcagtagtaatgggtaatttgtcacgattcatgaatcaacattgatacattattttaaactaaagtttatactttatttagattttctcggtttttctttaatgtcattttcctgttctggggtcccttccaaaatgccacattacatttttttttttttttgagacgcagtcttgctctgtcacccaggctggagtgcagtgatgcgatctcagctcactgcaacctctgcctctcaggtgcaagcaattctcctgcctcagcctcccgagtagctgggggttcccgccaccacgcctggctaatttttttgtatttttagtagagatggggtttcaccatgttggctaggctggttttgaactcctgatctcaagtgatccccctgcctcggcctcccaaagtgctgggattataagcttgagccattgcatccggccccacattacatttagtcatcatgtctcctcaggctcttcttggctatgacagtttctcagactttccttcattttggtgatgttgacaattttgagggatactggtcaggtattttgtagaatgtccctcaactgggatttgtctgatgttttcctcgtgattagactggtgttactgagttttggaagacgagagatgaagtgccatttcatatcatatcaaaggtaaatgttaacagcatgacttaccactgttggtgttgctataactcagctatctaaagtagtgattgccaggttcctccactgttaagttactgtttttcctctttccatactgtactctatggaaacaagtcactaagagtagcagaagagattgttatttaagtaggagattctaaagaatatcatttcttgctgagtgagaccttctccattgtttttcagtatttccttttaagttttactttattaggagacaggtgtatgcagttgacatgtttcaaatattgatttaaattgtgaagggatttgacattaaaatgaatattttagtgaatattctggagcacttagttggaacctaacgtatttgtgtaaatgctcctgtgtccacctgttgcccacatctactcatccccacgtctactcatcccccagcctccaagccttctctgtttgcctgtagctcctggaatctgattgcctcatagctaaaacctttatgaaaacatttgggtagagtagcccaggatttctttgcttggtaagaactcacttgctaaaatggtttttattaaaatatgtttgtgcttcactactgtgcttcttttgctagaatagatgcagccctaaagatttgcttgtcttcctaattcctttcttaatacctcatagtagtgactgagctattgatctgaagggataataacagccctacacgtgctttttgcaggttctgatatcttaagaactaaccgagagctttgaaaaagaacattgccttagtgacataaattcaagcctgcttcaaaccaaataatatacagcatgtgtcataaagaaggttcattcctagaaatcatcatattcaaaaggagcaaaggatgaggaagaaggaattacagcaagtgatagtacttgctcaaagactgttaaccagggtcagtgccatgggaacattgtctccagcagccccactcactctctacccaccccactcctaattcatatccctggctgctgctgctttttttttttttttgacacagggttttgctctgttgcccaggctggagtgcagtggcatgatcatagctcactgcagccttgacttccccgttcaagagatcctcccacctcagcctcctgagtagctgggactacagtcacgtgccaccacgcctggctaaatgtccctggcttctaacatgcacttaaagcacttctcagaaagactgtcccagtagaaaaggtgcacagaaagtaaacaattcactttttcttttttcttttttttttttttgagacagagtcttactctgttgcccaggctggaatgcagtggcgccatctcagctcactgcaacctcctcctcccaggttcaagtaattctcatgcctcagcttcctgagtagctgggattataggtgtgtgccaccatacccagctaatttttgtaatttgagtagagacagggttttgtcatgttttgaactcctggcctcaagctgtccgcccgcctcggcttcccaaagtgctgggattacaggtgtgagcctctgcgctcggcccaattcacttttcactgaagttgacctttagtatattgttagtagttttggattctagtttgagttatcactagaaaaaatagtgaacaatattttattattttttattgatacataatagatgtacatattttgggatacctgtatatgccccatacccagtttcccttattattttgagacagggtctcactctctctcaggctggagtgcagtggcccaatctcggcttactgctaccttggcctcccgtttcaagtagttctcccacctcagcctcccgagtagctgggaccacaggcatgcaccaccatgcccagctaatttttgtattttaggagagacgtgatgtcaccattttgcccaggctggtcttgaactcctgagctcaagccatctgcccacctcggccttccaaagtgctgggatttcaggcgtgagccaccacacctggttcagtttcccttattattaacatcttacattagaatggtacatttgccataattaataagccaatattaatatattattattattgggaggctgactgggccttgaggtcaggagttcgagaatagcctggccaacatggtgaaaccccgtctctactaaaattacaaaaaaattagccgggtgtggtggcatgcttgggactacccaggaggctgagacttgaaaatcgctgaacccaagaggctggggttgcagtgagccgagattgtgccactgcactccagcctgggcagagagagagagagagagagagagagagagagagactctttctcaagaaagggaaaaaaagtgtgtgtgtgtgtgtgtgtgtgtgtgtgtgtgtgtgtgtgtgtgtgtataaaattaactgaagttcatacttcattcagatttccttagtatttctcaaatgtccttttgctttttcaggatcccatctaggtcaccacatcatatttagtcatcatatttatttggactcttcttggctgtgacagtttctcagactttccttgtttttggtgactgacagtttagaggaatactggtcaggtgttttgtagaatgtccttcaattgggatttgtctgatgtttttctcatgattagatgtgagttgtggattttggggaggaagaccagggaggtgaagggccattctcatcatatatccacggtacatagtgtcaacaggcttatcattgatgatgttaacttggtcacctttctgaagtagtgtttcttaggtttacacactgtacagttatctttttaaaaatgatttgtattgatttttccgtctctgattctggagaggagtatggttcattttatttattcattcagcagaatgaaatatacagtagattattgttaactatagtcactctactgatctatccaacactaggtcttatttcttctaagtgtatgtttgtacccattaatcaacctataatcccagcactttgggaagctgaggcgggcggacagcttgaggccaggagttcaaacatggcaaaatcttgtctctactaaatgtttccagcaaaaaaaagagataagtgtttaaggtgacctttagtatattattagtagttttggattctagtttgatttatcactagaaaaaatacatctcactgtgtttagatgcgtctactataaaagccaaatagacaaaaattaactgggtatggtggtgcatgcctataataaggtgatggatatcccaattactctgatttgatcattacacatgaatgtatgaaaatatctcactatgtttagacacatctactataaaaggcaaatagacaaaaataagctattctaggccaggcgcaatggctcacacctgtaatcccagcactttgggaggctggggcaggtgcatcacttgaggtcaggagttcaagaccagcctggccaacatggcaaaaccctgtctctacaaaaaatacaaaattagctgggtgtggtggtgcgcacctgtaatcccagctactcaggaggctaagacaggagaatcgcttgaacccaaaaggtggagactacagtgactgagatcgtgccactgcactccagactgagtgacagagcaagactctgtctcaaaaaaataaaaaaaaaacttattctaaaagtagggattttttgctggacaaatttattaatctaagttctgcctaatgaggtctaggggaactccctgaatttgagcgaaatgccaaaaaagtaagctaaaggatatttaggtttacattattttcctcactgtcactttccagtatctcttatatccgtttaccacgtggaagaatctagtactcacttttaaaattttttgagatggagttttgccctttttgtccaggctggagtacaatggcatgatctcggctcactgcaacctctgcctcctgggttcaagtgattatcctgccttagcctcctgagtagctgggattacaggtgtgctccaccatacccagctaattttgtatttttagtagagacggggtcttgctatgttggccaggctggtctcgaagaatgtgattttatttatgatttaccagttattagactttctcacctcttcagtaattttagttttttattatttttattgatacattaatagatgtacatattttgggatacctgtaatattttgatacattcataaaatgtgtaatgatcaaatcagtaattgggatatccatcacgttaaacatttatctctttttttttgctggaaacatttggaatcttcttttctaggtattttgaaatatacagtagattattgttaactatagtcactctactgatgtatcaaacactaggtcttattcttctaagtgtatatttgtacccattaatcaacctctcttcatcttcccttcccccaaactcttcctctgataactaccagtctactctctatcttcatgagatccatttttgtagctctcacatatgaatgagaacatgtggtatttgtcttcttcacttatttcgtattcgtaagtagtgaaaagtgtgtccttaagtgagaccttttctgtcttcccagctttaatataaatacaaaagattgtgtgatactagggataaagcaacctccttattttcattccttcaaatgctagtcaaggtaacagatgaagatcagaaagtactaggaaaagaagtcaccatcacatcttgtgttgaaatttgttagggagtttcagtatcaaggaatgagtatgtcatgcagcagatgagcctctaggatgaatttgattaattcttcccagcagcaaaatctcataatcaaataatgttgcttgaggccttcttttgctttggagttagagaatctaaattgtgtaagctctagtggatttccattctgtcgtatcaagtatcgatggtctgtgtgaatggaaagagcagattttctgttgggctatatatatgagctcattggaaagagttaagaattattaaaaaaaaaaagaattataagtaaatacattttactggatttaacttcctaatgacaggcatctctaccagatttgatgatactgcaaacatggaaggaacataggcatctgggtttctttgctggctatgccactagtttgttgtgcaatttttttttttttttgtagtttgttatgtaactttctcaatggtcctcagattttcatctgtacagtgagagtaaaaaggccagagcattgcttaaaccccttaagaccatctaaatctgtggttcagaatgggaaataagagtagcaatactgactgtcttcccagttacctgttatgctcatgataaggtacattagataaaaatgtaagaggaatctgattttcccacaaaacgtttcatatatagttggggacatgatcttaacctggtgtcaaattcttttttctagatatgactacaaatatgagaatgaataaattatatgaaatgtgaacatgaatagatttctaggtaatacctatgggccatagagctttttaagatatgcatttttgaccaggcctggtggcttatgcctgtaatcccagcactttgggaggctgaggcaggcggattacttgaggtcaggagttcgagaccagcctggccaacatggtgaaaccccatctctagtaaaaaacaaacaaccaaacaaaaaaacccaaaaattagccaggcttggtggcacgcttctgtagtcccagctgctcgagaggctgaggcacgaaaatcgcttgagcctgggaggcagaggttgcagtgagccgagattgccccacttgcactccagcctgggcgacaaacattcctaaaagtagttgtgagtggagtaaatgtacagagacaagatctctgtatactggattccatattcctcttctcctttctttctgtgtgacaggctctcattctctttcactggtatttttgagcacctcttttgaacttagaggcgtgcctcatactctctgatgttggggggactgtgtgagcctgttggcttctctgtctacgtggctttccaatggacagagctggggcaggtcagccctgaatgaggctttgagtcttagcctgtcttgagttagagagaattttgggaacctcagactgctagctcagcagttcagcatgtttgctagtatcattctgactttgtgtggtcatgtttttgtaagattgctgttgtctggctcgttgtgattaagactagcccttgtatttctgggccagaaactggtccttactctgtttatcccctgtgaagtccttttatgggtacaatggttggcaccccaattcatccaaaggtaggaacatgttttctttttagctaagcttctggggaacttaagctctgcctagacccatacctgtggttgggtctttgctgcccaatcctgatgttatagatgctcacccactaattgcctttttaccagatttccctgatgttatattctgtctgcttttaccttgctgagtatcctcatgctcactgctcacctgcctggacctttggttgttgctgcactgtcttttctagtaatgtgctcttgtcacttggatttccttctaggccttgcttctgggtccacctccaagcacctgacattctgtactttttgatctgccatgctgcctgccttcagtagcttaattatgaaaatcagtagttttctttctctggaacctttattttaaaaatctattactaggccgggtgcagtagctcgcgcccgtaatcccagcactttgggaggccgacacaggcagatcacatgaggtcaggaattggagaccagcctggccaataaggtgaaatcccatctctactaaaaataggaaaattagccaagcgtggtggtgtgcacctgtaatctcagagacttgagaggctgaggcatgagaattgcttgaacctgggaggtggaggttgcagtgtgttgagactacaccactgcactccagcctgggcaacagagtgagaccctgtcttaaaaaaaattaattaggggcaagggagaactagaatcatgaaatctttgtattgaaaaagactctcagaagcttatacttcaactttccatcagatggatagcttggtaactcccaagataacccatcaatcgcattttgcagtacctctctattggtttcttgtgccaaaaccatcaatgcattcatttatttattcactcattccttagtgtctgcacagttactaaacatctacctttagctaggcaatggggagatgagtatgtgtgcatgcatgtgtgtgtgagtgagagagagcattccagtttctaggaagctgctagtccagttggggtagagaataaacaatcatgatggctagctagagatatacattgggcgggagaatgagtcattttctctgcatgactgaagggtggttcatggagggctttctgccattccagttaacaccaactttctctttttaatttaacttttattttaagttcggggtacatgtgtaggtttgttatatagttaaacttatgggggcttgctgtacagattattttgtcactcaggtattaaactagtacccattagttaacaccaactttctagtccaccaccagcttttcagctaaaatacaggaaactcctcatcttccttcttttttttttttttttttttttggccaatctctgacttgcttttggaatcatctttctttatgcaaatcttgatttgttcttcccctgttcataggctgcccattgtttaccccacaccccacaaggatatctaacttcttggcataactcatgaagccttcgacctttctgattcatgcctacttctccagttttattacatgctattttctatcaggttcttagtaccctagaacttaatgaagtttgctggctacactgtgcttacttgtacttctgttgcatgtgctgttcccactgcctggagtggttgccatttttgctttcctggtgaactctggggcactgagaacttgatagaaaatggtatatggggaaaaatcacaagtctgattttcctcttctgttatggcgtactccagcctgttggatgctgttgcactttatacaccccccactcctgcccaccacaagattgtaaactacttcagtccaggttatctttatgtcttcagtttaacacagagcctggcccagagtgggcagtccataaataattgttggatgaatagatgaaggaatgagtgaataaatacaagtttctatagtctgtttttcagtttacttcttccttggggctctgataatggtacttaaatggatcctatcactgttttgtttcatttagagatggggtctgacactgtcacccaggctgaagtacagtggcattttcatagctcactgaagctttgaacttttaggctcaagcgatccttccacctcagcctcccaagtagctggaaccacaggcatgttccaccatgcctggctttttaaaaaaattttttgtagagatgaggtcttgttttgttacctaggctggtctcaaactcctggcttcaaggaatcctcctgcctcggcctcccaaagtgttgggattacaggtgtgaaccaccacacaaaaccacactgttttgaccatagctccttgcaaagccagaaccatgcacactggcttatccactactggataagctacctgcctgccaaaacagagagaaaagccctttaggggttttagaaaactcttgatcttctcccaccctgttgtctctgctgccaagataagcttctactatgtcttttcagaactctgatcaagaggtagaaattgcatagaataaaaatacttcaccccttctcttctaaatcagagtggttgtgaagtgaggagaattagtacttgaataaaattcctgtctccttaggcagttctttgaatgagtcatctacaaactcaagcaatttgtaaggacaattatggccatttattctgttgtcagcctgttttgaataaataccaaatggagtattttggttcttaattatgcctttctcaccttcttaccagagcccgtttttacacaattatatcaattaacagtgagagacacatacacaactttcatgaacttaatctgccctgcatatcttcctgtgctttaatcatgatcttaaatttataatcagaaatcagccttttcagttcaaatcagttgtagatctctgcctaaaatagttggctctttcgaggttgttacttttgtaacacaacttttttcttgagaattattgaggtataatttacatacagtaaaatttgccctttttaggtatgtaaaaatcgatgaattttgacaaaattatataaattgtaatcaccactgaaatcaaaataatcaaattttctgtcacctaaaaagttccctcatgctcctttgtagtcagtcccctccctaaactgccaacccctggcaaccgctaatctgatttctgtcccttacagtttcgtcatttctagaattccatataaatgggatcaaaatgtatagcctttgagtctggcttgttttacttggcataatgcttttgggagtcatctatgtccttgcatttatccagtttgctgcctttcattgctgagtagaattccattaaagagataacactataatttgtgtatccattcaccagtagctgatggacatttggactgttttcactttttggtggttatgaataaaggtgctgtaaatatttgtgttcaggccaggcatggtggctcacacctgtaatcctagcactttgggaggccaaggtgagcgagttacttgaggtcaggaattcgagaccagcctggccaaaatggtgaaaccccatctctactaaaaatataaaaattatctgtgtgtggcggtgtgtgcctatagtcccagctactcggaggcggaggcatgagaattgcttgaacccgagaggcggaggttgcagtgtgctgagattgtgccactgcactccagcctgggcaacagagtaagaccctgtctccaaaaaaaaaaaaactgtgttcaggtttctgtgtagatgtatatcctgttttcagtaaatatataaaagcatcatagactgaaatgtactgggtacattttcatactgggtagtatgaaaactatgtatttaactttatatcttaagctgcccaactatttttcaaagtgactataccatttttgtttcctaacagcaacatataaggttgcatttgctccatatcctcaccaatattgttattgtctgtcctttaaaactttagccattctggtaggtgaatagtaatatctcactgtaattttattctgcatttttcctaatgactaatgattttgaacaagtgtcttaacatttttttgatttggcagggttttgaaaaattatacagctttgggctgggcgcagtggctcacacctgtaatctcagcactttggggccaaggtgggcagattacttgaggtcaggagttcgagagcagcctggccaacatggtgaaaccccgtctctacaaaaatacaaaaattagctgggcgttgtggcgggcgcctgtaatcccagctactcgggaggctgaggcaggagaatcacctgaacccgggaggcagaggttgcaatgagctgagatcgcactgttgcactccagcctgggtgacagagtgagactgtatcaaaaaaaaaaaaaaattatacagctttacagctttgagtgttctttatatattctggctactggtcctttatcagatatgtgttttgcaaatgtttttcccagtctatggcttgtctttttactttttaaatagtgtgtttcaaagagcagtagttttgtgtgtgtgttttttttttttttttgagacggagtcttgctctatcgcccaggctggagtgcagtggtgcgatctcggctcactgaaacctccgcctcctgggttcaagcaattctcctacctcagccttctgagtagctgggactataggtgcatgctaccatgcctagctaattttttgtattttagtagagatggggttttaccttgttgcccaggctggttgcaaactcctgagctcaggcaaatccgcccaccttggcctcccaaagtgctgggattacaggtgtgagccaccacccccagcccaagagcagtagttttaagttttgattgaagttccatttttcagtcttgtgttgtctgtttttttcagacagggccttgttctgtcacccaggctggagagcactggttcaatcatggctcactgctggcctcctgaactcaagcaatcctcctacctcagcctcccgagtagctggtactataggtgtgcaccaccatgcccagctaatttttgtggttttttttgtagaaacagggttttattatgttgccctggctggtctcaaactcctgaagagatcctcccaccttggcctcccagagggctgagattacaaacgtgagccactgtgcctggcctcaatattttcttttatggttaatggtttttctgtcctatctaagaaacagttgcccaactcaggatcatgaatatttgcttctattttttctagaaattttatagctttagggtttacatttcagtctatgatgaatttccggttgacttttatgtatagtgcaagatacaggttgagattcattttttgaatatagatatatctaattgttccagcatcatttgttgataagacgaaaaaaactatactttgtctattgaattagcttggcatccttgtcaaaaattaattgaccatatatgtgtggatcagtttctggaatttttattttgtttcattgatctatgttacccttttgcctacgctgtctagaatattatagctttattgtaagtcttgaaatcaattggtatgagtactccaagtttctttttttttttacaaaattgtttaggttatcctaaattattttttccatataattttggagttaccttataaatttttgaaaaagaaacgggattttatttgctgtgaattaaaatctatagataatttggaggagaattgcaatactgatgatattgagtcttctgatccatgaacacagtgtatctctgcaaggaagtctttgatttctctcatcagtgtttttgatacttttcaacgtacaaatcttataatactttgttagattgatccctcagtatcacatgtttcttggtgctgtagtaactggtgctttttttttttttttttttgagatggagtcttgctctgttgccaggctggaaaatctcagctcactgcaacctccacttcccgggttcaagcaatcaagcaattcttctgcctcagcctcccgagtaactgggactacaggtgtgctccaccacgcccagcgaatttttgtatttttagtatagacggggtttcaccatgttggcgaggatggcctcaatctcttgacctcgtgatctgcccaccttggactcccaaagtgctaggattacaggcataagccaccgcgcctggccacaactggtgcttttaaaaatttcattttcctgttcttcactattgtgtataaaaatacagttgattttttttatagcaaggcaaggaaaaaaaacaatttctatatattgatcttatgttcttaaactttgccagtcactaattatatctagtagtctcttatagattcttttatattttctggatagataattacattttctgtgaataaaggcagtattatttttcctctcccatctataagtatctgtattttttttctgtaccttattgcattagctaggagttctatcttatatgatgttgagtaggagtgttaagagtggattccctgccttcttcctgatcttagggggaaatcattttgtgttttattattaagtatgagttagctgtaagtttttcatagatgctctttatcttttttttttcttcatagatgctctttaccaggttgaggaagtttcttttgatttctagttagctgagttgttgttgctgttgttttttaagtaatgaagggctgctgaatgaatcttgcactttttctgtacctatagaattagtcatacagatttttccttgtttttgactgctgacactgtgaatggcattgtgtttgacgtatgaatgccgaactattcttgcattactagtctaaattccacatggcaataatagcttattctcttgtattttatggataaaaatcatggataaaagaaatgaagtaggtagcaattccttaaccatatgtgtgttttataagtcatagaaatttttccatcctaagggaagtgctaactcccttgcttagcatacaatacaggtagcatgtttttggttcctcttcgtttggtcttttaggctatcaaaagtgagtggggggaaatgtaacaaaaatagtatgtactaggcagtgtgtatgtttatcttatttaatctcacttgatggaaagtgaggtccatcaaacaatttgtaccaccaagtcttggagctagtaaatggcagggtggtgggggggcggtcagaatttaaatgcaggtgttttggataaaaccgttattagctcactgtatggtatcgcctctctttggaagtgagtgggtatgtgtgtgcatgtgtttgtgtttgtgtgagagagacagaggaagggagggaaggacaggaattgggagagtgaggtagaaattgagatttggaaggagagaaaagccctcccacctttcattgccatctaaaatctgggcttttagatatcgtgatttgtatctcagctttgccatttacttgatttgtggcacatttgtctctctgagcctcatgttttaaaaatttgaaatgtagaacatttacattgagttttgaggaatacagataatatatgtaaaatgtctcacatagaatgtgctcaatttagtggtgtccattactatcatcattattgatttcctaccattaaatgtattttgtaaatgaaaataatctggttttagaagatggcaaaggagacttagaatgatttctatagttgtttgtttagttcttttgacaaaattgcctaaagttcttttataaaaatggaattcattttgtctacttttcactccttctcaagtcaaaataacacaaggtatttactaaatcagtttgcaaatttggaaaattttaaaaagtactgctgagctgggtgcagtgactcacgcttgtaatcccagcactttgagaggcccaggagggaggattgcctgaggccaggagttcaagaccagcctgggcaacatagcaagacctcatcaaaataaaaaataaagtattcctgaatgctctggacttgcctactggtttggaagtggttatctcagtgtggaggattggagatgccgtttttattttacatggacaacagaccattgctagctaactttagtcccttagcccatgtagatctgacagtttatgacgtgagactgtcttctctaagtgacacaaaccatttcaggttgtttcagtaaggttattttgggtcttacaagcagggcccaagagcttctgtgtgtttcattagtcaagtcagggagatgagaatgagtctgagaaagggcatcagactatcagtgccttggactttgggagggctgttggctccaactctaccaatcaatagccttctgggaattggttcatatgattatttgatttcatagaagtactcttccagccaaaagtgctgcttgacacatgaaaattgtatcttgacaatttttggataataccacaccatcccttgatattgttgaaaatcagaattggtaatcagtatgctttccttctagccatgaagtctttaagtaaatatgttaaacttagagttttattgtagactttgtggttaattatgacctttcttagcaagctgatgtcacaatgtaataagtaagttatgtttctcatatttattcagaagtccaggatgtctttgtgttagggtgatatttaggttttgatatcttcgatttgtctattttccccaattgtatattcagtctgtaaaatttattttactcttttccaattacagtggccacatcttcttatttaattttcaccttactttgtacatcattttagggtaggtcttattgccaccttatgatgaaaaaaataaggctacattttcccaaagatcatcattggacagtgagtccatattcagaagccaattctgatttttgtttatgttctttggattagacctctgggccttgagcttgatctggctctctaaatttcattgatttggttaacattcaaaaactaaatatctaatgactacctttgtcccacagttaggatcaacaaatgtgattagatgcctgtcttcaaaggagttcatgaaataaccagtcggcaagaggcaaagtttgggaatagtttcttctacccttcatacacataaccatctctttctagattgatggagagggttccagtgtccaagcaggaatgaccaggcttcatgaaacttttgagtggctttaactaaaatgttgggccatgaggtgaggcccaaccttgtagatttagtggggcctcttgaggagctacttcgtgttaaacactattctaagattaaagcaaaacaagcaaaaaatatgatttcatccttcaggacctcacaagctagcagacaagatggaagcatacatagaggtgcttccaatttctgctttgccctgtccacccttcgttctgctagcagaacagttttttgaaaaacatgccctttccttgcttaaaactttctggtggctccctgtttctcataggaccaagttgaagtttcttatcaggacatacaaggcctccactgatttggcccagcttcttctacacttccacagcttgcttcaggcacataccactccttggggtgcttagaacccatcatgatttttcatacctctgggtatttatttatgctgagctctctgtatagaatgctgtattaatctgggtcctctgaaaaacagacacacaggattaaattggcaagggtttattaggggaaaatgcatgtggaacagacaatggtgagggggctgagaaggctgggagtgccattagtccttcatgcaagtctgagccctagtgaaggggggataggggagagctggttaggcagaaggtttccagacggcagtgcagtctaaagaagattcagaaaagctattggggagtgcaaagtcagctgttagtggagtcctgcaacttccagcaacagtctgctttggtatccctgctgtactcagtgattggttgggagcacccctttggaggtgtgacttagtacagacactaggatgagtttctgaggcagatggggtccttaatcagttgtgctccttgtagttggagacccttgagttgcctcttggcctcttcttggctaccataaattccttttctctttcgttaaattcctcctgcttgtccttaaagggccagctgtaaatgttttttcttccaaaaaacttttcattgaaggaaaatctcagaatgtccatcgtgatcccacgtcctgccatgatcataccataatctttgcttggcaaatttttaatacatttatttgatttgtacccctaccacctattacaggaccaaaaatctgttaggtactcaggaagtgttcgtttgaatgaatgcattggtagggcttggacaggcagatctggggagaaggtagttgaggcagagggaactgcttaagcaaagccatagagggagaagaataaaggatttacactgtagttaataaatgtcttttttccccaaataagtatatcttcccccaaagctgtcattttagagaaagcctattatgatgcaaaacagtgggggaaaggagtgtcttcctggcagttgaaaatgattcatatttgagaactttgttgaacaatgttttgagtatttcctgagagacttctttcttgagaggaaacagttgatggaaatggaattttactgctgccaggaaaagtgcgataaagataaaatctcatgcaacaactactaccagaatagaaatttccatagagcaaagagatttcaaagtctcagctaatggctcatatgtatttagtattcagtgcagctgaactgtaattctgtaatggaatttgaccaattttgagaagccagtttgtaatgtatgaattagtggagacccatacatcttgacgtttgctgactctgccagatgttggttatatttctgatggaaagaaacagagagctggctgggatcccaaatcttagaattgctaccggccgcctaccactgccacatgttgcagtggtaggagataaacatgctgaggataagacctgaaaaaaaatcactctatatcagcaactggagatacagcccatactccttatgaaatattctactctcgtggcctgggttgaaccatgtatgaggcaggcactccttttagcccaggcccaagtctgctctatgcagtcttcctcatatcttgtttccctagagttaccacttgaaggcattccttattcgtaatgtggtgatgattaatggcacctacctcatgggcttgctgtgaggtttcaatcagataatggatgctgaaggcttagactgtgcctggcatagagtaagtgctcaataaatggtagctagagttcttttattatgcaatagaagcaggactctgagggtaacatcttaatatttccagttgaatgttatcaaagtcagttgttcatgcatttgttaaattatgggccatagcaacccaactctatggacctgggctgctgtgtcccagactgtaattaacacacagttgcttatatctgtcttttcttccaagtgaggacagtttgttatgacttgtagattaagcaaaattacttgcttctccattgtgtgctaacctggtgtagaataccttttcttgtctgtcttatttaccatctctcttactttcaaatttctattataattctcctttagattacatatagctaacttaagaaagtcccagatgtgaaaataaggcgagtgcatgatgtatcccccttcccttgatttttgctgatcaggtggggaatctgacccaatagctcttcttctgtatcctttcttccctttcagtggagtagttcacatgggatattatctcctttacttgtcttttactactaaaacatttcttttaaccatcttcctcctttgttttccaagttttgcctgattacatcaagaactacctcctcctcctcctcctcctcattctatcccatttgaaagccaaacacatgaattgaattgtaaatggtaggaaatagagtattactattgagagatgtgtaccaaggcaaaggaaagccatacattaaaatgagcaaggggaaagtagtatttgaattcccaaagacatctcatactcactatgtccaaatctgaaatcactctctatcttctttaagccttctcctgctaaagtcctctggaactttgtggcagcctactctcaagatgtttcaccagtgggtttatttcattcttcttactcctactattcttgctctgggcctggccctcatcatctttcatcttgaggtaataacttctttcctcatctttttgtaccctctctgccctggatggcctatatagtggcaaaagaaggtgttttttttttctttcctttttagcttttttattgtaaaatgagacaagaatttaaaaaatcaaacaaatgtgtagcttaatacaatattacaaggcacacatacttgaaatcaccatccagatcaagcaatagagctttgtcagccaccccagaagtccttccaggtgccctctcccagtcaaaaaccttctctccttctgaaataaccattatcctgacttttaaagtagttatttccttgcatttctttatctatagacagtgctatttggaaacaccagtcttgctgcatccagttgcctctatgccaaagtctagaggtgcgcaaattccctaatgggtattcttttttgaaaaattattttaaaatatttaattgacaaagattgtataaattgaaagtgtgcagtgcaatgtgatgatttgatatacatatatattgtgtaatgattatcacggtcaaattaattaactcatctaataccacccatggtgtacattagagccccagaacttgttcatcttctatctgaaaatttgtgccatttgattattttcctatctcacccccttatctctggaaaccactctttgtttctgggattcagcttttctaggattccacatataagtgagaccatatagtatttgcctttctgtgtctggtttatttcacttagcataactgtcctctaggttcattcattttgttacaaatggcatgattttttttttgtttttttaatggtgaataatattccattgtgtaatatataccacattttctttatccatttatctgttgatggatacttaggttgtgaccatatcttggctattgtgaataatcctacaatgaacatgggggtacagatatcccttcaagatactgattttatttcctttctctccggccctcacaggttttctcaggcctacatttatagtctcctgttttgttttgttttgtttttgacatgaggtcttgctctgttaccaggctgaagtacagtggtactatcgtggctcactgtagcctcaaactccccaggctgagcctcctcccagctcagcctcctgagtagctgggactacaagtgtacgctaccatgcctggttactttttgtatttttttgtaggacagagtcttgatatgttgcccaggcttagtctcctttctatgattccccctcccctccccctagtctctgtccgtaccacgctatttataggctgctagatacctcaggtacctcttggtgtttgccagatgcctctaggtattggctcctgttgttccctttctgaagctgccgctcttccattcactggtgaaatcctagacccaactcaaatgtcatttcttctgtggtatgctgccctggatcttccttctctgacgtacctggggtagaacgaattcttcccgtccctgtgttctgtgtccattatagcattttacacttgcttctattgttagcatttttcagtctttggtacctaacagattttttgtaggtgctcaataaatgttctttgaatgaatgaatctatgtaatccatagttaaaggtctttcagggtgtcagattttcttcagaatcaacaaaaatatcttgttttgattttcacacaaagttaaaaacatattaattttattttctgtccgtaactattattgccaatatttggctttactaactttgtgtgataaatatttgctattttggccacattattggtaaaatagacctttgtgggcttttctggctacctgcacaccatttttattatttcaagggtaacaataattattgagtacaacagtgtgccagacattgtgctaagctttgtctgtgcattatttgctgactcatcaccctaatcctttattattttcattttacgtgtcagaaagtaaaacttagagaagttaaatgagttaaagttataacgctaagaaagggtagattcagggtgcaaatctaggcagtctgactataaatgtaaaacccattttttttagccattatttttttgtttgttttttcctctttgagacagagtctcacttgctctttgtccaggctagagtgcagtggcatgatctcggctcactgcaacctccctcttccggtttcaagcgattctcctgcctcagccttccaagtagctgggattacaggcacgtgccaccacgcccacctaatttttgtagtttttggtagagacggggtttcatcacttttgcctggctggtctcgaactcctggccccaagcgatccacccttcttggcctcccaaagtgttgtgtttacaggcatgagtcactgggcttggccgttttttaccattctgtgttatttcttattaagaaagataatagttctcagtagccaacagtggacttttgcaaagcatctgtggagcacagctcatttgtggaagtttgctacccactgccgcactgggacgcaagtcaattctttaacattttcattcccccttccctaaattgcttctgtgcaaggccctgtccagctctactgatactaggtgtgtatatcttgtggtgaatgggtggcagcttggttaatgactcttggtgagccggaaataacaaggttgctcttatattgacatgtctcttcttagccgcatatattatttagcttacggctactgtcttaagggttatcatcactataaatgatgtgttttgtgcctggcaaggtcataagttgtgtcttctaaaatgatattggtcataaatgttaattgctacttcttaacttccctttgaggtgttacaaggaaatccacgtatgaacaactgaggaagcaattaagcagaagaacagcagcacaggaaaatccaatagttggtactgcacataggcccctgggcttacagaaactcagaccaggggccccagaggaattgcctttgaaatagcagcagtggaggctcagccatttggggaatcattgatggtcattggtagatggcacagacgaatgaagtctagtctcacatgagtgtttgtcctgtttccctcattagcatgtcacttttccaggtcagaaattgtagtctctctttggttgagccctgtgccccttaatactgcccagtcctgcatatggcatagatatggcattgttcacctgcaggcatttcttgtctattttaaataaccctcttactgcattttggttttttaagtcagttttccatttaagcaaattgccaaggtttatctagaatttttggttgtgtaaaacttagctgcagcagctaacattttctgttcctctagcaaatgccaggtgctgtttaaaacactttctacatcgttacctcctggagtcctctcaaatcctttgaggtaggtactgttattctccctgctttctagctcaggattaaaattggcatcacttgcagcttagaagatttcttgttataaataaagaaatgtgttagggagatgtggtgatgcccacctgtggtcctagctacttgggaggctgaggcaggagaaacccttaggctcaggcgttcaaagctacagtatgtgatgatcttgcctgtgaacaggcactgcacttgtgcctgggcaacatagttgagatcgcatctcaaaaaaaattgttgtattgggatttcagccgcactttctgcctaaggtactgccttgtttggaaagggtacttgacaaacatctgtgtggctgggagggtgcttctagagatagtgatttttctctaggatcagttatataataattttgggaaaaaacacaccatttttgttttgttcttgttagagaagtggctgtagcattttctttcaatggacactttatcaacagcttttctaggaagttttattttattgtttttgtgggggtgagcttcaagactatatttgctgttgtttcttttcccagactaccctacttcctactgtagtgtaagtactgtagaaggatttagtaactgaaggtcagcagtttggctcttttgttaattcctgatgctgcagatgaagtaatgtgttttcttgtcagataaaatgtataaggctgctactcagcttgacaggaagaatgagctagaagtacttctcaaagaaaaacgtctcagataacttctgacttttcctttttcacttcctaacgttgttctcctgtatcctgctctactcctaagaaggtatgtgatttgggcaattcatttaatctccctgtacctcagttcccttatttataaaatactgaaaacaagcaggttcctctaacaattttatgagataatatctgtatagtacacatcacagggactggaatatagaaagcactcaataaaccttagctattattagcaaccacttgaatataaaaatgtacacttattcaggggcctgaatgctctccaggttcatgctccaggagtattgtttttttattttttattttttttgagacagggtcttactttgctgcccaggctggagtgcagtggcacaaacacagctcactaaagcctcaaccttctgggctcaagggatctttccacctcagcctccgagtagctaagactacaggtgtgtgccacctcgcccagctaatttcttttttcttttttttttttttttttgtggagatggggcccaggctggtcttgaactcctgacttcaagcgatccgcccacctcggcctcccaaactgctgggattacaggtgtgaggcactacgcctggccaaattggtgttattagtctcaaaaggaaacctaggttgatatcctgcttaccctaaggaaggttcttcagaggtgttttactgttcttggctaaagagcataagaagggcagtaactaaaagaactttagtggccagatgagaaaccaggtagttactggaaatagatattataatatctaaatttgtgcaattttattctgagaatatgacatttggtttcatcttcctacagtggaaccaaatgaatgggtaactaaaagtggtgtgatggagaggattgagtcctaaatttgtgtagtatgctcttccatcaaggattgagattagggggaggaggaggtagtaggtgagggaagaatatttaaataagatgagacatttggctggtcttggaaattgatgtcaagattcatgccccacctgctagtaaagttaatcaagaccagataaatcaggaagcctcactgtagagcagatttcattcattttacctctcccttcctctcctcaaattccccacattgtgtctgattatagccagatatggctgggcgttctaagcctcacctccggagattggtattcactaagtttggcctgacacacagagctctgcattttgaacaagttccctggggatgctcctgcagaccttctcagaagcaccttttgagaaaacctggattcaaattaaggcccacatatcgccataattggtcagtctggaattagcattgagttttggcatctagccacacacattcacttgtcctcttgcacttttgccaaaatgggaacaaatgcatttctctttagtttgggaaaatcaactttttatattaatgtggttgctaataatagctaacgtttattgagtgctttttatattccagtccctatgatgtgcactgtacaggtattatctcacagaactggtagaaaaacctgattgtgccaggcgcggtggctcacgcctgtaatcctagcactttgggagtccgaggtgggtggattacctgaggtcaggagttcgagaccagtctggccaacatggtgaaaccctgtctctgctaaaaatacaaaaaaaaaaaaaaaaaaaaaattagccaggcatggtggcacacgtctgtaatcccaggtactcgggaggctgaggcaggagaattgcttgagcctgggagacggaggttgcagtgagccgagatcgtgccattgcactccagcctgggtgacagagcgagactctgtttaaaaaaaaaaaaaaaacctggttgttttctatattctgtaaataaggaaactgaggtgcagggagataataaatgagttgcccaaattacatagctgcttaggagtagagctggaagtttatccaaacaacctacttgaacctgtactcagtttttgttcttaattggtctcgggtgcatggagttgttggctgcactttaactgctacactgcactgtctttggagccaatcaacttttttttttaatgtttcagaaacaagccaatttacttaaaattttttttttttaaattgtagtaacatacatgtaacgaaatttaccatcttaaccttttttttttttttttttttttgagttggagtctcgctctgttacccagcctggagtgcagtggtgagatcttggctcgctgcagcctctgcctcccaggttcaagcaattctctgcctcagcctcttaagtagctgctattacaggcacccaccaccactcctggctaatttttgtatttttagtagagacctgtttttgccatgttggccaggctggtctccaactcctggcctcaaatgatccgcctgcctcagcctcccaaagtgctgggattacaggcgtgaacccccatgcctggcccatcttaaccatgtttaagtgtactgttctgtggcattaactgcattcacactattgtgcaaccatcacaactctccatctctagaactcttgtcatcttgcaaaacaaattctgtattcattaaacaataaacttcccgttttcttttctccccagcccctggcaaccactgttctactttttgtctctatgacaaagccaatcaatttttgtgttaagtgtataccattaatctctacagccagtagctttctattgaattttttagataaaaaaatttacaagtcaaaccaggatttataaacatatactcagtattgaaacaagaagccatagacattttaaatagaatttagcatgtctttaaaaatgtgtaattgtatcttttaaaggacttgaagtctgctccactatgtaatacaactagattaatatttgataacttacacataagaaagctgcactgaaaggaaaaacaagccctattgctgggtggttcctttatgcttgagaaagcagtttctttggaaaataaatacatttgtgatcacatgaattaatgcaaattgctgcatcaggctaaaaatccattatgctcagtaactttaatgagattgtacattttgggatgctttggacagagcaaagcaatacatattaaaagggctgattttgaaagctgaagccccacttttcctcctgtcaattttttttaagttgaattgcctacaggttactaatatttagaaagctgatttgcgaagctggaaaccatcattctgagcaaactatcgcaaggacagaaaaccaaacaccacatgttctcactcataggtgggaattgaacaatgagaacacttggacacagggtggggaacatcacacaccggggcctgtcgtggggtggagggagcggggagggatagcattagggagatatacctaatgtaaatgacgagttaaggggtgcagcacaccaacatggcacatatatacatatgtaacaaacctgcacgttgtgcacatgtaccctagaacttaaagtataataataaaaagaaagctgatttgtgtggttacacaggtataatagttttatttcaagcttttgaagatacagttccacccctccccccccccacatttttattttatctttctgggaaaatcctgaacctagaagcttcttttataaactttgttctgtgtcagatcattaatttgtaagcttgatgtagacaatttcagatgctgttattattctgaaatgtactatggttgttatcaatttttagctgtttacacaaagcattattatgttttaattttttaggctatcttaaaatacctgaattgtgtcagccaaatagggactgaagggtgctttataataacttaaaacttagatccttttttacctaatgataaaatcagtaggagtgtattttttcattcagggtcatctgtctctttgattctctttcatttacattgtatgtaatcaggatatatatgattttaaaaatttgacaattagtcatgaggatttgttttaaaattaaaaagtattatatgtggttaaaaatttttaaacaggtcgggtgaggttgctcacgcctgtaatcccagcactttgggaggccgaggtgggcagattgcttgagtcctgtagttcgagaccagcctgggaaatgggaaacatggtgaaaccctgtctctacaaaaaatacaaaaaaattagccaggtgtggtggcacacacgtgtagttccagctactcaggaggctgaggtgggagaatcacctgagcccatggaggttgaggttgcagtgagccaagattgcaccattgtactctagcctggacaaccagagtgagaccctgtttcaaaaaaaaaaaaaaaaaaaagcgggggtggccaggcacagtggctcatgcctgtaatcccaggactttcggaggccgaggtaggcggatcacttgaggtgaggagttcgagaccagcctggccaacatagtgaaaccccatctctaccagaaaatacaaaaattagctgggcgtggtggcgcacacctgtaatgccagctactcgggagctgaggcatgagagtcgcttgaacctgggaggtggaggttgcagtgagccgagatcacgccactgcactccagcctgggcagacagagcaagactccatctcaaaaaaaaaaaattacagaaagtgtaaaaaagtttatatccacacttcattcaaagccctgttcagtttcttatctagactttcatatggtttttatgtcagtctaagtacacacacacacatatacacagtgcgtgtatcttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagcagagacggggtttcaccgtgttagccaggatggtctcgatctcctgacctcatgatccacccgcctcggcctcccaaagtgctgggattacaggcgtgagccaccgcgcctggccgcgtgtatctttttatacacagaagaatcatacaattcttaatattcaatttagtttttaacttactatatattacaaattatttcatatgggtatttacgtagctactcataaatagatgtcccacagtattccaatgtttagatattccgtagctcatttaaacagtcttctcctgagggacatttggattatttaatttgtttgttttactattataaacagtgctgtcaacagacatccttctacatttttgtttactcatgtttgaggaatcacataaaaacttttttaaagaaaaattggagtaatgatattgaaagtttatacattttgctgtttgatagttcctaattttaaaaaagccagtgtaaaaataacatttggaacaataaaaatgaaaaccagtatcatatacttgaacatagataactaaacatacgtgtaaatattttgaataattacagctatcatttaatgatcaccaatgtactgtatttacttctcacaacactatggggtaggtactcttttaaaaaatttttaaagcagctttattgaattataattgataaaactgcacatatttaatgcatacaatttgatgagtttgtacatatgcatacacccatgaaaccactacaactaaagtaataaacatatctattgcctccaaaagtttccttatgcttcttctggtttgttgttgtaagaacatatgacatgaagtgggatcatacagttatttgtttttctgtgactggcttatttcatttagcaaaatgtcttccaggttcattcatgtcacaatgggaggatttccttttttaagaccaaatggtattcattgtatgaatatatcacatttccttttttttttttttttttgccagtctagttttacttattatctcttcatttcccacgttcaccttcccagaacttattatattatattattattattattattattattttgagacagagtgtttctctgtcgcccaggctaaagtgcagtagcatgatctcagctcactgcaacctccacctcccaggttcaagcgattcttgtgcctcagcctccccagtagctgggattacaggcatatgccaccatgcccagctaatttttttttttttttttttttttttagtagagagggggttttgccacattggccaggctagtcttgaactggcctcaaccgatccacccaccttggcctaccaaagtgctgggattacaggcgtgagccaccgcgcctgcccccataactaattttaaacaatttctaaacatcatatgattctattcataaacacttcagctatcattattatttaacataggaaatattaacatatattatgggtacaaatgctataatatttaaagcacctttatgttatgatattaaatgtaaatatttgtttaaattcctggctttccttggttcatcaaatcaggtaataaattaaccagacaggttccaattcaatcagatacgaatataccacgttttctttatccattcatctgtcaatggacatttgggttgcttccttatcttggctgttgtgaatactgcttcaatgaatatggaagtacagatatgtcttcaagattctgattttaattttgtggtgatacacccagaagtgggattgctggattgtatggtaattctatgtttaattttttggggaaccaccatactggttttcatagcagctgcaccattttacattcccaccaacagtgttacaagggttgcagtttttccacatcctcactgacacattttatcttttgatttttttgataatatccattctatcaggtctgaagtgatacctcattatggttttgatttgcatttccttgatgattagtgatgttgagttccttttcatttacctgttggccattgtatgtcttttttggagaagtgtctattcagttcctttgtctattttttaactgggctatttggttttttgctattatgttgtaagaatttcttttttgttctttttttttttttgagacggagtctggctctgtcacccaggctggagtgcagtggcatgatcttggctcactgcaacttccacctcctgggttcaaacaattctcctgtctcagcctcctgagtagctgggactacaggcgcaccgccaccacgcctggctaatttttttttttttttgtacttttagtagagatggggtttcaccatattggtcagactggtcttgaactcctgacctcaggtgatccacctgcctcagcctcccaaagtgttgggattacaggcttgagccaccgcgcctggccaggaatttcttatatattttagatattagccccttgtcagatacatggtttccaaatattttctcccattccataggttgcctattcgttctgttgattgttttctttgctgtgcagaagctttttagtttcgtgtagtcctacttgtgtatttttgcttttgttgcctgtacttttggggtcatatgcaaaaaaatcattgccaaaaccagtgatttatttttatgttttcttataggagtttcagtttcaggtgttacatttaagtctttaatccattttgtgttgattttcatgtatggtgtaagataaaggtccagtttcactcctttggatgtagatatgcagtgtgtccaaaacagctcattatcatctccactcataaatctggtttttctgtattccctttctaggtgataatgtccccatttactctgtcatttaagcaatacacctctaagtcttttcagttctttttttaatctctcttaactccttctcctcttccattctcatggctgcagctttggtccaggccctcaacagttatcacctaggtaaatacagtcatatgtgccccagtgtagcttgtccagccttgcctcttgctatctttttcctcatatgtttttcttcagcaataggtgaactccttgtgggtcactcagtcaccccattccatctcctgcccttgggcctttgcgcatgctagctgctctgccagatcctccctcttacttcttagcctgtttaacccctactcatctttgaaaggcttgcttcaggcatcacatctaggaagtctctgctgacccctgagtttgggcttaggcactctttttcctcacacttgcctgtagctcctctgatgttatattcaccacactgggttataatgatctatttgggtgcctgtcttctcttctggattgtgaattcttggagactgcagccatggggaaatctattgcatttttctgtgtgtgaatgggagtggggtctctcctttagtcataatgtgtccttctcagggaggccttcctttgtaaccctatctaaaattgcaacctcccccaacacttcctatcccccttccttgatttattgttctccttggcacttattgctgtctaccatactatagattttacttatcttgtttattgtctgtctcctcccactagaatgtaagcgctatgagggaagggatttttgtctttttttaaactgttgtgttctcactgcctaaatcataccaggtatgtagtaggcacttagtgaatatttgttgaacgattcaacaaattcagctgcctctgatagtaaattttgttttgttttgtttttgaagacagggtcttgctctgtcgcttagtctggagtgcagtagtgcaaacacagctctctgcagcttcaaactcccaggctcgagtgatcctcccacctcagcctctcaagtagctgagattacaggcatgcactaccatacctggctaatgttttttgtattttttgtagagacagggctttgccatgttgcccaggctggtctcgaattcctgagctcaagcaatctgcttgtctcggcctcccaaagtgttggatttataggtgtgagccaccatgcctcgccagtgtattgttaagagtgtagtgtttggagccagactgttagacttcagattcttccggcgtctttttttttgtttgtttttgaaacagggtcttcttctgtcacccatgctagagtgtggtggcacagtcgttgcttaccacagcctcgacctcacaggcttaatgtgatcctcccacctcagcctcccgagtacctgggactacaggtgtgtgccaccatgtccggctacttgttttattttttgtagagacggggtttctccatgttgtctagactggtctcagactcctgaactcaagcgatcggcccaccttggcttcccaatgtgctgggattataggggtgagccacgatgcctggcttcctgaagctttttatctgtgtgatcatgggcaggtcacataatttctctgtgtctcagtcttttctgttttttttttttttttttttttttgagacagagtctttctctgtcacccaggctggagtatagtggtgcaaccttggctcactgtaaactctgcttcctagattcaagcgattctccttcctcagcctcctgaatagctgggattacaggcgcgcatcaccacacccagctaatttttgtatttttagtagagacagggtttcactatgttggtcaggctggtctcgaactcctgacctcgtgatctgcccgcctcagcctgccaaagtgctgctattacaggcatgtgccaccgcgcttggcccttttctgttttaaaatgggactaatagtcatctttactgcacagagtaaatagttctgtataacatattacaagattacctggtatgtggtaaacattgaaaaagtattacttgtttttattcctgacttggaaagttggccttagagatgtgtttatcttggcatttccagagcctggcctggtagtgcacacctgaaagtatcaaataattctttgtaagataaatgtttaaatggaatttaagcagatttttcaaaactattgtttttgtcttatttatttatttatttattttttttggggacagggtctcgctctgtcacccaggctggagtgcagtggcacgatctttgctcactgcaacctccgcctcccgggttcaagcgattctactgccttagtctccgagtagctgggattacaggtgcacgccaccacgcccggctaatttttttgtatttttagtagagatagggtttcaccatgttggccaggatggtctcaatctcttgacctcgtgatccgcccgcctcggcctcccaaagtgctggaattacaggcgtgagccaccacgcctggcctgttttgtcttctttaaattagtgttttggatttttgataattaatcatagcagtttgtatttaaattagatatgtgaatacctaaaggacaaaatcttaaaacatcctgtttttctttttttgagaatctcacgccattgcccaggctagattgcagtaacgtgatcatggcctcgaccttctgagcttaagtgatcctcctgcctgagcctcccaagtagctgggatcacaggcatgtgccaccatgccagtttaattttttttaattttaattttgtagagatgaggtcttgccatgttggtcttggactcctgggctcaagcaatcctgcctcagccttccagagtgctgggattataaacatgagccacagtgcctggccttaaacattttagacaaaaatgggaacttttgagctttgactttgattagacacagtaagcgcactcatgttctaaggctagaagctcctttaattttctgtggaatgtggatactgttgtagaattccaggctgtgcttaagctagtggatctgttccactttttaactccttgcttcatttttaccagctttagagccctatgtctttgtagccaagaaagaaattagtctaggcctgtaaagactcacatctagttaagatagacaagtcttcagttttcagtaatatgttgcaaaaaaggcagaaaactactcatcttggtttcttggaaagtgaaactgtatgtgtactaagctccatctgtcaaaagtagtatttaatactttttccttagcatcttttcagaaaatgggagcgtgggtgatggtgatggaaattaacatttacggagtgccaactatgggccagacactatatgtatgttattttgtttaaaccttataggaatattgtatgtcccaatttacatataaggacactgaggcacagaatggctaagtaacttggcaaagatgacatatcttgctagtaagtagcagagccagtgttttgatctaaaatcttttttactgtcactttccacatctgccacacacttgaacaagaaaatgtacagttgtcattcatcttgaatgttgataatttgtcttattgtcaggtttttgctactttcaaaaattggcacaaaggtaaaagaaccttgcatttcttgaagttgagaggtttgtggttccatttgtaagaagttaaatcctaaaaatacactgtaaagtatactaaatgagcaaattaagcattaatagctgtaaaactgtacatttatattatacatactgatttatgtaatatataaactaaaaattagaggtgtgaaggatccttaatatggtcacatatgtttcagttatcctaaaatactttttttgctaatactcttttcgtttttcttccttttttattttttgaggcagggtcttgctctgtcgcccagactggatggagtgcagtggcttgatctcggctcactgcagcctcaacctccagggtgtaagcaatcctcctacctctcagccttccaagtagctggaactacaggcacgcaccaccacgtccagctaatttttgtactttttatagtgacgaggttttgatatgttgcccacgctggtctcaagctcccaggctcaagcaatccacccacctcagcctcctacagtgctgggattataggtgtgagccaccacacccagcccactaatacttgattcttaaaaaatattttaagaatgttttttcttatggcttcaacattctttggaaatgtactttccatcagtaaaatgttcctagtttctactctaactctggagcagtatttgtatgtgtcatcaattgtttaaatttgaatcaagcatcagtaatggcataccatttgggctgctttgtggccctgatgaatgctattttattttatttattttttattttattttaattttgaggcagagtctccctctgtcatccaggctggagtgcagtggcccagtctcggctcactgcaacctcctccccctgggttcaagtgattctccttccttagcctcccaagtagctgggactacaggtgcgtgccaccacacccagctgatttttgtatttttagtagagattgggtttcgccatgttggccaggctggtctcgaactcctgacctcaagtgatctgcccacctgggcttcccaaagttctgggattacaggtgtgagccaccacacctggcctgtgaatgctattttaatatagttctcaggaatgattaaaaacaaatgtgtttttctaagtggtagaattaatagataaaatcactttgaaattaaagtcctcaggtaacatagaattcttttccctgaacaagtcattatgtagcacatggtataattttggcagacccaactttattaccaacaaaactgtaaagcgagtcctatgtcctgtttgtcttttcttctcgggggtttctgttcttactagaacaaatcaaagtacagtgtgtgttgctggtcttcaagaattattagtttttgttgtaactgtttaatgcagaaacagatgctagagcagttattccccaaggcaccatgtgcctaaggcatttttaaagcactagtatgttttcagtgtgatactgctactctggaagaactgtatacatagtggttcacttttccagtgtggttagaactgacatttctaagatataaagaaatttaaggccaatttggatttgtactctggctctgcttcctgcttaggtggaagactttgagtgatttagttatgctctctgcctctattttctcctcttcaaagtggggatgatgaaacctactttataactttgctgtgaggatttgtttcggaaaaactctcaaatcagctctgctctcacaccaacaacacaacaacaatcaacacagaagacttccgtgacaaaatgtggggattttttccaatacactaagcagtgaacaccagctgtgtcctctaattcaattttgacaccatctttctggagatagcatcagatcccacaggtagagggcgcagtccccaaaattgccccctctcccaggcaccagttccaagtctgggcctctgcaacttctgaccgaggagcttcaagttgaggttcccatgaacctctccttgggtttgattactttgccggagaagctcacagaactcagggaaacacatttactggtttattacaaaggatactgatgaaaaaatgtgtagggcgaggtatgggggaaggagagtggagtctccatgacctccctgggtgtaccaccctctaggaacctacatgtgttcagctatccagaagccctctgaaccctttctgtttgagtttttaatgtattttatctaaatacaaccatgtagaaatgtgattggacaaaaagctcatgatctaaacccagcaaggcttgtctgttcagacttttcttggctactctgtgtagcattccttcccttagggtatgggacagggtcctctttggaatgagtgtctgttgataagagtcttcccttgggcaggtgaaaggaagacaggagagggtcagagagatctgtttcctgaggcctaaagtgccccaacattataacaacagattatgacaagggttatggaagttatgagctagaaactgtggatgaagagggtgtgtgtgtgtgtgtgtgtgtgtgtgtgtgtataacaggattattatctaggactacacgaatttgatttgtgcatttgcttaagacagtgtaatactgtgttaggtatgcaggcttgagagtcagtccattgagatacaaattttggcttcgctcctttttagtcacctgaactaggatcacccacataacctctttgtgcttcagtgtcctcatctgtaaaatggggaaattaataactacctacatcacagagttgttacaaggcttaaatgagtcaatacatatgaaatgctttgaactccacctggtaagtcttcattaaatgttaaatattattaatttctttaatattgttatctccacttgtcagcatgctatgtcaacattcattcactatgttcactaaactgagacttccttgagaacttggccaaaatcagtatttgtatctcctgaacctgacatatttgtacttaatttaaaatgtttatgaaatgaataaaatagtgagggaataccttcatgcttctcagatctactctttttcttctttccatttcctttgaaactaatctttctcacgtgactcatatcatatttgaagctggactgtctatgttttctagaacaaaaatttgggatacttggtctaaaaacagattagtcttgttaaggctgccgtactacttatcacagtcccatattctgtgtctcattagatgtatttctcctctcctacttcttcctctctggtccccaacacacaatgtagagtctggggcattggggcgtagaaatgcttgataaatgattattgacttgagcaaagagtctacaggggtgattcagggcatgaattaaccttcctcatgctttgatctcagatggaaatagagctgctcattcacaccagtgatggtttcaaggttattaggagctgcggtatctgaatctggcttctttttatttttattttttctgagacggagtctcgctctgttgcccagactggagtgcagtggtgtgatctcagctcactgcaacctctgcctcccgggttcaagcgattcttctgcctcagcctcacgaatagctgggattacagatgtgcatcactatgcccggctaatttttgtagttttagtagagatggggtttcaccatgttggccaggctggtctcgaacttctgacttcaggtgatccacctccctcagcctcccaaagtgctgggattacaggtgtgagccactgcacccagcctgaatctggattattttgaagtaacacatttcgaacctcaaatgaggtacaggatatatgagacccagaaacaggcatttgaaaatattctgctttgtaaaattagatatccgtgcttttcttcaagggtattcttttctcctatctcttaaaacctgtatatctgtttttttaaattttctatttcaagtcctcaaatggtaaattagattggaaataattcattggtaagttgcagtcactatgcaaggagagttggcataaatggtgcagttttactcttgctgcatctctctacctatagcaacatagaaatatcttttctaattatagtcatgaaaagtctaatgaactctattctgttttaaaaaagccttttccattttcttttgttaagcactttcttttcttttttttttttttttttttttgagacggagtctcgctctgtcgcccaggctggagtgcagtggcgggatctcggctcactgcaagctccgcctcccgggttcacgccattcttctgcctcagcctcccaagtagctgggactacaggcgcccgccactacgcccggctaatttttttttgtatttttagtagagacggggtttcaccgtttttagccgggatggtctcgatctcctgacctcgtgatccgcccgcctcggcctcccaaagtgctgggattacaggcgtgagccaccgcgcccagccaagcactttcttttcatttgtgccatatatattgttgaaaattggcatttatatacccttctggctttaaacaattggttccattttccatgtaactagacacaaatgcattatgcaaaattgtgtttgtaaggagagatcatccttcattccgtttcataaaggttttctcttttttactgtttacgtgagggttgaatatgtctgccttctggtaacacattaaggttgcaatatttgtctagttgtaggaatacttagctcttttttgtttgaatttgacataacacatgggtaaatctaatcctgatggaaagttccatttaatttttttataacaacttttaattgacacataatgtatttatggggtatagagtgatatttcaatacatgtatacaatgtgtaatgatcaaatcagggtgattagcatatccatcaccttaaacatttatcatttctttgtgttgagaatattcaacattttctcttggctatttgaaaatatggaataaattattaattgtagtcaccctacagtgctatagaacactgtaacttattcctcctgtctagcagtaattttgaatccaagagccatccctcctgcctatccttcccagcctgtagttgccgctattctgctctctacttctatgagatcagcttatttagaaagctccctttttaaacacataaaaatatttttgtagtgtaaaaccaatatatgtacactgtaaaaaaaagtttgtcttaatcagcttaacatatgtttgaatttaaaaaaaatgtaattatcttaaagtttcagtttctaaaatcaaagtaaagtactaataccagtgcttcctcatgtatactcggttgagtttcttttgggggtgatgaaagtgttttagagttagattgtggtgatggttgcacaatgctgtgaatatgttaaaaaccatggtattattaaatgagtgaattttcatttagtatgtgatttattaataaagctgttttatgaaaagggtactcatatcactatgaatcagctctatcacttagtagctggctgtgtaataaccttggattaagttgctttcatttttttgtgccttggcttcctcatctgtacaatggggataataatatcttttttgttggttggttgtgaggactaaatgaataaatacatgcaaagagcttagaattgttttttgaaacataaaccctcaaacgtcagtggttgttattattcttatattgcatgtatagttcagaagagaagtctggggctgtagatacacctttttggtgtgatcaacataaagatggtaattaaagccacacatgtggattaggaaacccagggagaacatgtagaatgatgaaggacagagagctgagagccaaatctagagaaatagcatcatttaatatgggagcaggacaagcatatctggcaaaggaaactgagaagtcatgtccatagaggtgagacaggtgtagtgttagggaaggaaaggaaaaaattgtcttccaagaaggagaatatggctaatagtgtcttgctaaagagagtttatcttagtctaatttgtgttgctctaacagactgggtagttcataatgaaaataaattgatttcttaccgttctcaaaggccgggaagcccaaggttgaagggcctgcatctgccgaggtccttcttgctgagttgccccatggcagaaggtggaagggcaagaaagtttgagagagcaagagggcaagagcaggagggagccaaattaatttttataacaacccactctaacaataatctattcatgagggcagagcccttatggcctaatcacctcttaccatcctggtcccacctcttaataccatcatagtggcaatcacatttcagcatgagttttggaggggatatccaaaccataactttctgttcctgaggccctgaaacccatgtccttctcacatatgaagtatattaattctaccttaatggctccaaaagtttttttttttttaatttaaaaattttctttttaattctcagcaaggcaaggtacttctatatagaagggtgcgcccttacagatggaataatggtgagcgtacacttggacaagggaggggaaggggttcttaccctgacgcacgtggcccctgctgctgcgttgttcccctattgggtagggttaagaccgcacaggctaaactaattccgattggctaatttaaagagaatgacaggatgagtgctttggcgggaatcagggcagagcaggtagcaggtaatcggaatgagttagagtggagcaggtgatcggaatgagttagggtggagcaggtgatcggaatgagtcagggtggagcaggtaatcgaaaaagattctttacgaggaagttaagtttaaaagtagaaggaaaagaattgaacacactgacatattaattctttgaaaagaaatttagaactcatatctaacagcccctccccttgtatttccttacagctttcttttcaaacttttaacatgtcttagcttagttgttttgcttgattttctaaaagaagaagcttctctggataaggtggaggatagttaagggaggttttagtaagtgctatttttatgagcctctgcatcaacttacgggtgcatggtatgacacagcacccgacaagattaagtacactcattatggctgtgagagaaataagaattgaggctattatttctttccgtttaccgaactacttttctagccatcctgtaaagaggtcatttacccctgagttgctggctgactcattggatagagcagtcagaccttgcaatgcctttgttatacttccattaggggtggtggtgtttgggatgaagtgcaacattgagttttaatcatgatgcaaactcctcctctttctgctaatatcatgtctaaggctgtcctattttcccaagccatctggctagtagcccctaattgttcagctattcctttaacagcatctctagtgtagttaataaatcactgttggttgtaatagatgtagtttatccaatctacatttttattaactgtcacccaccaaaatattgacaaatcctgcagctatttgatttcgggctttaaattgatctggtattccccgtgggactccaattgcatctaaatagacgtgagagtcaaaagacccataaggtacttctctcgctttatgatgtcttatttttcctcctcctggttgatgaaatgccagggtgaaagggatagccaattggactaaagcataagtgccacttcagttacttggcagagtgtccagtaaaggtccaccataataccactacacatctgctcagggatgaataaaggctgactgattggtaagcttttgacaattcttaagctcactacatcccttcaggtctccaaggagtgataagtttcctccctgtcaagggagacatgaagtgaacctagtgttgggagacggaagctggatggcccttgggggctgacccgcagggtgccgaacttcaagatatagcagagagagagcttggcacgacttattactctaggctgtagaatcctggaaaagagctaccatgcagtccacgcctggtcgactggaggaccaccctagtggaaaggggacaatctgggcctctggcctgccgtgcgcacaagaataacaattgctttgttaaacgtgtggtcggaatttttgatccattccaaccaggcatttgcatcttggtatcctgtcttaattgccaaagtttgttttaagtctttaacttctatgatcctctcgtaaaatgaatatatggttttaggaaattacaaaaaccaactggggcagtccacccttgctctttagtggtccacagaacactggaccaactacgatataaaggtctacatcggggggcaagcctcctggttgacactggggtctttatcgaaatctccccagattaaatggtcccaatttactaatgtccagtctgaggagagtcaggagggacagaggtacttttctgaagtagagagctgtctttgacttggcaagtccccacagggtttaacaaggcaagcattaaatgcaatagtttgaggcaaaattgacttggttatgttaataactaaatggtcaggaatagagcgaggaaagaagaaagagtaatagatagatgaaagagttaaatttttcttagctttagtttggtagggttttctcctgggactagggcccacaactctggagggggtggcgctttcttgactcgggtatgatgagtccatcccttttttgctgtacgaacagcggtggttagcagcacaaggtagggtccttcccaggctggctcgagttttccttcttttcaccctttgatgagaacgtgatcttcaggctggcgctggtttaccggaaattctaggtgtggtacatgtgctaaaagacttttagttttgagggaaaggaaagtggaagataaaccaagtatataatttctaagaaactgaccttttgttttaaatgtgggtacatcagcagtggactttatagtccttggtgccttcttactgagaaatttcctgtagcacctatttttattagtttttagaccaaagaaagccaaacaccattttatatttgacaatgcttcctgtattatttttataccagataagctaaatttcacctttatattagtgtgttattaattttaaacttagttttaataaaacttatagacataatttattcaatttttaatgtctgaccataaggtaagatttttatagactctttttaaccttttataatttttgttaaagagcaggttagtgctttaagaaaaaccctttgtgtttttattttaatgtccagttcacagaaaaattggatgataccctttcaaccttagccaatatgtttgcatacagtttcctttacaattaatgttttaaaacttgcttaaaccttcaaaacaaatttttttaaccttttaatgtaggtaaaaatccacattcttatgcctccttataatccttttactgaaagtatattttactttgcttatacaccttgcaaataaactgtttctgcaatagttttacattcaggaggtctaattacttttaaattatacaacatttcttgcataaattcctttttataagacactttttttttctttcacggctttcacagacaattcttcgacatgcctcaactttctgacttattgcaaacatccctttctttaagcaaccagttatttcaggacaagaatttaccatataacattctctttacataaattctcctccccccttttttttcctaaaggtgataaccattcttttccaaagcgaacttccttcatatctgtggactagactgcctaaggccataagattagaagttaggataatacatgttacaagttaggataatacgttaacttttagcaaactttacttttgttgaaaactttgtaagtttgggatttcaattatcctttgctgttaataagaccttgtttagtccaaattaacttagaattgatatagatggttccttcctgattctgtaagtactttaaggcttagctgagtggaaacagctcatccatgtttgattagaccaattattaggccattttcctaactctgcttttacaagagtttccctgtcaattactgaatacctattgtgtctttttcactcagtcacctgggaggaaccatctattgtcctgtcctgaagggagttcctcctaggtctggtcagacctttgtgtggtaattaattaagatttagataccctgttaggaaacctgctgcgttaagggaattatccgtcgttaatgttaaatcatctttttctaacagaatagccccatactttaagatttttgagttagtaagctacctttttttttttttttttttttttttttgacttaggatagttctgaactggtgaggtgtgctcacaatcaggtttcctctaaaagttatttttttactttcttctgttagcaaagccattgctgctacagatagaatgtatttaggccatctgcgggttactgggttaaggatttttgataagaaggctacggggttgtccatggcctcagtgctttcgggctacgtccttgtttacactgacaacaaagtggtattggagtgttatagggtcacggagaagacctttaattatcaagtacaggttcctaatttaccttggcttttaaaggaatagggtacactgtttttttcttaactacttgtatatctctctctctttctctttgactttgtttctctcaatctttgactccctctttgtctctctgtctcttcctctgtctcttcctctctctctctttgcctcttctctctcttccccctctctttcttcccctctctgtctttcccctctctctgtctttcccctctctctttttctctcctctctgtctctctttctgtctctgtctctgtctctctctctctgctggtctttccttgcctctgccagccgcttatgctgctgttctcccctctccttcctcttcccctaggggagggactggcgggagtggagctactttttcttcctctaagaagaaagggggggtttgtgtgaggttcaagccttgaaattagcagaagtctcaacccctgaaaccagggatgtctcgccttgcctgtcccaggaggctcaacccctcaacaccagggaagtctcgctttgcctgtctcagaaggctcaacccctcacaccagggatgtcttgccttgcctgtcccacaaggctcaacccctcaaaccagggggtgtcttgcctgtcctagaaggctcaacccctcaaaccagggagtattttgccttgcttgtcctgggaggttgacctgtttccccccttttcccctctgaaggtcctttgcacacttcccactcgtgctgtcctctctggctgctcccctaagggagaattaggcccctgttagtgttggtgtgctggtataaatcccatggcaggatctgccctaagccatatgaggtagctatggaaccatggagaggacccactcactccatcctgcagtaggacttgtcaccatccacacaacaccgtaagcagggttgttggtgatcattcacgcatacacatatttagccctccagaatttgaccaccaaggaagtactttacggctcccgcggcttatccttccttggtctgcgcacagagtcattgccacagtatgtgaggatcctttaagctaggtcgctggccagttcccccccccccccccccccccccccccccgcattgctgagagcttgggttattcctcgcactgggtgggtcttgatttctcacccctgaggccaccacaatagggcagggtgcactgcagaaccagagaccaccccaggaggggaatgtaatcccagatgggcccccaaattgtcacatataaagtttcagtgctgctaaaggaatagcattcgaatatacaattttctttttaattctcagcggtgcaaggtacttctgtatagaagggtgcacccttacagatggaacaatggtgagtgcacccaaaagttgttgggttttttttcttttttctttttctttttttttgcatgataacatctcactgcagtgtcaatgtcctgggcgcaagcgattctcccacctcagtctcccacatagctgggactataggcacatgacaccgcagaagtcttaactcattccagaatcaactccaaatcccagagtctcatctaaatcagatatagatgagagactcaaggcatgattcatcctaatgtgaatttctctccagctgtgagcctgtgaaatgaacaagttatgtgctatcaaaatagcataggttagacattcccattccaaaagggaggaataaccaagaaggaagggataactcatccccagtaagtccaaaacccttcagggaaaacaacattaagttttaaagctaaataataatctcctctgactacatatcctgcatcctgggtacactgggatagagatttggcccccaaggcctcaggcagccttgctcctatggctttgttgggttcagtgcactcagtaactcacaggttggagtctcctacttgcagctctcccaggctgatgctgtaaactaggagctctacagttctggaatcatggtaatggtcccagtcccatatttccactatgcatttccctattgaggactctctgtgctggctccaacctcacatttctacttggcatttccctggtaggagctttctgtggtggctccacccctctgacaagtctctgcctgggcacccaggctgtctgtgacatcctttgaaatctagatagagttagctatgcccccacaactctcatattctgcacacctgcagaattggcaccatgtagacaccaccaaggtttatggcatggactttgtggagcagcagctcgatcctcacctgggctcccttgagccatggctggggtggccatggagtgctgggctggaatgcagggaggagagactctgggcagatagcctgtggagtatgccccaggtctgtcctccagaaccattcttccctcctgcagctctgggcctgtaatgggagggcagcctcaaagatctctgaaatgcctttggggtcttcctccattgtcttggtgattccttttgttagtatgaatctctgtagcaaagggttgcttggccacaccgttggtttgctccccaggaatgctttttcattctgtacctggccaagctgaaaaattaaaaaatctttctgttgtgctttttattttatttatctatttttttgagacagagccttgttctgtcacccagtctagagtgcagtggtgcaatcttggctcactgcagcctccgcctcccgggttcaacaattctctgcctcagcctcccgagtagctgggattataggtgcccgccactacgcctggctaattgtttgtatttttagtagacggggtttcaccatcttggccaggctagtcttgaattcctgacctcgtgatccacccgcctcggcctcccaaaatgctgggattacaagtgtgagccactgcccccggcccctgttgtacctctttttaaattgtaaatttcatctttaactcatttctttcttctcaactcctactgtatatggttaaaaatagccacacagctcctttgatattttgcttagaaatttcttctaccaaatatcctagttcattagttcattgctcttaaatcctgccctaggtcatgcacacaattcagccacattatttgccacttcataacaaggatggtgtttactccagtttacaataagatatttatcttttttatctgagacctcatcagaatggcctttatgtccatgtttataccaacattctgatcatgaccccttaagtaatccctaagaggcctcagactttccccatagcacgtctcttcttccgagccctcatcagaatcatccttaatactccatttatggcaatctaggctttttctaatctgctcttccaggttcttccagcccctacccattacccagttccacattttcagttattttttatagtaacaatcctactctcggtaccacttctctgtctttcttcattttgtgttgctataatagaataccacacatggagtaatttataaataaaagaaattcatttctaacaattctggagggtaggaagtcaaaggttgagggctcggcttctgttgagaaccttcttgctgcatcatcccatggtggaaggcagaagggcaaaagagggcaagagcaagtgagcaagagagggccgaacttgctttcataacaatccactctcatgataaccaacccacttctgcaattatgacattaatccattaatgggggcagagccctcatggcctaattatctcttaagggttccggtcctatctcttaataccatcacagtggcatttaaattttaacatgagttttggaggggacattcaaaccatagcagaggtttaagtaagataaagactgagaactattcattgcatttggcaagttagagttatgggagtgtgggtctatggaccagcctacagagagagggctgaaagagtgaagaggaggtgaggaagtagagatggtatattcttttgaggaacatggtcatttattcaatggttatttattgagctcctaccatgtgtcaggccttgctctagatgttaatggcatgtcagtgaataaaacaaacacatttctgccctgaagaataccactttacattgggcctatagagggaaggggagaagaggctagaaatagggtacatagtcaaggaaatcgtggagttttttttaaaggaaaataagtatttaaatatatttaagttaaggaaacatgggtagatacaaagtagagatgaagtggttgacagtataggaaagacaggataattattggtcaaaaaatatggggagatagagatcaaaacataggtagaggctctttgtgagtcttgaatgggagaagagatactttattctttctcaaactggaaggaaagagctgatgtgcacacagtgtgagggaatgcttcctagatgaccctgattttctaagggatgtaggagcaaggtcacccatatagagaggattgtgataggggacttgagagtcatgaagctttgaaatgagcatttagggtaagtggagagtcagatgaaggaagacaagtggaggtttgtggagtagcactgaagaatttgtaatgacattaattttttatcagtgtggttttaccaaaactgttctcagcctcctacatgcaggaatgaagaaagcagtttgcgagattggtcctggatttagagctttgtaggtaagtcatttatggcaaaaagccaggttgggaaggaattgagagggctagtgagagaataggttccatgaatcaatatggtgttcagagatcagagggaaagtgtagatgaggactggtaagggctttgagaaactgagggtagagtcaaaagagtagtggtctttagctgagtgcagtgctacatgcctgtaggcccagctactcaggaggctgaaatgggaagatcacttgagcccaggtgttcaaggctgcattgcacatgattatgcctgtgaatagccactgcactccaacctgggcaacatagtgagacccctgtctcttaaaaaaaaaaaacaaaaaagagagtagaggtcttaaagagctatgtagtagaagttatggagctgaaaaatgagagagggctattatgtgtcagggatgaagtaatatgtgataacagatcctactctctcactatagaagaggtaggtaaaaaagagtggaggtgaagatccttaaagcaaaggagttttgggactcagcaatctaggtttctggattggggtgggtgttgcatgtggatgatagaattttcaagtaccatggcaagtgttggcatagagaacaagtttgaaagccaaatttcaaactcttcagccaatgggcaataagtgaccagagaccggtgtttgatagtgatgacaacggatggtaaaggtcactacagataagaagtctgagaactataagatggtgtgttcagatttcatcagatgatggcaggagatgagatggagaggccaccagtgacccaaatgaatgaaggcacacgtccaaggagatggatagatgaccatgatgaggatgggtaaaagctggtatctccagatgatatcaaactaaaggaatgatgccatgagtatggagtaatagactctataagcaagggggaggcaagaggaagcttgcttattgccctctgagttacatagttaagaggttcacagggggaagaattttaagaagacagccaagtttcaaggaatgtgggtggttgtaaggtagggtttctgatgttaagatatagagagtttgattaacaaggatggcaggttctataggacgtagttttttttttttttttgagataggttcttgctctgatttccaatctagaatgcagtggcacaatcatagctcactgcaacgtcaacctcctaggctcagatgatcatcctgcctcagcctctggaataactgggattacaggcgtgagccaccacatccagctaattttttgattttttttgtagagatgaggtctcactgtgttgcccaggctggtctcgaactcctgggctcaagcagagtcctcccacctcggcttcccaaagtgctgggattataggtgtaagcccctgcacccagccatataggacatagctagtttgtttgtttgttgatgagacagggtctcactctgttgcccaagctggagtgcagtggcgtgatcttgactcactgcaatctctgcctcccagggtcaactgatcctcctgcctcaatctcccgagtagcttggactacaggcatgcacgccaccatgcccaggtaattgttttgtatttgtagagaagttttactatgttgcccaggcttgtctcgaactcctgagctcaagcaatctgcttgtctgggcctcccaaagtgttgggattacaggtgtgagccactgcgcctggcccaggacttagtttaatgaatgggagagagagagggaagggaaacaattaggtcatgtatgtggagtggaagaaggaagcccagagcagtaagtagatcaggataggcaattggatgagagtcatgggtagatgtaattggccttttgagtcccacaatttttttttttttttgtacaggcattttcagtaaatgccatgtaagcagtgcagagtgccacaggagtcactggtcagtcgcttccaccaaccgtttccttttgcagatactgcctgggtctgaacctgattaaagttctacattataggcttcctactccaaatcctaatgtttattctaactagtatcagtctgtttcagtcaaaatacaaactataacaatgaacacgctattttagaaatgtagccaaaatccttacttatgatctatgattatgtttcttttaaattttaaatgtattcctaggagtgaacgaaagcgtttcttcatagtgttttatggtcaccattagagcccaaatcctgctttccctatagcaactgggtggttgtgtttttattaatctattaatttattttaaaaaagaaaaaatagcagcaaaagtaaagtaaaccttaggagttacacaatggattgcatacttaatgctatggacaattgctaacccaaccttactttaacatttacaaagccagttttgattagctctttattcctagttatcagatatactccatttctctaaattaagtccagaggtggtccttactgagatttatagccactgataccacaaagtcttataatttagctgtttaagaattcttttgggtaaaaataatttaggaaggaaatctagtgttcaccaggttggaaacaactggacattagtaaaattgaagctccttagcaaagcttattccggtttgttatataacataccgattaatagccagaggttacctggattcatacaagaggcactgtttctcaaggtcaagcattgcatggccctttattgcaacttttcttttaaatatgaacgtataagtcagacttatttttggatgatcatagtgaaacccgaagatccataatgaagtttatgtgacagagatccccacacaacaatctgagcgatctctatagtggtgtacaacttccctgttgctttggcagtttcttaaacgtaattattcccaaagcaaatctattcaagcatatttaaaaagaatgggacagtatttggcaagcataagcgtgttttaaaagtgattccaaagatttaaaggttttagctgtaagaatgatggataatgagaattgcagaaaattagcgagagttcttttgccaagaacagtagtttgggaaagctttgggctttaaatagagggaattatgaataaagacagtagttgataaagatgaatacagtaaaaattaaagtgttgttgcctttaagagtattttatgtataaacttgattgatgtaaacttaattgttcaatgtttaaaagctctaattaatgtagtttatacttagtatgaagcacatcaaggtctccatttcctctactcactggaataattgaactatatattcagacttctctcactgcttcactccctacatatattcccctttacttttctctcaaaaatccctgacttctcctgataaaaataaattgctttaaacatttattgttaataaatgcattaatgaaaaagcagaaacatttgtggtggtttctctagttttttaaagcaaatctctgtaggggttcctaatttagttctgttccacgttgccctctggtcactaaatcaaacacagagccactgctgcttagggagctggcattctagtaaggcaagctagtgctagggcactagctggaagcctgttttgagctgactggaggctatgaaccccctaaagaaagagacagggtcccttgggcctgaggcttatcggtgatgggaggaaatgttgggtccagcccctggggaggtgaggtgcactagagaaactgagaggcaaacaagtgtgtccaccaggacctaatgttgctcacaaccccttaaccacttaatcatctgtcattcttttaagtaaatacctgcttatgctcattttatcgttttgaacattccatcttcagggtgctaacttgacaaatttttggtaaatctgtgcaatattagataaccacaggaacctttttattcaactcccacactttatgaatgggaaaacagactcagagagggggaactgagatagagttggctttctggtaagataagcttcctaatttagcatggggattatgcttatcactgtgtctagctcattccatgttctttaaatatttgtttcaataaaatgggataggcctttggattaggggatctcacaaatacacaggcccctacacacacacagattattgatttgatttggaaagaatgataggagaaggtgaatgtctgaggccaaccatttgcaattctaaatctgtggcccccttcttgttcagagctgttagctgctctgaccatcttctcctctttagttagggtgctaccagggcagtatggaaggtttcttcccactgcttgccctgcatatgtgctttcttcttactcggcaccaggcctttcctgcattgcaggtattgcagggccacgtggtatgacacagttgggtgaatttgattacacatgctgtttatttttgcttccagtctagtgcttacccagagccctccactctctgctactccttgcattcaaccctaaactgagtcatttatcataacctttgctgaaccttttgaagctgatttttctttcctttttgcaagcattttgttttattgaagtcttgaatgaagtcacaatgtactattctgtcttttgttcatatgctaattaagaagtgttatctagttagcgtggcatagttcatttacaaaactattcatggtcattttgattttataaggtttctctctgtttctgtttcgcaaagactgtatatatgttttttagttaaacaaagttaatgttaatttctttcatttgtgctccctgagtttcaagtgtaataaccctgcagatatatttcacctatttgtattagaattatatttttttccatggacatcagttttttttttttttctttgtcagaagcaactagttattggcagcaaaggaatttattattccattgtgctatataacacaactaacaattttttttcagtatttacaatatgaaggcactgtttcataattgctttataagttgtcatcaacataatcaccccctttgagactggtgggaaaactgagacatcacatggttaaggagcttgccccaggttacataactaataagtggcagaaccaatatttgaacccagatatctggctgtagaactgatacacatagccagtatgcttctgttcttcatcatcccttgtacaggctctttgaaacaacctggtaattgccatgctctatgaaaaaaggccattaaaattgcaaatattggagtacctctgatttttgagcatcaaaaatatacccatcagaagatattcatgagacagttaaacattgaggctccaaccttgtttatactatattttcatctctggtcatacataacttgatgacccttggtgatctcaaatgactctaaatgatactctgattttggggctaggcctgtttaatcaaatgagtgagccatatctgtttgtaattcttccatccatccatctttccatctgtccatctatagaattcttcatctgcacgtaacagacacttaggtgttacttatccttactgcagaagaagtcctgttgtatcctaagagaataagacacagcttcaagaatcactggctgatcaccttgaggggaagccagtttgtaagggttcgccaattttatgtatctgcagccttccatatgttacagggactcttaattaagctgctgaatttggcattagttgaactttcagtttactttcaaggagagtcatgcagacaattccagtccaagagaacagcagttgggaataaactgagatacttggcgagaaaatgaggtgggagttgaatttgatgacagcagagcattcttgctggagactactagtggaaaatgaagttagaatggcaagggaaagtaaggtttgttagagtagctctgaaaccaagcacagtatacaactgaaaataaaattctcttgtcattgtatgcagactctagctttggagcctggcacgtgtgaattatacaaagattttcaaactaatttgatcgtattctagatcacaagaggccaaaattacccaacgctcagacacattaatctcttggaaatttaagacaaactctacgcagccccagtcagcctctacatttcagcaactcttattcctttcttctgtatttacttagcagtgcgctgcaaatatacttgtatacttccttcacttatgtcctacttgtgtttcctgtcaactctatgagattgtaaacttgcctattgcaggaattgatacagccctagctcagaggtcagtgagaggtagaatgcaagcaaaaggagagaagtgattgggcttcgcctcagcctgtacctactacccagctgatacttttcacaatggcaaaaggtgaaagagtggaagaaaagggggagagttactctatggcacatggcaggaggaagattggtacccttggagggcatgtatggaatttaaaacctgctcactttgggaggctgaggtgggcagatcatgaggtcaggagatcgagaccatcctggctaacacggtgaaaccctgcctctactaaaaatacaaacaaattaggtgcgtgtggtggcgggtgcctgtagtcccagctacttgggaggctgaggcaggagaatggcgtgagcctggaaggcggagcttgcagtgagccgagattgcaccactgcactccagcctgggcgacagaaggagactgtctcaaaaaagcaaaacaaaacaaaacaaaaaaacctgctcatgcattctgggcagggcaatgcaaggcaagataagtggagccttggatagcaatgggcctgtctttgagttataacctgataaggtcctagtcccaggaaaatagctaggggaacgaggaagaaataactttccttagggaaatcacttaaaaaaatcaccttactaggttccattgtttctgagctccagagcaagatggagtgtgtatatatgtgtatgtatgtataatgttttaaaaactttattgtttattgccttttccatcccaaggtaccagaaaatttcataagtggcaatttttgtgattgaaatataccacttaggtgttctagttgttcttctacacaagattcactgtagtctcagcatggggatggcaaaagctgataggagaaaattttctctcttgtcttttgaacatcaatgaaaggagagttttccttacctctctgcagctcttgaatgttgaattttaatattctcatttggagtttcatttgaacaaatagctttcttctccaagcccttgtaccaccaatcatttcaacctgcagttctccttctctactccacctcaccctttgtagaaacaattctttggtcttagaaaggtttagacacagttcattaactagtattttgtatttataaaaattcaagtgtgtggatgaaaactactgaaacaagtcttgttgtctaattgtagtagagtatctaggtttagagttgattgcccagtagtgttgtagagactatgacccaacaaatagtgccgttgattacatgctgttatttactcatttattagtgagcactttgtgtgggcttcattactaattgttatgtcaaatatctgtataaataaataatatctgttaatcattgagatgttattctttaaaatgtaattttcagtttgtaaaaagtgcaaagataatgttatatcacaccagtgtcctttgacggctttggcagagtctttaaaaaaattttttttatttccatagatttttggggaacaagtggtatttggttacatgagtaagttctttagtgtgatttgtgagattttggtgcacccatcacccgagcagtatacactgaacccaatttgtagtcttttatccctcacccccttcccacccttcagtcttttttttttgtatgagactttatataggttagtgatatttctccctgctctgcttgcagagaaatcaatgctgtgaaaaataccctgccccagtttatgattattaagtgagataaacttaaaaagagaacagctcatgactggctgatttgaatgtttgtcttatgcccagcctctgttccatggtacacactagtgccagatgataggcccttctgaaaaccttttacaattgtccttgtattttatggcaggatatgttcacagaaaattttctgtaagtcaaaataatgtaaattgaatctgattttcttcacagaaacaatattacattggggattatatctctggcctaaagcctgactttttataaaaatagaaatagctgtaaccatcattttaatcaactgtttaatcagctggaaatgatgaatctgaatactgttcaggagaaaattgtctgaagtatgtttaaaatcagttaacaaggcatcacaacaaccagtcacattaaattatgtttaatgaactaaagtgtcgtagtagactatacaaagtttttgtcataatcactgccttgtttttactgaaactaattagaaggtggtttttcttaaagcagtttctgcaaagtcaaggacttctcacaggatttcttttagtaaattttgataggtatgcttgaggagacttttgggggagactttgaagagacttggtgtttcggctttttgagaaactgaattgagattttcttcatgctttgctttgctcattgtaaattccctgtagcagacatagattttggagaacaaattgttggtctgtcttcattttgattgtcaccagagaagggttaatgataaaattatggttgttgagatctgaaggattattatcagcaggtaaagagggaagagtattctatgccgagggaaacagtggaatactcagggacaagaagggtcctccggcttacctggaatggaaaaaaggccaatgggttataatagagaaagagaagaggagggcaaatgaagttgaggaaataggaggaagagaccagactgtgtataaaactttgcaggtcagaataaggattttaattttcagttctaagatcaatgggaaacgattcaagtggggcctggaggagcaatatggttaggtttgtgttgcacatggttgttgtgtggtcctagctaggttagccctcagggtactgtgcagccatcattcttggcacttagctgagttgtatgagcatttgatgaatgcccggtctcccctctccctatactctaagctccttgaaggcaaggactatgtcttttttactcatcaccctgtctctagtgctgtacacatagtaggagctcaataaatattggttgaatggatgcatcaactgtgttaacggatttaccttgtgacccactattaggcaagggagttacttttttattgaggtgaaattcacataacataaaactaaccattgtaaagtgaacaatctattggaatttagtacatttatattttttataaccacaaactcgtacctagttccggaacatttttatctccttaaaaggaaactccatacttattaaacagttactctgcattctcccctccccctagcacctggtaactaccaatctgctttctgtttttatggattaacctattctgcatatttcatatgatggaattatgcattatgtgaccttttgtgtctggcttctttcacttggcataatgtttttgagattcattcacattgtggaacatatcaatgcttcattcatttttatggctgaataatatttcattgtatggatataccacattgtgtttatccattcatcagttatggacatttgggttgtttccaccttttttttttttgagacagaatcttgctctgttgccctggctggagtgcagtggtgtgatctcagctcaatgtaatctctgcctcctgggttcaagcgattttcctgcctcagcctcccaagtagctgggattacaggcatctgccaccacgcctggataatttttgtatttttagtagagacagggtttcaccatgttggccatgctggctcgaactactgacctcaggtgatccgcccaccttggcctcccaaagtaccgtgattacaggcatgagccactgcaccagactgtttccaccttttgaatagttctgctatgatcatgcatgcacaagtttttgttctgatacctgttttcaattcttttgggcctatgcttaggagtggaattgtggggtcatatggtaattctatgtttaactttttaatgaactgccaaactgtttctcataggagctgaatcattttacagtcccaccagcaatgtatgagggttccaattactccacatccttgtcaacacttgttattttctttttttttttcttacaggctgttcattcacgccatctggaatgcatgaatgaacttccccttatttgcagtgaatatttcattccttggtactttattacatggttatttcacagtatgaaaatagaagtaaaactcaaaggtatattggacagaattggattctaaattcataaaatttgagtccaacagcattctggtacattgctttctgagatagacctgcaactattaggagaaccccagtttttctcttatatactatttttaggattgaagaagcagtctaaaggactaatctcacatccaaagaagtttcttccttctgaacatatgtattggttaaatcatttaacaactcttctattggaggtgtcttttgagagttgcattgagaattatgaggaagccccatgtagtcttatagctgaacgttctcatcataggcaattttctattggtttgacacatttgtatttctacccttctcctttttgtttttgttttgttttagtttagctgtgctcagcatgcagggaatagttgtatttgcttatagtaaatgactgggaaccaagctgagatgtcagcagaacattgtagaatactcaagtacactgactatataaagatcattcagattcctgtccatctgaagtaatcagactatcagtccaccattaatttgaggtctatcagtcctcattaataatgctaccaatgcaaatgcactttaattccattctttgaggactgcctatatttcattgggttctgccatttttcttcccttaagtaatgctataactattttctatttgacagcatgtagaacattttacatcatatccgagtttacaaagtagagtaagaatagacttagaattgtattaacatgttgcatacacatgtgctttttataataatgcaaactggagtgaaatgcattgcagtcaggagaattgagtctttatgaacttttaatttttgagtactagtcataactaagctgcttgcattccactgagcaaaggtttcctaatgaagaaacctacaactactgtgttgtttcatgatttagctgaaagtattattttctgtttaaagcttcctaggcattttttaatgttggctgtaaattcttataatggttctagataccccctatgtgtgctttagaaataccccattgctattttcagtcatacacttgaatagaacttctaactactgtttgtcttatttggtaaaaaacatttgttttgtggaaaattgtttggtttgagggtggtttggcctttagtgtgagtggtgtttttgtgaagtcatgcgttttgaatgtatccactctaataaaaattatttcaaatggctttatctctcctccctgtccctgtgtgtgtgtgtgtgtatgtgtgtgtgtgttttcattttacagcagaaatcctgtgtataggtaagatttgtattctaagaggtttattaattttaaaaattgccctcatggtagttaattctaacctgatttacttgcagttgtttgtaccttggttgctgggaaatggatttcattctgttttatcagaggagtaaacaatttccctagggtaataggcacatttgagaaggcattcattttttcacatttaaagattaccattaagtaaattgctactgtggtgctttaagtgggcatcttaaaagcctgaaagaaccaatgtaccctctagtgtaccaaaattagcaccttgaaggagttttatctagtcagtttgtacttaaacattttttttaaaggcattagcacatgaacctttccctggactttgtgacttttcatgaggttttatttatttttccctccttttctgctttgaagcctgaaattgtttttgtttgtttttgttttggagagagtctcgttctgtcacccaggctggagtgcaatggtgcgatctcggctcactgcaacctccggctcccaggctcaagcgattctcctgcctcatcctcctgagtagctgggattacaggcacctgtgaccactcctggctaatttttgtatttttagtagaggcaggttttgccatgttggccaatctggtctcgaactcctgacctcaggtgatctgcccacctcggcctcccaaagtgctgagattacaggcatgagccaccgtgcccggcccaaacctgcaattttttattccacatatattgtcttctcgtgtgtattagtttgtaagttactctttatcctgaaacagggagtaatttcttcctcacccttgaatgctttttttttgttttaggggactaggctgaaacaggtggcaagtgatgcaacatccaaagccacttttcaagctttttttttttttttttttttttttttgagatggagtctcgctctgtcacccaggctggaatgcagtgatgcgatctcagctcactgcaacctccgcctcccgggttcaagtgattctcctgcctcagcctcccaagtagttggaattacaggtgtgtaccaccacgcctggctaatttttgtgtttttagtagagacggagttttgccatgttggccaggctagtctcaaactcctgaccaagtgatccacccacctcggcttcccaaagtgctaggattataggtgtgagccaccacactcggccggccacatttcaagttttattgctagaaagtccgtccccactagctgggtgcggtggctcacggctgtaatcccagcactttgggaggccgaggcgggtggatcacctgaggtcaggagttcgagaccagcctggccaacatggcgaaaacccgtctttactaaaaatacaaaaattagctgggtgtggtagtgggcgcctgtaatcccagctattcaggaggctgaggcaggagaactgcttgaacccaggaggcggaggttgcagtgagccgagatcacaccattgcagtccagcctgggtgacaagagcgaaactccgtgtcaaagaaaatctggccccactttcccctgcttcattttagatcagattatttagtcaagtcctctccaagttacatatgaagaaaccaatgccaggacttccccaagacacatacagaccgattgatggtagaaggctattaggaccttgatctcctggtttcttgcctctctttattaagctttagaagcaaaaacacccacctgggatcatagccaaatacttaattttatcaatttttggcatacatggatagaaattgtcacaaatacaacactgatctcacctcataaccttgagtgctttgccagtatagctgattgtgaataccatgtgttttttctaccagtggactctagcatagatgtagcccagatatgtagacatgtttgctgagataagaggtatattacagtagcattgcccaaaacatgttgtacagaatgtgatgtcactggattttccttgtgggaagaaaagagttctgtggtcaaaaaattttgggaaatgctgacttacacaaagttaaaagaggtttcttcaagactttatggagcttttactacatgggtatgcattgtgaataaccaggaggaggggtgggcttcccctttctctaaggaacctcattattaacttgttccatgtaattcagtctggggaacattgagtgtggtgtcctgatattcttgccatttatcttactgtggcattcctagttggcagtactcaaaggcacattaaaatttaacaatctaaacaatttttatttatatgtaaggcattactgaatatttgtcgtgctcttctttttatgcttcaatatccaagttatacattacatttcaaacgtcttgctaatttatatagtctcttttaagcatgttttaggaataattacaatcagatcatcagttatatttatagcagcatccagtctttatagtgcacagaagcttcaaatccaaagctttggggagagggaagagatgatggagagacagtgtcaataattccagtgcagttcccaagtgcctgtgtactctgccacaaagggagaaacgaattcctatttttactgtcaggatgtcagatcaacagttccaaaatactaacggtatatgttctggacagcagcctccataagctcctccagtggccctcagttgtcatcaaacatggcacttgtcaagctccctggctaactctagtcctcttcatgaacactgaagaacagtgttttcaaaaccaagcactctctgctagtggaccataattcatcctgcccctttaggcaggggtagcaccaaaatttcccgtgcctcttctgtagagccagaaactttcttgctttaaataaaacatttacatgtgggttatgttgaggacgttgcctagttccatgctggcccagttgctagagtttcaatattcctatagtttgttaacatctgcaaacctcatcctttgttcctgcgaatagtttacagtcatttaaagtgatttctgggtgtttctgttaatcctgctgtaagcagtctcttacgttatgtgaccttattttatagataaggaaatgaggctcaactaagccattttctccaggtctcattttgaagaaaaaaaaaatgtaaataatatttctcagagtcataactgtcttgctttccctgtcctctccagattttgccctgaaagccttccctgtaggaagaatgtttgtttttttttaaagagatggggtctttactctgttgcccaagctggagtgcagtggtgatcatagttcactgtaacctcgaacttctgggcttaagtggtcctcctgcctcaggttccctagtaggtaggactacaggtgtgtgccagcatgccccgctaattaaaaaaaatttttttttcgtagagacaggggtctcactatgtttgaccaggctggtctggaactctgggcctcaagcaaagcattgggattacaggtccaagccactgtgccaggtccaggaagaatgcgccccccgccccgaaaccctttactttcttcatttattcaactaagccatgctccacaatggaaacttgctttttatctacctcttttgttggggatgttaagaaaagttatagcctggatgtgctctttaaattaattacatttacagctcgggcagtttttaagccagtttgctttttgtatggtatttaacagtttacttggaaaaatgcattcattggttttgctggacacactccaacttgtatttgaactggcagacctttctaggaaacatcacttttatagtaatgacactatcactgaaaaaagaaataaaaccctgttcaggtcgtcagacaccagttttacaatattttttcttttgctccagctagagtttcttatctcttcttaaactgtaataaaaattcttctgtggtgatctagaaagtaatttttggatgagaatttatctcttctaggtaatgatgctggtcaaggcatttttctccctaatatccactggcttttttccttgcgattgctagatattactgttggctgctgagatataactttcttacctctgagatatctaaatagtgagaaaagtcttccatccctaagggacctttccacataaaccatctgcttaggcctttgttgcatatatttttgaagcttgaatttactgtattacagtgactcttagggtggagaaactgtatcatagtgaatacttagattatgtctcttcctcttaaactacaactaaaagttcaattcaactttcctccgaagcttattgtttagccccactttttattgtggtccatttattgtaggcagggattagaaaagaacttcccaagatgaggaaaaattactgtgtggtgtaagatactgatatttaaaataataacaccttaaaatacagaagttacaaaggcaaatcaggtctttggagaagaataacaaaaagatatgaaatggtgcaataatggggctaaggccgccagagtactgctttgagctcttaaggaatagactgtcatctgatgcttcctttgctgcctcccatggaagtacaggaactaggcaagccataattggctcacttcccaagttctgggaaactttacaaggatcacaggggttggtacaagttgcttgataatctgcagcattctctctgagatttagctgccattgtgttgccaaatttctgcatgtcagtatgcagatggtcccatctctccctccagcctctgaggtttgtaatctatatttatttctcctcttttcagccaggttgggttttgaggtcttggggcctgctttattcctgctttttatttgcatgtatatttttatccatttcctgagggtaatcgtaaatggttagctggattttcagcctcactgctcctatctttaagagttaagaatctccttatttagagttttaaattttgttaagtgtttggaatgaaaggctgtgtgtagagatgggtagggtgaaagtgaaagggaacttctgaggttttgtatacttgctggttaagtttctgtgcatattgtcaggctttgggttaggaaagattctgttaataagggaagttgagttgctgagaccccaaaggaacactgagagtcgcaggttacttcctataaatggaagaacctgaatcattaaaagataaaattcctgttagaatcttgaatcacagaatgtttacagtatttttgatccatcaactttctattagcaatcctttaatgaagctgcatttcagtctttagagccacaatttctgagccctgaagttcttggagtaagggcatggtgggggaagggggatcagattgggaatacttagaattgattgtccctggtgaaattaaactgctcagtggatcactttgagataatgaaaggtccactctgagcttccaaacaaggcattgttcttatccaaatcctcatggtcagtctttttcttaagtgttgtgcttgctgatttaggtgtttgtgtgaggcttaatatccatttcctgtagtagtttttttttttcaattaaatgtgaagccattgggtaatgcctaattagagaaatctttgtgtttagggataaactttatgtattcatttgtcctttggtcaggtgtttgagaatttcagttaatatgactgtaattaagctttaaaggcagaacaacacaaaatgccccatcagtcttgcttcacttcctttggcaaaaggagagacagcttaatcacttcagaagttgcagtaaaagcaaaatctgaaaagtgcaattttaaggatcattttagagttatgattgtaaattacacattaagtttattcatttttgcttgttataatggagtgggcttggaaacctcagcaatttgaccaccgaatacattgtagttattttaaccaagaagcttaatacactggaaatgtttcctggcactgtagtgatctcctccccatacccccaccccttcagccctagtatggaaatgctgacttctgggagcattttagtagacatctgaaattttgatgaaatgctctttcaattttgaatttggcctttttaagacactatgctgttcaaaaatattcctgcttcagagaagaaaatagctttgggctggagagtggagaaccattttaaatcattgccaagtcttcagattttaataagaaatttttttgttcatttttgagcaaatacttttatttgctgtggttgcttacagaaagcagttcgatgaccaataaaagtaatgctgtaactgccagggattacgtcggttttaagattatttgctgataatccaagtagctttgcattatatcagggcctgtaattctcattatcagtgatctgaataattgatgggagataaccacatgcaaaataaattgtcgaaggggaatcttactttgcgagcagcttaaaatggttggacggaacactgagggttatttgtatttttaacctttggaaagcaaattgtttaaattatttaaagaaatagtgcaagattatggctggcatactaaaaacttgcaggatgttatttaaggacgatcactgtttgaaagagtctgtggcagtaattcttagctgtgcttgcaaattagaattgtcacctggggagcttccagaaaaattaaatattaaataaaagaaccaggcatcagtattgtgtttaaatccactgtgtgaccaggattaagagtcaaagatctatggctaactcataaatataagtttgccagcaaatggaaaggatatagaggtaggctttatttcagatccttttgccagcttttatagtaacagtcttgtattgaggtctctgtttttcttcagttcttatctagtcaggtctggaggcaaccaaggaacaaattttatttccaatggcttttcatttttttatgactagcaaagacataggattttaagatggtgccagttaaataattactgtgttaggttttttattgagaggccattttggggtataaattacttgctttatttttttttacagcattcagtttatactatggaggtataaattaggagtacaaaaggttgatttttatcttgagaaagaaatttacattgctttctctgttaattcatatattgtaaacatattttttaatatttgccatactttattatgtagtgtgatgtgtcattaaaatagagtcagtaccagcatatttccagttttaagaaatgctgttcttaaggacaattgaatgggaagcagttcagcacaggatggactcctaatgaattacaattcattacgaggtgccaggaatcacacactcccactccagactacactgcgtgccatccaaatgggaattttaaaaatgatttctacttagcgtttctctgctttggcaaagacacctacattattcaaaatcacaggaactaacaccactgtttttaacactctatattggcagcaggtgggcaattacattgaatttacttgagttcagcattgctattttttatgtgaaccaaatattattatacagttgcaggaaattccaccagccattgcagtttcatcagcttttagggtgaaacaggcacggaaaagacacctacttcatactaccccacccccagtctcaggcacgtctcaacccaaacctgtttagggtaaagagactgtaaaatgctattttggaaaatgctcaggagtggacattctgctgcttctttcaggcttctgtttcatcatctaacagcaatcactgccgggatgtgcacacacaaaaccccaaacctgcatagtaatttcaatccattttctccaatttaatggagatagaggccacttaggccttattcagaaaagatcagagagatagtgtatgaggaaagctcttagtgaaactggaaatgtcattcaaatgtagggaattaataaaaatatcagtgtgcctaaaaaaattgtattgtgctttttccttttgttctttggcatggaatgtagaagacaattcagaattgggaaagcactagtccatttctgttttaagttaatcagtggttgctgtaattgaggggaaaaatctatattgacagcacatgacatatcctacttcactgattctctacctcctttgcctcttccccctttccacttgtagaattaactaagaacttgtataaaaggtaaccctgcctcatttactctgcagccacttcttccttgtgtgaaaaactaaacagccatatgaatattaaattaaaggttgcaaattgcaatgtatacgtggacttggcattttctgtaattcaaattggtacattataagagtcaggtctgttgtggagaccacagagaggccttaacctgcaacagaaggtgggagctggggtgaagccagataaactatacatctggcaggtgcacacactttcacttttaagttttacaaaatggatattatggaaaatttggtgctcttatcagtaagctgtgtcagaacctgtatattacagttgcaaacagagaagtaagcccctaaatcaaagctaccacttggtaaaggtactgtttactggtttccaggaactgtgtgaaaatttatctatgaatcatttactcttagcatgcgaaggaccttggacaatcagttgttctaatgccttgtctttgggcaggcagataaataactaagctatccagcatagatacttaactgactttttccaggtctccagggatcccacaaattctcttagcacatgccagagtagctttccagagttatatacagcctgaatctcttctacttcagtttgtcccagttactttttgcatgattccctacaaattttgaaggcaatatcataagcttaaatgaaaacgcaaggcaaagaggttttatctgtacttggggggtgatttttaatttttaaacgaagaaataattttccacataccatctacataagatgcacaaattcagactggagtactttcagacattgtagataattggaagactacaagttctaagtagtcttgcttaaaatgattactttgagggtgggatttatacctttgacctttaaatagatcactgaaaggaaggaaaatctttgtgactacatatattaaaacattttaggttggggaattatagttctaaaaaataatgggaatatataaatgggtatttgtttctgtcatgcatcctttgacttatatatgtggtagtctcagatatggtaatatagtaccatacaaggagactgtcccaaatttatataagaaaagggtattatcctgattaaagtgaagagagtgaggccttagcaaaattaaagggtgggataaaatagagcccaatcttgaaacttttaggttcggtgagtctacttattaaaaatgtaaaaggggcatgagaaatatattgtgtgaattggaactttacaacaatgaggctctgagagattgcaaaataaactatcctgtaaagccaaataactagtttctttttagaaaaagtcgatcatttcttcaatagaggcagccattctatttctgacctttacacttatacacaattattttgtgtttagaagtaatctgcattatgctttctgttctctagtaaggtagttgaaaggttgtcctcagtagttgcataataaatgaaatattcccagtccattctttcgtgagttagtgtgttgctagtgaaggttatggttaagattcatttgggctgtggatgaaagaaaaatgattggcagtaaaaatattgtttctctagggtactttctttaatcattttagaattgcactgttgacctcagaacagttggttcaaacagcacttttactaatctttactatgtcagcaagtaagagcttaatggattttgaattccctaacaaggttttctcctctccctactactttctcgccagattatggcccagcatgcttggacaagaattatgggcttggtagaagtgtggacaaatgtgatgaaaaactgaattttttcccttttctcttggtcagtgtgctggagaagagaaacgagttggcacacgcacagtgtttgttggcaatcatccagtttcggaaacagaagcttacattgcacaaagattttgtgataatagaatagtctcatctaaggtaagtttttgttttaactcaatagatgttcatatagtgaatcagataatgcattctaatttgtgcttctgaggaaactgatgcatttatgtatgtgtacatgtatttgcatgtatatggatcatataccagctataataagtattcctctgaaagacagtttatttaaaaaatcactttgtcttgttataggtgaaagatcattcacttgccttccgttatgattcacagtgcttgttgattatgcatattactttaaaccgtaaagtttgctaaaaatacaaattacttacttgtgcaaagcttcctgaattacccttgaatggatgaactaggatataaaagaatgcaaattcttttataaaagaatttgcattcttttggagaatgctgtcctggaatgactttatttgcatttctttctagttcccctgccaacccctccacctcccatcccacttctcaagtattaatagactcctacgtcccaaagggtgcatgctgctcagtacactgcttcagctgtgatctgttaagagttaagtcactgcagctgtgtcaccgtttgactgcatctttcttcagcatagtgtaggactaagagcattggcctggaagtttgaacacctgtatttaaatcctggcccaaccacttactagttgtgtcaccttggtcaaattaatcgccccgattctaaatgtcctcgttggtgaaatggggctaatactctgtgaaaccacttcttatagctcctagtactcagtagtcatcattctgcaagtgttatttagctagtctttacctctggctgaccaggttaggtgctaggttggcctactgccatctcttatagaatggaatagatcttgaagattttcctcacttcctcatgtgccctggcaaggcagagataaaagttggtgacatttggttcactgtacacttgtaatcacttagaaactgaaacacaaaattatgcccttccttaaaaatatatgacattttggttttcaaatatgcatttaatttcttgtttgggcggtgatacagtagtgatcatgttttgctgggagattaacatgtgaaatatggtcaggacaggtgaaaattttgttgcctaatgagcagatatgtaggcctatagaacattttattttggataaaaatgtctatttcctcttaatcttacacactagtggcagaaattttattctcagccagaggttgacatacttatgcctaaaatagtgaatagttcttttactggaaatttcagctcaccttgtggtatccaattaaatggtctgtagtagtcctttgattcagaattgtggacttgtagagctaaatggtcttaagaggttaaggccagagaaatttaggcacatggtcaccaagcagagttagtaataaaaccaggagtagaactactttataaggtctagttgctctgaataaagaggtctttttacatcatcgtgctgtttgggttccttcctcattttttttctctcctcttgcattgtgcttggcatggggcgacaactcaaacggtagctgctattgttatttgtgtttctgtgattattattacaatagtgagtagtactattgatttcctcaagttcatgtgttttgaatgtgtgggatactgtctcctaaatggaggccttcaggtctactccgaaaagaccaacaatttcataatttgactttttcttcctcacattgtcttggctgtttgtatttataccagaattttttaaaggattattttttcaaaatatactgtttatagaatatgttagctgccttccaactttgtagcaagtgttgattttctttctccacccttcagtcataaaaataactatcttaattggatgccgcttttgtttacaaataccaccagtaatgtgacattataaatgttaaggcagggaacactgaagacaaacattttgacctactttaagttttatttgcttataaaagtaatgctttttttgtgggggggagacagagtctcgctctgtcgtccaggctggagttcagtggcgcgatcttggctcactgcaagccccgcctcctgggttcacgccattctcctgcctcagcctcccaagtagctgggactacaggcgcccaccaccacgcccggctaattttttgtatttttagtagagatggggtttcactgggttagccaggatggtctcgtgatccgcctgccttggccttccaaagtgctgggattacaggcgtgaaccactgcacccggcctaatgctttttgtttttttatctcctgggaacacaaatactttctttagaaaaatttggcctctacagcctcacaaactttaatgtactctgcagggattttggaaatcaccagaattttgtagctggtgcaaaacttggaaattcccttctttagcaaaaggagcattgattgtactctgctatgaattttaggatctttagtttccatcatgtttatctgttgtgtgtttttttcctttaaaaattttaaaggttttttttaaaaaattaattaatttttttttttttttttttggtatttttagtagagacggggtttcaccatattggccaggctggtcacaaactcctggcctcaagtaatccccctgcctcagcctccgaaagtgccgggattacagaagtgagtcactgcaccccgccctttgcccagcttttaatggagttgattttttttcttactgtttgagttccttatagattctggatattagtcttttgccagaatcataatttgtaaatattttctgccattctatagattgtctgtttactctgttgattatttctttcgctgtgcagctttttaatttaagtcccgtttgtttatttttggttttcgggcatttgcttttttgtcttcgtcatcagttatttgcctaggctaatgtccagaagagtttttcctaagttttctttgagcagttgactgctaactttattattactttaaatatctactactttatttttacctttttctctttcttttttgctgctattcagacacattaaaagttattcagacacattaaaagttatttggagtctcaagttcctcatctgcatttttaatgctaaaccatcagcatttttaatgataaattggaaatcttgggtaacacagaactggtcaaaacaagtaaagttctaaagcctccttttgcttaaatgaaataattgactctcaaagctgagattctcttcaactttcctcctttgggaaatttgcttagtaagtttataaagttttggtttcaaattaaattagatgatacatatttgaggcagtgacccacaactttttcacataatttcatctttagtggccacacttgtgtacagattatttaatccactacaaagcatatataaaatgcattgtatgtaccgggaaagctggcgttttttgtttgtttgtttgtttttgagacaagagtctctgtcgcccaggctggaatgtagtggcgcgcgatttcagctcaatgcaacctccgcctcatgggttcaagcgattctcctgcctcagcctcccaagtagctgggattacaggcgcccgcctggctaattttttgtgtttttaatagacacggggtttcgccatgttggccaggctggtctcgaactccggactgcaggtgatccacccacctcagcctcccaaagtgctgggattacaggtgtgagccatcatgcccagcccaaagctggcattttctgtataaatagttttaaacatgttctaaatgtctgggctgctttttaagtttatagttgtacttaaagatagtataaaagaggcccggtgcagtggctcacacctgtaatgccagcacttcgggaggctgaggcgggtgaagttcgagaccagcctcggagatggttcaaagggagaccccgtatctacaaaaaatacaaaaattggccaggcgcggtggctcacgcctgtaatcccagcactttgggaggccgaggcgggcagattgcctgagtttaggagtttaagaccagcctgaccaacatggtgaaaccccgtctctactaaaaatataaaaattagccgggtgtgttggcgtatgcctgtaattccagctactcgggacgctgaggcaggagaatcgcttgaacctgggaggcggaggttgcagtgagctgagatcacaccactgcactctagcttgggtgacagagtgagactctgtctcaaaaaaaacaaacaaacaaacaaacaaacaaaaaaaacccaaaaaacaaaaaccacacacaacaaaaattagccaggtgtggtggtgtgtgcctgtagtcccagctactcaggaggctgaggcgggcggattgcttgagcctgggaggcagaggctgcagtgagctgggaacgcgctaccgcactccagcctgggtgacagtgtgagactctgtttcaataaataaataaatactatttactgacgtctccaagcaagaactaacttgtaacaaaaactgaattctcatcattgtgtctaaaaaactgctatacacattttcttcttgtgattaacttttttttttgccatagaggtcatgcttgagataacattgtttttgatttgtagcaactgaccaagctggagaatctactttttagataaacaagttaatttgaataacttgatgtatatggctgtaactcaatttcacttttagttagaaaactctaaaaagtagacttttcttggtctgcattaaaatcttacatttgtattatactaaaaaagatgtgctagaaactaagtttaccttttagttaaaccagtagagtaaatggctagggcacaagttttaataaagatttcttgtatatcttctgtgtgctaaactattgttctaggcacctgtgataaggggacttaggacatgctccatgatctcttaagagctcatgacttgatgaaggagagaagagggcagtcatttcctatgaagggaataatcagaattcctccaggaagcagttcatttaataaaacagtggtcaactaacagttgggacttaaaaacgacaacagcaaaagtattcccttttgatgtgtttatatcacctttcacagatgactctgtaatgcttatttgattaattaaaaactctttaatttgggaacagaagggtaacgtaccagaagctcagccattagcctgttgttggagtttagcttattgttttagaaagttgattttaaataattgggacagttaaaaatgctggtctgaactatgtcagcttcaaagtgactggatcagtggttttgagtggcttctatttttggtcacaagctaccttgggaatctcataagaagtgtggaccttcttctcccaagtgatgcacatccatgcacaattctgcatttattttaaaattatcttccctaaggaacttcttggactccagggtagaacctattctaagttggttattggttgtaatgcagctgttctactgaatgtacttgcctccttttgtgttttttccctgaggattccctaaattttgagcccataagcctttttaaactgaaaggttagtaaattcccatatagtatgtcgtgctctacaacttggcttttcagtcacctcttattaaaggttatgttctcacatattatacagataattgggatgggctttggtaattggtaattggtaaaagtttcatgctaaatcgcacatggtcagaagacgagaactcttaggccaactgtcaaccgcagaactctcaaatgtaaatttagctttttaggttaagaaacatttctttctttctagtttctggtcttactaggtcatctgaaaaattcaatgatttttggtcacttttaagtgattcagtccctgagcttaaggtatcagggacaaagtacgattgacagttggcctaagagttctgcagttgacagttggcctaagagttctggccgtgtgcaattcagcatgaaacttttacctattaccaattaccaaagcgcagcccagagtggtatgttattgattaaaatgaaagccctccatggcccagggttgtgtatacaccttcccagctgtcatggaaattggaggtactcatagggacagagtgactcataggggtatctgttatgatcatcaagactccagaggttagctgagccagaaattaatgtgttcattcattcctccaaataatttatttatttatttattttattatttatttatttttgaggcaggtctcactttgtcgcccaggctggagtgcagtggcaccatatcagctcactgcagcctccgcctcctgggttcaagcgattctcgtgtcttagcctctcaagtagctgggactacaggcgtgcaccaccatgtccagctaagttttgtatttttagtagagatggggtttcaccatgttgcccaggccttttttttttttggcgacggagtctcattctcgctctgttgtctaggctggagtgcagtagtgagatcttggctgactgcaaccgctgcctcccaggtttaagcgattctcctgtctcagccgcccgagtagctgggattacagtgtgcgtcaccacacccggctaatttttgttatttttagtagagacagggttttgccatgttggccaggctggtctcaaactcctgacttcaggtgatctgcctgccttggcctcccagagtgctgggattacaggtgtgaaccactgtgcctggccatccaaataatttattgtctgccttgtaccaggcactgtgttgagtgttgggaaaattgtaaacaatacaggtgaacaacctgctcctatagaactctttgcttatcaagggagaaactttaatttaaaatgtacacatatataactcactataataagtgttatcaagtaagtatatatagggtgacatgagaacacataacaaggaacctaatttagattgggtcagagaaagcaaaggtatgagactagatggttattgtaatgcgtagaatgaaagcttcatttctgaaaaaggttttcatatacagtgcctctaaatatatgcttatgtatatgtgtgagatttcagtttcaaagtgttggacatactaaatatcactttatatgataatgtggacccataatcagtcattactattaagatttttcaagttttcttcataacagtgttcttttttcttcctcccttacagtatacactttggaattttctcccaaagaatctgtttgaacagtttagaagaattgcaaatttttattttctcataatcttccttgtacaggtaagagctccttaaacagccacttaacttttagaaacttgattgctttaaacgaattttcaatctatttctaaccttaaaatgccatgtaattaaaaaaagacattccagagcttattatgacttcttaaagtagaaacataacatttaaagattatcattttgtaaatttctaaagttgtgtttttactagaaaacctgttgagattttgtttcattgttactttctttgaaattttcatggatatcatatttttgctcatcccaggatgacgtgtattgtgtaccattaaatgaaatggaatatatcaaaactgaaaatagttcaaactagtagttttattttgttacataccagtttcagcctaattggaaacttctcactcatcttcctgattaccatttttgctctctctcattcatttactcactgtaagggtgagagcctagttagatcaatctgcttctctgtattctttctactgttttgtgttttaaattttagacagtttaaattgtgtcttccatctttaaatctgtaagctattaaaatcttttcctcgccataattacccctgaaaattttactacattaaaggtactttttttctcatttcattttttaaatgaagcagaaaaatcccattgaagttgctccaatgccctgttgatgttaagtgcttctgttgactcactttgaggctttgagtaaatggtactgtaattgaatttagccttgctacttaaaatcagtctgggatataatatgggcaagagcctattttaatcctgaatgatggaagatttgaaaaggagctcctctggatctatggtcagatgtcttacagatatagaataaactacctagaggattctgcttgaaagaatcattctacttggtgggcagtgcatttcatttcagttcagcaaatgtataccactcacctacctactatgtgctgtgcagtaggacagacaacaaaaatggtagcaggtacaatgaagatcaagatatggcttttctactcttaaagaatttatgctatagctgagaagaccagtcacataacagttatgtattcacttaatgtagtaaagccattcaagaagcattaacagaatgctttgggtatacagtgtaagttatcatttttttctacccaagaggaatttgataaggcttcagagaatagatgctatctgaacagagcctttaaggattagaaggatttacttggtggagaatgctgaactggtatttcagggatagggaagagattgcctaaagtcacagagccatgtagaagccttgcgtacatggaagtatacattgtatctacaacacagggtgtatggcagaggcagggcttgttgagggttggagatgagagtcaacgagttgggagggcagactgaactcaaaatcatcctcccttaaatgtagttctttttcagtatttcctgtgtcagtaaatgatgacaacattcacctagacatgctaacccgatacttggaagacatctttaatattagcatttacatctaactcttggcatttttgcctcctaaatatttatagaacttctttccatgcctgccgctaacactagtccaagcccatcatctttcacctagattacagcaatagcctcctaaatagactccctgccttcactcttgttcccttctaattcatcttccacagagcagtaagaatgatcttttcaaaatgcagttctgttcatgtgacctttccttgcttaaaactttcaaggatttcctgctatttgtgggatagagaatgaacagcttactttggcctagagggccctgcacagtctggctcctgcctccctctccagccccatctcacaccacactccctctcgccactggcttcctttatttcctagagacctgcatatactgttcactgtgcctagaaaactacctttcgtctagttaactcctgtttacccttcagacctcagcatctacacacttgttttactgtctgatttttcctgtaagctgccagctacatgaaggcagggacttgtctccatcttgtttaaagcagtatctctagagctttgctgataatagcacaagcgctgacagaatggtgctcagcaaataggtggtaagtgaatggatatatttcaataaaggggttaatccaagctgggataaaaactatgcctgaatttaggactatttcttaaactaactgccatgtagtttgcttttgttttaatgaaaattaatatttaccctactactggaaagtgttttgtctatgtttctgtttgaaatgtttgcagcatgtaagtgctgcatatgagttaatgacaaattttcattttactttcaatttaattttatttacctaggtcacagtagacacaccaactagcccagttaccagtggacttccacttttctttgttataactgttacagccatcaagcaggtaaatttcttatttacacttgcacctgcatttcagtccaggcttgttggaatttcattgtcaaaggctctttttcatatttatatacagtgggtagtatcctttatggatttattttatatttggttcctcttgaaaacctattaaaatgataggcacatccttaatgtatttccttgtttcctcttaaatatctgtgtatgtgggtgtaaatgtaaaagaaagagcaggtaaaaggtacagcccagtcaggaaataggaggcagattttttaatgcatattaattgtttcagcgtggtatgtctgtgtgaaaaactcccatttttgtggatttttaaaaattgcttaagcctgtagcgagaactcaagggaagaatactttaattttcttgttttttccttctactgcttcagggggtagtaggtagaggggacatttcctgttttttgtcagagctgatagactgccacagattgtgatatggatgtctttgaagtattttgaacattttgtatgctagtatgtttgaaaaattgcagatgaaaatggaaacaggaaattggaggtgaaagggtaggttaacaatgttaatcatgttttgtgtcagtccacagcatctgactatttacaaacatatttttagatgatatttaacaaagtgcttttaaaaagggtaccaaagaagcttgcaaaacaaaggtcttcttagcattattgggaacaagattacctttcctcttggggttatctggtcttatatcttgcctaccaggaactataagaatattttatcaagtgttcagttgcaaaataaagacttttggaatgttcttttccttagactgataggattattttctttaacatcataaaattgctggttccaagaatagcatgtgtggttttcaaaggcttttttactgattcattctgctcccaatactggttcatgttaggacctttatttcttcaccagcatcacaaaatgtactctataaagtgatagcttagcattgtcataaagaggacagaagaagaatggatatagtacctgaggggaaaaagtggggggaggcgatgaagagacttttcaaacagttgtgtttgaaaaggtacagacattcttacaacgaaaaaagacaaaggtatataaaaaaggagaggaggtcatgatcaaacattcatgaacatcctttagatcttttggcttaaatctactttagatgaaaagtccaaagtaaaatgagccattagatctttctctgattacttttaactggaaacgatgaataccaatttatattttcttttgtcaccaagtcagttgaaaagtttagctgttgatctctacaacttatcatagcttctctgccaaaacaatccttgcttgccttttctattattctctgtgggtgagaaataattaaaatactcccttggagatgattactcgaacagtctactacagcatatacaaaagattatatgtaagtgattatggctataagaaaatacaaacccaggacaatcttttttcaaattaaaaaatagaattaactaactcaagagtacagttaaaataaatcatagcctttcacacatgaaaatattaagtctccagtgcttgtgttttcattaatgtttaaagagtggagaaaacttttaacacaacaaagctatttatctaaggagtattttgaaagtgtgtctcagatttgctattaaaatgtgtagcattgtctctttagcattctgagtttaaattaatgctataattataaatatttggtgttgactcatgggaggatatagaaatttattaacagctttatttcattatcagaactcaattatatagttatttttatctttcagggatatgaggattgtctgagacacagagctgacaatgaagtcaacaaaagcactgtttacattattgaaaatgcaaagcgagtgagaaaagaaagtgaaaaaatcaaggtattttttcttagtccactccttttttaatggtaaaaatacaccattttaaagtgtataatttagtgtcatttagtactttataatgttgtgcaaccgttaactctatctagttccagaacattttcatcacccgaaaaggaaaccctatacccataagcagtcactccacatttctccctcctcccaggccctggcaatactaaccttctttctgtccctatggatgtatgtattctgaatgtttcatatttcttatgtgtcctttttgtctagcttctttcactcagaatgtttttgaggttcatctgcattatagtatatagcagcatttcattccttttgatagctgaataacatttcattttatttattcaccagctgatggacatttgggttgtttctaccttttgggtattatgaattgctatgaacattgaattacagtttttgtttgaacatctgtttttaattctttgaggtatatacctaggaggaaaattgctgggtcatattgtaattacgtgtttaactttttaatgaaccactaaactattttccatagtgcctgtaccattttacattcccatcagcaacataagagacttccaaggtagtagtatttttttttttgacaatctcaggcaattgtttattccagttaatcattgtttattatttacccagtaagaccctgtcaaataacatttttgacttgtccatgtcaaacactaattttttggttctcattagattttttaaattaaaaaattatatttttagagcagttttaggttcacaggaaaattgagtagaaaatatagagagtacccataaacccactgtccccaaacacattttctctggctgtcaacatcccacaccagaatggtacatttgttacaatcagtgaacctattttggcacactatcacccaaagtccatagattatattaggggtcactcttggtgtacattctgtgggttttgttaaatataggatacatatccacatagcctacatttgtatatatgtacatatgtatccatagtagtgtcataccaggatagtttcactgccctaaaaatcttctgttctcttcctgttcattccttattccccccaacccatggtaaccagcgatctttctgctgtctctatagttttgcctttcctaggatgtcacatatttagaatcatacagccttttcagattggcttctttcacttagtaatatgctttcaagtttcttccatgtctttccatggcttgatagctcatttgtttctagtgatgaataatatttcattttctggatataccatagtttatccattcacctactgaagggcattttagttgcctccgagttttggcaattatgagtaaaactgctataaacatttgtgtgcaggtttttatatggacatacattttcaattcatttgagtaaatacaaagaagtgctgaattgtatggtaagagtatgtttcgttttgtaagaaactgccaaactatcttccaaagtagctgtatcattttgcattctcaccaacaatgaatgggagttcttgttgttccacatcctcactgggttttgatgttctcagtgctttgtatgttggccattttaacaggtgtgtagtactatctcacttttgtcttaattagcatttcactgataacatatgatatggactttcttttcatatggttctttgtcatctgtatatcttcattggtgagatgctgcttagattttgcccatttttaaagcaggttgttttcttattgaattttaagaattctccatatgcccaacaatagttaaatttccttgcatcatcttatagtaatgatgggaggaagactacagagtgggagggtcaccagtgtttgacatagaatgtcttcctttttctactttttcttttctctattctttacatcctggtcaagggggaacttgtgccgaactaggttaggttaagatctgaagtttttgaaacaactgtagaaactcagcattattgatcagcgtaagaaccaaaggcagactgagtacagtggcttacgcctgtaatcccagcactctgggaggccaagttgggtggatcgcttgagtccaggagttggaatccatcctgggcaacatggcaaaaccctgtctctccaaaaaaattagccaggcagtcccagctacttgggaggctgaggtgggaggatcacctgagcccaaaaagttgaggctgcggtgatccgagatcgagccactgcactccagcctgggtgacagagtgagaccctgtctcaaaaaaaaaaaaaaaccaacaacagtaacaacaaacaaaggctgcctaaatgattcatagcatccaatctgttgttcccagtacactacgtaaaattgcaaagcaggcaaaggcctcttacatctctccctttctttcatttcctctttctgattttgttgacactccaccccactcccctttacaaaggcccccatttttcattttccctccaccaagcttcttttccttgaggctgaactcaaccaggtataatcttgattaaataaatgtgaagctattgtgattaaattattgtgtgagatgctatttgatgtagctgtttctggagtgtaagtgtgtgggaagagatgcttattagccagcagtctctaaatagcagattgcttggctggggagtcgggggaaagagtttgttgagactccttttgagcaagagagagacttggtctgcatccttagtgtggtggggagtctttgaagtgttaaagccggagagtgacttgatgatttttaaaaataaaactggagtgaggcaaaatgaaagcatgaatgtgcaatcagagagatatagcttaggcaaaaaatgataagggcttatattaggatgatagtagtattgataacaataataaaaatagtagtcaccatttatatggtatgtagtatatgccaggcagtctttttttacattctgttaactcatttaaccctcaacaacagccatatgaagtaggtatttttattatcctctctttacagatgatgaaaccgaggcataaggaggttaaggaacttgcccactactagtaagttggaaagctgggatttgaattaaagcaagcctaggtgtagagtccatgctcttaaccacaactctttactacctgtttagattttaagggaaatggatatattcaggatattttttggaggtagaataatcaggatttagtgatttaggatgtagtgggtgagagaaacagaaaaaaaaaaaaagaataattaagatagccttcctggttttggcctgagcaactgagggaattacatagtgctattaaagaaaatgctagtgcttttaaataagatgggaaagcctaggagaaaaacagatttagggacagaggtgggagtgaagagaaatcaggaattcacttttggctatgttaagtttgagaaacctattagacatacagttggagttgtcaatcctggagctcagaggaggtgttttaaatagaagttgaaatttgggtgtcatcagtctgtacataccgtatgatgccatgagactggatggaatttcatacagcacagagaatgagacttataataggacttgaggaattccattgtgaagacactattatttttaatggaaggagtattttttggcgtccgaaatatcagaaactagatatagtaagacacctctcaatcatatgtcatgctttagtgccaaatagaaataaaagttatactctagtacttcaaccaatgaatcaaccaaaatatattgaaatattgtgctgagttacagaagggttacaaagaatgaaagagatggttcatgctctcaagaagttttatagtttagcttagtagtcatgccacataatgctaaaagaataaaaatacaagaccataactggtcagaacccagtgagtgcgtctgaaaaaaaaaaaaaaaaactctgaatttagagaacgggaatgaaaacagttttctcacatgagatgggcatgaaatagattgtaaaattcagagaggcagagtgtgaaaacatatggattggggcagagaatgaggaacaatgctaagaggtaaagaagctccttgggtaaaaatgaggtgttaggttagatttagtaaaaggagttgatttgaacatcttttctaatataaatgtttaatgctataaattttcctccaagtattgctttagcaacagcctacaaatttggatatattatgtttacattttcatttagtttaatattttctgatttctctttaattcttcctcgattcatgggttatttagaagtttgttatgtaatttctaaatatttgggaattttctggttattattattttgttttgagatggagtttcgctcttgtcacccaggctggagtgcaatgccacaatcttggctcactgcaacctccacctcccgggttcaagcaattctcctgcctcagcctcccaagtagctgggattacaggcatgcgccaccatgcccgactaattttgtatttttagtagggatgaggttttaccatgttggtcaggctggtgtcgaactccgcaggtgatccatccaccccggcctcccaaagtgctgggattacaggtgtgagccaccgtgccagcctagatacctttttgttattggtttctaatttaattccgttgtgttcagagagcatattttcattttctcattcacaccctttgtgttattgttgtcatacgttttacttttacattttataaagcccacaatatgttactatttttgcctgtgagttgtcttttttggtaataaaatatataaaataaactttaccatttaactttttttctttgagatggagtttgctcttgttgcccaggctggagtacaatggcgtgatcttggctcaccgcaacgtctgtctactgggttcaagcgattctcctgcctcagcctcccaagtagctgggattacaggcatgcgccaccatgcccggctaatttttttgtatttttagttgagacggggtttctccatgttggtcaggctggtctcaaactcctgacttcaggtgatctgcccgcctcagcctcctaaaatgctgggattacaggcatgagccaccgcgccaggccccatttaaccatttttaagtaaccatttttaagtgtacaatttatttatagtaagtacattcacaatgttgtacaaccatcaccactatccatttccagaacttttccattatcccaaacaaagctctattcattaaacagtaacttcccatttctcccttcctcagccccttgtggcctctattctattaatactttttgtctctatgaatttccctatcctcaatactttatgtaagtggagttgtacaatacttgtccatttatgtctggcttctttcacttagcataatgttttcaaggttgatccatgttatagcatgtatcagaaattccttcctttttaaaggtgaataatattccaatttatgtatataacagtttgttgatccatttatatgttgatggacatttgagttatttctaacttttgactattttgattaatgctgctgtgaacattggtatataagtatctgagtttttccctttgattcttttgagtatataacttagagcagaattactaggttgtaattatctttttaaaacctttttttttttttttaagacaagagtctcactctgtcacccaggctggagtacagtggcacgatctcggctcactgcagcctctgcctcctgagttcaagtgattcttctgcctcagcctcctgagtagctggggttacaggcatgtggcaccgcacctggctaatttttgtatttttggtagagacggggttttgccatgttggccagactggtctcgaacccctgacctcaggtgatctgcctgcctcagcctcccaaagtgctaggagtatgggtgggagccaccgtgcccagcctaaaactgtttttaaaagattaacaataagaactatattttatatttacccacattttttcatttccctatgcagatttaaattttcatatagtatcttattttttatccatgaagagctttctgtagtattttatagtgtaaatctgctggaagtgaatgttcctatggaaaagtttttatctcaccttcaattacgaaaattatttttctggctatatagaattatgggttagaggggtttttttctttcagtactttaaagatattactccattgtcttctgatatgcatagtttctaatgagtctttcatttctattcttgttcttgtgtatataatatttctttgatgcctttacatttttctttctattttcagttttcagcagtttgactatgatatacctacatttttttcatcgtagttatccttctcgaagttctcttggatctattgtttgtcggctttgattaactttggataattcttggtcattatctttttgaaatattttttcagactcattctctctattcttccggtactccaattacatgactattatactgtttgatattttctcctttgagtaatttgttgtttttttaagtacactcctttttctcctgtttatatatcactttggataattttagttgctctgtcttcagaattagtgattatttcctttgttgtacccagtccactagttgaaggaaatcttcatctctgataacatggttttcatttctgactttacattttcatttttttgtagtatccctctgccagcattcttcgttcactgttacatgttgtctaccttttccactaaataccgtaccatttaatatcttttttttttttttttttttaagagacagggtcttactctgttgcccaggctggagtacagtggcgcagccatagcttactgcagccttgaactcctgggctcaggcagtcctcccacctccatctccagagtagctgggtctataggtgtgcaactacacttggctaactgttattatcattttttatagagatggggttctgttaagttgccgaggctggtctcaaactcctggccttatgcggtcctcccaccttggcctcccagagtgctggtaatatagatgtgagccaccacaccccacccatttaacatcttaatcatagctgtttttaagtccctgtttcataattacaaaatctggacattttgggtctggtttcatggactgctttatctttcaatgatggctcattttttgcttgtgtttttgtgcatctcattttttaattgaattttgggcattgtatgtaaaagaatggtattcactgaggtcagtggtatatgtgttctgaaatgggcctggcttcttctgtcaggccactagtgttggcggttgagtcaatctagtcaacagttgggctggctttggtttttgatgtttttaatgtgtcacttaacttcaaattccttaagtggtagaatgccattaccttgagctttgtgtggggcctggtgtgccggagagttttttatggtgttcctgttatactatctgctttcagcaacatcctatattcccgagtcccagaggttgcccctccccgccccacgttcccttgccttttctccagtggtagactgctatttcttgtttgttactcagtgtaaggctcttggcaggaacagaatgatttcttggttttctcattccaatcacaatattaagcaggccatatgcaccaaagcctcagggtaagactttctcaatatcctcccccctcatagtaactgaacttctaccttgtatcagcaccaggttattggtatgataggtttcctgtccaattccctgtagcaggtcccatcccctgtagcaggtcacttttgtttctacctctcctctaacagtagtgatgtttccctgagactatgccagggaaggtttcctgcctttctcctagatgcagatgacatttgcttaatatgagaaaggggtctatgattctggcatggtttttttgtgcctatttcttcacagcagtcaccacctgtatgcccgtgccagtgagaaaggttcttttaggtctcctgcctgtatgctttctcatgaacactcagtagaagcctctagagaagagctggtgaatggttgtggtctcttcttgtctctcaggcttgtagagattctgaactgtcatactagctcacacccagtctttaggaattggttaaaaatctagttgttttcttcttacccactttcatggtagccatctcttccttctatgcttggtcagttatgaaacagttcatctgtcctgtctctcctcagaaacacttgttaccctttgaaattcagttcacttggttgctttgcaacctcagctctctgatggactaaaaaatacgtatttgtttttagattatccattttttcctaatgtttgtaatgggaggtggtgatgttctcttgtggcttttaaaatggtaaatagacctctagagttcattgtctaactagatcatgttattccctgtctttaaaagtcctgtacctatccttttacctttagagtgaggcctaaatcccttaggctggcctgctaagccctttgtgatctgactcatacccatcttgtcagtctgagcttgcactgcagatataggggcctttatatttcatatctgactacatcctaactgttgaaaaaatgctctctttgtgtgttttatttatcaatgcctgagagtcatcttccgacctctaatgggtatctccttcttgtaagatgtgttaggattctgtttgttatctctcttctgcatatttaagcataaattgtggttttgtgtaagcaacataagtgtttatgtaagtgaggaaggaacaatccaacaaaataaaatattatttacaagttagttcaattattgatgctgttgatcttggctagtgattaagattggcaaagaaaataaaattcttcctgaataggtcttgaaatcctcatctttatctgccgaatcatattgcaaatagaagttgggtgttgcatgtattacctagcatttcacagtcagtgtgtctaggtcagtgtgccaaatattgactcccttctaaagtgggttatcttctgcatccagcagcctcttccctttacctgaaggtgctgtacaaaagtattatttataattttcaatatgtaccatggtgtgaaaatcttgggaaggaccagactggaggatttcttatatctttccaaaaaaatgttatgactcttcataagttgggagtaaagtagttgcaggatgttagtaataattataattaacacctttgaagtagttaatatgtgccaggcactttgctcagtacttttcttgtatcatcatttcatgctcacattaattctctgaggtagttgcaatcgtctaagacacttatttaaggtcatatagttaagtggcagagctgggatgagaagtcaggttaaagagtccaaacttttaatggttatgatttacttaaccctacattattaaattattcatgatttcttctctcaggtttttcctttccttgagctttgggtacttgctgataagaaattgtttctcattgctatattaagtgattctcctgacagcagatgaattcatagaaagtgacctatagaaaaaaaaaattcaaatattttgggaaaaatcaatgcctctctaattaactgggattttctgagcactgaagaaggacctggcacccaacaacacagttgttaccacatggcaggcaaagtatgttgaagtatgcgtggtacagagtgggagtgtggctgttcagtgttcatgaagtgcccagtttgtgacatgttgtagattttcttgattcattcatgaagtgataatgtcattgtcttatcaaacatttgtgcaagaaatatcagagagcaaacggatgtcagaatcatttattaaaggtaaaggtcagtgctaaggtaatctgaaagcatcctaagtccttctaaccttaaagaggattctgaatattgagtaatattctttcatcacctttcacatgatgtaggatgctgagatactctcaaagccccagagctagagataatctcttgctaatgttttgacttttgtatgagtgtaatgaatgctttgtttggaatttaaaatatttatatttatttctcaattccaggttggtgatgtagtagaagtacaggcagatgaaacctttccctgtgatcttattcttctatcatcttgcaccactgatggaacctgttatgtcactacagccagtcttgatggggaatccaattgcaaggtaacagactaaaccttgcctaaacattttgatctcaggatagttaatcatacaatactgcctcccatcaccctctaatcttttattttttcttatttttattttttcttaggttttatatttgaaaagagctgttatgtaattgttttttaacttctaagcaaacactcgtgtttgggtaaaagggtggtaattacgtgtggaaaaactgagccccaagtaaaagctaccacaatttttatagcactgcttgaatttaatattgacacagcctatttaatatttagactctaaaatgggagtaatcataggcttaaactgtgtgactatacaaataacttcatgtatgctaaccttacaatttgatctatttttttctaaaatgtatattttcattaaaaatgtatattcttgggatgtaggaaacccaacctggagtaatttgattgctatttaaaaataatacttagggctgggtgcggtggctcacgcctgtaatcctagcactttgggaggctgaggtagacggatcatttgagttcagcagttcgaaaccagcctggccaacatggtgaaaccctgtctctactaaaaatacaaaaaaattagccgggcatagtggtgggcgcctgtaattccagctactcgggaggctgaggcaatagaattgcttgagcccgggagatggaggttgcagtgagccaagatcacgccactgcactccagcctaggtgacagggtgagtctccatctcaaaaaaaaaaaaaaaaaaaaaaaaaaaaaaagatagggtgtagtttggaaaatgtttgctttataagtaagttataaagcaacattttatgtacatataacaaattataactcatttataattgcaagtgacttaaagtaaatttggccaaatgggggtaacttatttccctcatacactttctggcacagtcggttttcttggccatggtccagagctccacagggcatgaagatgtatcctctctatgctgcctttaaggagggttactcatgtggctcacctctgggtatgtccttggagggctcctctgtttgtttattccatctggagttgaggactacgactcagtatgtaaaaaagaacctttacctgttggatgactaattctgtatttcaaaagcatggtaatgacctgcttttaaccttttcaaaaacaaagttataatttagggaatgtcaagatataaatcaagaaatctacataaagatttcctgatagtgaaaaagttgtttggagtaagaaaactttcagatagtttcttttttcagttaagttgttctgatcaaatcagctaaaagtacagaggttttcaaaatcaggagatagttttaaatatagttcagacattgccgtaatatttcccccaagatgacgacaacagctttcccttctgcctaagtggtgcgctctttgagtctgctttaacccttgtttgatgatttataagtgggttcattggcgcctgccttgagttctggatgaatcaagtgcataatatacactagtagaatattctaattatctgactaatgcaagacacgtcatctccctgccccttgtacaaaatgtatccatattgaacattttcaagatcattaattaagctatttgtgtaatggaactattaatgatttttttcttgctgttggcaaaattttagcatttttgtgaccaaaaaggttatgttcaattcatatgtgtatatctccattgccatacactatagtgagcaaaataataagtctcagttctgtaaataggaaaaaaaataaatgtattaactttttcacgtggttttagttaattatatgcatgttgtgaatagaattctctcagctgtccatgtcaagaagagcttttaggtttttaattgtctttgaaaccctccttgcggcaggttatctttctaattatttgtaatatattttcataataataccataaaacttattagtgggaaatgttaatatttgtttattctgccaaagcctcttactaaaacataaactaaatttgtttctgaaatcagttgggtgtatgattatgaaaagaaagtttttttggttttcactttttcttctgctttcaactagacacattatgcagtacgtgataccattgcactgtgta

SEQ ID NO: 3908 - DNA, 5669 bp, human
aggccacagactgggagaaaatatttgcaaagcacacatcaaaacactgacttgcacccagaacatacagagaactcttaaaaactcaaaactgcaaaaagaaacacctaaaaattggcaaaagagttgacaatttgcgaaggggatatacacatggcgaaaaagcacaggaaaagatgctcaacgccattacaggttagggaagacaaactacaaccaggatgagggcccgaaacacatggcttcagaatggtgaaactcagcaacactgacgaggccacgtgcctgggaggatgcagaggaactgggacactccagtgttactggcgggaaggcaggtggtacgggcactgtagaaaatggtttggccatctctgatgcagttaaaagcgcacttcccgtgggacttggctgccccactcctgggtataagatttacccccagagaagtgaaagcgcgcagccttgtagaaacccacacaccagtgtttgtagcagtcttgtttgcattttggatagcggccttgtttggttttcacaaaccaccctcagcggacagtcagataaactgtaggcatccatacaatggaataccactcagaactgagagggaacgacctgtggatacagggagggaacaacttggatgaatctcattagagacattatgtggatggcgggaagccagtctcaacaggttacttgtctcgcgatgccatctacataaagttccagcagagacaaaagtacagtgacagagaacagatcagtgtttgccggggctaatggtggggacggtgtgatagtgaagggacagcacggagagttttgcagggtgacagacctcttctgcatcctgccaacggctgtgcgaatctacttgtgtgaagactcagggaactcacaccaaaggaagacggtcacttttcctactgtatgatagataattaataaaaagggagaacggaggagtgtcgtcccaggaggcagggcaggagggcgaagacgtgtcacaggggagcctggccaagtggcgcccccggaactcgtcctctgggcttgtgtgtggatgagacaaggtctacctggtacgacagggacatactgggaatgcgcccttgccgtggaggcggggacccggcagcgctacgtatccagcatcaacctgtatccagcatcaacccgccaagttcactaacttggtaggggtgaggttagggatccttaggagcccaggcagccagactttctggggagcccattcccatttgtgttgccaaagtacccccagcaggttgtgggaatgttgcctgtgaagagagtctgttggggtgagatcttgtgtgtgtgcacagggtgacagttgtgtcccatttcccgggaagctgtgatggcagcagaacctagaggagcctgagagagtgtgggagagtgggcctctggaagagtagaggctgcggagccaggtgcagggctgtctgtcacccaaaggaagagggactgatgactcactgagcgtgtgtgtcccctggtggcagcaggccccatagtgaacataccataccttttctgtcctgagcgatgctcccagcagtcctgggagatggaacggtccttattcggctcacgggaaggaccgccttaactggacagacacagcaaggtgctaaagatgccttccatcagaggccaggttggaagctctaaagagacttctcttgctgttctctcacccacccccaggttgtgtgtgtcccgctgtggattctcatgtcctttctgtgcctggtggtcctctactacattgtgtggtccgtcttgttcttgcgctctatggatgtgattgcagagcagcgcaggacacacataaccatggccctgagctggatgaccatcgtcgtgccccttcttacatttgaggtaagcgttccacgggaagcctcttcagcccctgaagcttgcgcttcccctgacaggattctgcacccctagaaaggcagcctctgtccctcgagctcacagtgagcccactccaggagaggggagagaacacagccatctccgagagggagcttcggtgaaaggagagcatccttcctttctcttgggggcagcacgtggggctggcagggagaagagtgcacctttttagccatggtgcctctgtatggctccagtttccactctggggaaagcagagtgggatgtcagatttgtgtattggagtcacgtggagaattctagaatgggagctgttgactccttagaacaaacacccggaggagtttgccataaaactgctggcactgggaacttttcaagtggataggctattgccgagctctgaagagggacataaaagctcatttcgagctttccccagggataggtggtttcctgcctttttctggcggtgctgatgttccctcttgtgggagctcacgcgggggtggggtggtggggaggaactgcctaatgaagtctggcttccgcctctgcccattttcggtgctggcatcaaccgggactatgtctctttctttagattctgctggttcacaaactggatggccacaacgccttctccagcatcccgatctttgtccccctttggctctcgttgatcacgctgatggcaaccacatttggacagaagggaggaaaccactgtatgtactcagcatttcagaagtccttggtgtgtgtctggggggggaccagggagtgggggggggggcggatagaagtctaggaagggatgagtccccgagggccccaatttagaagcttgtgtgggaaagtgagggctgaggaaattctgggaccttctaagggaagggcatgccgtaactctggtgttctgctggcctgcaccgggacttttctcgcagtgcacgctgccatttgaggtagaaccagacacggcaggcaacctctcagagatcccgttccctcctctgcaaaatggggatcaagacagattcttcccaggcccgggagggtttgatggaaaatccacatctcccacccaaacctgggattcatcctaggtccctgttggcctctctgcctcccccatatccttgctgccatcacccgagtcttgcctgtcttgccttgctaacactctattcccctccacctgcttgctgaggcagacacttccaaaacgatctctgcagagggtgccttcctggcaaggctgtgggctccatggcacggaagcccagagcattgcccttcggaaagccagtgggtttgggggcagggcctcactgcagcccagcagcccgggctgtgcttgctgtttgtgcctctgccccctaccccgcacccgggagcagggagggcttgcaccgagctgacactccagtagcctacagagaggagtagtgggactgggaaagtggctttaaggtggctccatgagttcaggccccctcctggccaggacccgtgcatgactaccgccctcacggattccagagggtgacagaaatcttgttcttgggtggcactgtcatccatgagtttatcctggctggagaagattagcggaagacaccgtagtctgcgcaccacagatattttgagactcactggagcagtagttctcaaacttgggcatccagcagaatcccaaaagggccaggaaaaggggaccgctggagcccaccctagcccgactcagtttctggaggtctgggctggggcccgagaatggcatccctaactaggccccgtggacgctgtccctgccggtccgggaaccccactccaagcaccacagagctagcatttgcacttcttccccattttgggtactcaagccctgttcaggctttgtgactcaggagtctggataaagtatgttatgacattgtaggagtgaaacttcttgttacggaaagaaagttaacaggaaggtcagttgagcctcgtgtgtgaaataaaaaattcttatttttcagggtggtttggtatccgcaaagatttctgtcagtttctgcttgaaatcttcccatttctacgagaatatggaaacatttcctatgatctccatcacgaagataatgaagaaaccgaagagaccccagttccggagccccctaaaatcgcacccatgtttcgaaagaaggccagggtggtcattacccagagccctgggaagtatgtgctcccacctcccaaattaaatatcgaaatgccagattagatgccacttccggggacagagcttaagtggactgggacgcactctctccgccttcctctgccccctcgttcaccccgcagaccagaaccagtactggagctgggtctccaggtacgtccatctcatgccttgtttgcatccagcgcctatcagccactcaccacgacgggacgcggaagtggcaggtgacgggggtgtgtgccagcagatgcggatgccaggaagagtgtgagaacaggggtgggattaccgtctgtctgggaggggctccaggtacccctcttccccgtcagacccactgggagatggctgcttgccaggcccccagaaggaacatctgtctatacggtgctgaaatcccaatcaaaagtattgtttagaaatgtatttctccacagggctgacctcctgcagctcgctgagcactcccaggtcctcagcactcccaggtcgtggctggggcagtcagtaggaactgtaactatgtctctgatgcaccacgtgtttagacacagcacagtccttttttctgttcctactgtggaagtagtttctctttgggcatgctgacagcagtttttcatagcctcacggatgagccctttctacgggagtgactccatgcttgtatacagagtatttatacaaatgttttagcatcttcatatgcggtgttaacccctagttctgtacagcatattctgttcaagtatttttttacaagcttgtgctgtaggcacatgccttctgctgcagaagtggacgcccgtggcacactccccccccccccgtggggtgccacgccttcatgggacattgccacttctgccctggaactcgtgcaggtacgtagtagctgctactgccagaacggcaacaccaagcaagagatggtccatgcttttctgacgttctcagaatagtggctagcttcaaacctgacaagcgctgcttgaagccggaacactagagaatgttgctgagagcagaaacggccacgcgggtcacgactatgcgtgggaaagtctcaagcttccctcctgccagcaacaagaaggctttggagtaggcatgatgttttcacgtgtgcgtgccgtttctccaagcactgcaggttccaccgtgtgtcagaggctgcaagtttaacatcctcctgcctgaaaacaaataggtcctttgctgaaaagagggtaaaaaaagagctttgatcttctcagccaggagaagagggtggtgttttcacgcgggcaactgctcgccggcctacatggggttaattcaagtctgctgcgagcacgactccgcccttggcactggcctccagcaagccctgttctctttggggtacaggggaacgggatggtttagactttcctgctcagtgtgtaaaaaatgtagctaaagccactatttttgctctccttaagctgttcaataaaccggttcctcattt

SEQ ID NO: 3909 - DNA, 1568 bp, human
ctttatgatgtcatggggctggttacatgactgccaaggggtgctgctggccacactgcactagcaagtttgccagatggaggacaagcgatcattgagtatggctcgctgtgaagaaagaaattcgagaggacaggatcatggcttggaaagggtgcctttccctccccagttgcagtcagagacctaccttcacccagcagatccttcccctgcctgggacgacccggggtccactgggagccctaacttgaggctgctgacagaagaaatcgctttccaacctctggccgaggaagcttcgttcagaaggccgcaccctgacggtgacgtcccgccccagggagaagataatctcctctccctcccctttccacagaaactgtggagactggtcagcagcaaccagttttcgtccatctggtgggatgacagtggggcttgtagagtgatcaatcaaaaactctttgaaaaggagattctcaaaagggacgtcgcacacaaagtgtttgccacaacttcgataaagagcttcttccgccagctaaacttgtatggcttccgaaaacggcgtcaatgcactttcaggaccttcacccgcattttctccgcaaaaaggctggtctccatcttgaataaggtaatgaacgacaagcctctggaggggttaagtcggtgggctctggggcctggtcgggtggaagtcccaggactgcctcctgggaagtgggcgacctcaggcagggtgtggggccatcgctgtgggcctgtgtccccctctgggtggaggtgacatgaactaagagtgaatgtggggagagggctgaggatggtgcgggcccctctcgagtgtgtaaaatatcacaggtgccaagtagccgtatctgcgtgtcgtcctccccggggccagccatgtcatctggcggttgctgtgtccccctgactccacagcacattaccctgtgaggtgagcaggccaggggagtctggtatttgtaccactgtcaccctagctggtgtctggagaggtgctcaagtggaagcactgaagggcgcctggcgcaggaggtgcagatgctcctgctgcccttggtaggtgggcccctggtgtggaagagccagtacccagggcctccaacccagccggggtgcattctgttgccagctgacactgcatgggggaggcccagaatcttcttccctcctggtctgcaacttcaaagaccctttccgccggccatggacaccctaatctgccattttgaggctttttccaagacggaaaggcccgccacaacttggtaaaccttgacgatgtgaacgcgagtccccagcttcctttggggactgggaccttttccagaaaggcctcctgggccagtagagttctcttgcacaggggcgtagatggttggtagttgtagtccatccttgtgacttgcagtttccttttgtttatttaaactttgacttatagttagagttctactgccatccttactttcaaagagactcccctcacctcctcgtgaggatgaagagaagagtgggtgtcaagtctgcaccaa

SEQ ID NO: 3910 - DNA, 2802 bp, human
ctgcctccgactccccactggactgcatggcgacggcgtgtggtggggcagtcagctaagccatttgcctaaggggctgtcgggcatctgcgtgctggggaccgacagtgtgggtgtgttaggaggatctgtatggagcacattgctgcctctggctaggacagggtggaaagggtggcgtggctacagcctgacccatgggcaccgtcctaccctttgttctgtgcttccgagtgtcagtcatgtgctggggtctgtgggcccatgactcagacggtgagctctgaccttcctgagccagggctttgctgtagttgtgcctggctcaggagctctaggacaaggggaccgctccaggtctgcatctacggtgtggcagggcccctcggcactcttgtgcactagtgtcatctttcccattgaaatgactgtgaggaccagaatgtgcacatgcagatgggcagctacttgtctgccttggccctttattacacaacttgctgggggtggagatgccaccccccggcagtcagagcccctttatgatgtcatggggctggttacatgactgccaaggggtgctgctggccacactgcactagcaagtttgccagatggaggacaagcgatcattgagtatggctcgctgtgaagaaagaaattcgagaggacaggatcatggcttggaaagggtgcctttccctccccagttgcagtcagagacctaccttcacccagcagatccttcccctgcctgggacgacccggggtccactgggagccctaacttgaggctgctgacagaagaaatcgctttccaacctctggccgaggaagcttcgttcagaaggccgcaccctgacggtgacgtcccgccccagggagaagataatctcctctccctcccctttccacagaaactgtggagactggtcagcagcaaccagttttcgtccatctggtgggatgacagtggggcttgtagagtgatcaatcaaaaactctttgaaaaggagattctcaaaagggacgtcgcacacaaagtgtttgccacaacttcgataaagagcttcttccgccagctaaacttgtatggcttccgaaaacggcgtcaatgcactttcaggaccttcacccgcattttctccgcaaaaaggctggtctccatcttgaataaggtaatgaacgacaagcctctggaggggttaagtcggtgggctctggggcctggtcgggtggaagtcccaggactgcctcctgggaagtgggcgacctcaggcagggtgtggggccatcgctgtgggcctgtgtccccctctgggtggaggtgacatgaactaagagtgaatgtggggagagggctgaggatggtgcgggcccctctcgagtgtgtaaaatatcacaggtgccaagtagccgtatctgcgtgtcgtcctccccggggccagccatgtcatctggcggttgctgtgtccccctgactccacagcacattaccctgtgaggtgagcaggccaggggagtctggtatttgtaccactgtcaccctagctggtgtctggagaggtgctcaagtggaagcactgaagggcgcctggcgcaggaggtgcagatgctcctgctgcccttggtaggtgggcccctggtgtggaagagccagtacccagggcctccaacccagccggggtgcattctgttgccagctgacactgcatgggggaggcccagaatcttcttccctcctggtctgcaacttcaaagaccctttccgccggccatggacaccctaatctgccattttgaggctttttccaagacggaaaggcccgccacaacttggtaaaccttgacgatgtgaacgcgagtccccagcttcctttggggactgggaccttttccagaaaggcctcctgggccagtagagttctcttgcacaggggcgtagatggttggtagttgtagtccatccttgtgacttgcagtttccttttgtttatttaaactttgacttatagttagagttctactgccatccttactttcaaagagactcccctcacctcctcgtgaggatgaagagaagagtgggtgtcaagtctgcaccaagacatcaggaggaggacaagccagaagctgctggatcctgtctggcaccagcagacactgagcaacaagatcacacgtctccgaatgagaatgaccaggtcacaccgcaacaccgggaaccggccggtcccaacacccaaatcaggagtggctctgctccaccagcaactcctgtgatggtgcctgattccgccgtggcgagtgacaacagtccagtgacccagccggccggcgagtggtcagagggcagccaggctcacgtcactccggtggccgctgtccctgggcctgcagcgctgcccttcctctatgtccctggatctcccactcagatgaattcttacgggcctgtggtggcccttcccacagcgtcccgtagtacccttgccatggacaccacaggacttcctgcacctggcatgctgcccttttgccatctctgggtaccggtgaccctagtggctgctggggctgcacagcctgctgcctccatggtcatgttcccccatctcccagctctgcaccaccattgcccccacagccaccgcacgtcacagtacatgccagctagcgatgggccccaggcgtacccagactacgcagaccagagcacatagagggcagcatttgggcagaatatgtgctggtcaataaatgtgtcagaaaatgagtaattttctgactgcacaaaaaagt

SEQ ID NO: 3911 - DNA, 5669 bp, human; identical to SEQ ID NO: 3908

SEQ ID NO: 3912 - DNA, 35352 bp, human
ccggtcgcgtgcggacacaaggatggggacctcccagcgaggagcgctctgggcggggctccggacgcatgcgcggccctcgtacggaagcccggaaggaggggcagggggcggtggctcaggtttctccgggcggcggcggcggcggcgacggcgacggcgacggcagcggggacggcagcagtagcgggagcagcagcgtggacgcggctggcgctggcgccatgaacccgctgtaaggcgcaggctgtgcagcacggggtgcgggggaggaggaggaggacgccgcggtgaagttctccgccatgaacctgaggggcctcttccaggacttcaacccgaggtgaggcggcgtcgttggcgcccccgggagtccgcgctgcgggctcgggcgcgggctggtgttcggctccggggaggcacggcgggcgagatgctgcagcccgaggacccgggcgcctgcccgagcctccctgcgggtgcaagcggtccccaggcaaaacagtcggcctcggcgcccgcccgcttcctcctcccgtgcccggtgctttcagcccctgcccggccacggccggaagggcccggccgcgagccccgtcctgccccaagggaaccccattcttttctgcttgctgtccctcattggtgtcccaacttcttcgtctcggttccatcctcttctgcgccgctgcgggccctccattctccgcgtcagggccgtctcactcgacccaacacccctacccccaccccagctgtttcctccagttcctcgcagtccttggggttttccttgggtttatgcccatccctctcttgtttgcttctttgttgaacggatacctgaaacactgttgaatccttggagtcagtgtcggggtatggcaataccttatataatgcatttctgggtgagcctgatcattttccatactcattttctcatcagtcttcactacaagtttatttgcaggaagtagatattgctgtccttcttttccagatggggaacacccagtggacagtgtggagaaaacactggctaagcactcaagcgcctgtccttgcacttgcccgactgttttgtaactgttctttaccccaggctgtgagctccctgaagctgagaccatctcctgctcatctcagtgtccccagcgcctcccacccaccgtatctggcacatagtaggcacatataaaatgtttgtggaactaaactgagcccaaagacttggattggagacgaggccatatgtaactgggtgattctctgcccttctttggcccttctgtaaaatgaggagttggcctaactgatctcttaaatgcactactctccgaaaggagtatccgtttcccttatttgccagttgggaagacgtgctcagtaaatatttgtgtgctgtaacctatgctaggtgctttagatgctggcggtctcagcatggggtgaagaagggcttgtacacttaagatgccttacagtactgtgcagtgctgtactgcgggggggccaactctggggacctatgccttggctgcttgttgaggatgaaaggaagttttaggggagtatttgtatgttgagggtgcagtctccctagggatggtgacattttaacttgtgagtcattgtgactttgtatgtgctcttattccactttgagttcatgttctggttaggagtgccagtgtctctaacacggtgcagacattatcattgttggcttcgaaggcatagaggaggtaacagaactaactgcagtcccttcctctgctgcatcagggggttaagattggtctgcagggtagtagggttggtgctgtggctggacaagccctgtatgtcttctatttggagatggtgataagaaagttaagtaaaaactgaattgttttgtgcccttgggcaactcacttatctattgttttatctgtagaatgagtataatctctcagtggggtagggaggccaattaaggattgattacaaagtgccttacaaatagaaagctacagtgacttgtttgcaaggtgacagagaattcagaagcctcaagaaactgccttaagtgatcaaacaggctaacagagttgccaaagcaaaatagtgctgcactgatactacctttaaccgttttttcctttagcccttttccccccaaaaaaattagtatatgaaattacagtgaaatacctggtatctaagcagatttatagtaattctcaacatattcatcaatctcttaattctacctgcattaaaatgtatttctacctgaaaagtttaaaggtcttttatactgtgccattttcctgattcattgttgccagaggtagtgagttccttaattttacagatatttcaagaggacattggccaggtattattggtaaatcagatttgtttttttagctggtagtgtttcacctctcctgagcactcctagtttttgacagtgtgctttagtctccttccatgctgaggaaggccttctctataggagaaagaaaactgaggggtgtacacaggaagttaccttatgctggggactcaaaccttgatgctactgctttgctccctgcctctatttttgaaccaattcaacatctccctcctaccccaggaccttgtcacacactgttctctttaccaggaatgtttccctctcttttcctctcctccagacctagtgaactcctatttatcctcacttggcacttgctaagggaagcattcctgacttccctgaccagatttactgctccctgtttctacagttcctgtagtatttactactcctccatcatagtgcatatttgtacccttgtgtctgtctggatgcttatttgattaatacctgcctcccccactaaactttaagctccatggggtcaaggccgtgactgtgtcagtatcgtagcctgcatacttggaatagtacctggctcaataaatatttgtggagtaaataactgaataactctccagagcctataagataaatctagagctgctgctttcaatcactgctttcctggtggtctgtggcctggttctctttcttctcacactcttcccaccttcagagtgcagccattgctttggagagatgggagagaacatggcactaaggcagaatatggctatatttactttgaagagcatgtctttgtcatagaaatagtcactgtcatggtttggtgggtcccaaggcatgggtcatggctccagatcccctttccagccttttggatcttggtaagtctgaacccactgctgcgttggcaaggctctggaaactatagtgacagagaatgattcacaagtgtcaacactcagatgtacagggctgccagctgacccactctacctatttccatctggcactgaactggttgatcatgaacttcttttcataattgctttttagttatgcaggttaagacatgccgaaacagatgtaccggacccacaaacaagtccttccttgaatgcctgaggcttcctaacagtgaaagagccctgttcttagagtaggcaaactgattctgaggcattgtaggtggtagggatctggtagtaggtagcattaggtgggctcccggcactcaccatggagccttgaaattttctgctactttgggggagttgctggttcagagaaggcccttccaccctggtagccatgtggcactggaaggctgtgaaaactctgctgggccttcttagtcatctgttgtgagctcctgatgggagtgtggtgtatccctcaggtgtgctagactggaacaaaggctgagaagtgttgctctgggggttccaacttgtgggcatggggtactgatgagatcagtagtgtttggagacttctgtatgctccatcttcagaagacattctggagtccatataagttatcttgtctcttgtttgaagcaggaaaaaggaatgcgattgctggtaatatagttcactaaagtcagctacctggcctctaacagttatttgcaaagtatattataacattgattcctcaaacatctagattcctatctcgtgccaagtgatgtactaggtgctctaagtacaaaaataaaggaatatagtcctcctctcaatgcgtaagcctagtggaagaagcagaaatgaaagggaaataagaattcaatagagtatgaggcattacagtgaaagaaaccaaatgtcttagaagtacaaatggcagagctactaattctgtctcgagcaggcagggaagagtctatagtggaaatgacttttgagctagattttgaattgagctagtcttttgagccagacttttgagctagaattgtagggttgtcatcagaccagagagtaggaagggtaccttgtgaggaagagagagagagatcagattgttactgtgtctatgtagaaaaggaagacataagaaactccattttgatctgtactaagaaaaattgtttctgctttgagatgctgttaacctgtaactttagtcccaaccctgtgctcacagaaacctgtgctgtaatgaatcaaggtttaatggatttagggctgtgcaggatgtaccttgttaacaatatgtttgcaggcagtatgcttggtaaaagtcatcgccattctccattctcgattaaccagggacacagtgcactgcggaaggccgcagggacatctgcccaagaaagcctgggtattgtccaaggtttccccccactgagacagcctgagatatggccttgtgggaaaggaaagaccttaccaccccccagcccgacacccgtaaagtgtctgtgctgaggaggagtagtgaaagaggggggcctctttgcagttgagataagaggaaggcttctgtctcctgctcatccctgggaatggaatgtctctgtgtaaagctgaccattcccattcgttctattctgagataggagaaaaccaccctgtggctggaggcgaagtatgctggcagcaatactgctctgttactctttgctacactgagttgtttgggtaaagagaaacataaatctagcctgcgtgcacatccaggcacagtacctttccttgaacttattcatgatacagattcctttgctcacgtttccctgctgaccttctccccacctgttgccctgctacactcccctcgctaagatagtaaaaataatgatcagtaaatactgaggtaactcagaggctagcgctggtgcgggtcctccgtatgctgagtgccggtcccctgggcccactgttctttctctatactttgtttctgtgtcttatttcttttctcagtctcgtcccacctgacgagaaatacccacaggtgtggaggggctggcccctttcagtatctcagaagggacaaagtacacaaaggcatggggtcatgatagtgcctggtatgttcaggtagtgaagaggtccatgtggtatgagcactgcagatgatatgtgtcgtatgaattaaaaatacatagttactgcaaatagtttttacaggttattgtttttaagaaagcagtatctaatgcacgagtgtactgtcagtactgtcaatgaactacttaccactcaagtgactgcttatctgttgttctgtcctctcaagccacctacagtcagaaaatggtcttgattttactgatgttgctgttaataatagctgtgacttcttgagtacccaccacatgccaggcccaatgtaggggctttgcatccattatccatgatctttacaacaaccctgcaaaattaggtatcagccttattttaaagtcttgacagcttgtgacttccctgaagttgcataggcaggaagaatctaagtcaacattcgaatccacgtcagtctcatgaagcctgtgctctttcctgcgtgccatgccatagttctagttaagtgacaactcctttcctccatgacattgtagatccagtatgctaaggaaccctctatttacaaattgtaagtgattaaacaaaacaaacctgttagtggcgcttatacatccaaatgagtgttgttattcaaagaggttacttggggaaagagaatgtatacacctattccattgttcatactccttgttactcatctggaattccctttaaagtcagtttacatatcacataagaagatccatctcattgctttatgatcatctatcattttcaaccaaaatagttccacctagtttgatcacacatcttattcactaaccttggctctgactgactgtttgccatttccaaaatttgaatccaccctcagtgaaaatttagcaccatttgggatagtcagaagatcagactgcaggttctcaaggtgcttccaagaagaaagcttcaaagatgatttgagtaatgaagtaccattggaattactgcattgcctcccaaggggactggttaaaggagagaaatctcatttgaatgtataatttccagttttaaaagtatcattcctattacttgataattacacacacattgttcttagctgtgttctttgagggccaggatttggaggtgctgaattacgtgctgaatgagtggatgttgggtacaaatagacatctaccactgggaagtctttgttgtacaggagagaccgtggattgaaggagttttagatagtttcctaggactccagaagttaagctttttaatatggagcttgagttttctaatcattttgcctgatatgtcatgcctgtacaagatgactggaatttaagacaaaagcctcgaactctggagatagatgctttataagtggagactcatactttgtcagctccaacctaatagtgacaacaatgattgctaaatgagattattacctacaatgtggcagaacttttgtctttcataatactgctaaagctagaatgggtaaaatgtatcatttacacagtgctttcacatacccttgtcttaatgaatcagtatatgaggaatcagatgaggagacagacctgggggaaaataactcacccaagaccacaccgctgatgaatggcagttgaggaacttaaatgcagatcttcctactggcctgggctctgcttttatttggcttttgtgcttttttgtatctactggttaaatgctcttaaacattttttatcttaataaaaccagctaaagtctccactaaaagactttaaatttggttaataaggtgtaagaggggcagttcccttgatagtttgtgagtatgtcaggttgtcatttggagccattctgtcaagctttagactgggatgtgccatccaaagtttgtgtgtgtgtatgtgcttgtgcgtgtgtacgtgcatgcaggcatgtgttaatgcgcgtgtatgtgctccagtgaagccagcagcttccactggaaaaaaactgataggtctaaaaagagtccagctgcattcttatgatatgcagaaaacagatactagaacttttacattcagagtcatcattcctttgctaagtatattctctctctccctcccttcttccttttctccctccctattctcccaaccctgcaaagtggagagagggaatttgagcctgagcagaaagctccatgtaaatttcagagaggatactagctttggcccaggtagcactacttagtgattcatcgtatactaacactacagattcaaatgagagtggaataaatccattctaaaggtgtaactggaaaagtgaattttaagaagtagtgattaatgttaaaccagaacctcccatttctcccaggtttgtggagaattaagcagtctatttttatacttggaatctggtctgaatgtttcttgaaaagtaactcaaagtagtttaggctatgaccataagttatttttgtaaatacattttcttatcactgtattattgcatattattgtgtattcttttgcaaatcaggcttgatatttccttttggctatgcagtcaccttttagactttgcttgcaaatatattgatatagttaagatactattctttctttccccaactaggagtgtgtatgaattacatcttttgaacttactgattgtattactttgttttacttgatcaactttgtagtttaatttttttaaaaagctagctgttgggattactgatcagtttcatttttatatctatatttctacttttagttttattattttcatgttttggctttttccccaaatttcttagaaactcagtttactagttttcttttgcctcttttttttttctttgttttctacttttacttaaacattttaaatgaacacattttctcttgagttttgttttggcagctgcccaggtatttttatgtttcaattgtattttagtaactctactaaactgcttaacaaatcagtattgaaaatgatccattttttgtcagtgtttttatgaattgtataaaatgtcaacctctggtctctactgattacaatctaccttacacactcatatgtatcttctgtcactcttgttgagaaaatctgcagtggccccatattacctattaataaattccaaggactttaccttgatattcacattcccctaccatgttaccacagccaacttctggcttattccccccagtaccctttctcctgtctctgcagcaccctacccaccacgatttatagaaagtattctgtgtgttccagtctgctggaattggagaggggaggataaagaggggatgagcaatgggtacaataatacagttagatagaaataataaatctagtgtttggtagcacaagagggcaaatatagttaataatgtatatttgcaaataactaaaagagtggaattgaaatgtgcctaacacaagtaagtgatcagtgcttgaggtgatggatatcccagttactctgatttgatcattacacattgtatgcttgcatcacagtatcacgtgtaccccataaataggcacaactgttttgtatccataataaataaaaataatttttaaaaaattggaaaacatcttattccctttgtctggaattccttattcccaacttgttgcccagattccacttctcttcccatctctctcagggaaattaatcttccaagtcccctagtttaccatatgtagttacttgttgatacatcatctccctctgttcctattagtctgagcatcttgagcgaacgcattgttgctcctttttatgtatctcacacatttcaggcactcaaatatttttaacaattgtaaattagatgtgtgtttattgtgtattgctgccccatgatcctttttttctccctggaaaaactatatatatgtaaagcaagtatgttttcttgttctgctacgtaattatcttcatataagcttgctgttttttaaattttctcgttctgctacttaattctcttcatataaccttgctgttttttaaatctactcttgtgttcatttccgtattttccttaggaactttgtctgttttatctgtcatgatttaagagtagcatgaggaagcccacaattaaaatatttctgtgtatccttaaaaaagaaaaattgtaaaattatttccatattccatggtcatgttaggtttttgttatttaggttttccttattagtccttttagcattttaatactttcggctttgaaatctaatttatctaattttaaagatagtaaattgttgctcttgtcttcatccaggcgtgctaaacctctgtcatctgatttctgatagttggttcgacttttgactttggttccaagcgtaactcttgaatgtaacaggtttactttcttaatctaggaagcaacctttctttttacagagctgtggtaggcagaataatgacgcccccaagtatgtccacatcctaatccgtggaaccagggaatatgttctgttacatggcaaaggggaattaaggtagcagatggaattaagtttgctcatcagctgaccttaaaatagattattctggattctctggctgagcccaatgtaattacagggcccttaaatatagaagagggagacagaaaaggaggtcagagtgattcagtatgagaagaactgcattctccattgttgactttgaagatggaggaaggggccatgagctaaggaatgtggcagcctctagagctagaaaaggcaaagaaacattctctcctagagccttcagtagcatagtcctgctgacacctcaagtttagcccagcgagacccatattggactctgacctccagaattgtaagggttatgccttttaaaccactaggtttatgctttttaaaccactaggtttgtggcagttttgaatggcagcaataggaaattaataagagaacattcagctcatgtatatttttctaaccctagtatttgaatcatgaattatattttgtgggtccttttgtaagtttatcttgttttctatttttcatgtaatagacataaaattttaagtttcctttaaattatgtcaaaaaccacataaaataatcccttttccaacatttaaaacattttggtacttctcttttctttagttccactactctctttttttattaaataaggaaactgttttacagaggataatgaagttagcttacagcatttaccaccccccccaccaatttactttttatttatagtctgaaaatcctttaggataaaaattacctgtacatgttatctaatttacatatgaatcctgtgtcgtcattatcttagcatttgttaatgtttgaatccactaatttcttttttaaatagtctgttttcaagtccattgtttctggtaattatatttgtagccacaggctttagttgacaaattggttctgatttttttagattttggaatatttccctctgctttaagagagaaaacttctgcctctactaattgtgtactgtaattgtggtgataactccatttctattaacttgtgaatcaccttgacacaggctctcttcttgtccaaagtctaagggatgaagtcatttttatcttggtttctttaaatgttctttctttgtagcagcttataaaagcctgtttttgttttcgagtattaataatattagctaatgtgtattgagtacgctggttatcagactgtttcccacagaccttgggagtgggccttgagaccctttccaggtatctgcaaagtcaaaattataatactaagacattctttgccttggtcgacattggcactggtggtacaaaagtagtgcatcaaacagctggtgctggagcacaaatcaggacagtggcaccagctgcactagtcttctgtcactggattcttcaccaccacgtgctggacttgcagttaaaaaaaaaatgccagcttcacttacgaatgtccttgataaagcagaaaaatattaatctcatttaatcttgacccctgaatgcacatctagtttaatattccatgtgatgaaatgggaagaatgcataaaggcctgttgtatgctgaagtgcaatggttgactcaaggaaaaacgtgtgtgcctgagttacaagctgctgttttcatggagtatcatttttatttggaaggacaactgacagacaagactgtggttatttgtgttatggtgtttggcagacattttcttgaaaatgcaggaagccacaataaacatacgtgtgcatgtgtctttatagcagcatgatttatagtcctttgggtatatacccagtaatgggatggctgggtcaaatggtatttctagttctagatccctgaggaatcgccacactgacttccacaacggttgaactagtttacagtcccaccaacagtgtaaaagtgttcctatttctccacatcctctccagcacctgttgtttcctgactttttaatgattgacattctaactggcactattcacaatagcaaagatttggaaccaacccaaatgtccaacaatgatagactggatcaagaaaatgtggcacatatacaccatggaatactatacagccataaaaaatgatgagttcatgtcctttgtagggacatgggtgaaattggaaatcatcattctcagtaaactattgcaaggacaaaaaaccaaacaccacatgttctcactcatagatgggaattgaacaatgagaacacatggacacaggaaggggaacatcacactctggggactgttgtggggtgggggttggggggagggatagcattaggagatatacctaatgctaagtgacgagttaatgggtgcagcacaccagcatggcacatgtatacatatgtaactaacctgcacattgtgcacatgtaccctaaatcttaaagtataataataataaaaaaaagaaaaaaaaagacaaaaatactataataaaagatgcttctatcacacacacaaaaaaagaaagtgcaggaagcaaaacttcaaggaaaacaactcatggtattttttgtaaatggtaaaatttgatctttcatgggaaaaccagaatttttgaaaagttgtatctgctaccatgagcttgacaacctcccagtaattaaaatatttctgatgaagttggtgaagatagtaagtaatgtgattttttttgctattgtatatgaaatgtgtcaacatttgaaagatctttataactcagtaaaccaatattttccagtcgacctacattgcattatacaataatgctgggataaaagattcattgaaagtataagagagaccagtggatttcagtgtagcagagtacaaaaaggtcattgatacgatttcagattccacatcatagttaacctttaagaaactaccacttgttgagttttagtgtcctgttgaagaacgtctaccattatctgaaagagctattaaaatagttcttttctaactacagatctctgtgaggccagattttctttgtatacttgaaccaaaacaatgtattgcaacagaatgaatgtaaatatagatattagaatctaggtgtcttctatgatatcatacattaaaaattttgctaaactgtagaaacagtgtcgctactctcactaaatttgtgttggttttggaaatgtttttaaataatgttatgtatgttagtatgtaatgtgtttattattaccttcgaagagtagatattttttgaataacaactgtatcgtaaatattaaataccaatagggataacccatatcaaccagagctctttgggatcctcagtaagtgttagaactgaaaaggagttctttttaagagttaaacgtcaaaatttttgatactaaaaactttgagagccactgatttagtgctttatacaaagcacttgttatactcattatcttatattcgtagccaccttatgaggtacatattattgccctaactttatgggtaagaataccatgacacaatgatgctatgtatatttttttagcaacccctctgaatctcatgatcttcccagcgtagttttctctctgggaggcttgcttccaagtttaattttgtaggtccagtcttcttacaaccctcctcccttttttccaatcgaagtttcttatgttatttttcatagtacaaaaacagtacacgtaccttacagaaaactcagatatcataagcaaaagagtataaagactatccttaatcttcccgagtggagacctgttagctgctcagcagatatttatacagatgcttttctaaacatgttcatttatcagtgtaaagccggtatagtataatactcaattagaaggattttggagtcaaatggtttgactcccaactctgagctcttagacaagttatttaacatctgagctttctgttccttatctgtaactgcactgatctgtttttctgtgtctagagttttgccctttccagaatgtcaaataagtagcattgtacactatcttgtgttttccatctgaattattttacttatagtgcattttagattcatcaatgttgttgttgtcatccatagtttgttactttttactgctgattagtattccattgaacggatatatcaaaattcagttaaccattcaccagtttatggatgtgtgagttgttaccagtggcaattatgaataaagcttcttggaatatttgaatacaggcctttgtgtggacatacgttttcctttttcttgagtaaaatacctaggtgtgggattgctgggccatagaataagtatacacttaactgtataagaaacttccaaaatgttttctaaagtggctgtactattttgcattcccaccagcatatataagagatctagtgtgtgtgtaatcttatctcattgtcattttagtttgcattgtcctaacatctgaaaatactgagtattttttgtgtgcttatttgctttttgtatgccttctttgatgggatgtctctgaattttttggccattttaaatcgggttgttcacttatttttttagttgtaaaagtcctttttatatactggatacaggttactttgtcagatacgtgttttcagagtatggtctcccagtttgtggcttggctgtcattttgttaatgataggtatcttttggagagtaagagtttttcattttggagaagtccaatttcatatcccatctaagaaatgtttgcctaaccgtaggttgcaagtatttttttttcatatgtgttttggacattttatagttttgtgtatgacatttaggtctatgatccatgtcacataaatttttgtatatgttataaggttaagagtcaaggtgtactttcctcatttatccagttgtaccaccatttattgaaacataattatttctccattgagttgttttggcacctttgtggaaaattaactgactctatatgtatgggtctgttttccaactctctagtacgttctatatatctattcttatgccagtactacattgtgtttattactgtagctttatagtaagctttgaaagcatgtagtataaattgtccaactttgttctttttcagaattgttttgcccattctaggtcctttgcactgtcatatgacttttaaagtcagtatgtcaatttctacagaagaacctgctggctcccaattttcgctgggattgcattgattctttaaaataatttggttaatttggtgtgtgtggtaggctaaatcatgacccacaaagatacccacttccatggaacctgttaaagatcttgagatgatggggttatccaagtggggcaataaatgcaatcaatcacaggttcccttaaaagagggagataatattaagaggagaaggcagtgtggtggaaacagagacagagatttgaagattttatgcagctggttttgatgatagagaaaggggccatgagccaagggaatacagctctggaaactggaaaaaaacaagtaatagattctcccatagagtctccagaaggagtaggtcctgctgacatcttggttttagcccagtgaaaccctttttggacctctggcctcaggataataaatgtgtgccattttaagtcaccaattttgtggtagtttgttacagcacccataggaaactaatacacagaggatgtaaatcttaacagtattgagtgttctatgaacacagtatatgtctccatttatttagatctttaatttttcttggcagttatgaactgaatgtgtccctttaaaaatcacaagttgactctagtccccagtgtgatggtatttggaggtggggcatttgggaggtgattaggttatgagggtggaaccctcatggttggaactagtgcccttataaaaagagaccagagagctaactcactctcttttcaccatgtgaagggtattgagaagtctgccatctgccacccagaaggcagccctcgccagaacccagccatgctggcatcctgatctccaacttccagcctctggaactgtgaggaataaatttctgttgtttattagcttccccacagtcctaccagtgttttgtaggtttcagtatataggttttgcatatatgttgttacatttatccctaagtgttttatatttgtgatgctattgtaaatggtggattttttcataaacttttaatttttgaatagttataaatttataggaaagttgcagtaaatgatacatatttttaaatttctgtttccaatttgtgatagctactatatagaaatgcaataatttttgtaaatttaccttgtgtccttcaattttgttaaattcacttactagatctactagcttttttttagattacttaggatttcctacagggaatatcatgttgcctatagataatgacaggtttacttctttcttttaaaactatattcttttaatttctttttatcatcttattgttgtggctaggacctttagtacaatgttgaatagatgtgttgaagtggacatacttgctgtgtttcctgtcttaaggggaaagtattgagtctctcaccattaagcattataactgcaggtttttcatagatgctcttcttttcctaatttgtttaacgcttttaacttgaatgggtagcaaattacgtcaaatgctttttacacaactattgagatgatcatatgatttttctttttcagcctgctaataccacgaaggttgctaactgattttcaaatgttaatccaagattgcaatcttgcaatcctagctaaaccacacctagtcgtaatgtagtatccttatatattgctgaattcagttggctaaaatcttttcaggatttttgcatctctgttcatgagagatattggtctgtagttttctttctttgtcagttttgttatcagggtaatgctggcttcataaaataaattgggaaatgttcccccctcatcttttttgcaagagtttgtgaagaattggtggtatttcctcattaaatgtttggtagattttgccatggcctgacattttctttctgaaaaaggttttaactagaattgcagtttccatgtctttgtttcaagaaatttcctggcataaagttgtttataatatcccctacttatccctttagtattattaggatttgtagtgatatccctgttttcattcttgatattagtaatttgagcctactcttttttactgattattctggctgtagatttaccaattttcttactttctcaaagaaactgcttttagtttcattgatttttttctctaatccctttttactgtattttattgattaatgtgcttacatttatcattttcttctttccatttactttttaaaaatttccttccgtttcttacatggaggttccttacctccatgttctttctagtttcataagatagaatcttagattattgacttgatatcttttctaatgtaagtatttgatgctaaaatttcccttaagtactgctttagtgtatctcacaaattttggtatattgtgtttttgcctttagtccaaaatatttttcaattttcttcatagtctttgacctatggattatttcgcagtgtggcatttaattttcaagtattttgagaattttccagatatttttctattgttgatttctagtttgactccattgtgcttgtttactttgtatgatttcagtccttttaaatttgttgagctttgttttatggcccagaattcaatctatcttggtgaatgttccgtgtgtgtttgaaaggaatctgtattttgcttttgttgggaggaactcattaatattaattaggtcaagttggttgatagtgttgctacaatcatatatatccttagtaattttctgtttatgtgttctattagttactaagaaaggaatgttaatttccatttataacagtttgatttttttatttctccttttagattgatcagtactttctacatgtattgtgaaactttgttattaggcatatgacaaattgacccctttatcattatgaactacctctatttgtccctggaaatagtccttgttcaaaaatatactgtgtcttatgttgtggtaggcagaatgccccacccccacaaatacacagatacccaggccctaagccctgaaacctgtgaatatgttattattttacatggcaaaggggactttgaagctatatttattagcattcgtttctgctgttaccatgacaaattactctcagttctttaggtcagaagtccgggtacagcacaactcagatgggtcttctgcctagtttcacagggtcaaaatcaaagtgtcaggagggctctattcctttctggagcctccagggattaatctgctttcaagcacatttgggctattgtcagaatttagttccttggggttgtagggctgaggtcccatttaccttgctggctgtcagctgcgagttattctcagcttctgaagcctgcctgcattccttggctcatggttccttacctccatgttcaaagccagaagtaacaggctgaatccttctcaagtctggaatctctctgacttctgcctcatctctcttccaccacatttctctgacttactcttctgctttcttaagggcttatgggattacactgggcacacctggataatccagtataatcttcctattgtaaagttagctgattagtaaccttaattccatctgcaaagtcccttcacagtattactcagattagtgtttgattgaataatcaggggacaggaatcctgggaaacttctttagaattctgcctaccaaccacagttatggaccttaaaatagggagagtagcctggcttaaccaggtggactcagtttcatcacatgaactcttaaaagcggagaactttctctcagtggaagcagaagcgatatggcagaagtagtgagaaaacatcccaagcatgagaaagattgaatatgctatagcttgttactggctttgagatgtaggggcctatttacaaggacccaggagaggcccctactatcgcaagatcagctgctgcgtgacagcaagcaaagagacacatacctcagtcctacaaccacaagaaactggattctgccaacaacctgaatgagcttagaagtagattctgccagagtcccctgataagcattccaccaacagacatctttatttcagccttgtgagattctgagtagagaaaccaaccaagcccgtctcgccttttgtcatatagaactgtgagataataaatttacgttgttttaagctgctaagtttgtggtaatttgttacagcagcaatggaagactaaacagatattaatatagtcattccagctttcttttggttagtgtttatttggtataactttttctttccttttgcttttaatctatctgtgtctttatagatagataaagtgggattcttacagacagcatatagttgtcttgcttacttatccaatctgatcatctttgtctttcagttggccatttatatttaatatagttattgacagggttgagttttaactgttttcttgctgcagcctggaaactgcctctgatctgcaaactggggcaatagtagggtttacctcctttatttcctccttctcacctgttctccactgcctgttgtcaatgtctgaaaactgttcttttgtagactgtatcaagcttcttatttaggcgggaaggtaaattatattcctattattaagtcaaggctggaaatagaggtcctcaagagtataatttctaattatttcaaggacatcctctgtagcaattcccttttatatgagacgtgagcatgtgtgtatgtgtaatttattcattcatggaaagtataatacatacactaaaatgttcatgccatatgaatatgacagatggctgcctttttagaaatagaatcagttagtgatagaacttgaccattttcagagcatgtcagccttttccagtctctgtgtcttggtatagctagttccttctgcctggaatacttcctcatctcacttgctttcctgcctggcagcttcctacttgccctctggaaccagctctagggtcaccacatctctgcttctgagtgcctcctcagacacagtctgtatttcctcttccaagctctcatcacaaacattgtgctgtattatatgtttctgtgtggtcttccttctatgaggaagccttggaaagcaggagacttattttagtcttctttatgtttcttttattcccaacacattatgtctgccccatagaccttttcaataaatgattattgagttagtgactccttttacatgctgacaaatgtggctcttattactccccatttcagtatcacatatttgtaaaagtgaatccttcttaatcgttttacttttctcctagtaaattcctcatctatgcctgtctgctgctgttctctgtgctgctggcccttcgtttggatggcatcatacagtggagttactgggctgtctttgctccaatatggctgtggaagttaatggtcattgttggagcctcagttggaactggagtctgggcacgaaatcctcaatatcggtaatactgctttatacaacccattggtctctagcatgagggagcaatatcttgacttttctcacttttgatgaagtaaggaccattttattttctacctatctggggtcttagaactatagtataagctaacagatctcttctgtgtttttgaaaatttagtctttggtatgtattttcttacaaaagcagtgccatttgggggtaagttgccagccagctcacagatgcctatataatccaaaatgcacccaaaatacagaactggtatgccatactagactaagcagcatgaaaccaccctgtttttaggaaaagacactcatattatgtttggtcatgaaagatctttctccaatacagttttggaactggggctccccttgtcccaccctcctagtcccagagctttaggactattagcagtgtaggggaggtggcttgaccaggagaccatgagtccctgagacagcagctggggaatgaggaaagtcaaagattggatgccgagaaggaaagcagagcctttgggggcaggggagaggggtaccctttaccgtttccaactcttgccctccctgctcttggatgcctccgctggcccaaattcctgggagttggctcacgccagcatgcaacctgcttgttgctgggacctgcgagaggctttcccttctctgccacagagactgtaactacataaagggaaaaagggggacttaagactgggaggctattatgaacctccactgggaaaatgaggagtacaggaattcccagaaggcagctgctcatgtgggaaaagtgtaaagttgaaactaccgcaccttttttttttttttttttttttttttgagacagagtttcgctcttgttgcccaggctggagtgcaatggtgtgatctcggcccactgcagcctccacatcccgggttcaagtgattctcctgcctcggcctcctgagtagctgggattacaggcacctgccaccatgcccagctaattttttgtatttttagtagagatagggtttcaccatgccaggctagttttgaactcctgacatcaggtgatccacccgccttggcctcctgaagtgctgggattacaggtgtgagccaccacgtccggccactacatcaactttttaaatttttgtttactaaatatgaaaatgattcagattgtgtaaattacatatcacatacatgtctaagaactgtaaaacagttacacagagagccttggcaggtgagggacattcatgtatagctgtttcagagttcttagattttttttgaaagattgatgacctgtgtggctgtatgtgttttatttttttatgagatattttcagatatctaatattaattgcttctcaaagaatgcaaagttaaataaacatttaggttctactaattgatatttagaatatattcaaacttctctttgttggtcttatttaagatgttttgagcaaggaaaggaattgtgtatgtggggttgaatgtaaggaatgtacaggcgtggtcattctcatgttaacattaaccagtggaacatggttgggtcctacaggaataacctctgatagcattttctctatgatctaacttccggtgtatttgtcacccacaatacatgtatatcataaatgttcatctgtattttgaataaacattgtaggcctttcagatgcattatagagccttttcctgattagcggccttaccattgctcaattgtagatctgttaaggttattgtgcatgatacttagctaattaaactgattttgtttgagaacagttttaactcttgttcttctttctctttcatctgcaggtgttaatttatcttaatggaatagaaaggaaaatgaaaatcatttatacgttttatttgcatttaaaaatagcacctaacaatagttactactatcttgaaatataactggcacttgttcatagaactagagttatttttataatattgtgtgaagggtggtttacatggtttcttgaaaaatgaggatcatgagacttaaggggtatttgcctggttttagcagcagaagcaaatcagcttgaataatcttggaagtaactcttgttgttgaatttaaagatgtgaacagaagtgtttatgtacattgtcagggaaataagaactggctattacttttgagaatatccttatacggttaaaacattaaattctggtttggttgtaatgttcattttgtattatgtagtagttcttcgatgtttcagagattgcctaccaaagcttaggtttaagttagctttctacctgatttccctttgcttttgtcaaattttcaagtaaaattcaaagtataaatataagttggtatttgccctgaactgcttgcttatagtggagattctgaactgagggtgttttcttcttctctcccttttttagagcagaaggagaaacgtgtgtggagtttaaagccatgttgattgcagtgggcatccacttgctcttgttgatgtttgaagttctggtctgtgacagaatcgagagaggaagccatttctggctcctggtcttcatgccgctgttctttgtttccccggtgtctgttgcagcttgcgtttggggctttcgacatgacaggtcactagaggtgagatttcatatatttaagaatgttttccactttgggaggtcaaggcaggtggatcacttgaggtcaggagtttgagaccagcctggccaacatggtgaaaccccgtctctactaataatacaaaaattagccgggtgtggtggcatgcgccagtaatcccagcttctccggaggctgaggcgggagaatctcttgaacccaggaggcggaggttgcagtgagccaagattgaaccattgcactccagcctgggtgacagaatgaaactccgtcttaaaaaaaaaaaaaaagaatgttttcaaaagtaaaatattttgctcagttattcagatgtcaatttcttaccctttgttaggaagagcttgatcattaccaactctacatcatgagacaacaaggcaacaaaagatgatggaaataacaatttttctttcttcacttagaacactagcttttcacccaggacatcagccttctcccagcttcacatcctgtatcaatcagacagaaacagaactgataggttagatacagatatatgtataaagagagttaaggaactggctcacattactgtggggctggcaagtctgaaatctccagggcaggtgaacaggctggagacctaggaggagttgacactgcagtcctggcacagaattttttcctctccaggaaaccacagtttttgcttttaaggccttcacctgattgcatgaggcccacccatgctatggagggtagtctcctttattcaaagtcagtaccttcactgcaacagcaagcttagtgtttgattaaataactgggtactatagcccagccaagttgacactcaaaactgaccatctccccacctcagaccccatgatttagcacctcccctgctgtctggttagcttatcctgatgtgcccctgtgtttgtttattcattcaataaacatttatcaagtatttactagatgccaagccctttttccctaagcatagaggatatgcagatgaataaaataccaggactagtaataatagtaatgaaagtaattgcagataacgtttattgagcacttactgtgtgccaggcattgtgcgaggcacattacatgtggtagttttcttactaactaactctgtgaggtaggtccagagaagataagtcatttgttcatggccacatgtgaaggggcaggaccaggattccgtttgagtcagcccgactctaaagcccgggcacataactacataactgcatagaagctgagggcccaaagctgaatactgatgggttgaggggagaactagaggctgtagatgcctggttttgagccgtgtggatgaagagtgaagggagaagactgcagttggcttaggaagtaaacatagcagctgtagggtgggtcaggcatataagcctagaccccaggtatgggcgtgaggggaaggtatgtagacagagggacggtgatggagcaaggccctgtgggactcagggagaatgggacctagagcaccaggaagggtttggccttgaacaaggggagctattccctgattttcatgctggtggaaaggccacagcatgggtatagtggtaggtaggagtgagccgtggagggagagtatctgatggtccactttcaccctccctacaattcccagtttatatcagggacttgagcatccatggattttggtatccacagggggtcctggaaccaatcccccacagatactgagggacaactatacaaggactaggactgcattgggcctgaattacagaaagtaagtctttcatatattcacactctaggcattcctgcccttggaagaaacaacataccaggagctgagctccctcctcctgtgatgcaagaacagtacctatgttggtgagggggtggtctggagtaggctcatacagagatgggaaggaggagttgagggtctgccaggaagccctgtgttgggagggaagggatggcatttttgggacacattgaagcctagaggcaggaaacactccatcagctgagtggactgtggcgattcagatccgacgggagcacaaggtggaaaggaaggaactgtgggagttgagaagagagggagcctctacagagggattggggcaaataggggccacgtcctcagcccacagagcatgtgctgaagtgccccaggcaccccagtgcactcacagggcaccaggggatagtggacattttgaggaaaacagtaatacctgacatttgttgggacaccatacaaactactagcttgaaatagtttacaggtttatttttaggccacactgcattcctttcagtgacgtcgtatctttaagaagctgggttttcagcagttgctgtgaaaacaaaaaaggctaatgctgtgtgaaaatccgggtgaagaacaggtaacgagtgggagcaccttgtctgattccaaggcgtgggaaatggtgagctacctgacaggcacacgcatcccactgggaattagttttggttatttaagaataatattaacatttttctttagatttatatgaattattttttctggtggctacttagaaatacttactaagttagacgtaattacttaaatcagtgcaactgttggcattcccagccacattagggatttcttttggcctagaggtctatggaggaattactaaattccccatgtacctatgtactgagaacttttgggaagctctgggcctggtcccagatttcaattttgtgggcaagaatgtactttaccagagtgaggagcagcctgcagggcgtttgggctggaggcgggaggttagtaaggggttgctgaagtggtaggcggatggtgccgaagaaggcctcactaggcagtcatcatcaggataggaagtgggcacgggattcaggagaaatctggactttacagtggacaggatgtggtgactgaacgtgacagtgtgggaaaaagaatgcagggtgattcccgggctcatggcttgagaaatgagaccactgttgtgcctccaagtgacatgggaggctatagaaagtgacatgggaggctatagaaagtgacatgggaggccatagaaagtgacatgggaggccatagaaagtgacatgggaggccatagaaagtgacaagggaggccatagaaagtgacatgggaggccatagtgacatgggaggccatagaaagtgacatgggaggctatagaaagtgacatgggaggctatagaaagtgacatgggaggccatagaaagtgacatgggaggccatagaaagtgacatgggaggccatagaaagtgacatgggaggccatagaaagtgacatgggaggctatagaaagaggagatacaaggttctaagtgcaggcgataatgatctctatttgggactggcttcatttgaggtgcctttaggagagccgagtggcctatgcacagctgggtctgctatgcagcaggaaggctaagttggagacagatgtgagaactaaccatgaaggaggtaataatgcagaccaagggtctggttgaaatttcttctcccccagtccagggtgcagcgggtgagtgaaaatatgtgtgtttgtgtgtctgtcttcctagtcgggagagaagactgagtttgtggctctgcggagcatcaccatttaaggagggggaaaaggagacagaaggaattaccagaacactccagagggctccaagactgtatggtgggatcctagatggccaggaggaggggagcaaaaaggaaagagtcatccacagtatcagtaggatgccagttgaagtgtttttgctgcctcccggttatcggtgactttgatgaaagctgtcttctggtggtcatgggggtggaggccagatcacaaggaagctgggaatggtagatgagatagtaggggcttgcatattcattactgtctcgcagagagaaacctgaggctaagaggggtcttggatcaaaggatggggtgggtttatctggtttcggggcttttgtttttaatgagaaggagtcatttctgtgctgctaggagggatcaatggaataggtggggttaaagatacagtacggaatctacagttgatggcttgatgtgacaaggtcctcaaggagcctgaaaggaaggggtggggtccaagggcaaaaccgaggtatgagaagaaggatgcacaaggatggtttcgagtagacagtattgttggtagggacatgaaggaagcttagtggtctattgcagctagcctgtgttcccagtgaacctggaaacaaggttctcatctgtgctcaggcctcaggccagaaagggcaaggcagcagaggggcaaggcagcagaggggcaaggcagcaggctgagccccatttccccttgccataatactgctgtgcccctctggtaccgaaaatcaggagtttccagtgcaatataatattatacaagttacactgtattataatgtgtattgtcttttagtgtgttaaccaaattactgcagtattaaatgcaaattatactttgtttaactgattcttctcttcatttttagttagaaatcctgtgttctgtcaacattctccagtttatattcattgccttaagactggacaagatcatccactggccctggcttgtatgtaacttttaaaatccttaaataaacttcttttttattataaaagtaattcatattcactgtacaaagcttggaaaagacggacaagcagaagtaatagcctaatagtcacccataatcccaccatggggagataacatggttagtgtttttatgtctgtgttttatacaaacagtttggatataactgtgtgcaccattttgtatcctgatttttttgttttaatgttgtatcataaacattttatcatgttaataaaaggtctttataaacatgacttctaaagtttaattgatacaaaatattcttcaagtgcatgtatcagaccatcctcttatttctaaaatatggtatttccattgttgccagtgttgaatgattttaaatcatactgcagtatatatgtttatgcattaaaatttttgccttttgttttttggttgttttcttaggaaatagtccagaaatagtgttactgagctagaggttgggaactatttgagattcctatatacgtatactgcactgccaacttgcttttccaaaagccatacctggccaggcgcagtggcttacacttacagtcccagcactttgggaggccgaggtgagctgatcacttgagctcaggagttcgagaccaacctgtgcaatgtagcaagaccctgtctcaaaagaaaaaaaaaaaaagccatacccatttacactcttgctggtggtggcatctatgtcatgcttctaaactgtgacttcagttactgggcatttggttgaaattaactgtgaataaatgggtagatggatgcagagatagaaagataagtggcaaggtagaaattagagaacacagtatagattccactattaaatgcatggaaaaaagatggagactaaaggcagaagagttccattgccactgggaggtaaggtcatgctagtgtttttgttcggttttattttctctgttgtttgatgtataattttgcatacaatatattttatgtattaaatatagctacccttaaaaagtgaaaagtatagtaaagaattgggagcagagaagaaatgaagggaacctaagtatactccatatttaaagatgggaataatcacttctgcccaaagtctttgataaaacattcataataaaaaatattcagtcactcatcctacaacttcacagtgctgtatctggagaatggtcattgggttcaaaactgtttctgttgtgacgtgaaggaaacatatctaaacaagaccaaattttttcgtataagatactgtcagggaaaaaaaagattagtaattttgagagctttccacaaatgagaagaaagattttttctgcccttcatcctctgtagatcccagttgatgaagcagtctgagtacatgtttcccatagtgagcaagagaaaacaaggaagcctattgagatctaacattccacccatgaagggaacttcagtaaaaaggagaatctcatcacagaatggggaacggggaagaaaggctgtgcatagactctgcagagaaacctacaatcaagaactggtcaggagaagtaaaattcgtatgccaactcaaatcatagatctaaaagaaaatgtaaaactatagatctgttaggaaataacataggacagaatctttggggtttgcaattaggcagagagtacttagaaatggcactgttaatatggtccatacgagagagaaatcataaatttggacttcctcaaaattaaaatgaaatgaagacaggccacagactgggagaaaatatttgcaaagcacacatcaaaacactgacttgcacccagaacatacagagaactcttaaaaactcaaaactgcaaaaagaaacacctaaaaattggcaaaagagttgacaatttgcgaaggggatatacacatggcgaaaaagcacaggaaaagatgctcaacgccattacaggttagggaagacaaactacaaccaggatgagggcccgaaacacatggcttcagaatggtgaaactcagcaacactgacgaggccacgtgcctgggaggatgcagaggaactgggacactccagtgttactggcgggaaggcaggtggtacgggcactgtagaaaatggtttggccatctctgatgcagttaaaagcgcacttcccgtgggacttggctgccccactcctgggtataagatttacccccagagaagtgaaagcgcgcagccttgtagaaacccacacaccagtgtttgtagcagtcttgtttgcattttggatagcggccttgtttggttttcacaaaccaccctcagcggacagtcagataaactgtaggcatccatacaatggaataccactcagaactgagagggaacgacctgtggatacagggagggaacaacttggatgaatctcattagagacattatgtggatggcgggaagccagtctcaacaggttacttgtctcgcgatgccatctacataaagttccagcagagacaaaagtacagtgacagagaacagatcagtgtttgccggggctaatggtggggacggtgtgatagtgaagggacagcacggagagttttgcagggtgacagacctcttctgcatcctgccaacggctgtgcgaatctacttgtgtgaagactcagggaactcacaccaaaggaagacggtcacttttcctactgtatgatagataattaataaaaagggagaacggaggagtgtcgtcccaggaggcagggcaggagggcgaagacgtgtcacaggggagcctggccaagtggcgcccccggaactcgtcctctgggcttgtgtgtggatgagacaaggtctacctggtacgacagggacatactgggaatgcgcccttgccgtggaggcggggacccggcagcgctacgtatccagcatcaacctgtatccagcatcaacccgccaagttcactaacttggtaggggtgaggttagggatccttaggagcccaggcagccagactttctggggagcccattcccatttgtgttgccaaagtacccccagcaggttgtgggaatgttgcctgtgaagagagtctgttggggtgagatcttgtgtgtgtgcacagggtgacagttgtgtcccatttcccgggaagctgtgatggcagcagaacctagaggagcctgagagagtgtgggagagtgggcctctggaagagtagaggctgcggagccaggtgcagggctgtctgtcacccaaaggaagagggactgatgactcactgagcgtgtgtgtcccctggtggcagcaggccccatagtgaacataccataccttttctgtcctgagcgatgctcccagcagtcctgggagatggaacggtccttattcggctcacgggaaggaccgccttaactggacagacacagcaaggtgctaaagatgccttccatcagaggccaggttggaagctctaaagagacttctcttgctgttctctcacccacccccaggttgtgtgtgtcccgctgtggattctcatgtcctttctgtgcctggtggtcctctactacattgtgtggtccgtcttgttcttgcgctctatggatgtgattgcagagcagcgcaggacacacataaccatggccctgagctggatgaccatcgtcgtgccccttcttacatttgaggtaagcgttccacgggaagcctcttcagcccctgaagcttgcgcttcccctgacaggattctgcacccctagaaaggcagcctctgtccctcgagctcacagtgagcccactccaggagaggggagagaacacagccatctccgagagggagcttcggtgaaaggagagcatccttcctttctcttgggggcagcacgtggggctggcagggagaagagtgcacctttttagccatggtgcctctgtatggctccagtttccactctggggaaagcagagtgggatgtcagatttgtgtattggagtcacgtggagaattctagaatgggagctgttgactccttagaacaaacacccggaggagtttgccataaaactgctggcactgggaacttttcaagtggataggctattgccgagctctgaagagggacataaaagctcatttcgagctttccccagggataggtggtttcctgcctttttctggcggtgctgatgttccctcttgtgggagctcacgcgggggtggggtggtggggaggaactgcctaatgaagtctggcttccgcctctgcccattttcggtgctggcatcaaccgggactatgtctctttctttagattctgctggttcacaaactggatggccacaacgccttctccagcatcccgatctttgtccccctttggctctcgttgatcacgctgatggcaaccacatttggacagaagggaggaaaccactgtatgtactcagcatttcagaagtccttggtgtgtgtctggggggggaccagggagtgggggggggggcggatagaagtctaggaagggatgagtccccgagggccccaatttagaagcttgtgtgggaaagtgagggctgaggaaattctgggaccttctaagggaagggcatgccgtaactctggtgttctgctggcctgcaccgggacttttctcgcagtgcacgctgccatttgaggtagaaccagacacggcaggcaacctctcagagatcccgttccctcctctgcaaaatggggatcaagacagattcttcccaggcccgggagggtttgatggaaaatccacatctcccacccaaacctgggattcatcctaggtccctgttggcctctctgcctcccccatatccttgctgccatcacccgagtcttgcctgtcttgccttgctaacactctattcccctccacctgcttgctgaggcagacacttccaaaacgatctctgcagagggtgccttcctggcaaggctgtgggctccatggcacggaagcccagagcattgcccttcggaaagccagtgggtttgggggcagggcctcactgcagcccagcagcccgggctgtgcttgctgtttgtgcctctgccccctaccccgcacccgggagcagggagggcttgcaccgagctgacactccagtagcctacagagaggagtagtgggactgggaaagtggctttaaggtggctccatgagttcaggccccctcctggccaggacccgtgcatgactaccgccctcacggattccagagggtgacagaaatcttgttcttgggtggcactgtcatccatgagtttatcctggctggagaagattagcggaagacaccgtagtctgcgcaccacagatattttgagactcactggagcagtagttctcaaacttgggcatccagcagaatcccaaaagggccaggaaaaggggaccgctggagcccaccctagcccgactcagtttctggaggtctgggctggggcccgagaatggcatccctaactaggccccgtggacgctgtccctgccggtccgggaaccccactccaagcaccacagagctagcatttgcacttcttccccattttgggtactcaagccctgttcaggctttgtgactcaggagtctggataaagtatgttatgacattgtaggagtgaaacttcttgttacggaaagaaagttaacaggaaggtcagttgagcctcgtgtgtgaaataaaaaattcttatttttcagggtggtttggtatccgcaaagatttctgtcagtttctgcttgaaatcttcccatttctacgagaatatggaaacatttcctatgatctccatcacgaagataatgaagaaaccgaagagaccccagttccggagccccctaaaatcgcacccatgtttcgaaagaaggccagggtggtcattacccagagccctgggaagtatgtgctcccacctcccaaattaaatatcgaaatgccagattagatgccacttccggggacagagcttaagtggactgggacgcactctctccgccttcctctgccccctcgttcaccccgcagaccagaaccagtactggagctgggtctccaggtacgtccatctcatgccttgtttgcatccagcgcctatcagccactcaccacgacgggacgcggaagtggcaggtgacgggggtgtgtgccagcagatgcggatgccaggaagagtgtgagaacaggggtgggattaccgtctgtctgggaggggctccaggtacccctcttccccgtcagacccactgggagatggctgcttgccaggcccccagaaggaacatctgtctatacggtgctgaaatcccaatcaaaagtattgtttagaaatgtatttctccacagggctgacctcctgcagctcgctgagcactcccaggtcctcagcactcccaggtcgtggctggggcagtcagtaggaactgtaactatgtctctgatgcaccacgtgtttagacacagcacagtccttttttctgttcctactgtggaagtagtttctctttgggcatgctgacagcagtttttcatagcctcacggatgagccctttctacgggagtgactccatgcttgtatacagagtatttatacaaatgttttagcatcttcatatgcggtgttaacccctagttctgtacagcatattctgttcaagtatttttttacaagcttgtgctgtaggcacatgccttctgctgcagaagtggacgcccgtggcacactccccccccccccgtggggtgccacgccttcatgggacattgccacttctgccctggaactcgtgcaggtacgtagtagctgctactgccagaacggcaacaccaagcaagagatggtccatgcttttctgacgttctcagaatagtggctagcttcaaacctgacaagcgctgcttgaagccggaacactagagaatgttgctgagagcagaaacggccacgcgggtcacgactatgcgtgggaaagtctcaagcttccctcctgccagcaacaagaaggctttggagtaggcatgatgttttcacgtgtgcgtgccgtttctccaagcactgcaggttccaccgtgtgtcagaggctgcaagtttaacatcctcctgcctgaaaacaaataggtcctttgctgaaaagagggtaaaaaaagagctttgatcttctcagccaggagaagagggtggtgttttcacgcgggcaactgctcgccggcctacatggggttaattcaagtctgctgcgagcacgactccgcccttggcactggcctccagcaagccctgttctctttggggtacaggggaacgggatggtttagactttcctgctcagtgtgtaaaaaatgtagctaaagccactatttttgctctccttaagctgttcaataaaccggttcctcatttt

SEQ ID NO: 3913 - DNA, 10813 bp, human
tggtctgtgacagaatcgagagaggaagccatttctggctcctggtcttcatgccgctgttctttgtttccccggtgtctgttgcagcttgcgtttggggctttcgacatgacaggtcactagaggtgagatttcatatatttaagaatgttttccactttgggaggtcaaggcaggtggatcacttgaggtcaggagtttgagaccagcctggccaacatggtgaaaccccgtctctactaataatacaaaaattagccgggtgtggtggcatgcgccagtaatcccagcttctccggaggctgaggcgggagaatctcttgaacccaggaggcggaggttgcagtgagccaagattgaaccattgcactccagcctgggtgacagaatgaaactccgtcttaaaaaaaaaaaaaaagaatgttttcaaaagtaaaatattttgctcagttattcagatgtcaatttcttaccctttgttaggaagagcttgatcattaccaactctacatcatgagacaacaaggcaacaaaagatgatggaaataacaatttttctttcttcacttagaacactagcttttcacccaggacatcagccttctcccagcttcacatcctgtatcaatcagacagaaacagaactgataggttagatacagatatatgtataaagagagttaaggaactggctcacattactgtggggctggcaagtctgaaatctccagggcaggtgaacaggctggagacctaggaggagttgacactgcagtcctggcacagaattttttcctctccaggaaaccacagtttttgcttttaaggccttcacctgattgcatgaggcccacccatgctatggagggtagtctcctttattcaaagtcagtaccttcactgcaacagcaagcttagtgtttgattaaataactgggtactatagcccagccaagttgacactcaaaactgaccatctccccacctcagaccccatgatttagcacctcccctgctgtctggttagcttatcctgatgtgcccctgtgtttgtttattcattcaataaacatttatcaagtatttactagatgccaagccctttttccctaagcatagaggatatgcagatgaataaaataccaggactagtaataatagtaatgaaagtaattgcagataacgtttattgagcacttactgtgtgccaggcattgtgcgaggcacattacatgtggtagttttcttactaactaactctgtgaggtaggtccagagaagataagtcatttgttcatggccacatgtgaaggggcaggaccaggattccgtttgagtcagcccgactctaaagcccgggcacataactacataactgcatagaagctgagggcccaaagctgaatactgatgggttgaggggagaactagaggctgtagatgcctggttttgagccgtgtggatgaagagtgaagggagaagactgcagttggcttaggaagtaaacatagcagctgtagggtgggtcaggcatataagcctagaccccaggtatgggcgtgaggggaaggtatgtagacagagggacggtgatggagcaaggccctgtgggactcagggagaatgggacctagagcaccaggaagggtttggccttgaacaaggggagctattccctgattttcatgctggtggaaaggccacagcatgggtatagtggtaggtaggagtgagccgtggagggagagtatctgatggtccactttcaccctccctacaattcccagtttatatcagggacttgagcatccatggattttggtatccacagggggtcctggaaccaatcccccacagatactgagggacaactatacaaggactaggactgcattgggcctgaattacagaaagtaagtctttcatatattcacactctaggcattcctgcccttggaagaaacaacataccaggagctgagctccctcctcctgtgatgcaagaacagtacctatgttggtgagggggtggtctggagtaggctcatacagagatgggaaggaggagttgagggtctgccaggaagccctgtgttgggagggaagggatggcatttttgggacacattgaagcctagaggcaggaaacactccatcagctgagtggactgtggcgattcagatccgacgggagcacaaggtggaaaggaaggaactgtgggagttgagaagagagggagcctctacagagggattggggcaaataggggccacgtcctcagcccacagagcatgtgctgaagtgccccaggcaccccagtgcactcacagggcaccaggggatagtggacattttgaggaaaacagtaatacctgacatttgttgggacaccatacaaactactagcttgaaatagtttacaggtttatttttaggccacactgcattcctttcagtgacgtcgtatctttaagaagctgggttttcagcagttgctgtgaaaacaaaaaaggctaatgctgtgtgaaaatccgggtgaagaacaggtaacgagtgggagcaccttgtctgattccaaggcgtgggaaatggtgagctacctgacaggcacacgcatcccactgggaattagttttggttatttaagaataatattaacatttttctttagatttatatgaattattttttctggtggctacttagaaatacttactaagttagacgtaattacttaaatcagtgcaactgttggcattcccagccacattagggatttcttttggcctagaggtctatggaggaattactaaattccccatgtacctatgtactgagaacttttgggaagctctgggcctggtcccagatttcaattttgtgggcaagaatgtactttaccagagtgaggagcagcctgcagggcgtttgggctggaggcgggaggttagtaaggggttgctgaagtggtaggcggatggtgccgaagaaggcctcactaggcagtcatcatcaggataggaagtgggcacgggattcaggagaaatctggactttacagtggacaggatgtggtgactgaacgtgacagtgtgggaaaaagaatgcagggtgattcccgggctcatggcttgagaaatgagaccactgttgtgcctccaagtgacatgggaggctatagaaagtgacatgggaggctatagaaagtgacatgggaggccatagaaagtgacatgggaggccatagaaagtgacatgggaggccatagaaagtgacaagggaggccatagaaagtgacatgggaggccatagtgacatgggaggccatagaaagtgacatgggaggctatagaaagtgacatgggaggctatagaaagtgacatgggaggccatagaaagtgacatgggaggccatagaaagtgacatgggaggccatagaaagtgacatgggaggccatagaaagtgacatgggaggctatagaaagaggagatacaaggttctaagtgcaggcgataatgatctctatttgggactggcttcatttgaggtgcctttaggagagccgagtggcctatgcacagctgggtctgctatgcagcaggaaggctaagttggagacagatgtgagaactaaccatgaaggaggtaataatgcagaccaagggtctggttgaaatttcttctcccccagtccagggtgcagcgggtgagtgaaaatatgtgtgtttgtgtgtctgtcttcctagtcgggagagaagactgagtttgtggctctgcggagcatcaccatttaaggagggggaaaaggagacagaaggaattaccagaacactccagagggctccaagactgtatggtgggatcctagatggccaggaggaggggagcaaaaaggaaagagtcatccacagtatcagtaggatgccagttgaagtgtttttgctgcctcccggttatcggtgactttgatgaaagctgtcttctggtggtcatgggggtggaggccagatcacaaggaagctgggaatggtagatgagatagtaggggcttgcatattcattactgtctcgcagagagaaacctgaggctaagaggggtcttggatcaaaggatggggtgggtttatctggtttcggggcttttgtttttaatgagaaggagtcatttctgtgctgctaggagggatcaatggaataggtggggttaaagatacagtacggaatctacagttgatggcttgatgtgacaaggtcctcaaggagcctgaaaggaaggggtggggtccaagggcaaaaccgaggtatgagaagaaggatgcacaaggatggtttcgagtagacagtattgttggtagggacatgaaggaagcttagtggtctattgcagctagcctgtgttcccagtgaacctggaaacaaggttctcatctgtgctcaggcctcaggccagaaagggcaaggcagcagaggggcaaggcagcagaggggcaaggcagcaggctgagccccatttccccttgccataatactgctgtgcccctctggtaccgaaaatcaggagtttccagtgcaatataatattatacaagttacactgtattataatgtgtattgtcttttagtgtgttaaccaaattactgcagtattaaatgcaaattatactttgtttaactgattcttctcttcatttttagttagaaatcctgtgttctgtcaacattctccagtttatattcattgccttaagactggacaagatcatccactggccctggcttgtatgtaacttttaaaatccttaaataaacttcttttttattataaaagtaattcatattcactgtacaaagcttggaaaagacggacaagcagaagtaatagcctaatagtcacccataatcccaccatggggagataacatggttagtgtttttatgtctgtgttttatacaaacagtttggatataactgtgtgcaccattttgtatcctgatttttttgttttaatgttgtatcataaacattttatcatgttaataaaaggtctttataaacatgacttctaaagtttaattgatacaaaatattcttcaagtgcatgtatcagaccatcctcttatttctaaaatatggtatttccattgttgccagtgttgaatgattttaaatcatactgcagtatatatgtttatgcattaaaatttttgccttttgttttttggttgttttcttaggaaatagtccagaaatagtgttactgagctagaggttgggaactatttgagattcctatatacgtatactgcactgccaacttgcttttccaaaagccatacctggccaggcgcagtggcttacacttacagtcccagcactttgggaggccgaggtgagctgatcacttgagctcaggagttcgagaccaacctgtgcaatgtagcaagaccctgtctcaaaagaaaaaaaaaaaaagccatacccatttacactcttgctggtggtggcatctatgtcatgcttctaaactgtgacttcagttactgggcatttggttgaaattaactgtgaataaatgggtagatggatgcagagatagaaagataagtggcaaggtagaaattagagaacacagtatagattccactattaaatgcatggaaaaaagatggagactaaaggcagaagagttccattgccactgggaggtaaggtcatgctagtgtttttgttcggttttattttctctgttgtttgatgtataattttgcatacaatatattttatgtattaaatatagctacccttaaaaagtgaaaagtatagtaaagaattgggagcagagaagaaatgaagggaacctaagtatactccatatttaaagatgggaataatcacttctgcccaaagtctttgataaaacattcataataaaaaatattcagtcactcatcctacaacttcacagtgctgtatctggagaatggtcattgggttcaaaactgtttctgttgtgacgtgaaggaaacatatctaaacaagaccaaattttttcgtataagatactgtcagggaaaaaaaagattagtaattttgagagctttccacaaatgagaagaaagattttttctgcccttcatcctctgtagatcccagttgatgaagcagtctgagtacatgtttcccatagtgagcaagagaaaacaaggaagcctattgagatctaacattccacccatgaagggaacttcagtaaaaaggagaatctcatcacagaatggggaacggggaagaaaggctgtgcatagactctgcagagaaacctacaatcaagaactggtcaggagaagtaaaattcgtatgccaactcaaatcatagatctaaaagaaaatgtaaaactatagatctgttaggaaataacataggacagaatctttggggtttgcaattaggcagagagtacttagaaatggcactgttaatatggtccatacgagagagaaatcataaatttggacttcctcaaaattaaaatgaaatgaagacaggccacagactgggagaaaatatttgcaaagcacacatcaaaacactgacttgcacccagaacatacagagaactcttaaaaactcaaaactgcaaaaagaaacacctaaaaattggcaaaagagttgacaatttgcgaaggggatatacacatggcgaaaaagcacaggaaaagatgctcaacgccattacaggttagggaagacaaactacaaccaggatgagggcccgaaacacatggcttcagaatggtgaaactcagcaacactgacgaggccacgtgcctgggaggatgcagaggaactgggacactccagtgttactggcgggaaggcaggtggtacgggcactgtagaaaatggtttggccatctctgatgcagttaaaagcgcacttcccgtgggacttggctgccccactcctgggtataagatttacccccagagaagtgaaagcgcgcagccttgtagaaacccacacaccagtgtttgtagcagtcttgtttgcattttggatagcggccttgtttggttttcacaaaccaccctcagcggacagtcagataaactgtaggcatccatacaatggaataccactcagaactgagagggaacgacctgtggatacagggagggaacaacttggatgaatctcattagagacattatgtggatggcgggaagccagtctcaacaggttacttgtctcgcgatgccatctacataaagttccagcagagacaaaagtacagtgacagagaacagatcagtgtttgccggggctaatggtggggacggtgtgatagtgaagggacagcacggagagttttgcagggtgacagacctcttctgcatcctgccaacggctgtgcgaatctacttgtgtgaagactcagggaactcacaccaaaggaagacggtcacttttcctactgtatgatagataattaataaaaagggagaacggaggagtgtcgtcccaggaggcagggcaggagggcgaagacgtgtcacaggggagcctggccaagtggcgcccccggaactcgtcctctgggcttgtgtgtggatgagacaaggtctacctggtacgacagggacatactgggaatgcgcccttgccgtggaggcggggacccggcagcgctacgtatccagcatcaacctgtatccagcatcaacccgccaagttcactaacttggtaggggtgaggttagggatccttaggagcccaggcagccagactttctggggagcccattcccatttgtgttgccaaagtacccccagcaggttgtgggaatgttgcctgtgaagagagtctgttggggtgagatcttgtgtgtgtgcacagggtgacagttgtgtcccatttcccgggaagctgtgatggcagcagaacctagaggagcctgagagagtgtgggagagtgggcctctggaagagtagaggctgcggagccaggtgcagggctgtctgtcacccaaaggaagagggactgatgactcactgagcgtgtgtgtcccctggtggcagcaggccccatagtgaacataccataccttttctgtcctgagcgatgctcccagcagtcctgggagatggaacggtccttattcggctcacgggaaggaccgccttaactggacagacacagcaaggtgctaaagatgccttccatcagaggccaggttggaagctctaaagagacttctcttgctgttctctcacccacccccaggttgtgtgtgtcccgctgtggattctcatgtcctttctgtgcctggtggtcctctactacattgtgtggtccgtcttgttcttgcgctctatggatgtgattgcagagcagcgcaggacacacataaccatggccctgagctggatgaccatcgtcgtgccccttcttacatttgaggtaagcgttccacgggaagcctcttcagcccctgaagcttgcgcttcccctgacaggattctgcacccctagaaaggcagcctctgtccctcgagctcacagtgagcccactccaggagaggggagagaacacagccatctccgagagggagcttcggtgaaaggagagcatccttcctttctcttgggggcagcacgtggggctggcagggagaagagtgcacctttttagccatggtgcctctgtatggctccagtttccactctggggaaagcagagtgggatgtcagatttgtgtattggagtcacgtggagaattctagaatgggagctgttgactccttagaacaaacacccggaggagtttgccataaaactgctggcactgggaacttttcaagtggataggctattgccgagctctgaagagggacataaaagctcatttcgagctttccccagggataggtggtttcctgcctttttctggcggtgctgatgttccctcttgtgggagctcacgcgggggtggggtggtggggaggaactgcctaatgaagtctggcttccgcctctgcccattttcggtgctggcatcaaccgggactatgtctctttctttagattctgctggttcacaaactggatggccacaacgccttctccagcatcccgatctttgtccccctttggctctcgttgatcacgctgatggcaaccacatttggacagaagggaggaaaccactgtatgtactcagcatttcagaagtccttggtgtgtgtctggggggggaccagggagtgggggggggggcggatagaagtctaggaagggatgagtccccgagggccccaatttagaagcttgtgtgggaaagtgagggctgaggaaattctgggaccttctaagggaagggcatgccgtaactctggtgttctgctggcctgcaccgggacttttctcgcagtgcacgctgccatttgaggtagaaccagacacggcaggcaacctctcagagatcccgttccctcctctgcaaaatggggatcaagacagattcttcccaggcccgggagggtttgatggaaaatccacatctcccacccaaacctgggattcatcctaggtccctgttggcctctctgcctcccccatatccttgctgccatcacccgagtcttgcctgtcttgccttgctaacactctattcccctccacctgcttgctgaggcagacacttccaaaacgatctctgcagagggtgccttcctggcaaggctgtgggctccatggcacggaagcccagagcattgcccttcggaaagccagtgggtttgggggcagggcctcactgcagcccagcagcccgggctgtgcttgctgtttgtgcctctgccccctaccccgcacccgggagcagggagggcttgcaccgagctgacactccagtagcctacagagaggagtagtgggactgggaaagtggctttaaggtggctccatgagttcaggccccctcctggccaggacccgtgcatgactaccgccctcacggattccagagggtgacagaaatcttgttcttgggtggcactgtcatccatgagtttatcctggctggagaagattagcggaagacaccgtagtctgcgcaccacagatattttgagactcactggagcagtagttctcaaacttgggcatccagcagaatcccaaaagggccaggaaaaggggaccgctggagcccaccctagcccgactcagtttctggaggtctgggctggggcccgagaatggcatccctaactaggccccgtggacgctgtccctgccggtccgggaaccccactccaagcaccacagagctagcatttgcacttcttccccattttgggtactcaagccctgttcaggctttgtgactcaggagtctggataaagtatgttatgacattgtaggagtgaaacttcttgttacggaaagaaagttaacaggaaggtcagttgagcctcgtgtgtgaaataaaaaattcttatttttcagggtggtttggtatccgcaaagatttctgtcagtttctgcttgaaatcttcccatttctacgagaatatggaaacatttcctatgatctccatcacgaagataatgaagaaaccgaagagaccccagttccggagccccctaaaatcgcacccatgtttcgaaagaaggccagggtggtcattacccagagccctgggaagtatgtgctcccacctcccaaattaaatatcgaaatgccagattagatgccacttccggggacagagcttaagtggactgggacgcactct

SEQ ID NO: 3914 - DNA, 35271 bp, human
gtacggaagcccggaaggaggggcagggggcggtggctcaggtttctccgggcggcggcggcggcggcgacggcgacggcgacggcagcggggacggcagcagtagcgggagcagcagcgtggacgcggctggcgctggcgccatgaacccgctgtaaggcgcaggctgtgcagcacggggtgcgggggaggaggaggaggacgccgcggtgaagttctccgccatgaacctgaggggcctcttccaggacttcaacccgaggtgaggcggcgtcgttggcgcccccgggagtccgcgctgcgggctcgggcgcgggctggtgttcggctccggggaggcacggcgggcgagatgctgcagcccgaggacccgggcgcctgcccgagcctccctgcgggtgcaagcggtccccaggcaaaacagtcggcctcggcgcccgcccgcttcctcctcccgtgcccggtgctttcagcccctgcccggccacggccggaagggcccggccgcgagccccgtcctgccccaagggaaccccattcttttctgcttgctgtccctcattggtgtcccaacttcttcgtctcggttccatcctcttctgcgccgctgcgggccctccattctccgcgtcagggccgtctcactcgacccaacacccctacccccaccccagctgtttcctccagttcctcgcagtccttggggttttccttgggtttatgcccatccctctcttgtttgcttctttgttgaacggatacctgaaacactgttgaatccttggagtcagtgtcggggtatggcaataccttatataatgcatttctgggtgagcctgatcattttccatactcattttctcatcagtcttcactacaagtttatttgcaggaagtagatattgctgtccttcttttccagatggggaacacccagtggacagtgtggagaaaacactggctaagcactcaagcgcctgtccttgcacttgcccgactgttttgtaactgttctttaccccaggctgtgagctccctgaagctgagaccatctcctgctcatctcagtgtccccagcgcctcccacccaccgtatctggcacatagtaggcacatataaaatgtttgtggaactaaactgagcccaaagacttggattggagacgaggccatatgtaactgggtgattctctgcccttctttggcccttctgtaaaatgaggagttggcctaactgatctcttaaatgcactactctccgaaaggagtatccgtttcccttatttgccagttgggaagacgtgctcagtaaatatttgtgtgctgtaacctatgctaggtgctttagatgctggcggtctcagcatggggtgaagaagggcttgtacacttaagatgccttacagtactgtgcagtgctgtactgcgggggggccaactctggggacctatgccttggctgcttgttgaggatgaaaggaagttttaggggagtatttgtatgttgagggtgcagtctccctagggatggtgacattttaacttgtgagtcattgtgactttgtatgtgctcttattccactttgagttcatgttctggttaggagtgccagtgtctctaacacggtgcagacattatcattgttggcttcgaaggcatagaggaggtaacagaactaactgcagtcccttcctctgctgcatcagggggttaagattggtctgcagggtagtagggttggtgctgtggctggacaagccctgtatgtcttctatttggagatggtgataagaaagttaagtaaaaactgaattgttttgtgcccttgggcaactcacttatctattgttttatctgtagaatgagtataatctctcagtggggtagggaggccaattaaggattgattacaaagtgccttacaaatagaaagctacagtgacttgtttgcaaggtgacagagaattcagaagcctcaagaaactgccttaagtgatcaaacaggctaacagagttgccaaagcaaaatagtgctgcactgatactacctttaaccgttttttcctttagcccttttccccccaaaaaaattagtatatgaaattacagtgaaatacctggtatctaagcagatttatagtaattctcaacatattcatcaatctcttaattctacctgcattaaaatgtatttctacctgaaaagtttaaaggtcttttatactgtgccattttcctgattcattgttgccagaggtagtgagttccttaattttacagatatttcaagaggacattggccaggtattattggtaaatcagatttgtttttttagctggtagtgtttcacctctcctgagcactcctagtttttgacagtgtgctttagtctccttccatgctgaggaaggccttctctataggagaaagaaaactgaggggtgtacacaggaagttaccttatgctggggactcaaaccttgatgctactgctttgctccctgcctctatttttgaaccaattcaacatctccctcctaccccaggaccttgtcacacactgttctctttaccaggaatgtttccctctcttttcctctcctccagacctagtgaactcctatttatcctcacttggcacttgctaagggaagcattcctgacttccctgaccagatttactgctccctgtttctacagttcctgtagtatttactactcctccatcatagtgcatatttgtacccttgtgtctgtctggatgcttatttgattaatacctgcctcccccactaaactttaagctccatggggtcaaggccgtgactgtgtcagtatcgtagcctgcatacttggaatagtacctggctcaataaatatttgtggagtaaataactgaataactctccagagcctataagataaatctagagctgctgctttcaatcactgctttcctggtggtctgtggcctggttctctttcttctcacactcttcccaccttcagagtgcagccattgctttggagagatgggagagaacatggcactaaggcagaatatggctatatttactttgaagagcatgtctttgtcatagaaatagtcactgtcatggtttggtgggtcccaaggcatgggtcatggctccagatcccctttccagccttttggatcttggtaagtctgaacccactgctgcgttggcaaggctctggaaactatagtgacagagaatgattcacaagtgtcaacactcagatgtacagggctgccagctgacccactctacctatttccatctggcactgaactggttgatcatgaacttcttttcataattgctttttagttatgcaggttaagacatgccgaaacagatgtaccggacccacaaacaagtccttccttgaatgcctgaggcttcctaacagtgaaagagccctgttcttagagtaggcaaactgattctgaggcattgtaggtggtagggatctggtagtaggtagcattaggtgggctcccggcactcaccatggagccttgaaattttctgctactttgggggagttgctggttcagagaaggcccttccaccctggtagccatgtggcactggaaggctgtgaaaactctgctgggccttcttagtcatctgttgtgagctcctgatgggagtgtggtgtatccctcaggtgtgctagactggaacaaaggctgagaagtgttgctctgggggttccaacttgtgggcatggggtactgatgagatcagtagtgtttggagacttctgtatgctccatcttcagaagacattctggagtccatataagttatcttgtctcttgtttgaagcaggaaaaaggaatgcgattgctggtaatatagttcactaaagtcagctacctggcctctaacagttatttgcaaagtatattataacattgattcctcaaacatctagattcctatctcgtgccaagtgatgtactaggtgctctaagtacaaaaataaaggaatatagtcctcctctcaatgcgtaagcctagtggaagaagcagaaatgaaagggaaataagaattcaatagagtatgaggcattacagtgaaagaaaccaaatgtcttagaagtacaaatggcagagctactaattctgtctcgagcaggcagggaagagtctatagtggaaatgacttttgagctagattttgaattgagctagtcttttgagccagacttttgagctagaattgtagggttgtcatcagaccagagagtaggaagggtaccttgtgaggaagagagagagagatcagattgttactgtgtctatgtagaaaaggaagacataagaaactccattttgatctgtactaagaaaaattgtttctgctttgagatgctgttaacctgtaactttagtcccaaccctgtgctcacagaaacctgtgctgtaatgaatcaaggtttaatggatttagggctgtgcaggatgtaccttgttaacaatatgtttgcaggcagtatgcttggtaaaagtcatcgccattctccattctcgattaaccagggacacagtgcactgcggaaggccgcagggacatctgcccaagaaagcctgggtattgtccaaggtttccccccactgagacagcctgagatatggccttgtgggaaaggaaagaccttaccaccccccagcccgacacccgtaaagtgtctgtgctgaggaggagtagtgaaagaggggggcctctttgcagttgagataagaggaaggcttctgtctcctgctcatccctgggaatggaatgtctctgtgtaaagctgaccattcccattcgttctattctgagataggagaaaaccaccctgtggctggaggcgaagtatgctggcagcaatactgctctgttactctttgctacactgagttgtttgggtaaagagaaacataaatctagcctgcgtgcacatccaggcacagtacctttccttgaacttattcatgatacagattcctttgctcacgtttccctgctgaccttctccccacctgttgccctgctacactcccctcgctaagatagtaaaaataatgatcagtaaatactgaggtaactcagaggctagcgctggtgcgggtcctccgtatgctgagtgccggtcccctgggcccactgttctttctctatactttgtttctgtgtcttatttcttttctcagtctcgtcccacctgacgagaaatacccacaggtgtggaggggctggcccctttcagtatctcagaagggacaaagtacacaaaggcatggggtcatgatagtgcctggtatgttcaggtagtgaagaggtccatgtggtatgagcactgcagatgatatgtgtcgtatgaattaaaaatacatagttactgcaaatagtttttacaggttattgtttttaagaaagcagtatctaatgcacgagtgtactgtcagtactgtcaatgaactacttaccactcaagtgactgcttatctgttgttctgtcctctcaagccacctacagtcagaaaatggtcttgattttactgatgttgctgttaataatagctgtgacttcttgagtacccaccacatgccaggcccaatgtaggggctttgcatccattatccatgatctttacaacaaccctgcaaaattaggtatcagccttattttaaagtcttgacagcttgtgacttccctgaagttgcataggcaggaagaatctaagtcaacattcgaatccacgtcagtctcatgaagcctgtgctctttcctgcgtgccatgccatagttctagttaagtgacaactcctttcctccatgacattgtagatccagtatgctaaggaaccctctatttacaaattgtaagtgattaaacaaaacaaacctgttagtggcgcttatacatccaaatgagtgttgttattcaaagaggttacttggggaaagagaatgtatacacctattccattgttcatactccttgttactcatctggaattccctttaaagtcagtttacatatcacataagaagatccatctcattgctttatgatcatctatcattttcaaccaaaatagttccacctagtttgatcacacatcttattcactaaccttggctctgactgactgtttgccatttccaaaatttgaatccaccctcagtgaaaatttagcaccatttgggatagtcagaagatcagactgcaggttctcaaggtgcttccaagaagaaagcttcaaagatgatttgagtaatgaagtaccattggaattactgcattgcctcccaaggggactggttaaaggagagaaatctcatttgaatgtataatttccagttttaaaagtatcattcctattacttgataattacacacacattgttcttagctgtgttctttgagggccaggatttggaggtgctgaattacgtgctgaatgagtggatgttgggtacaaatagacatctaccactgggaagtctttgttgtacaggagagaccgtggattgaaggagttttagatagtttcctaggactccagaagttaagctttttaatatggagcttgagttttctaatcattttgcctgatatgtcatgcctgtacaagatgactggaatttaagacaaaagcctcgaactctggagatagatgctttataagtggagactcatactttgtcagctccaacctaatagtgacaacaatgattgctaaatgagattattacctacaatgtggcagaacttttgtctttcataatactgctaaagctagaatgggtaaaatgtatcatttacacagtgctttcacatacccttgtcttaatgaatcagtatatgaggaatcagatgaggagacagacctgggggaaaataactcacccaagaccacaccgctgatgaatggcagttgaggaacttaaatgcagatcttcctactggcctgggctctgcttttatttggcttttgtgcttttttgtatctactggttaaatgctcttaaacattttttatcttaataaaaccagctaaagtctccactaaaagactttaaatttggttaataaggtgtaagaggggcagttcccttgatagtttgtgagtatgtcaggttgtcatttggagccattctgtcaagctttagactgggatgtgccatccaaagtttgtgtgtgtgtatgtgcttgtgcgtgtgtacgtgcatgcaggcatgtgttaatgcgcgtgtatgtgctccagtgaagccagcagcttccactggaaaaaaactgataggtctaaaaagagtccagctgcattcttatgatatgcagaaaacagatactagaacttttacattcagagtcatcattcctttgctaagtatattctctctctccctcccttcttccttttctccctccctattctcccaaccctgcaaagtggagagagggaatttgagcctgagcagaaagctccatgtaaatttcagagaggatactagctttggcccaggtagcactacttagtgattcatcgtatactaacactacagattcaaatgagagtggaataaatccattctaaaggtgtaactggaaaagtgaattttaagaagtagtgattaatgttaaaccagaacctcccatttctcccaggtttgtggagaattaagcagtctatttttatacttggaatctggtctgaatgtttcttgaaaagtaactcaaagtagtttaggctatgaccataagttatttttgtaaatacattttcttatcactgtattattgcatattattgtgtattcttttgcaaatcaggcttgatatttccttttggctatgcagtcaccttttagactttgcttgcaaatatattgatatagttaagatactattctttctttccccaactaggagtgtgtatgaattacatcttttgaacttactgattgtattactttgttttacttgatcaactttgtagtttaatttttttaaaaagctagctgttgggattactgatcagtttcatttttatatctatatttctacttttagttttattattttcatgttttggctttttccccaaatttcttagaaactcagtttactagttttcttttgcctcttttttttttctttgttttctacttttacttaaacattttaaatgaacacattttctcttgagttttgttttggcagctgcccaggtatttttatgtttcaattgtattttagtaactctactaaactgcttaacaaatcagtattgaaaatgatccattttttgtcagtgtttttatgaattgtataaaatgtcaacctctggtctctactgattacaatctaccttacacactcatatgtatcttctgtcactcttgttgagaaaatctgcagtggccccatattacctattaataaattccaaggactttaccttgatattcacattcccctaccatgttaccacagccaacttctggcttattccccccagtaccctttctcctgtctctgcagcaccctacccaccacgatttatagaaagtattctgtgtgttccagtctgctggaattggagaggggaggataaagaggggatgagcaatgggtacaataatacagttagatagaaataataaatctagtgtttggtagcacaagagggcaaatatagttaataatgtatatttgcaaataactaaaagagtggaattgaaatgtgcctaacacaagtaagtgatcagtgcttgaggtgatggatatcccagttactctgatttgatcattacacattgtatgcttgcatcacagtatcacgtgtaccccataaataggcacaactgttttgtatccataataaataaaaataatttttaaaaaattggaaaacatcttattccctttgtctggaattccttattcccaacttgttgcccagattccacttctcttcccatctctctcagggaaattaatcttccaagtcccctagtttaccatatgtagttacttgttgatacatcatctccctctgttcctattagtctgagcatcttgagcgaacgcattgttgctcctttttatgtatctcacacatttcaggcactcaaatatttttaacaattgtaaattagatgtgtgtttattgtgtattgctgccccatgatcctttttttctccctggaaaaactatatatatgtaaagcaagtatgttttcttgttctgctacgtaattatcttcatataagcttgctgttttttaaattttctcgttctgctacttaattctcttcatataaccttgctgttttttaaatctactcttgtgttcatttccgtattttccttaggaactttgtctgttttatctgtcatgatttaagagtagcatgaggaagcccacaattaaaatatttctgtgtatccttaaaaaagaaaaattgtaaaattatttccatattccatggtcatgttaggtttttgttatttaggttttccttattagtccttttagcattttaatactttcggctttgaaatctaatttatctaattttaaagatagtaaattgttgctcttgtcttcatccaggcgtgctaaacctctgtcatctgatttctgatagttggttcgacttttgactttggttccaagcgtaactcttgaatgtaacaggtttactttcttaatctaggaagcaacctttctttttacagagctgtggtaggcagaataatgacgcccccaagtatgtccacatcctaatccgtggaaccagggaatatgttctgttacatggcaaaggggaattaaggtagcagatggaattaagtttgctcatcagctgaccttaaaatagattattctggattctctggctgagcccaatgtaattacagggcccttaaatatagaagagggagacagaaaaggaggtcagagtgattcagtatgagaagaactgcattctccattgttgactttgaagatggaggaaggggccatgagctaaggaatgtggcagcctctagagctagaaaaggcaaagaaacattctctcctagagccttcagtagcatagtcctgctgacacctcaagtttagcccagcgagacccatattggactctgacctccagaattgtaagggttatgccttttaaaccactaggtttatgctttttaaaccactaggtttgtggcagttttgaatggcagcaataggaaattaataagagaacattcagctcatgtatatttttctaaccctagtatttgaatcatgaattatattttgtgggtccttttgtaagtttatcttgttttctatttttcatgtaatagacataaaattttaagtttcctttaaattatgtcaaaaaccacataaaataatcccttttccaacatttaaaacattttggtacttctcttttctttagttccactactctctttttttattaaataaggaaactgttttacagaggataatgaagttagcttacagcatttaccaccccccccaccaatttactttttatttatagtctgaaaatcctttaggataaaaattacctgtacatgttatctaatttacatatgaatcctgtgtcgtcattatcttagcatttgttaatgtttgaatccactaatttcttttttaaatagtctgttttcaagtccattgtttctggtaattatatttgtagccacaggctttagttgacaaattggttctgatttttttagattttggaatatttccctctgctttaagagagaaaacttctgcctctactaattgtgtactgtaattgtggtgataactccatttctattaacttgtgaatcaccttgacacaggctctcttcttgtccaaagtctaagggatgaagtcatttttatcttggtttctttaaatgttctttctttgtagcagcttataaaagcctgtttttgttttcgagtattaataatattagctaatgtgtattgagtacgctggttatcagactgtttcccacagaccttgggagtgggccttgagaccctttccaggtatctgcaaagtcaaaattataatactaagacattctttgccttggtcgacattggcactggtggtacaaaagtagtgcatcaaacagctggtgctggagcacaaatcaggacagtggcaccagctgcactagtcttctgtcactggattcttcaccaccacgtgctggacttgcagttaaaaaaaaaatgccagcttcacttacgaatgtccttgataaagcagaaaaatattaatctcatttaatcttgacccctgaatgcacatctagtttaatattccatgtgatgaaatgggaagaatgcataaaggcctgttgtatgctgaagtgcaatggttgactcaaggaaaaacgtgtgtgcctgagttacaagctgctgttttcatggagtatcatttttatttggaaggacaactgacagacaagactgtggttatttgtgttatggtgtttggcagacattttcttgaaaatgcaggaagccacaataaacatacgtgtgcatgtgtctttatagcagcatgatttatagtcctttgggtatatacccagtaatgggatggctgggtcaaatggtatttctagttctagatccctgaggaatcgccacactgacttccacaacggttgaactagtttacagtcccaccaacagtgtaaaagtgttcctatttctccacatcctctccagcacctgttgtttcctgactttttaatgattgacattctaactggcactattcacaatagcaaagatttggaaccaacccaaatgtccaacaatgatagactggatcaagaaaatgtggcacatatacaccatggaatactatacagccataaaaaatgatgagttcatgtcctttgtagggacatgggtgaaattggaaatcatcattctcagtaaactattgcaaggacaaaaaaccaaacaccacatgttctcactcatagatgggaattgaacaatgagaacacatggacacaggaaggggaacatcacactctggggactgttgtggggtgggggttggggggagggatagcattaggagatatacctaatgctaagtgacgagttaatgggtgcagcacaccagcatggcacatgtatacatatgtaactaacctgcacattgtgcacatgtaccctaaatcttaaagtataataataataaaaaaaagaaaaaaaaagacaaaaatactataataaaagatgcttctatcacacacacaaaaaaagaaagtgcaggaagcaaaacttcaaggaaaacaactcatggtattttttgtaaatggtaaaatttgatctttcatgggaaaaccagaatttttgaaaagttgtatctgctaccatgagcttgacaacctcccagtaattaaaatatttctgatgaagttggtgaagatagtaagtaatgtgattttttttgctattgtatatgaaatgtgtcaacatttgaaagatctttataactcagtaaaccaatattttccagtcgacctacattgcattatacaataatgctgggataaaagattcattgaaagtataagagagaccagtggatttcagtgtagcagagtacaaaaaggtcattgatacgatttcagattccacatcatagttaacctttaagaaactaccacttgttgagttttagtgtcctgttgaagaacgtctaccattatctgaaagagctattaaaatagttcttttctaactacagatctctgtgaggccagattttctttgtatacttgaaccaaaacaatgtattgcaacagaatgaatgtaaatatagatattagaatctaggtgtcttctatgatatcatacattaaaaattttgctaaactgtagaaacagtgtcgctactctcactaaatttgtgttggttttggaaatgtttttaaataatgttatgtatgttagtatgtaatgtgtttattattaccttcgaagagtagatattttttgaataacaactgtatcgtaaatattaaataccaatagggataacccatatcaaccagagctctttgggatcctcagtaagtgttagaactgaaaaggagttctttttaagagttaaacgtcaaaatttttgatactaaaaactttgagagccactgatttagtgctttatacaaagcacttgttatactcattatcttatattcgtagccaccttatgaggtacatattattgccctaactttatgggtaagaataccatgacacaatgatgctatgtatatttttttagcaacccctctgaatctcatgatcttcccagcgtagttttctctctgggaggcttgcttccaagtttaattttgtaggtccagtcttcttacaaccctcctcccttttttccaatcgaagtttcttatgttatttttcatagtacaaaaacagtacacgtaccttacagaaaactcagatatcataagcaaaagagtataaagactatccttaatcttcccgagtggagacctgttagctgctcagcagatatttatacagatgcttttctaaacatgttcatttatcagtgtaaagccggtatagtataatactcaattagaaggattttggagtcaaatggtttgactcccaactctgagctcttagacaagttatttaacatctgagctttctgttccttatctgtaactgcactgatctgtttttctgtgtctagagttttgccctttccagaatgtcaaataagtagcattgtacactatcttgtgttttccatctgaattattttacttatagtgcattttagattcatcaatgttgttgttgtcatccatagtttgttactttttactgctgattagtattccattgaacggatatatcaaaattcagttaaccattcaccagtttatggatgtgtgagttgttaccagtggcaattatgaataaagcttcttggaatatttgaatacaggcctttgtgtggacatacgttttcctttttcttgagtaaaatacctaggtgtgggattgctgggccatagaataagtatacacttaactgtataagaaacttccaaaatgttttctaaagtggctgtactattttgcattcccaccagcatatataagagatctagtgtgtgtgtaatcttatctcattgtcattttagtttgcattgtcctaacatctgaaaatactgagtattttttgtgtgcttatttgctttttgtatgccttctttgatgggatgtctctgaattttttggccattttaaatcgggttgttcacttatttttttagttgtaaaagtcctttttatatactggatacaggttactttgtcagatacgtgttttcagagtatggtctcccagtttgtggcttggctgtcattttgttaatgataggtatcttttggagagtaagagtttttcattttggagaagtccaatttcatatcccatctaagaaatgtttgcctaaccgtaggttgcaagtatttttttttcatatgtgttttggacattttatagttttgtgtatgacatttaggtctatgatccatgtcacataaatttttgtatatgttataaggttaagagtcaaggtgtactttcctcatttatccagttgtaccaccatttattgaaacataattatttctccattgagttgttttggcacctttgtggaaaattaactgactctatatgtatgggtctgttttccaactctctagtacgttctatatatctattcttatgccagtactacattgtgtttattactgtagctttatagtaagctttgaaagcatgtagtataaattgtccaactttgttctttttcagaattgttttgcccattctaggtcctttgcactgtcatatgacttttaaagtcagtatgtcaatttctacagaagaacctgctggctcccaattttcgctgggattgcattgattctttaaaataatttggttaatttggtgtgtgtggtaggctaaatcatgacccacaaagatacccacttccatggaacctgttaaagatcttgagatgatggggttatccaagtggggcaataaatgcaatcaatcacaggttcccttaaaagagggagataatattaagaggagaaggcagtgtggtggaaacagagacagagatttgaagattttatgcagctggttttgatgatagagaaaggggccatgagccaagggaatacagctctggaaactggaaaaaaacaagtaatagattctcccatagagtctccagaaggagtaggtcctgctgacatcttggttttagcccagtgaaaccctttttggacctctggcctcaggataataaatgtgtgccattttaagtcaccaattttgtggtagtttgttacagcacccataggaaactaatacacagaggatgtaaatcttaacagtattgagtgttctatgaacacagtatatgtctccatttatttagatctttaatttttcttggcagttatgaactgaatgtgtccctttaaaaatcacaagttgactctagtccccagtgtgatggtatttggaggtggggcatttgggaggtgattaggttatgagggtggaaccctcatggttggaactagtgcccttataaaaagagaccagagagctaactcactctcttttcaccatgtgaagggtattgagaagtctgccatctgccacccagaaggcagccctcgccagaacccagccatgctggcatcctgatctccaacttccagcctctggaactgtgaggaataaatttctgttgtttattagcttccccacagtcctaccagtgttttgtaggtttcagtatataggttttgcatatatgttgttacatttatccctaagtgttttatatttgtgatgctattgtaaatggtggattttttcataaacttttaatttttgaatagttataaatttataggaaagttgcagtaaatgatacatatttttaaatttctgtttccaatttgtgatagctactatatagaaatgcaataatttttgtaaatttaccttgtgtccttcaattttgttaaattcacttactagatctactagcttttttttagattacttaggatttcctacagggaatatcatgttgcctatagataatgacaggtttacttctttcttttaaaactatattcttttaatttctttttatcatcttattgttgtggctaggacctttagtacaatgttgaatagatgtgttgaagtggacatacttgctgtgtttcctgtcttaaggggaaagtattgagtctctcaccattaagcattataactgcaggtttttcatagatgctcttcttttcctaatttgtttaacgcttttaacttgaatgggtagcaaattacgtcaaatgctttttacacaactattgagatgatcatatgatttttctttttcagcctgctaataccacgaaggttgctaactgattttcaaatgttaatccaagattgcaatcttgcaatcctagctaaaccacacctagtcgtaatgtagtatccttatatattgctgaattcagttggctaaaatcttttcaggatttttgcatctctgttcatgagagatattggtctgtagttttctttctttgtcagttttgttatcagggtaatgctggcttcataaaataaattgggaaatgttcccccctcatcttttttgcaagagtttgtgaagaattggtggtatttcctcattaaatgtttggtagattttgccatggcctgacattttctttctgaaaaaggttttaactagaattgcagtttccatgtctttgtttcaagaaatttcctggcataaagttgtttataatatcccctacttatccctttagtattattaggatttgtagtgatatccctgttttcattcttgatattagtaatttgagcctactcttttttactgattattctggctgtagatttaccaattttcttactttctcaaagaaactgcttttagtttcattgatttttttctctaatccctttttactgtattttattgattaatgtgcttacatttatcattttcttctttccatttactttttaaaaatttccttccgtttcttacatggaggttccttacctccatgttctttctagtttcataagatagaatcttagattattgacttgatatcttttctaatgtaagtatttgatgctaaaatttcccttaagtactgctttagtgtatctcacaaattttggtatattgtgtttttgcctttagtccaaaatatttttcaattttcttcatagtctttgacctatggattatttcgcagtgtggcatttaattttcaagtattttgagaattttccagatatttttctattgttgatttctagtttgactccattgtgcttgtttactttgtatgatttcagtccttttaaatttgttgagctttgttttatggcccagaattcaatctatcttggtgaatgttccgtgtgtgtttgaaaggaatctgtattttgcttttgttgggaggaactcattaatattaattaggtcaagttggttgatagtgttgctacaatcatatatatccttagtaattttctgtttatgtgttctattagttactaagaaaggaatgttaatttccatttataacagtttgatttttttatttctccttttagattgatcagtactttctacatgtattgtgaaactttgttattaggcatatgacaaattgacccctttatcattatgaactacctctatttgtccctggaaatagtccttgttcaaaaatatactgtgtcttatgttgtggtaggcagaatgccccacccccacaaatacacagatacccaggccctaagccctgaaacctgtgaatatgttattattttacatggcaaaggggactttgaagctatatttattagcattcgtttctgctgttaccatgacaaattactctcagttctttaggtcagaagtccgggtacagcacaactcagatgggtcttctgcctagtttcacagggtcaaaatcaaagtgtcaggagggctctattcctttctggagcctccagggattaatctgctttcaagcacatttgggctattgtcagaatttagttccttggggttgtagggctgaggtcccatttaccttgctggctgtcagctgcgagttattctcagcttctgaagcctgcctgcattccttggctcatggttccttacctccatgttcaaagccagaagtaacaggctgaatccttctcaagtctggaatctctctgacttctgcctcatctctcttccaccacatttctctgacttactcttctgctttcttaagggcttatgggattacactgggcacacctggataatccagtataatcttcctattgtaaagttagctgattagtaaccttaattccatctgcaaagtcccttcacagtattactcagattagtgtttgattgaataatcaggggacaggaatcctgggaaacttctttagaattctgcctaccaaccacagttatggaccttaaaatagggagagtagcctggcttaaccaggtggactcagtttcatcacatgaactcttaaaagcggagaactttctctcagtggaagcagaagcgatatggcagaagtagtgagaaaacatcccaagcatgagaaagattgaatatgctatagcttgttactggctttgagatgtaggggcctatttacaaggacccaggagaggcccctactatcgcaagatcagctgctgcgtgacagcaagcaaagagacacatacctcagtcctacaaccacaagaaactggattctgccaacaacctgaatgagcttagaagtagattctgccagagtcccctgataagcattccaccaacagacatctttatttcagccttgtgagattctgagtagagaaaccaaccaagcccgtctcgccttttgtcatatagaactgtgagataataaatttacgttgttttaagctgctaagtttgtggtaatttgttacagcagcaatggaagactaaacagatattaatatagtcattccagctttcttttggttagtgtttatttggtataactttttctttccttttgcttttaatctatctgtgtctttatagatagataaagtgggattcttacagacagcatatagttgtcttgcttacttatccaatctgatcatctttgtctttcagttggccatttatatttaatatagttattgacagggttgagttttaactgttttcttgctgcagcctggaaactgcctctgatctgcaaactggggcaatagtagggtttacctcctttatttcctccttctcacctgttctccactgcctgttgtcaatgtctgaaaactgttcttttgtagactgtatcaagcttcttatttaggcgggaaggtaaattatattcctattattaagtcaaggctggaaatagaggtcctcaagagtataatttctaattatttcaaggacatcctctgtagcaattcccttttatatgagacgtgagcatgtgtgtatgtgtaatttattcattcatggaaagtataatacatacactaaaatgttcatgccatatgaatatgacagatggctgcctttttagaaatagaatcagttagtgatagaacttgaccattttcagagcatgtcagccttttccagtctctgtgtcttggtatagctagttccttctgcctggaatacttcctcatctcacttgctttcctgcctggcagcttcctacttgccctctggaaccagctctagggtcaccacatctctgcttctgagtgcctcctcagacacagtctgtatttcctcttccaagctctcatcacaaacattgtgctgtattatatgtttctgtgtggtcttccttctatgaggaagccttggaaagcaggagacttattttagtcttctttatgtttcttttattcccaacacattatgtctgccccatagaccttttcaataaatgattattgagttagtgactccttttacatgctgacaaatgtggctcttattactccccatttcagtatcacatatttgtaaaagtgaatccttcttaatcgttttacttttctcctagtaaattcctcatctatgcctgtctgctgctgttctctgtgctgctggcccttcgtttggatggcatcatacagtggagttactgggctgtctttgctccaatatggctgtggaagttaatggtcattgttggagcctcagttggaactggagtctgggcacgaaatcctcaatatcggtaatactgctttatacaacccattggtctctagcatgagggagcaatatcttgacttttctcacttttgatgaagtaaggaccattttattttctacctatctggggtcttagaactatagtataagctaacagatctcttctgtgtttttgaaaatttagtctttggtatgtattttcttacaaaagcagtgccatttgggggtaagttgccagccagctcacagatgcctatataatccaaaatgcacccaaaatacagaactggtatgccatactagactaagcagcatgaaaccaccctgtttttaggaaaagacactcatattatgtttggtcatgaaagatctttctccaatacagttttggaactggggctccccttgtcccaccctcctagtcccagagctttaggactattagcagtgtaggggaggtggcttgaccaggagaccatgagtccctgagacagcagctggggaatgaggaaagtcaaagattggatgccgagaaggaaagcagagcctttgggggcaggggagaggggtaccctttaccgtttccaactcttgccctccctgctcttggatgcctccgctggcccaaattcctgggagttggctcacgccagcatgcaacctgcttgttgctgggacctgcgagaggctttcccttctctgccacagagactgtaactacataaagggaaaaagggggacttaagactgggaggctattatgaacctccactgggaaaatgaggagtacaggaattcccagaaggcagctgctcatgtgggaaaagtgtaaagttgaaactaccgcaccttttttttttttttttttttttttttgagacagagtttcgctcttgttgcccaggctggagtgcaatggtgtgatctcggcccactgcagcctccacatcccgggttcaagtgattctcctgcctcggcctcctgagtagctgggattacaggcacctgccaccatgcccagctaattttttgtatttttagtagagatagggtttcaccatgccaggctagttttgaactcctgacatcaggtgatccacccgccttggcctcctgaagtgctgggattacaggtgtgagccaccacgtccggccactacatcaactttttaaatttttgtttactaaatatgaaaatgattcagattgtgtaaattacatatcacatacatgtctaagaactgtaaaacagttacacagagagccttggcaggtgagggacattcatgtatagctgtttcagagttcttagattttttttgaaagattgatgacctgtgtggctgtatgtgttttatttttttatgagatattttcagatatctaatattaattgcttctcaaagaatgcaaagttaaataaacatttaggttctactaattgatatttagaatatattcaaacttctctttgttggtcttatttaagatgttttgagcaaggaaaggaattgtgtatgtggggttgaatgtaaggaatgtacaggcgtggtcattctcatgttaacattaaccagtggaacatggttgggtcctacaggaataacctctgatagcattttctctatgatctaacttccggtgtatttgtcacccacaatacatgtatatcataaatgttcatctgtattttgaataaacattgtaggcctttcagatgcattatagagccttttcctgattagcggccttaccattgctcaattgtagatctgttaaggttattgtgcatgatacttagctaattaaactgattttgtttgagaacagttttaactcttgttcttctttctctttcatctgcaggtgttaatttatcttaatggaatagaaaggaaaatgaaaatcatttatacgttttatttgcatttaaaaatagcacctaacaatagttactactatcttgaaatataactggcacttgttcatagaactagagttatttttataatattgtgtgaagggtggtttacatggtttcttgaaaaatgaggatcatgagacttaaggggtatttgcctggttttagcagcagaagcaaatcagcttgaataatcttggaagtaactcttgttgttgaatttaaagatgtgaacagaagtgtttatgtacattgtcagggaaataagaactggctattacttttgagaatatccttatacggttaaaacattaaattctggtttggttgtaatgttcattttgtattatgtagtagttcttcgatgtttcagagattgcctaccaaagcttaggtttaagttagctttctacctgatttccctttgcttttgtcaaattttcaagtaaaattcaaagtataaatataagttggtatttgccctgaactgcttgcttatagtggagattctgaactgagggtgttttcttcttctctcccttttttagagcagaaggagaaacgtgtgtggagtttaaagccatgttgattgcagtgggcatccacttgctcttgttgatgtttgaagttctggtctgtgacagaatcgagagaggaagccatttctggctcctggtcttcatgccgctgttctttgtttccccggtgtctgttgcagcttgcgtttggggctttcgacatgacaggtcactagaggtgagatttcatatatttaagaatgttttccactttgggaggtcaaggcaggtggatcacttgaggtcaggagtttgagaccagcctggccaacatggtgaaaccccgtctctactaataatacaaaaattagccgggtgtggtggcatgcgccagtaatcccagcttctccggaggctgaggcgggagaatctcttgaacccaggaggcggaggttgcagtgagccaagattgaaccattgcactccagcctgggtgacagaatgaaactccgtcttaaaaaaaaaaaaaaagaatgttttcaaaagtaaaatattttgctcagttattcagatgtcaatttcttaccctttgttaggaagagcttgatcattaccaactctacatcatgagacaacaaggcaacaaaagatgatggaaataacaatttttctttcttcacttagaacactagcttttcacccaggacatcagccttctcccagcttcacatcctgtatcaatcagacagaaacagaactgataggttagatacagatatatgtataaagagagttaaggaactggctcacattactgtggggctggcaagtctgaaatctccagggcaggtgaacaggctggagacctaggaggagttgacactgcagtcctggcacagaattttttcctctccaggaaaccacagtttttgcttttaaggccttcacctgattgcatgaggcccacccatgctatggagggtagtctcctttattcaaagtcagtaccttcactgcaacagcaagcttagtgtttgattaaataactgggtactatagcccagccaagttgacactcaaaactgaccatctccccacctcagaccccatgatttagcacctcccctgctgtctggttagcttatcctgatgtgcccctgtgtttgtttattcattcaataaacatttatcaagtatttactagatgccaagccctttttccctaagcatagaggatatgcagatgaataaaataccaggactagtaataatagtaatgaaagtaattgcagataacgtttattgagcacttactgtgtgccaggcattgtgcgaggcacattacatgtggtagttttcttactaactaactctgtgaggtaggtccagagaagataagtcatttgttcatggccacatgtgaaggggcaggaccaggattccgtttgagtcagcccgactctaaagcccgggcacataactacataactgcatagaagctgagggcccaaagctgaatactgatgggttgaggggagaactagaggctgtagatgcctggttttgagccgtgtggatgaagagtgaagggagaagactgcagttggcttaggaagtaaacatagcagctgtagggtgggtcaggcatataagcctagaccccaggtatgggcgtgaggggaaggtatgtagacagagggacggtgatggagcaaggccctgtgggactcagggagaatgggacctagagcaccaggaagggtttggccttgaacaaggggagctattccctgattttcatgctggtggaaaggccacagcatgggtatagtggtaggtaggagtgagccgtggagggagagtatctgatggtccactttcaccctccctacaattcccagtttatatcagggacttgagcatccatggattttggtatccacagggggtcctggaaccaatcccccacagatactgagggacaactatacaaggactaggactgcattgggcctgaattacagaaagtaagtctttcatatattcacactctaggcattcctgcccttggaagaaacaacataccaggagctgagctccctcctcctgtgatgcaagaacagtacctatgttggtgagggggtggtctggagtaggctcatacagagatgggaaggaggagttgagggtctgccaggaagccctgtgttgggagggaagggatggcatttttgggacacattgaagcctagaggcaggaaacactccatcagctgagtggactgtggcgattcagatccgacgggagcacaaggtggaaaggaaggaactgtgggagttgagaagagagggagcctctacagagggattggggcaaataggggccacgtcctcagcccacagagcatgtgctgaagtgccccaggcaccccagtgcactcacagggcaccaggggatagtggacattttgaggaaaacagtaatacctgacatttgttgggacaccatacaaactactagcttgaaatagtttacaggtttatttttaggccacactgcattcctttcagtgacgtcgtatctttaagaagctgggttttcagcagttgctgtgaaaacaaaaaaggctaatgctgtgtgaaaatccgggtgaagaacaggtaacgagtgggagcaccttgtctgattccaaggcgtgggaaatggtgagctacctgacaggcacacgcatcccactgggaattagttttggttatttaagaataatattaacatttttctttagatttatatgaattattttttctggtggctacttagaaatacttactaagttagacgtaattacttaaatcagtgcaactgttggcattcccagccacattagggatttcttttggcctagaggtctatggaggaattactaaattccccatgtacctatgtactgagaacttttgggaagctctgggcctggtcccagatttcaattttgtgggcaagaatgtactttaccagagtgaggagcagcctgcagggcgtttgggctggaggcgggaggttagtaaggggttgctgaagtggtaggcggatggtgccgaagaaggcctcactaggcagtcatcatcaggataggaagtgggcacgggattcaggagaaatctggactttacagtggacaggatgtggtgactgaacgtgacagtgtgggaaaaagaatgcagggtgattcccgggctcatggcttgagaaatgagaccactgttgtgcctccaagtgacatgggaggctatagaaagtgacatgggaggctatagaaagtgacatgggaggccatagaaagtgacatgggaggccatagaaagtgacatgggaggccatagaaagtgacaagggaggccatagaaagtgacatgggaggccatagtgacatgggaggccatagaaagtgacatgggaggctatagaaagtgacatgggaggctatagaaagtgacatgggaggccatagaaagtgacatgggaggccatagaaagtgacatgggaggccatagaaagtgacatgggaggccatagaaagtgacatgggaggctatagaaagaggagatacaaggttctaagtgcaggcgataatgatctctatttgggactggcttcatttgaggtgcctttaggagagccgagtggcctatgcacagctgggtctgctatgcagcaggaaggctaagttggagacagatgtgagaactaaccatgaaggaggtaataatgcagaccaagggtctggttgaaatttcttctcccccagtccagggtgcagcgggtgagtgaaaatatgtgtgtttgtgtgtctgtcttcctagtcgggagagaagactgagtttgtggctctgcggagcatcaccatttaaggagggggaaaaggagacagaaggaattaccagaacactccagagggctccaagactgtatggtgggatcctagatggccaggaggaggggagcaaaaaggaaagagtcatccacagtatcagtaggatgccagttgaagtgtttttgctgcctcccggttatcggtgactttgatgaaagctgtcttctggtggtcatgggggtggaggccagatcacaaggaagctgggaatggtagatgagatagtaggggcttgcatattcattactgtctcgcagagagaaacctgaggctaagaggggtcttggatcaaaggatggggtgggtttatctggtttcggggcttttgtttttaatgagaaggagtcatttctgtgctgctaggagggatcaatggaataggtggggttaaagatacagtacggaatctacagttgatggcttgatgtgacaaggtcctcaaggagcctgaaaggaaggggtggggtccaagggcaaaaccgaggtatgagaagaaggatgcacaaggatggtttcgagtagacagtattgttggtagggacatgaaggaagcttagtggtctattgcagctagcctgtgttcccagtgaacctggaaacaaggttctcatctgtgctcaggcctcaggccagaaagggcaaggcagcagaggggcaaggcagcagaggggcaaggcagcaggctgagccccatttccccttgccataatactgctgtgcccctctggtaccgaaaatcaggagtttccagtgcaatataatattatacaagttacactgtattataatgtgtattgtcttttagtgtgttaaccaaattactgcagtattaaatgcaaattatactttgtttaactgattcttctcttcatttttagttagaaatcctgtgttctgtcaacattctccagtttatattcattgccttaagactggacaagatcatccactggccctggcttgtatgtaacttttaaaatccttaaataaacttcttttttattataaaagtaattcatattcactgtacaaagcttggaaaagacggacaagcagaagtaatagcctaatagtcacccataatcccaccatggggagataacatggttagtgtttttatgtctgtgttttatacaaacagtttggatataactgtgtgcaccattttgtatcctgatttttttgttttaatgttgtatcataaacattttatcatgttaataaaaggtctttataaacatgacttctaaagtttaattgatacaaaatattcttcaagtgcatgtatcagaccatcctcttatttctaaaatatggtatttccattgttgccagtgttgaatgattttaaatcatactgcagtatatatgtttatgcattaaaatttttgccttttgttttttggttgttttcttaggaaatagtccagaaatagtgttactgagctagaggttgggaactatttgagattcctatatacgtatactgcactgccaacttgcttttccaaaagccatacctggccaggcgcagtggcttacacttacagtcccagcactttgggaggccgaggtgagctgatcacttgagctcaggagttcgagaccaacctgtgcaatgtagcaagaccctgtctcaaaagaaaaaaaaaaaaagccatacccatttacactcttgctggtggtggcatctatgtcatgcttctaaactgtgacttcagttactgggcatttggttgaaattaactgtgaataaatgggtagatggatgcagagatagaaagataagtggcaaggtagaaattagagaacacagtatagattccactattaaatgcatggaaaaaagatggagactaaaggcagaagagttccattgccactgggaggtaaggtcatgctagtgtttttgttcggttttattttctctgttgtttgatgtataattttgcatacaatatattttatgtattaaatatagctacccttaaaaagtgaaaagtatagtaaagaattgggagcagagaagaaatgaagggaacctaagtatactccatatttaaagatgggaataatcacttctgcccaaagtctttgataaaacattcataataaaaaatattcagtcactcatcctacaacttcacagtgctgtatctggagaatggtcattgggttcaaaactgtttctgttgtgacgtgaaggaaacatatctaaacaagaccaaattttttcgtataagatactgtcagggaaaaaaaagattagtaattttgagagctttccacaaatgagaagaaagattttttctgcccttcatcctctgtagatcccagttgatgaagcagtctgagtacatgtttcccatagtgagcaagagaaaacaaggaagcctattgagatctaacattccacccatgaagggaacttcagtaaaaaggagaatctcatcacagaatggggaacggggaagaaaggctgtgcatagactctgcagagaaacctacaatcaagaactggtcaggagaagtaaaattcgtatgccaactcaaatcatagatctaaaagaaaatgtaaaactatagatctgttaggaaataacataggacagaatctttggggtttgcaattaggcagagagtacttagaaatggcactgttaatatggtccatacgagagagaaatcataaatttggacttcctcaaaattaaaatgaaatgaagacaggccacagactgggagaaaatatttgcaaagcacacatcaaaacactgacttgcacccagaacatacagagaactcttaaaaactcaaaactgcaaaaagaaacacctaaaaattggcaaaagagttgacaatttgcgaaggggatatacacatggcgaaaaagcacaggaaaagatgctcaacgccattacaggttagggaagacaaactacaaccaggatgagggcccgaaacacatggcttcagaatggtgaaactcagcaacactgacgaggccacgtgcctgggaggatgcagaggaactgggacactccagtgttactggcgggaaggcaggtggtacgggcactgtagaaaatggtttggccatctctgatgcagttaaaagcgcacttcccgtgggacttggctgccccactcctgggtataagatttacccccagagaagtgaaagcgcgcagccttgtagaaacccacacaccagtgtttgtagcagtcttgtttgcattttggatagcggccttgtttggttttcacaaaccaccctcagcggacagtcagataaactgtaggcatccatacaatggaataccactcagaactgagagggaacgacctgtggatacagggagggaacaacttggatgaatctcattagagacattatgtggatggcgggaagccagtctcaacaggttacttgtctcgcgatgccatctacataaagttccagcagagacaaaagtacagtgacagagaacagatcagtgtttgccggggctaatggtggggacggtgtgatagtgaagggacagcacggagagttttgcagggtgacagacctcttctgcatcctgccaacggctgtgcgaatctacttgtgtgaagactcagggaactcacaccaaaggaagacggtcacttttcctactgtatgatagataattaataaaaagggagaacggaggagtgtcgtcccaggaggcagggcaggagggcgaagacgtgtcacaggggagcctggccaagtggcgcccccggaactcgtcctctgggcttgtgtgtggatgagacaaggtctacctggtacgacagggacatactgggaatgcgcccttgccgtggaggcggggacccggcagcgctacgtatccagcatcaacctgtatccagcatcaacccgccaagttcactaacttggtaggggtgaggttagggatccttaggagcccaggcagccagactttctggggagcccattcccatttgtgttgccaaagtacccccagcaggttgtgggaatgttgcctgtgaagagagtctgttggggtgagatcttgtgtgtgtgcacagggtgacagttgtgtcccatttcccgggaagctgtgatggcagcagaacctagaggagcctgagagagtgtgggagagtgggcctctggaagagtagaggctgcggagccaggtgcagggctgtctgtcacccaaaggaagagggactgatgactcactgagcgtgtgtgtcccctggtggcagcaggccccatagtgaacataccataccttttctgtcctgagcgatgctcccagcagtcctgggagatggaacggtccttattcggctcacgggaaggaccgccttaactggacagacacagcaaggtgctaaagatgccttccatcagaggccaggttggaagctctaaagagacttctcttgctgttctctcacccacccccaggttgtgtgtgtcccgctgtggattctcatgtcctttctgtgcctggtggtcctctactacattgtgtggtccgtcttgttcttgcgctctatggatgtgattgcagagcagcgcaggacacacataaccatggccctgagctggatgaccatcgtcgtgccccttcttacatttgaggtaagcgttccacgggaagcctcttcagcccctgaagcttgcgcttcccctgacaggattctgcacccctagaaaggcagcctctgtccctcgagctcacagtgagcccactccaggagaggggagagaacacagccatctccgagagggagcttcggtgaaaggagagcatccttcctttctcttgggggcagcacgtggggctggcagggagaagagtgcacctttttagccatggtgcctctgtatggctccagtttccactctggggaaagcagagtgggatgtcagatttgtgtattggagtcacgtggagaattctagaatgggagctgttgactccttagaacaaacacccggaggagtttgccataaaactgctggcactgggaacttttcaagtggataggctattgccgagctctgaagagggacataaaagctcatttcgagctttccccagggataggtggtttcctgcctttttctggcggtgctgatgttccctcttgtgggagctcacgcgggggtggggtggtggggaggaactgcctaatgaagtctggcttccgcctctgcccattttcggtgctggcatcaaccgggactatgtctctttctttagattctgctggttcacaaactggatggccacaacgccttctccagcatcccgatctttgtccccctttggctctcgttgatcacgctgatggcaaccacatttggacagaagggaggaaaccactgtatgtactcagcatttcagaagtccttggtgtgtgtctggggggggaccagggagtgggggggggggcggatagaagtctaggaagggatgagtccccgagggccccaatttagaagcttgtgtgggaaagtgagggctgaggaaattctgggaccttctaagggaagggcatgccgtaactctggtgttctgctggcctgcaccgggacttttctcgcagtgcacgctgccatttgaggtagaaccagacacggcaggcaacctctcagagatcccgttccctcctctgcaaaatggggatcaagacagattcttcccaggcccgggagggtttgatggaaaatccacatctcccacccaaacctgggattcatcctaggtccctgttggcctctctgcctcccccatatccttgctgccatcacccgagtcttgcctgtcttgccttgctaacactctattcccctccacctgcttgctgaggcagacacttccaaaacgatctctgcagagggtgccttcctggcaaggctgtgggctccatggcacggaagcccagagcattgcccttcggaaagccagtgggtttgggggcagggcctcactgcagcccagcagcccgggctgtgcttgctgtttgtgcctctgccccctaccccgcacccgggagcagggagggcttgcaccgagctgacactccagtagcctacagagaggagtagtgggactgggaaagtggctttaaggtggctccatgagttcaggccccctcctggccaggacccgtgcatgactaccgccctcacggattccagagggtgacagaaatcttgttcttgggtggcactgtcatccatgagtttatcctggctggagaagattagcggaagacaccgtagtctgcgcaccacagatattttgagactcactggagcagtagttctcaaacttgggcatccagcagaatcccaaaagggccaggaaaaggggaccgctggagcccaccctagcccgactcagtttctggaggtctgggctggggcccgagaatggcatccctaactaggccccgtggacgctgtccctgccggtccgggaaccccactccaagcaccacagagctagcatttgcacttcttccccattttgggtactcaagccctgttcaggctttgtgactcaggagtctggataaagtatgttatgacattgtaggagtgaaacttcttgttacggaaagaaagttaacaggaaggtcagttgagcctcgtgtgtgaaataaaaaattcttatttttcagggtggtttggtatccgcaaagatttctgtcagtttctgcttgaaatcttcccatttctacgagaatatggaaacatttcctatgatctccatcacgaagataatgaagaaaccgaagagaccccagttccggagccccctaaaatcgcacccatgtttcgaaagaaggccagggtggtcattacccagagccctgggaagtatgtgctcccacctcccaaattaaatatcgaaatgccagattagatgccacttccggggacagagcttaagtggactgggacgcactctctccgccttcctctgccccctcgttcaccccgcagaccagaaccagtactggagctgggtctccaggtacgtccatctcatgccttgtttgcatccagcgcctatcagccactcaccacgacgggacgcggaagtggcaggtgacgggggtgtgtgccagcagatgcggatgccaggaagagtgtgagaacaggggtgggattaccgtctgtctgggaggggctccaggtacccctcttccccgtcagacccactgggagatggctgcttgccaggcccccagaaggaacatctgtctatacggtgctgaaatcccaatcaaaagtattgtttagaaatgtatttctccacagggctgacctcctgcagctcgctgagcactcccaggtcctcagcactcccaggtcgtggctggggcagtcagtaggaactgtaactatgtctctgatgcaccacgtgtttagacacagcacagtccttttttctgttcctactgtggaagtagtttctctttgggcatgctgacagcagtttttcatagcctcacggatgagccctttctacgggagtgactccatgcttgtatacagagtatttatacaaatgttttagcatcttcatatgcggtgttaacccctagttctgtacagcatattctgttcaagtatttttttacaagcttgtgctgtaggcacatgccttctgctgcagaagtggacgcccgtggcacactccccccccccccgtggggtgccacgccttcatgggacattgccacttctgccctggaactcgtgcaggtacgtagtagctgctactgccagaacggcaacaccaagcaagagatggtccatgcttttctgacgttctcagaatagtggctagcttcaaacctgacaagcgctgcttgaagccggaacactagagaatgttgctgagagcagaaacggccacgcgggtcacgactatgcgtgggaaagtctcaagcttccctcctgccagcaacaagaaggctttggagtaggcatgatgttttcacgtgtgcgtgccgtttctccaagcactgcaggttccaccgtgtgtcagaggctgcaagtttaacatcctcctgcctgaaaacaaataggtcctttgctgaaaagagggtaaaaaaagagctttgatcttctcagccaggagaagagggtggtgttttcacgcgggcaactgctcgccggcctacatggggttaattcaagtctgctgcgagcacgactccgcccttggcactggcctccagcaagccctgttctctttggggtacaggggaacgggatggtttagactttcctgctcagtgtgtaaaaaatgtagctaaagccactatttttgctctccttaagctgttcaataaaccggttcctcatttt

SEQ ID NO: 3915 - DNA, 35186 bp, human
cagcggggacggcagcagtagcgggagcagcagcgtggacgcggctggcgctggcgccatgaacccgctgtaaggcgcaggctgtgcagcacggggtgcgggggaggaggaggaggacgccgcggtgaagttctccgccatgaacctgaggggcctcttccaggacttcaacccgaggtgaggcggcgtcgttggcgcccccgggagtccgcgctgcgggctcgggcgcgggctggtgttcggctccggggaggcacggcgggcgagatgctgcagcccgaggacccgggcgcctgcccgagcctccctgcgggtgcaagcggtccccaggcaaaacagtcggcctcggcgcccgcccgcttcctcctcccgtgcccggtgctttcagcccctgcccggccacggccggaagggcccggccgcgagccccgtcctgccccaagggaaccccattcttttctgcttgctgtccctcattggtgtcccaacttcttcgtctcggttccatcctcttctgcgccgctgcgggccctccattctccgcgtcagggccgtctcactcgacccaacacccctacccccaccccagctgtttcctccagttcctcgcagtccttggggttttccttgggtttatgcccatccctctcttgtttgcttctttgttgaacggatacctgaaacactgttgaatccttggagtcagtgtcggggtatggcaataccttatataatgcatttctgggtgagcctgatcattttccatactcattttctcatcagtcttcactacaagtttatttgcaggaagtagatattgctgtccttcttttccagatggggaacacccagtggacagtgtggagaaaacactggctaagcactcaagcgcctgtccttgcacttgcccgactgttttgtaactgttctttaccccaggctgtgagctccctgaagctgagaccatctcctgctcatctcagtgtccccagcgcctcccacccaccgtatctggcacatagtaggcacatataaaatgtttgtggaactaaactgagcccaaagacttggattggagacgaggccatatgtaactgggtgattctctgcccttctttggcccttctgtaaaatgaggagttggcctaactgatctcttaaatgcactactctccgaaaggagtatccgtttcccttatttgccagttgggaagacgtgctcagtaaatatttgtgtgctgtaacctatgctaggtgctttagatgctggcggtctcagcatggggtgaagaagggcttgtacacttaagatgccttacagtactgtgcagtgctgtactgcgggggggccaactctggggacctatgccttggctgcttgttgaggatgaaaggaagttttaggggagtatttgtatgttgagggtgcagtctccctagggatggtgacattttaacttgtgagtcattgtgactttgtatgtgctcttattccactttgagttcatgttctggttaggagtgccagtgtctctaacacggtgcagacattatcattgttggcttcgaaggcatagaggaggtaacagaactaactgcagtcccttcctctgctgcatcagggggttaagattggtctgcagggtagtagggttggtgctgtggctggacaagccctgtatgtcttctatttggagatggtgataagaaagttaagtaaaaactgaattgttttgtgcccttgggcaactcacttatctattgttttatctgtagaatgagtataatctctcagtggggtagggaggccaattaaggattgattacaaagtgccttacaaatagaaagctacagtgacttgtttgcaaggtgacagagaattcagaagcctcaagaaactgccttaagtgatcaaacaggctaacagagttgccaaagcaaaatagtgctgcactgatactacctttaaccgttttttcctttagcccttttccccccaaaaaaattagtatatgaaattacagtgaaatacctggtatctaagcagatttatagtaattctcaacatattcatcaatctcttaattctacctgcattaaaatgtatttctacctgaaaagtttaaaggtcttttatactgtgccattttcctgattcattgttgccagaggtagtgagttccttaattttacagatatttcaagaggacattggccaggtattattggtaaatcagatttgtttttttagctggtagtgtttcacctctcctgagcactcctagtttttgacagtgtgctttagtctccttccatgctgaggaaggccttctctataggagaaagaaaactgaggggtgtacacaggaagttaccttatgctggggactcaaaccttgatgctactgctttgctccctgcctctatttttgaaccaattcaacatctccctcctaccccaggaccttgtcacacactgttctctttaccaggaatgtttccctctcttttcctctcctccagacctagtgaactcctatttatcctcacttggcacttgctaagggaagcattcctgacttccctgaccagatttactgctccctgtttctacagttcctgtagtatttactactcctccatcatagtgcatatttgtacccttgtgtctgtctggatgcttatttgattaatacctgcctcccccactaaactttaagctccatggggtcaaggccgtgactgtgtcagtatcgtagcctgcatacttggaatagtacctggctcaataaatatttgtggagtaaataactgaataactctccagagcctataagataaatctagagctgctgctttcaatcactgctttcctggtggtctgtggcctggttctctttcttctcacactcttcccaccttcagagtgcagccattgctttggagagatgggagagaacatggcactaaggcagaatatggctatatttactttgaagagcatgtctttgtcatagaaatagtcactgtcatggtttggtgggtcccaaggcatgggtcatggctccagatcccctttccagccttttggatcttggtaagtctgaacccactgctgcgttggcaaggctctggaaactatagtgacagagaatgattcacaagtgtcaacactcagatgtacagggctgccagctgacccactctacctatttccatctggcactgaactggttgatcatgaacttcttttcataattgctttttagttatgcaggttaagacatgccgaaacagatgtaccggacccacaaacaagtccttccttgaatgcctgaggcttcctaacagtgaaagagccctgttcttagagtaggcaaactgattctgaggcattgtaggtggtagggatctggtagtaggtagcattaggtgggctcccggcactcaccatggagccttgaaattttctgctactttgggggagttgctggttcagagaaggcccttccaccctggtagccatgtggcactggaaggctgtgaaaactctgctgggccttcttagtcatctgttgtgagctcctgatgggagtgtggtgtatccctcaggtgtgctagactggaacaaaggctgagaagtgttgctctgggggttccaacttgtgggcatggggtactgatgagatcagtagtgtttggagacttctgtatgctccatcttcagaagacattctggagtccatataagttatcttgtctcttgtttgaagcaggaaaaaggaatgcgattgctggtaatatagttcactaaagtcagctacctggcctctaacagttatttgcaaagtatattataacattgattcctcaaacatctagattcctatctcgtgccaagtgatgtactaggtgctctaagtacaaaaataaaggaatatagtcctcctctcaatgcgtaagcctagtggaagaagcagaaatgaaagggaaataagaattcaatagagtatgaggcattacagtgaaagaaaccaaatgtcttagaagtacaaatggcagagctactaattctgtctcgagcaggcagggaagagtctatagtggaaatgacttttgagctagattttgaattgagctagtcttttgagccagacttttgagctagaattgtagggttgtcatcagaccagagagtaggaagggtaccttgtgaggaagagagagagagatcagattgttactgtgtctatgtagaaaaggaagacataagaaactccattttgatctgtactaagaaaaattgtttctgctttgagatgctgttaacctgtaactttagtcccaaccctgtgctcacagaaacctgtgctgtaatgaatcaaggtttaatggatttagggctgtgcaggatgtaccttgttaacaatatgtttgcaggcagtatgcttggtaaaagtcatcgccattctccattctcgattaaccagggacacagtgcactgcggaaggccgcagggacatctgcccaagaaagcctgggtattgtccaaggtttccccccactgagacagcctgagatatggccttgtgggaaaggaaagaccttaccaccccccagcccgacacccgtaaagtgtctgtgctgaggaggagtagtgaaagaggggggcctctttgcagttgagataagaggaaggcttctgtctcctgctcatccctgggaatggaatgtctctgtgtaaagctgaccattcccattcgttctattctgagataggagaaaaccaccctgtggctggaggcgaagtatgctggcagcaatactgctctgttactctttgctacactgagttgtttgggtaaagagaaacataaatctagcctgcgtgcacatccaggcacagtacctttccttgaacttattcatgatacagattcctttgctcacgtttccctgctgaccttctccccacctgttgccctgctacactcccctcgctaagatagtaaaaataatgatcagtaaatactgaggtaactcagaggctagcgctggtgcgggtcctccgtatgctgagtgccggtcccctgggcccactgttctttctctatactttgtttctgtgtcttatttcttttctcagtctcgtcccacctgacgagaaatacccacaggtgtggaggggctggcccctttcagtatctcagaagggacaaagtacacaaaggcatggggtcatgatagtgcctggtatgttcaggtagtgaagaggtccatgtggtatgagcactgcagatgatatgtgtcgtatgaattaaaaatacatagttactgcaaatagtttttacaggttattgtttttaagaaagcagtatctaatgcacgagtgtactgtcagtactgtcaatgaactacttaccactcaagtgactgcttatctgttgttctgtcctctcaagccacctacagtcagaaaatggtcttgattttactgatgttgctgttaataatagctgtgacttcttgagtacccaccacatgccaggcccaatgtaggggctttgcatccattatccatgatctttacaacaaccctgcaaaattaggtatcagccttattttaaagtcttgacagcttgtgacttccctgaagttgcataggcaggaagaatctaagtcaacattcgaatccacgtcagtctcatgaagcctgtgctctttcctgcgtgccatgccatagttctagttaagtgacaactcctttcctccatgacattgtagatccagtatgctaaggaaccctctatttacaaattgtaagtgattaaacaaaacaaacctgttagtggcgcttatacatccaaatgagtgttgttattcaaagaggttacttggggaaagagaatgtatacacctattccattgttcatactccttgttactcatctggaattccctttaaagtcagtttacatatcacataagaagatccatctcattgctttatgatcatctatcattttcaaccaaaatagttccacctagtttgatcacacatcttattcactaaccttggctctgactgactgtttgccatttccaaaatttgaatccaccctcagtgaaaatttagcaccatttgggatagtcagaagatcagactgcaggttctcaaggtgcttccaagaagaaagcttcaaagatgatttgagtaatgaagtaccattggaattactgcattgcctcccaaggggactggttaaaggagagaaatctcatttgaatgtataatttccagttttaaaagtatcattcctattacttgataattacacacacattgttcttagctgtgttctttgagggccaggatttggaggtgctgaattacgtgctgaatgagtggatgttgggtacaaatagacatctaccactgggaagtctttgttgtacaggagagaccgtggattgaaggagttttagatagtttcctaggactccagaagttaagctttttaatatggagcttgagttttctaatcattttgcctgatatgtcatgcctgtacaagatgactggaatttaagacaaaagcctcgaactctggagatagatgctttataagtggagactcatactttgtcagctccaacctaatagtgacaacaatgattgctaaatgagattattacctacaatgtggcagaacttttgtctttcataatactgctaaagctagaatgggtaaaatgtatcatttacacagtgctttcacatacccttgtcttaatgaatcagtatatgaggaatcagatgaggagacagacctgggggaaaataactcacccaagaccacaccgctgatgaatggcagttgaggaacttaaatgcagatcttcctactggcctgggctctgcttttatttggcttttgtgcttttttgtatctactggttaaatgctcttaaacattttttatcttaataaaaccagctaaagtctccactaaaagactttaaatttggttaataaggtgtaagaggggcagttcccttgatagtttgtgagtatgtcaggttgtcatttggagccattctgtcaagctttagactgggatgtgccatccaaagtttgtgtgtgtgtatgtgcttgtgcgtgtgtacgtgcatgcaggcatgtgttaatgcgcgtgtatgtgctccagtgaagccagcagcttccactggaaaaaaactgataggtctaaaaagagtccagctgcattcttatgatatgcagaaaacagatactagaacttttacattcagagtcatcattcctttgctaagtatattctctctctccctcccttcttccttttctccctccctattctcccaaccctgcaaagtggagagagggaatttgagcctgagcagaaagctccatgtaaatttcagagaggatactagctttggcccaggtagcactacttagtgattcatcgtatactaacactacagattcaaatgagagtggaataaatccattctaaaggtgtaactggaaaagtgaattttaagaagtagtgattaatgttaaaccagaacctcccatttctcccaggtttgtggagaattaagcagtctatttttatacttggaatctggtctgaatgtttcttgaaaagtaactcaaagtagtttaggctatgaccataagttatttttgtaaatacattttcttatcactgtattattgcatattattgtgtattcttttgcaaatcaggcttgatatttccttttggctatgcagtcaccttttagactttgcttgcaaatatattgatatagttaagatactattctttctttccccaactaggagtgtgtatgaattacatcttttgaacttactgattgtattactttgttttacttgatcaactttgtagtttaatttttttaaaaagctagctgttgggattactgatcagtttcatttttatatctatatttctacttttagttttattattttcatgttttggctttttccccaaatttcttagaaactcagtttactagttttcttttgcctcttttttttttctttgttttctacttttacttaaacattttaaatgaacacattttctcttgagttttgttttggcagctgcccaggtatttttatgtttcaattgtattttagtaactctactaaactgcttaacaaatcagtattgaaaatgatccattttttgtcagtgtttttatgaattgtataaaatgtcaacctctggtctctactgattacaatctaccttacacactcatatgtatcttctgtcactcttgttgagaaaatctgcagtggccccatattacctattaataaattccaaggactttaccttgatattcacattcccctaccatgttaccacagccaacttctggcttattccccccagtaccctttctcctgtctctgcagcaccctacccaccacgatttatagaaagtattctgtgtgttccagtctgctggaattggagaggggaggataaagaggggatgagcaatgggtacaataatacagttagatagaaataataaatctagtgtttggtagcacaagagggcaaatatagttaataatgtatatttgcaaataactaaaagagtggaattgaaatgtgcctaacacaagtaagtgatcagtgcttgaggtgatggatatcccagttactctgatttgatcattacacattgtatgcttgcatcacagtatcacgtgtaccccataaataggcacaactgttttgtatccataataaataaaaataatttttaaaaaattggaaaacatcttattccctttgtctggaattccttattcccaacttgttgcccagattccacttctcttcccatctctctcagggaaattaatcttccaagtcccctagtttaccatatgtagttacttgttgatacatcatctccctctgttcctattagtctgagcatcttgagcgaacgcattgttgctcctttttatgtatctcacacatttcaggcactcaaatatttttaacaattgtaaattagatgtgtgtttattgtgtattgctgccccatgatcctttttttctccctggaaaaactatatatatgtaaagcaagtatgttttcttgttctgctacgtaattatcttcatataagcttgctgttttttaaattttctcgttctgctacttaattctcttcatataaccttgctgttttttaaatctactcttgtgttcatttccgtattttccttaggaactttgtctgttttatctgtcatgatttaagagtagcatgaggaagcccacaattaaaatatttctgtgtatccttaaaaaagaaaaattgtaaaattatttccatattccatggtcatgttaggtttttgttatttaggttttccttattagtccttttagcattttaatactttcggctttgaaatctaatttatctaattttaaagatagtaaattgttgctcttgtcttcatccaggcgtgctaaacctctgtcatctgatttctgatagttggttcgacttttgactttggttccaagcgtaactcttgaatgtaacaggtttactttcttaatctaggaagcaacctttctttttacagagctgtggtaggcagaataatgacgcccccaagtatgtccacatcctaatccgtggaaccagggaatatgttctgttacatggcaaaggggaattaaggtagcagatggaattaagtttgctcatcagctgaccttaaaatagattattctggattctctggctgagcccaatgtaattacagggcccttaaatatagaagagggagacagaaaaggaggtcagagtgattcagtatgagaagaactgcattctccattgttgactttgaagatggaggaaggggccatgagctaaggaatgtggcagcctctagagctagaaaaggcaaagaaacattctctcctagagccttcagtagcatagtcctgctgacacctcaagtttagcccagcgagacccatattggactctgacctccagaattgtaagggttatgccttttaaaccactaggtttatgctttttaaaccactaggtttgtggcagttttgaatggcagcaataggaaattaataagagaacattcagctcatgtatatttttctaaccctagtatttgaatcatgaattatattttgtgggtccttttgtaagtttatcttgttttctatttttcatgtaatagacataaaattttaagtttcctttaaattatgtcaaaaaccacataaaataatcccttttccaacatttaaaacattttggtacttctcttttctttagttccactactctctttttttattaaataaggaaactgttttacagaggataatgaagttagcttacagcatttaccaccccccccaccaatttactttttatttatagtctgaaaatcctttaggataaaaattacctgtacatgttatctaatttacatatgaatcctgtgtcgtcattatcttagcatttgttaatgtttgaatccactaatttcttttttaaatagtctgttttcaagtccattgtttctggtaattatatttgtagccacaggctttagttgacaaattggttctgatttttttagattttggaatatttccctctgctttaagagagaaaacttctgcctctactaattgtgtactgtaattgtggtgataactccatttctattaacttgtgaatcaccttgacacaggctctcttcttgtccaaagtctaagggatgaagtcatttttatcttggtttctttaaatgttctttctttgtagcagcttataaaagcctgtttttgttttcgagtattaataatattagctaatgtgtattgagtacgctggttatcagactgtttcccacagaccttgggagtgggccttgagaccctttccaggtatctgcaaagtcaaaattataatactaagacattctttgccttggtcgacattggcactggtggtacaaaagtagtgcatcaaacagctggtgctggagcacaaatcaggacagtggcaccagctgcactagtcttctgtcactggattcttcaccaccacgtgctggacttgcagttaaaaaaaaaatgccagcttcacttacgaatgtccttgataaagcagaaaaatattaatctcatttaatcttgacccctgaatgcacatctagtttaatattccatgtgatgaaatgggaagaatgcataaaggcctgttgtatgctgaagtgcaatggttgactcaaggaaaaacgtgtgtgcctgagttacaagctgctgttttcatggagtatcatttttatttggaaggacaactgacagacaagactgtggttatttgtgttatggtgtttggcagacattttcttgaaaatgcaggaagccacaataaacatacgtgtgcatgtgtctttatagcagcatgatttatagtcctttgggtatatacccagtaatgggatggctgggtcaaatggtatttctagttctagatccctgaggaatcgccacactgacttccacaacggttgaactagtttacagtcccaccaacagtgtaaaagtgttcctatttctccacatcctctccagcacctgttgtttcctgactttttaatgattgacattctaactggcactattcacaatagcaaagatttggaaccaacccaaatgtccaacaatgatagactggatcaagaaaatgtggcacatatacaccatggaatactatacagccataaaaaatgatgagttcatgtcctttgtagggacatgggtgaaattggaaatcatcattctcagtaaactattgcaaggacaaaaaaccaaacaccacatgttctcactcatagatgggaattgaacaatgagaacacatggacacaggaaggggaacatcacactctggggactgttgtggggtgggggttggggggagggatagcattaggagatatacctaatgctaagtgacgagttaatgggtgcagcacaccagcatggcacatgtatacatatgtaactaacctgcacattgtgcacatgtaccctaaatcttaaagtataataataataaaaaaaagaaaaaaaaagacaaaaatactataataaaagatgcttctatcacacacacaaaaaaagaaagtgcaggaagcaaaacttcaaggaaaacaactcatggtattttttgtaaatggtaaaatttgatctttcatgggaaaaccagaatttttgaaaagttgtatctgctaccatgagcttgacaacctcccagtaattaaaatatttctgatgaagttggtgaagatagtaagtaatgtgattttttttgctattgtatatgaaatgtgtcaacatttgaaagatctttataactcagtaaaccaatattttccagtcgacctacattgcattatacaataatgctgggataaaagattcattgaaagtataagagagaccagtggatttcagtgtagcagagtacaaaaaggtcattgatacgatttcagattccacatcatagttaacctttaagaaactaccacttgttgagttttagtgtcctgttgaagaacgtctaccattatctgaaagagctattaaaatagttcttttctaactacagatctctgtgaggccagattttctttgtatacttgaaccaaaacaatgtattgcaacagaatgaatgtaaatatagatattagaatctaggtgtcttctatgatatcatacattaaaaattttgctaaactgtagaaacagtgtcgctactctcactaaatttgtgttggttttggaaatgtttttaaataatgttatgtatgttagtatgtaatgtgtttattattaccttcgaagagtagatattttttgaataacaactgtatcgtaaatattaaataccaatagggataacccatatcaaccagagctctttgggatcctcagtaagtgttagaactgaaaaggagttctttttaagagttaaacgtcaaaatttttgatactaaaaactttgagagccactgatttagtgctttatacaaagcacttgttatactcattatcttatattcgtagccaccttatgaggtacatattattgccctaactttatgggtaagaataccatgacacaatgatgctatgtatatttttttagcaacccctctgaatctcatgatcttcccagcgtagttttctctctgggaggcttgcttccaagtttaattttgtaggtccagtcttcttacaaccctcctcccttttttccaatcgaagtttcttatgttatttttcatagtacaaaaacagtacacgtaccttacagaaaactcagatatcataagcaaaagagtataaagactatccttaatcttcccgagtggagacctgttagctgctcagcagatatttatacagatgcttttctaaacatgttcatttatcagtgtaaagccggtatagtataatactcaattagaaggattttggagtcaaatggtttgactcccaactctgagctcttagacaagttatttaacatctgagctttctgttccttatctgtaactgcactgatctgtttttctgtgtctagagttttgccctttccagaatgtcaaataagtagcattgtacactatcttgtgttttccatctgaattattttacttatagtgcattttagattcatcaatgttgttgttgtcatccatagtttgttactttttactgctgattagtattccattgaacggatatatcaaaattcagttaaccattcaccagtttatggatgtgtgagttgttaccagtggcaattatgaataaagcttcttggaatatttgaatacaggcctttgtgtggacatacgttttcctttttcttgagtaaaatacctaggtgtgggattgctgggccatagaataagtatacacttaactgtataagaaacttccaaaatgttttctaaagtggctgtactattttgcattcccaccagcatatataagagatctagtgtgtgtgtaatcttatctcattgtcattttagtttgcattgtcctaacatctgaaaatactgagtattttttgtgtgcttatttgctttttgtatgccttctttgatgggatgtctctgaattttttggccattttaaatcgggttgttcacttatttttttagttgtaaaagtcctttttatatactggatacaggttactttgtcagatacgtgttttcagagtatggtctcccagtttgtggcttggctgtcattttgttaatgataggtatcttttggagagtaagagtttttcattttggagaagtccaatttcatatcccatctaagaaatgtttgcctaaccgtaggttgcaagtatttttttttcatatgtgttttggacattttatagttttgtgtatgacatttaggtctatgatccatgtcacataaatttttgtatatgttataaggttaagagtcaaggtgtactttcctcatttatccagttgtaccaccatttattgaaacataattatttctccattgagttgttttggcacctttgtggaaaattaactgactctatatgtatgggtctgttttccaactctctagtacgttctatatatctattcttatgccagtactacattgtgtttattactgtagctttatagtaagctttgaaagcatgtagtataaattgtccaactttgttctttttcagaattgttttgcccattctaggtcctttgcactgtcatatgacttttaaagtcagtatgtcaatttctacagaagaacctgctggctcccaattttcgctgggattgcattgattctttaaaataatttggttaatttggtgtgtgtggtaggctaaatcatgacccacaaagatacccacttccatggaacctgttaaagatcttgagatgatggggttatccaagtggggcaataaatgcaatcaatcacaggttcccttaaaagagggagataatattaagaggagaaggcagtgtggtggaaacagagacagagatttgaagattttatgcagctggttttgatgatagagaaaggggccatgagccaagggaatacagctctggaaactggaaaaaaacaagtaatagattctcccatagagtctccagaaggagtaggtcctgctgacatcttggttttagcccagtgaaaccctttttggacctctggcctcaggataataaatgtgtgccattttaagtcaccaattttgtggtagtttgttacagcacccataggaaactaatacacagaggatgtaaatcttaacagtattgagtgttctatgaacacagtatatgtctccatttatttagatctttaatttttcttggcagttatgaactgaatgtgtccctttaaaaatcacaagttgactctagtccccagtgtgatggtatttggaggtggggcatttgggaggtgattaggttatgagggtggaaccctcatggttggaactagtgcccttataaaaagagaccagagagctaactcactctcttttcaccatgtgaagggtattgagaagtctgccatctgccacccagaaggcagccctcgccagaacccagccatgctggcatcctgatctccaacttccagcctctggaactgtgaggaataaatttctgttgtttattagcttccccacagtcctaccagtgttttgtaggtttcagtatataggttttgcatatatgttgttacatttatccctaagtgttttatatttgtgatgctattgtaaatggtggattttttcataaacttttaatttttgaatagttataaatttataggaaagttgcagtaaatgatacatatttttaaatttctgtttccaatttgtgatagctactatatagaaatgcaataatttttgtaaatttaccttgtgtccttcaattttgttaaattcacttactagatctactagcttttttttagattacttaggatttcctacagggaatatcatgttgcctatagataatgacaggtttacttctttcttttaaaactatattcttttaatttctttttatcatcttattgttgtggctaggacctttagtacaatgttgaatagatgtgttgaagtggacatacttgctgtgtttcctgtcttaaggggaaagtattgagtctctcaccattaagcattataactgcaggtttttcatagatgctcttcttttcctaatttgtttaacgcttttaacttgaatgggtagcaaattacgtcaaatgctttttacacaactattgagatgatcatatgatttttctttttcagcctgctaataccacgaaggttgctaactgattttcaaatgttaatccaagattgcaatcttgcaatcctagctaaaccacacctagtcgtaatgtagtatccttatatattgctgaattcagttggctaaaatcttttcaggatttttgcatctctgttcatgagagatattggtctgtagttttctttctttgtcagttttgttatcagggtaatgctggcttcataaaataaattgggaaatgttcccccctcatcttttttgcaagagtttgtgaagaattggtggtatttcctcattaaatgtttggtagattttgccatggcctgacattttctttctgaaaaaggttttaactagaattgcagtttccatgtctttgtttcaagaaatttcctggcataaagttgtttataatatcccctacttatccctttagtattattaggatttgtagtgatatccctgttttcattcttgatattagtaatttgagcctactcttttttactgattattctggctgtagatttaccaattttcttactttctcaaagaaactgcttttagtttcattgatttttttctctaatccctttttactgtattttattgattaatgtgcttacatttatcattttcttctttccatttactttttaaaaatttccttccgtttcttacatggaggttccttacctccatgttctttctagtttcataagatagaatcttagattattgacttgatatcttttctaatgtaagtatttgatgctaaaatttcccttaagtactgctttagtgtatctcacaaattttggtatattgtgtttttgcctttagtccaaaatatttttcaattttcttcatagtctttgacctatggattatttcgcagtgtggcatttaattttcaagtattttgagaattttccagatatttttctattgttgatttctagtttgactccattgtgcttgtttactttgtatgatttcagtccttttaaatttgttgagctttgttttatggcccagaattcaatctatcttggtgaatgttccgtgtgtgtttgaaaggaatctgtattttgcttttgttgggaggaactcattaatattaattaggtcaagttggttgatagtgttgctacaatcatatatatccttagtaattttctgtttatgtgttctattagttactaagaaaggaatgttaatttccatttataacagtttgatttttttatttctccttttagattgatcagtactttctacatgtattgtgaaactttgttattaggcatatgacaaattgacccctttatcattatgaactacctctatttgtccctggaaatagtccttgttcaaaaatatactgtgtcttatgttgtggtaggcagaatgccccacccccacaaatacacagatacccaggccctaagccctgaaacctgtgaatatgttattattttacatggcaaaggggactttgaagctatatttattagcattcgtttctgctgttaccatgacaaattactctcagttctttaggtcagaagtccgggtacagcacaactcagatgggtcttctgcctagtttcacagggtcaaaatcaaagtgtcaggagggctctattcctttctggagcctccagggattaatctgctttcaagcacatttgggctattgtcagaatttagttccttggggttgtagggctgaggtcccatttaccttgctggctgtcagctgcgagttattctcagcttctgaagcctgcctgcattccttggctcatggttccttacctccatgttcaaagccagaagtaacaggctgaatccttctcaagtctggaatctctctgacttctgcctcatctctcttccaccacatttctctgacttactcttctgctttcttaagggcttatgggattacactgggcacacctggataatccagtataatcttcctattgtaaagttagctgattagtaaccttaattccatctgcaaagtcccttcacagtattactcagattagtgtttgattgaataatcaggggacaggaatcctgggaaacttctttagaattctgcctaccaaccacagttatggaccttaaaatagggagagtagcctggcttaaccaggtggactcagtttcatcacatgaactcttaaaagcggagaactttctctcagtggaagcagaagcgatatggcagaagtagtgagaaaacatcccaagcatgagaaagattgaatatgctatagcttgttactggctttgagatgtaggggcctatttacaaggacccaggagaggcccctactatcgcaagatcagctgctgcgtgacagcaagcaaagagacacatacctcagtcctacaaccacaagaaactggattctgccaacaacctgaatgagcttagaagtagattctgccagagtcccctgataagcattccaccaacagacatctttatttcagccttgtgagattctgagtagagaaaccaaccaagcccgtctcgccttttgtcatatagaactgtgagataataaatttacgttgttttaagctgctaagtttgtggtaatttgttacagcagcaatggaagactaaacagatattaatatagtcattccagctttcttttggttagtgtttatttggtataactttttctttccttttgcttttaatctatctgtgtctttatagatagataaagtgggattcttacagacagcatatagttgtcttgcttacttatccaatctgatcatctttgtctttcagttggccatttatatttaatatagttattgacagggttgagttttaactgttttcttgctgcagcctggaaactgcctctgatctgcaaactggggcaatagtagggtttacctcctttatttcctccttctcacctgttctccactgcctgttgtcaatgtctgaaaactgttcttttgtagactgtatcaagcttcttatttaggcgggaaggtaaattatattcctattattaagtcaaggctggaaatagaggtcctcaagagtataatttctaattatttcaaggacatcctctgtagcaattcccttttatatgagacgtgagcatgtgtgtatgtgtaatttattcattcatggaaagtataatacatacactaaaatgttcatgccatatgaatatgacagatggctgcctttttagaaatagaatcagttagtgatagaacttgaccattttcagagcatgtcagccttttccagtctctgtgtcttggtatagctagttccttctgcctggaatacttcctcatctcacttgctttcctgcctggcagcttcctacttgccctctggaaccagctctagggtcaccacatctctgcttctgagtgcctcctcagacacagtctgtatttcctcttccaagctctcatcacaaacattgtgctgtattatatgtttctgtgtggtcttccttctatgaggaagccttggaaagcaggagacttattttagtcttctttatgtttcttttattcccaacacattatgtctgccccatagaccttttcaataaatgattattgagttagtgactccttttacatgctgacaaatgtggctcttattactccccatttcagtatcacatatttgtaaaagtgaatccttcttaatcgttttacttttctcctagtaaattcctcatctatgcctgtctgctgctgttctctgtgctgctggcccttcgtttggatggcatcatacagtggagttactgggctgtctttgctccaatatggctgtggaagttaatggtcattgttggagcctcagttggaactggagtctgggcacgaaatcctcaatatcggtaatactgctttatacaacccattggtctctagcatgagggagcaatatcttgacttttctcacttttgatgaagtaaggaccattttattttctacctatctggggtcttagaactatagtataagctaacagatctcttctgtgtttttgaaaatttagtctttggtatgtattttcttacaaaagcagtgccatttgggggtaagttgccagccagctcacagatgcctatataatccaaaatgcacccaaaatacagaactggtatgccatactagactaagcagcatgaaaccaccctgtttttaggaaaagacactcatattatgtttggtcatgaaagatctttctccaatacagttttggaactggggctccccttgtcccaccctcctagtcccagagctttaggactattagcagtgtaggggaggtggcttgaccaggagaccatgagtccctgagacagcagctggggaatgaggaaagtcaaagattggatgccgagaaggaaagcagagcctttgggggcaggggagaggggtaccctttaccgtttccaactcttgccctccctgctcttggatgcctccgctggcccaaattcctgggagttggctcacgccagcatgcaacctgcttgttgctgggacctgcgagaggctttcccttctctgccacagagactgtaactacataaagggaaaaagggggacttaagactgggaggctattatgaacctccactgggaaaatgaggagtacaggaattcccagaaggcagctgctcatgtgggaaaagtgtaaagttgaaactaccgcaccttttttttttttttttttttttttttgagacagagtttcgctcttgttgcccaggctggagtgcaatggtgtgatctcggcccactgcagcctccacatcccgggttcaagtgattctcctgcctcggcctcctgagtagctgggattacaggcacctgccaccatgcccagctaattttttgtatttttagtagagatagggtttcaccatgccaggctagttttgaactcctgacatcaggtgatccacccgccttggcctcctgaagtgctgggattacaggtgtgagccaccacgtccggccactacatcaactttttaaatttttgtttactaaatatgaaaatgattcagattgtgtaaattacatatcacatacatgtctaagaactgtaaaacagttacacagagagccttggcaggtgagggacattcatgtatagctgtttcagagttcttagattttttttgaaagattgatgacctgtgtggctgtatgtgttttatttttttatgagatattttcagatatctaatattaattgcttctcaaagaatgcaaagttaaataaacatttaggttctactaattgatatttagaatatattcaaacttctctttgttggtcttatttaagatgttttgagcaaggaaaggaattgtgtatgtggggttgaatgtaaggaatgtacaggcgtggtcattctcatgttaacattaaccagtggaacatggttgggtcctacaggaataacctctgatagcattttctctatgatctaacttccggtgtatttgtcacccacaatacatgtatatcataaatgttcatctgtattttgaataaacattgtaggcctttcagatgcattatagagccttttcctgattagcggccttaccattgctcaattgtagatctgttaaggttattgtgcatgatacttagctaattaaactgattttgtttgagaacagttttaactcttgttcttctttctctttcatctgcaggtgttaatttatcttaatggaatagaaaggaaaatgaaaatcatttatacgttttatttgcatttaaaaatagcacctaacaatagttactactatcttgaaatataactggcacttgttcatagaactagagttatttttataatattgtgtgaagggtggtttacatggtttcttgaaaaatgaggatcatgagacttaaggggtatttgcctggttttagcagcagaagcaaatcagcttgaataatcttggaagtaactcttgttgttgaatttaaagatgtgaacagaagtgtttatgtacattgtcagggaaataagaactggctattacttttgagaatatccttatacggttaaaacattaaattctggtttggttgtaatgttcattttgtattatgtagtagttcttcgatgtttcagagattgcctaccaaagcttaggtttaagttagctttctacctgatttccctttgcttttgtcaaattttcaagtaaaattcaaagtataaatataagttggtatttgccctgaactgcttgcttatagtggagattctgaactgagggtgttttcttcttctctcccttttttagagcagaaggagaaacgtgtgtggagtttaaagccatgttgattgcagtgggcatccacttgctcttgttgatgtttgaagttctggtctgtgacagaatcgagagaggaagccatttctggctcctggtcttcatgccgctgttctttgtttccccggtgtctgttgcagcttgcgtttggggctttcgacatgacaggtcactagaggtgagatttcatatatttaagaatgttttccactttgggaggtcaaggcaggtggatcacttgaggtcaggagtttgagaccagcctggccaacatggtgaaaccccgtctctactaataatacaaaaattagccgggtgtggtggcatgcgccagtaatcccagcttctccggaggctgaggcgggagaatctcttgaacccaggaggcggaggttgcagtgagccaagattgaaccattgcactccagcctgggtgacagaatgaaactccgtcttaaaaaaaaaaaaaaagaatgttttcaaaagtaaaatattttgctcagttattcagatgtcaatttcttaccctttgttaggaagagcttgatcattaccaactctacatcatgagacaacaaggcaacaaaagatgatggaaataacaatttttctttcttcacttagaacactagcttttcacccaggacatcagccttctcccagcttcacatcctgtatcaatcagacagaaacagaactgataggttagatacagatatatgtataaagagagttaaggaactggctcacattactgtggggctggcaagtctgaaatctccagggcaggtgaacaggctggagacctaggaggagttgacactgcagtcctggcacagaattttttcctctccaggaaaccacagtttttgcttttaaggccttcacctgattgcatgaggcccacccatgctatggagggtagtctcctttattcaaagtcagtaccttcactgcaacagcaagcttagtgtttgattaaataactgggtactatagcccagccaagttgacactcaaaactgaccatctccccacctcagaccccatgatttagcacctcccctgctgtctggttagcttatcctgatgtgcccctgtgtttgtttattcattcaataaacatttatcaagtatttactagatgccaagccctttttccctaagcatagaggatatgcagatgaataaaataccaggactagtaataatagtaatgaaagtaattgcagataacgtttattgagcacttactgtgtgccaggcattgtgcgaggcacattacatgtggtagttttcttactaactaactctgtgaggtaggtccagagaagataagtcatttgttcatggccacatgtgaaggggcaggaccaggattccgtttgagtcagcccgactctaaagcccgggcacataactacataactgcatagaagctgagggcccaaagctgaatactgatgggttgaggggagaactagaggctgtagatgcctggttttgagccgtgtggatgaagagtgaagggagaagactgcagttggcttaggaagtaaacatagcagctgtagggtgggtcaggcatataagcctagaccccaggtatgggcgtgaggggaaggtatgtagacagagggacggtgatggagcaaggccctgtgggactcagggagaatgggacctagagcaccaggaagggtttggccttgaacaaggggagctattccctgattttcatgctggtggaaaggccacagcatgggtatagtggtaggtaggagtgagccgtggagggagagtatctgatggtccactttcaccctccctacaattcccagtttatatcagggacttgagcatccatggattttggtatccacagggggtcctggaaccaatcccccacagatactgagggacaactatacaaggactaggactgcattgggcctgaattacagaaagtaagtctttcatatattcacactctaggcattcctgcccttggaagaaacaacataccaggagctgagctccctcctcctgtgatgcaagaacagtacctatgttggtgagggggtggtctggagtaggctcatacagagatgggaaggaggagttgagggtctgccaggaagccctgtgttgggagggaagggatggcatttttgggacacattgaagcctagaggcaggaaacactccatcagctgagtggactgtggcgattcagatccgacgggagcacaaggtggaaaggaaggaactgtgggagttgagaagagagggagcctctacagagggattggggcaaataggggccacgtcctcagcccacagagcatgtgctgaagtgccccaggcaccccagtgcactcacagggcaccaggggatagtggacattttgaggaaaacagtaatacctgacatttgttgggacaccatacaaactactagcttgaaatagtttacaggtttatttttaggccacactgcattcctttcagtgacgtcgtatctttaagaagctgggttttcagcagttgctgtgaaaacaaaaaaggctaatgctgtgtgaaaatccgggtgaagaacaggtaacgagtgggagcaccttgtctgattccaaggcgtgggaaatggtgagctacctgacaggcacacgcatcccactgggaattagttttggttatttaagaataatattaacatttttctttagatttatatgaattattttttctggtggctacttagaaatacttactaagttagacgtaattacttaaatcagtgcaactgttggcattcccagccacattagggatttcttttggcctagaggtctatggaggaattactaaattccccatgtacctatgtactgagaacttttgggaagctctgggcctggtcccagatttcaattttgtgggcaagaatgtactttaccagagtgaggagcagcctgcagggcgtttgggctggaggcgggaggttagtaaggggttgctgaagtggtaggcggatggtgccgaagaaggcctcactaggcagtcatcatcaggataggaagtgggcacgggattcaggagaaatctggactttacagtggacaggatgtggtgactgaacgtgacagtgtgggaaaaagaatgcagggtgattcccgggctcatggcttgagaaatgagaccactgttgtgcctccaagtgacatgggaggctatagaaagtgacatgggaggctatagaaagtgacatgggaggccatagaaagtgacatgggaggccatagaaagtgacatgggaggccatagaaagtgacaagggaggccatagaaagtgacatgggaggccatagtgacatgggaggccatagaaagtgacatgggaggctatagaaagtgacatgggaggctatagaaagtgacatgggaggccatagaaagtgacatgggaggccatagaaagtgacatgggaggccatagaaagtgacatgggaggccatagaaagtgacatgggaggctatagaaagaggagatacaaggttctaagtgcaggcgataatgatctctatttgggactggcttcatttgaggtgcctttaggagagccgagtggcctatgcacagctgggtctgctatgcagcaggaaggctaagttggagacagatgtgagaactaaccatgaaggaggtaataatgcagaccaagggtctggttgaaatttcttctcccccagtccagggtgcagcgggtgagtgaaaatatgtgtgtttgtgtgtctgtcttcctagtcgggagagaagactgagtttgtggctctgcggagcatcaccatttaaggagggggaaaaggagacagaaggaattaccagaacactccagagggctccaagactgtatggtgggatcctagatggccaggaggaggggagcaaaaaggaaagagtcatccacagtatcagtaggatgccagttgaagtgtttttgctgcctcccggttatcggtgactttgatgaaagctgtcttctggtggtcatgggggtggaggccagatcacaaggaagctgggaatggtagatgagatagtaggggcttgcatattcattactgtctcgcagagagaaacctgaggctaagaggggtcttggatcaaaggatggggtgggtttatctggtttcggggcttttgtttttaatgagaaggagtcatttctgtgctgctaggagggatcaatggaataggtggggttaaagatacagtacggaatctacagttgatggcttgatgtgacaaggtcctcaaggagcctgaaaggaaggggtggggtccaagggcaaaaccgaggtatgagaagaaggatgcacaaggatggtttcgagtagacagtattgttggtagggacatgaaggaagcttagtggtctattgcagctagcctgtgttcccagtgaacctggaaacaaggttctcatctgtgctcaggcctcaggccagaaagggcaaggcagcagaggggcaaggcagcagaggggcaaggcagcaggctgagccccatttccccttgccataatactgctgtgcccctctggtaccgaaaatcaggagtttccagtgcaatataatattatacaagttacactgtattataatgtgtattgtcttttagtgtgttaaccaaattactgcagtattaaatgcaaattatactttgtttaactgattcttctcttcatttttagttagaaatcctgtgttctgtcaacattctccagtttatattcattgccttaagactggacaagatcatccactggccctggcttgtatgtaacttttaaaatccttaaataaacttcttttttattataaaagtaattcatattcactgtacaaagcttggaaaagacggacaagcagaagtaatagcctaatagtcacccataatcccaccatggggagataacatggttagtgtttttatgtctgtgttttatacaaacagtttggatataactgtgtgcaccattttgtatcctgatttttttgttttaatgttgtatcataaacattttatcatgttaataaaaggtctttataaacatgacttctaaagtttaattgatacaaaatattcttcaagtgcatgtatcagaccatcctcttatttctaaaatatggtatttccattgttgccagtgttgaatgattttaaatcatactgcagtatatatgtttatgcattaaaatttttgccttttgttttttggttgttttcttaggaaatagtccagaaatagtgttactgagctagaggttgggaactatttgagattcctatatacgtatactgcactgccaacttgcttttccaaaagccatacctggccaggcgcagtggcttacacttacagtcccagcactttgggaggccgaggtgagctgatcacttgagctcaggagttcgagaccaacctgtgcaatgtagcaagaccctgtctcaaaagaaaaaaaaaaaaagccatacccatttacactcttgctggtggtggcatctatgtcatgcttctaaactgtgacttcagttactgggcatttggttgaaattaactgtgaataaatgggtagatggatgcagagatagaaagataagtggcaaggtagaaattagagaacacagtatagattccactattaaatgcatggaaaaaagatggagactaaaggcagaagagttccattgccactgggaggtaaggtcatgctagtgtttttgttcggttttattttctctgttgtttgatgtataattttgcatacaatatattttatgtattaaatatagctacccttaaaaagtgaaaagtatagtaaagaattgggagcagagaagaaatgaagggaacctaagtatactccatatttaaagatgggaataatcacttctgcccaaagtctttgataaaacattcataataaaaaatattcagtcactcatcctacaacttcacagtgctgtatctggagaatggtcattgggttcaaaactgtttctgttgtgacgtgaaggaaacatatctaaacaagaccaaattttttcgtataagatactgtcagggaaaaaaaagattagtaattttgagagctttccacaaatgagaagaaagattttttctgcccttcatcctctgtagatcccagttgatgaagcagtctgagtacatgtttcccatagtgagcaagagaaaacaaggaagcctattgagatctaacattccacccatgaagggaacttcagtaaaaaggagaatctcatcacagaatggggaacggggaagaaaggctgtgcatagactctgcagagaaacctacaatcaagaactggtcaggagaagtaaaattcgtatgccaactcaaatcatagatctaaaagaaaatgtaaaactatagatctgttaggaaataacataggacagaatctttggggtttgcaattaggcagagagtacttagaaatggcactgttaatatggtccatacgagagagaaatcataaatttggacttcctcaaaattaaaatgaaatgaagacaggccacagactgggagaaaatatttgcaaagcacacatcaaaacactgacttgcacccagaacatacagagaactcttaaaaactcaaaactgcaaaaagaaacacctaaaaattggcaaaagagttgacaatttgcgaaggggatatacacatggcgaaaaagcacaggaaaagatgctcaacgccattacaggttagggaagacaaactacaaccaggatgagggcccgaaacacatggcttcagaatggtgaaactcagcaacactgacgaggccacgtgcctgggaggatgcagaggaactgggacactccagtgttactggcgggaaggcaggtggtacgggcactgtagaaaatggtttggccatctctgatgcagttaaaagcgcacttcccgtgggacttggctgccccactcctgggtataagatttacccccagagaagtgaaagcgcgcagccttgtagaaacccacacaccagtgtttgtagcagtcttgtttgcattttggatagcggccttgtttggttttcacaaaccaccctcagcggacagtcagataaactgtaggcatccatacaatggaataccactcagaactgagagggaacgacctgtggatacagggagggaacaacttggatgaatctcattagagacattatgtggatggcgggaagccagtctcaacaggttacttgtctcgcgatgccatctacataaagttccagcagagacaaaagtacagtgacagagaacagatcagtgtttgccggggctaatggtggggacggtgtgatagtgaagggacagcacggagagttttgcagggtgacagacctcttctgcatcctgccaacggctgtgcgaatctacttgtgtgaagactcagggaactcacaccaaaggaagacggtcacttttcctactgtatgatagataattaataaaaagggagaacggaggagtgtcgtcccaggaggcagggcaggagggcgaagacgtgtcacaggggagcctggccaagtggcgcccccggaactcgtcctctgggcttgtgtgtggatgagacaaggtctacctggtacgacagggacatactgggaatgcgcccttgccgtggaggcggggacccggcagcgctacgtatccagcatcaacctgtatccagcatcaacccgccaagttcactaacttggtaggggtgaggttagggatccttaggagcccaggcagccagactttctggggagcccattcccatttgtgttgccaaagtacccccagcaggttgtgggaatgttgcctgtgaagagagtctgttggggtgagatcttgtgtgtgtgcacagggtgacagttgtgtcccatttcccgggaagctgtgatggcagcagaacctagaggagcctgagagagtgtgggagagtgggcctctggaagagtagaggctgcggagccaggtgcagggctgtctgtcacccaaaggaagagggactgatgactcactgagcgtgtgtgtcccctggtggcagcaggccccatagtgaacataccataccttttctgtcctgagcgatgctcccagcagtcctgggagatggaacggtccttattcggctcacgggaaggaccgccttaactggacagacacagcaaggtgctaaagatgccttccatcagaggccaggttggaagctctaaagagacttctcttgctgttctctcacccacccccaggttgtgtgtgtcccgctgtggattctcatgtcctttctgtgcctggtggtcctctactacattgtgtggtccgtcttgttcttgcgctctatggatgtgattgcagagcagcgcaggacacacataaccatggccctgagctggatgaccatcgtcgtgccccttcttacatttgaggtaagcgttccacgggaagcctcttcagcccctgaagcttgcgcttcccctgacaggattctgcacccctagaaaggcagcctctgtccctcgagctcacagtgagcccactccaggagaggggagagaacacagccatctccgagagggagcttcggtgaaaggagagcatccttcctttctcttgggggcagcacgtggggctggcagggagaagagtgcacctttttagccatggtgcctctgtatggctccagtttccactctggggaaagcagagtgggatgtcagatttgtgtattggagtcacgtggagaattctagaatgggagctgttgactccttagaacaaacacccggaggagtttgccataaaactgctggcactgggaacttttcaagtggataggctattgccgagctctgaagagggacataaaagctcatttcgagctttccccagggataggtggtttcctgcctttttctggcggtgctgatgttccctcttgtgggagctcacgcgggggtggggtggtggggaggaactgcctaatgaagtctggcttccgcctctgcccattttcggtgctggcatcaaccgggactatgtctctttctttagattctgctggttcacaaactggatggccacaacgccttctccagcatcccgatctttgtccccctttggctctcgttgatcacgctgatggcaaccacatttggacagaagggaggaaaccactgtatgtactcagcatttcagaagtccttggtgtgtgtctggggggggaccagggagtgggggggggggcggatagaagtctaggaagggatgagtccccgagggccccaatttagaagcttgtgtgggaaagtgagggctgaggaaattctgggaccttctaagggaagggcatgccgtaactctggtgttctgctggcctgcaccgggacttttctcgcagtgcacgctgccatttgaggtagaaccagacacggcaggcaacctctcagagatcccgttccctcctctgcaaaatggggatcaagacagattcttcccaggcccgggagggtttgatggaaaatccacatctcccacccaaacctgggattcatcctaggtccctgttggcctctctgcctcccccatatccttgctgccatcacccgagtcttgcctgtcttgccttgctaacactctattcccctccacctgcttgctgaggcagacacttccaaaacgatctctgcagagggtgccttcctggcaaggctgtgggctccatggcacggaagcccagagcattgcccttcggaaagccagtgggtttgggggcagggcctcactgcagcccagcagcccgggctgtgcttgctgtttgtgcctctgccccctaccccgcacccgggagcagggagggcttgcaccgagctgacactccagtagcctacagagaggagtagtgggactgggaaagtggctttaaggtggctccatgagttcaggccccctcctggccaggacccgtgcatgactaccgccctcacggattccagagggtgacagaaatcttgttcttgggtggcactgtcatccatgagtttatcctggctggagaagattagcggaagacaccgtagtctgcgcaccacagatattttgagactcactggagcagtagttctcaaacttgggcatccagcagaatcccaaaagggccaggaaaaggggaccgctggagcccaccctagcccgactcagtttctggaggtctgggctggggcccgagaatggcatccctaactaggccccgtggacgctgtccctgccggtccgggaaccccactccaagcaccacagagctagcatttgcacttcttccccattttgggtactcaagccctgttcaggctttgtgactcaggagtctggataaagtatgttatgacattgtaggagtgaaacttcttgttacggaaagaaagttaacaggaaggtcagttgagcctcgtgtgtgaaataaaaaattcttatttttcagggtggtttggtatccgcaaagatttctgtcagtttctgcttgaaatcttcccatttctacgagaatatggaaacatttcctatgatctccatcacgaagataatgaagaaaccgaagagaccccagttccggagccccctaaaatcgcacccatgtttcgaaagaaggccagggtggtcattacccagagccctgggaagtatgtgctcccacctcccaaattaaatatcgaaatgccagattagatgccacttccggggacagagcttaagtggactgggacgcactctctccgccttcctctgccccctcgttcaccccgcagaccagaaccagtactggagctgggtctccaggtacgtccatctcatgccttgtttgcatccagcgcctatcagccactcaccacgacgggacgcggaagtggcaggtgacgggggtgtgtgccagcagatgcggatgccaggaagagtgtgagaacaggggtgggattaccgtctgtctgggaggggctccaggtacccctcttccccgtcagacccactgggagatggctgcttgccaggcccccagaaggaacatctgtctatacggtgctgaaatcccaatcaaaagtattgtttagaaatgtatttctccacagggctgacctcctgcagctcgctgagcactcccaggtcctcagcactcccaggtcgtggctggggcagtcagtaggaactgtaactatgtctctgatgcaccacgtgtttagacacagcacagtccttttttctgttcctactgtggaagtagtttctctttgggcatgctgacagcagtttttcatagcctcacggatgagccctttctacgggagtgactccatgcttgtatacagagtatttatacaaatgttttagcatcttcatatgcggtgttaacccctagttctgtacagcatattctgttcaagtatttttttacaagcttgtgctgtaggcacatgccttctgctgcagaagtggacgcccgtggcacactccccccccccccgtggggtgccacgccttcatgggacattgccacttctgccctggaactcgtgcaggtacgtagtagctgctactgccagaacggcaacaccaagcaagagatggtccatgcttttctgacgttctcagaatagtggctagcttcaaacctgacaagcgctgcttgaagccggaacactagagaatgttgctgagagcagaaacggccacgcgggtcacgactatgcgtgggaaagtctcaagcttccctcctgccagcaacaagaaggctttggagtaggcatgatgttttcacgtgtgcgtgccgtttctccaagcactgcaggttccaccgtgtgtcagaggctgcaagtttaacatcctcctgcctgaaaacaaataggtcctttgctgaaaagagggtaaaaaaagagctttgatcttctcagccaggagaagagggtggtgttttcacgcgggcaactgctcgccggcctacatggggttaattcaagtctgctgcgagcacgactccgcccttggcactggcctccagcaagccctgttctctttggggtacaggggaacgggatggtttagactttcctgctcagtgtgtaaaaaatgtagctaaagccactatttttgctctccttaagctgttcaataaaccggttcctcatttt

SEQ ID NO: 3916 - DNA, 5669 bp, human; identical to SEQ ID NO: 3908

SEQ ID NO: 3917 - DNA, 5669 bp, human; identical to SEQ ID NO: 3908

SEQ ID NO: 3918 - DNA, 35352 bp, human; identical to SEQ ID NO: 3912

SEQ ID NO: 3919 - DNA, 10813 bp, human; identical to SEQ ID NO: 3913

SEQ ID NO: 3920 - DNA, 35271 bp, human; identical to SEQ ID NO: 3914

SEQ ID NO: 3921 - DNA, 35186 bp, human; identical to SEQ ID NO: 3915

SEQ ID NO: 3922 - DNA, 11177 bp, human
taaattcctcatctatgcctgtctgctgctgttctctgtgctgctggcccttcgtttggatggcatcatacagtggagttactgggctgtctttgctccaatatggctgtggaagttaatggtcattgttggagcctcagttggaactggagtctgggcacgaaatcctcaatatcggtaatactgctttatacaacccattggtctctagcatgagggagcaatatcttgacttttctcacttttgatgaagtaaggaccattttattttctacctatctggggtcttagaactatagtataagctaacagatctcttctgtgtttttgaaaatttagtctttggtatgtattttcttacaaaagcagtgccatttgggggtaagttgccagccagctcacagatgcctatataatccaaaatgcacccaaaatacagaactggtatgccatactagactaagcagcatgaaaccaccctgtttttaggaaaagacactcatattatgtttggtcatgaaagatctttctccaatacagttttggaactggggctccccttgtcccaccctcctagtcccagagctttaggactattagcagtgtaggggaggtggcttgaccaggagaccatgagtccctgagacagcagctggggaatgaggaaagtcaaagattggatgccgagaaggaaagcagagcctttgggggcaggggagaggggtaccctttaccgtttccaactcttgccctccctgctcttggatgcctccgctggcccaaattcctgggagttggctcacgccagcatgcaacctgcttgttgctgggacctgcgagaggctttcccttctctgccacagagactgtaactacataaagggaaaaagggggacttaagactgggaggctattatgaacctccactgggaaaatgaggagtacaggaattcccagaaggcagctgctcatgtgggaaaagtgtaaagttgaaactaccgcaccttttttttttttttttttttttttttgagacagagtttcgctcttgttgcccaggctggagtgcaatggtgtgatctcggcccactgcagcctccacatcccgggttcaagtgattctcctgcctcggcctcctgagtagctgggattacaggcacctgccaccatgcccagctaattttttgtatttttagtagagatagggtttcaccatgccaggctagttttgaactcctgacatcaggtgatccacccgccttggcctcctgaagtgctgggattacaggtgtgagccaccacgtccggccactacatcaactttttaaatttttgtttactaaatatgaaaatgattcagattgtgtaaattacatatcacatacatgtctaagaactgtaaaacagttacacagagagccttggcaggtgagggacattcatgtatagctgtttcagagttcttagattttttttgaaagattgatgacctgtgtggctgtatgtgttttatttttttatgagatattttcagatatctaatattaattgcttctcaaagaatgcaaagttaaataaacatttaggttctactaattgatatttagaatatattcaaacttctctttgttggtcttatttaagatgttttgagcaaggaaaggaattgtgtatgtggggttgaatgtaaggaatgtacaggcgtggtcattctcatgttaacattaaccagtggaacatggttgggtcctacaggaataacctctgatagcattttctctatgatctaacttccggtgtatttgtcacccacaatacatgtatatcataaatgttcatctgtattttgaataaacattgtaggcctttcagatgcattatagagccttttcctgattagcggccttaccattgctcaattgtagatctgttaaggttattgtgcatgatacttagctaattaaactgattttgtttgagaacagttttaactcttgttcttctttctctttcatctgcaggtgttaatttatcttaatggaatagaaaggaaaatgaaaatcatttatacgttttatttgcatttaaaaatagcacctaacaatagttactactatcttgaaatataactggcacttgttcatagaactagagttatttttataatattgtgtgaagggtggtttacatggtttcttgaaaaatgaggatcatgagacttaaggggtatttgcctggttttagcagcagaagcaaatcagcttgaataatcttggaagtaactcttgttgttgaatttaaagatgtgaacagaagtgtttatgtacattgtcagggaaataagaactggctattacttttgagaatatccttatacggttaaaacattaaattctggtttggttgtaatgttcattttgtattatgtagtagttcttcgatgtttcagagattgcctaccaaagcttaggtttaagttagctttctacctgatttccctttgcttttgtcaaattttcaagtaaaattcaaagtataaatataagttggtatttgccctgaactgcttgcttatagtggagattctgaactgagggtgttttcttcttctctcccttttttagagcagaaggagaaacgtgtgtggagtttaaagccatgttgattgcagtgggcatccacttgctcttgttgatgtttgaagttctggtctgtgacagaatcgagagaggaagccatttctggctcctggtcttcatgccgctgttctttgtttccccggtgtctgttgcagcttgcgtttggggctttcgacatgacaggtcactagaggtgagatttcatatatttaagaatgttttccactttgggaggtcaaggcaggtggatcacttgaggtcaggagtttgagaccagcctggccaacatggtgaaaccccgtctctactaataatacaaaaattagccgggtgtggtggcatgcgccagtaatcccagcttctccggaggctgaggcgggagaatctcttgaacccaggaggcggaggttgcagtgagccaagattgaaccattgcactccagcctgggtgacagaatgaaactccgtcttaaaaaaaaaaaaaaagaatgttttcaaaagtaaaatattttgctcagttattcagatgtcaatttcttaccctttgttaggaagagcttgatcattaccaactctacatcatgagacaacaaggcaacaaaagatgatggaaataacaatttttctttcttcacttagaacactagcttttcacccaggacatcagccttctcccagcttcacatcctgtatcaatcagacagaaacagaactgataggttagatacagatatatgtataaagagagttaaggaactggctcacattactgtggggctggcaagtctgaaatctccagggcaggtgaacaggctggagacctaggaggagttgacactgcagtcctggcacagaattttttcctctccaggaaaccacagtttttgcttttaaggccttcacctgattgcatgaggcccacccatgctatggagggtagtctcctttattcaaagtcagtaccttcactgcaacagcaagcttagtgtttgattaaataactgggtactatagcccagccaagttgacactcaaaactgaccatctccccacctcagaccccatgatttagcacctcccctgctgtctggttagcttatcctgatgtgcccctgtgtttgtttattcattcaataaacatttatcaagtatttactagatgccaagccctttttccctaagcatagaggatatgcagatgaataaaataccaggactagtaataatagtaatgaaagtaattgcagataacgtttattgagcacttactgtgtgccaggcattgtgcgaggcacattacatgtggtagttttcttactaactaactctgtgaggtaggtccagagaagataagtcatttgttcatggccacatgtgaaggggcaggaccaggattccgtttgagtcagcccgactctaaagcccgggcacataactacataactgcatagaagctgagggcccaaagctgaatactgatgggttgaggggagaactagaggctgtagatgcctggttttgagccgtgtggatgaagagtgaagggagaagactgcagttggcttaggaagtaaacatagcagctgtagggtgggtcaggcatataagcctagaccccaggtatgggcgtgaggggaaggtatgtagacagagggacggtgatggagcaaggccctgtgggactcagggagaatgggacctagagcaccaggaagggtttggccttgaacaaggggagctattccctgattttcatgctggtggaaaggccacagcatgggtatagtggtaggtaggagtgagccgtggagggagagtatctgatggtccactttcaccctccctacaattcccagtttatatcagggacttgagcatccatggattttggtatccacagggggtcctggaaccaatcccccacagatactgagggacaactatacaaggactaggactgcattgggcctgaattacagaaagtaagtctttcatatattcacactctaggcattcctgcccttggaagaaacaacataccaggagctgagctccctcctcctgtgatgcaagaacagtacctatgttggtgagggggtggtctggagtaggctcatacagagatgggaaggaggagttgagggtctgccaggaagccctgtgttgggagggaagggatggcatttttgggacacattgaagcctagaggcaggaaacactccatcagctgagtggactgtggcgattcagatccgacgggagcacaaggtggaaaggaaggaactgtgggagttgagaagagagggagcctctacagagggattggggcaaataggggccacgtcctcagcccacagagcatgtgctgaagtgccccaggcaccccagtgcactcacagggcaccaggggatagtggacattttgaggaaaacagtaatacctgacatttgttgggacaccatacaaactactagcttgaaatagtttacaggtttatttttaggccacactgcattcctttcagtgacgtcgtatctttaagaagctgggttttcagcagttgctgtgaaaacaaaaaaggctaatgctgtgtgaaaatccgggtgaagaacaggtaacgagtgggagcaccttgtctgattccaaggcgtgggaaatggtgagctacctgacaggcacacgcatcccactgggaattagttttggttatttaagaataatattaacatttttctttagatttatatgaattattttttctggtggctacttagaaatacttactaagttagacgtaattacttaaatcagtgcaactgttggcattcccagccacattagggatttcttttggcctagaggtctatggaggaattactaaattccccatgtacctatgtactgagaacttttgggaagctctgggcctggtcccagatttcaattttgtgggcaagaatgtactttaccagagtgaggagcagcctgcagggcgtttgggctggaggcgggaggttagtaaggggttgctgaagtggtaggcggatggtgccgaagaaggcctcactaggcagtcatcatcaggataggaagtgggcacgggattcaggagaaatctggactttacagtggacaggatgtggtgactgaacgtgacagtgtgggaaaaagaatgcagggtgattcccgggctcatggcttgagaaatgagaccactgttgtgcctccaagtgacatgggaggctatagaaagtgacatgggaggctatagaaagtgacatgggaggccatagaaagtgacatgggaggccatagaaagtgacatgggaggccatagaaagtgacaagggaggccatagaaagtgacatgggaggccatagtgacatgggaggccatagaaagtgacatgggaggctatagaaagtgacatgggaggctatagaaagtgacatgggaggccatagaaagtgacatgggaggccatagaaagtgacatgggaggccatagaaagtgacatgggaggccatagaaagtgacatgggaggctatagaaagaggagatacaaggttctaagtgcaggcgataatgatctctatttgggactggcttcatttgaggtgcctttaggagagccgagtggcctatgcacagctgggtctgctatgcagcaggaaggctaagttggagacagatgtgagaactaaccatgaaggaggtaataatgcagaccaagggtctggttgaaatttcttctcccccagtccagggtgcagcgggtgagtgaaaatatgtgtgtttgtgtgtctgtcttcctagtcgggagagaagactgagtttgtggctctgcggagcatcaccatttaaggagggggaaaaggagacagaaggaattaccagaacactccagagggctccaagactgtatggtgggatcctagatggccaggaggaggggagcaaaaaggaaagagtcatccacagtatcagtaggatgccagttgaagtgtttttgctgcctcccggttatcggtgactttgatgaaagctgtcttctggtggtcatgggggtggaggccagatcacaaggaagctgggaatggtagatgagatagtaggggcttgcatattcattactgtctcgcagagagaaacctgaggctaagaggggtcttggatcaaaggatggggtgggtttatctggtttcggggcttttgtttttaatgagaaggagtcatttctgtgctgctaggagggatcaatggaataggtggggttaaagatacagtacggaatctacagttgatggcttgatgtgacaaggtcctcaaggagcctgaaaggaaggggtggggtccaagggcaaaaccgaggtatgagaagaaggatgcacaaggatggtttcgagtagacagtattgttggtagggacatgaaggaagcttagtggtctattgcagctagcctgtgttcccagtgaacctggaaacaaggttctcatctgtgctcaggcctcaggccagaaagggcaaggcagcagaggggcaaggcagcagaggggcaaggcagcaggctgagccccatttccccttgccataatactgctgtgcccctctggtaccgaaaatcaggagtttccagtgcaatataatattatacaagttacactgtattataatgtgtattgtcttttagtgtgttaaccaaattactgcagtattaaatgcaaattatactttgtttaactgattcttctcttcatttttagttagaaatcctgtgttctgtcaacattctccagtttatattcattgccttaagactggacaagatcatccactggccctggcttgtatgtaacttttaaaatccttaaataaacttcttttttattataaaagtaattcatattcactgtacaaagcttggaaaagacggacaagcagaagtaatagcctaatagtcacccataatcccaccatggggagataacatggttagtgtttttatgtctgtgttttatacaaacagtttggatataactgtgtgcaccattttgtatcctgatttttttgttttaatgttgtatcataaacattttatcatgttaataaaaggtctttataaacatgacttctaaagtttaattgatacaaaatattcttcaagtgcatgtatcagaccatcctcttatttctaaaatatggtatttccattgttgccagtgttgaatgattttaaatcatactgcagtatatatgtttatgcattaaaatttttgccttttgttttttggttgttttcttaggaaatagtccagaaatagtgttactgagctagaggttgggaactatttgagattcctatatacgtatactgcactgccaacttgcttttccaaaagccatacctggccaggcgcagtggcttacacttacagtcccagcactttgggaggccgaggtgagctgatcacttgagctcaggagttcgagaccaacctgtgcaatgtagcaagaccctgtctcaaaagaaaaaaaaaaaaagccatacccatttacactcttgctggtggtggcatctatgtcatgcttctaaactgtgacttcagttactgggcatttggttgaaattaactgtgaataaatgggtagatggatgcagagatagaaagataagtggcaaggtagaaattagagaacacagtatagattccactattaaatgcatggaaaaaagatggagactaaaggcagaagagttccattgccactgggaggtaaggtcatgctagtgtttttgttcggttttattttctctgttgtttgatgtataattttgcatacaatatattttatgtattaaatatagctacccttaaaaagtgaaaagtatagtaaagaattgggagcagagaagaaatgaagggaacctaagtatactccatatttaaagatgggaataatcacttctgcccaaagtctttgataaaacattcataataaaaaatattcagtcactcatcctacaacttcacagtgctgtatctggagaatggtcattgggttcaaaactgtttctgttgtgacgtgaaggaaacatatctaaacaagaccaaattttttcgtataagatactgtcagggaaaaaaaagattagtaattttgagagctttccacaaatgagaagaaagattttttctgcccttcatcctctgtagatcccagttgatgaagcagtctgagtacatgtttcccatagtgagcaagagaaaacaaggaagcctattgagatctaacattccacccatgaagggaacttcagtaaaaaggagaatctcatcacagaatggggaacggggaagaaaggctgtgcatagactctgcagagaaacctacaatcaagaactggtcaggagaagtaaaattcgtatgccaactcaaatcatagatctaaaagaaaatgtaaaactatagatctgttaggaaataacataggacagaatctttggggtttgcaattaggcagagagtacttagaaatggcactgttaatatggtccatacgagagagaaatcataaatttggacttcctcaaaattaaaatgaaatgaagacaggccacagactgggagaaaatatttgcaaagcacacatcaaaacactgacttgcacccagaacatacagagaactcttaaaaactcaaaactgcaaaaagaaacacctaaaaattggcaaaagagttgacaatttgcgaaggggatatacacatggcgaaaaagcacaggaaaagatgctcaacgccattacaggttagggaagacaaactacaaccaggatgagggcccgaaacacatggcttcagaatggtgaaactcagcaacactgacgaggccacgtgcctgggaggatgcagaggaactgggacactccagtgttactggcgggaaggcaggtggtacgggcactgtagaaaatggtttggccatctctgatgcagttaaaagcgcacttcccgtgggacttggctgccccactcctgggtataagatttacccccagagaagtgaaagcgcgcagccttgtagaaacccacacaccagtgtttgtagcagtcttgtttgcattttggatagcggccttgtttggttttcacaaaccaccctcagcggacagtcagataaactgtaggcatccatacaatggaataccactcagaactgagagggaacgacctgtggatacagggagggaacaacttggatgaatctcattagagacattatgtggatggcgggaagccagtctcaacaggttacttgtctcgcgatgccatctacataaagttccagcagagacaaaagtacagtgacagagaacagatcagtgtttgccggggctaatggtggggacggtgtgatagtgaagggacagcacggagagttttgcagggtgacagacctcttctgcatcctgccaacggctgtgcgaatctacttgtgtgaagactcagggaactcacaccaaaggaagacggtcacttttcctactgtatgatagataattaataaaaagggagaacggaggagtgtcgtcccaggaggcagggcaggagggcgaagacgtgtcacaggggagcctggccaagtggcgcccccggaactcgtcctctgggcttgtgtgtggatgagacaaggtctacctggtacgacagggacatactgggaatgcgcccttgccgtggaggcggggacccggcagcgctacgtatccagcatcaacctgtatccagcatcaacccgccaagttcactaacttggtaggggtgaggttagggatccttaggagcccaggcagccagactttctggggagcccattcccatttgtgttgccaaagtacccccagcaggttgtgggaatgttgcctgtgaagagagtctgttggggtgagatcttgtgtgtgtgcacagggtgacagttgtgtcccatttcccgggaagctgtgatggcagcagaacctagaggagcctgagagagtgtgggagagtgggcctctggaagagtagaggctgcggagccaggtgcagggctgtctgtcacccaaaggaagagggactgatgactcactgagcgtgtgtgtcccctggtggcagcaggccccatagtgaacataccataccttttctgtcctgagcgatgctcccagcagtcctgggagatggaacggtccttattcggctcacgggaaggaccgccttaactggacagacacagcaaggtgctaaagatgccttccatcagaggccaggttggaagctctaaagagacttctcttgctgttctctcacccacccccaggttgtgtgtgtcccgctgtggattctcatgtcctttctgtgcctggtggtcctctactacattgtgtggtccgtcttgttcttgcgctctatggatgtgattgcagagcagcgcaggacacacataaccatggccctgagctggatgaccatcgtcgtgccccttcttacattt

SEQ ID NO: 3923 - DNA, 35352 bp, human; identical to SEQ ID NO: 3912

SEQ ID NO: 3924 - DNA, 26565 bp, human
gcagcggggacggcagcagtagcgggagcagcagcgtggacgcggctggcgctggcgccatgaacccgctgtaaggcgcaggctgtgcagcacggggtgcgggggaggaggaggaggacgccgcggtgaagttctccgccatgaacctgaggggcctcttccaggacttcaacccgaggtgaggcggcgtcgttggcgcccccgggagtccgcgctgcgggctcgggcgcgggctggtgttcggctccggggaggcacggcgggcgagatgctgcagcccgaggacccgggcgcctgcccgagcctccctgcgggtgcaagcggtccccaggcaaaacagtcggcctcggcgcccgcccgcttcctcctcccgtgcccggtgctttcagcccctgcccggccacggccggaagggcccggccgcgagccccgtcctgccccaagggaaccccattcttttctgcttgctgtccctcattggtgtcccaacttcttcgtctcggttccatcctcttctgcgccgctgcgggccctccattctccgcgtcagggccgtctcactcgacccaacacccctacccccaccccagctgtttcctccagttcctcgcagtccttggggttttccttgggtttatgcccatccctctcttgtttgcttctttgttgaacggatacctgaaacactgttgaatccttggagtcagtgtcggggtatggcaataccttatataatgcatttctgggtgagcctgatcattttccatactcattttctcatcagtcttcactacaagtttatttgcaggaagtagatattgctgtccttcttttccagatggggaacacccagtggacagtgtggagaaaacactggctaagcactcaagcgcctgtccttgcacttgcccgactgttttgtaactgttctttaccccaggctgtgagctccctgaagctgagaccatctcctgctcatctcagtgtccccagcgcctcccacccaccgtatctggcacatagtaggcacatataaaatgtttgtggaactaaactgagcccaaagacttggattggagacgaggccatatgtaactgggtgattctctgcccttctttggcccttctgtaaaatgaggagttggcctaactgatctcttaaatgcactactctccgaaaggagtatccgtttcccttatttgccagttgggaagacgtgctcagtaaatatttgtgtgctgtaacctatgctaggtgctttagatgctggcggtctcagcatggggtgaagaagggcttgtacacttaagatgccttacagtactgtgcagtgctgtactgcgggggggccaactctggggacctatgccttggctgcttgttgaggatgaaaggaagttttaggggagtatttgtatgttgagggtgcagtctccctagggatggtgacattttaacttgtgagtcattgtgactttgtatgtgctcttattccactttgagttcatgttctggttaggagtgccagtgtctctaacacggtgcagacattatcattgttggcttcgaaggcatagaggaggtaacagaactaactgcagtcccttcctctgctgcatcagggggttaagattggtctgcagggtagtagggttggtgctgtggctggacaagccctgtatgtcttctatttggagatggtgataagaaagttaagtaaaaactgaattgttttgtgcccttgggcaactcacttatctattgttttatctgtagaatgagtataatctctcagtggggtagggaggccaattaaggattgattacaaagtgccttacaaatagaaagctacagtgacttgtttgcaaggtgacagagaattcagaagcctcaagaaactgccttaagtgatcaaacaggctaacagagttgccaaagcaaaatagtgctgcactgatactacctttaaccgttttttcctttagcccttttccccccaaaaaaattagtatatgaaattacagtgaaatacctggtatctaagcagatttatagtaattctcaacatattcatcaatctcttaattctacctgcattaaaatgtatttctacctgaaaagtttaaaggtcttttatactgtgccattttcctgattcattgttgccagaggtagtgagttccttaattttacagatatttcaagaggacattggccaggtattattggtaaatcagatttgtttttttagctggtagtgtttcacctctcctgagcactcctagtttttgacagtgtgctttagtctccttccatgctgaggaaggccttctctataggagaaagaaaactgaggggtgtacacaggaagttaccttatgctggggactcaaaccttgatgctactgctttgctccctgcctctatttttgaaccaattcaacatctccctcctaccccaggaccttgtcacacactgttctctttaccaggaatgtttccctctcttttcctctcctccagacctagtgaactcctatttatcctcacttggcacttgctaagggaagcattcctgacttccctgaccagatttactgctccctgtttctacagttcctgtagtatttactactcctccatcatagtgcatatttgtacccttgtgtctgtctggatgcttatttgattaatacctgcctcccccactaaactttaagctccatggggtcaaggccgtgactgtgtcagtatcgtagcctgcatacttggaatagtacctggctcaataaatatttgtggagtaaataactgaataactctccagagcctataagataaatctagagctgctgctttcaatcactgctttcctggtggtctgtggcctggttctctttcttctcacactcttcccaccttcagagtgcagccattgctttggagagatgggagagaacatggcactaaggcagaatatggctatatttactttgaagagcatgtctttgtcatagaaatagtcactgtcatggtttggtgggtcccaaggcatgggtcatggctccagatcccctttccagccttttggatcttggtaagtctgaacccactgctgcgttggcaaggctctggaaactatagtgacagagaatgattcacaagtgtcaacactcagatgtacagggctgccagctgacccactctacctatttccatctggcactgaactggttgatcatgaacttcttttcataattgctttttagttatgcaggttaagacatgccgaaacagatgtaccggacccacaaacaagtccttccttgaatgcctgaggcttcctaacagtgaaagagccctgttcttagagtaggcaaactgattctgaggcattgtaggtggtagggatctggtagtaggtagcattaggtgggctcccggcactcaccatggagccttgaaattttctgctactttgggggagttgctggttcagagaaggcccttccaccctggtagccatgtggcactggaaggctgtgaaaactctgctgggccttcttagtcatctgttgtgagctcctgatgggagtgtggtgtatccctcaggtgtgctagactggaacaaaggctgagaagtgttgctctgggggttccaacttgtgggcatggggtactgatgagatcagtagtgtttggagacttctgtatgctccatcttcagaagacattctggagtccatataagttatcttgtctcttgtttgaagcaggaaaaaggaatgcgattgctggtaatatagttcactaaagtcagctacctggcctctaacagttatttgcaaagtatattataacattgattcctcaaacatctagattcctatctcgtgccaagtgatgtactaggtgctctaagtacaaaaataaaggaatatagtcctcctctcaatgcgtaagcctagtggaagaagcagaaatgaaagggaaataagaattcaatagagtatgaggcattacagtgaaagaaaccaaatgtcttagaagtacaaatggcagagctactaattctgtctcgagcaggcagggaagagtctatagtggaaatgacttttgagctagattttgaattgagctagtcttttgagccagacttttgagctagaattgtagggttgtcatcagaccagagagtaggaagggtaccttgtgaggaagagagagagagatcagattgttactgtgtctatgtagaaaaggaagacataagaaactccattttgatctgtactaagaaaaattgtttctgctttgagatgctgttaacctgtaactttagtcccaaccctgtgctcacagaaacctgtgctgtaatgaatcaaggtttaatggatttagggctgtgcaggatgtaccttgttaacaatatgtttgcaggcagtatgcttggtaaaagtcatcgccattctccattctcgattaaccagggacacagtgcactgcggaaggccgcagggacatctgcccaagaaagcctgggtattgtccaaggtttccccccactgagacagcctgagatatggccttgtgggaaaggaaagaccttaccaccccccagcccgacacccgtaaagtgtctgtgctgaggaggagtagtgaaagaggggggcctctttgcagttgagataagaggaaggcttctgtctcctgctcatccctgggaatggaatgtctctgtgtaaagctgaccattcccattcgttctattctgagataggagaaaaccaccctgtggctggaggcgaagtatgctggcagcaatactgctctgttactctttgctacactgagttgtttgggtaaagagaaacataaatctagcctgcgtgcacatccaggcacagtacctttccttgaacttattcatgatacagattcctttgctcacgtttccctgctgaccttctccccacctgttgccctgctacactcccctcgctaagatagtaaaaataatgatcagtaaatactgaggtaactcagaggctagcgctggtgcgggtcctccgtatgctgagtgccggtcccctgggcccactgttctttctctatactttgtttctgtgtcttatttcttttctcagtctcgtcccacctgacgagaaatacccacaggtgtggaggggctggcccctttcagtatctcagaagggacaaagtacacaaaggcatggggtcatgatagtgcctggtatgttcaggtagtgaagaggtccatgtggtatgagcactgcagatgatatgtgtcgtatgaattaaaaatacatagttactgcaaatagtttttacaggttattgtttttaagaaagcagtatctaatgcacgagtgtactgtcagtactgtcaatgaactacttaccactcaagtgactgcttatctgttgttctgtcctctcaagccacctacagtcagaaaatggtcttgattttactgatgttgctgttaataatagctgtgacttcttgagtacccaccacatgccaggcccaatgtaggggctttgcatccattatccatgatctttacaacaaccctgcaaaattaggtatcagccttattttaaagtcttgacagcttgtgacttccctgaagttgcataggcaggaagaatctaagtcaacattcgaatccacgtcagtctcatgaagcctgtgctctttcctgcgtgccatgccatagttctagttaagtgacaactcctttcctccatgacattgtagatccagtatgctaaggaaccctctatttacaaattgtaagtgattaaacaaaacaaacctgttagtggcgcttatacatccaaatgagtgttgttattcaaagaggttacttggggaaagagaatgtatacacctattccattgttcatactccttgttactcatctggaattccctttaaagtcagtttacatatcacataagaagatccatctcattgctttatgatcatctatcattttcaaccaaaatagttccacctagtttgatcacacatcttattcactaaccttggctctgactgactgtttgccatttccaaaatttgaatccaccctcagtgaaaatttagcaccatttgggatagtcagaagatcagactgcaggttctcaaggtgcttccaagaagaaagcttcaaagatgatttgagtaatgaagtaccattggaattactgcattgcctcccaaggggactggttaaaggagagaaatctcatttgaatgtataatttccagttttaaaagtatcattcctattacttgataattacacacacattgttcttagctgtgttctttgagggccaggatttggaggtgctgaattacgtgctgaatgagtggatgttgggtacaaatagacatctaccactgggaagtctttgttgtacaggagagaccgtggattgaaggagttttagatagtttcctaggactccagaagttaagctttttaatatggagcttgagttttctaatcattttgcctgatatgtcatgcctgtacaagatgactggaatttaagacaaaagcctcgaactctggagatagatgctttataagtggagactcatactttgtcagctccaacctaatagtgacaacaatgattgctaaatgagattattacctacaatgtggcagaacttttgtctttcataatactgctaaagctagaatgggtaaaatgtatcatttacacagtgctttcacatacccttgtcttaatgaatcagtatatgaggaatcagatgaggagacagacctgggggaaaataactcacccaagaccacaccgctgatgaatggcagttgaggaacttaaatgcagatcttcctactggcctgggctctgcttttatttggcttttgtgcttttttgtatctactggttaaatgctcttaaacattttttatcttaataaaaccagctaaagtctccactaaaagactttaaatttggttaataaggtgtaagaggggcagttcccttgatagtttgtgagtatgtcaggttgtcatttggagccattctgtcaagctttagactgggatgtgccatccaaagtttgtgtgtgtgtatgtgcttgtgcgtgtgtacgtgcatgcaggcatgtgttaatgcgcgtgtatgtgctccagtgaagccagcagcttccactggaaaaaaactgataggtctaaaaagagtccagctgcattcttatgatatgcagaaaacagatactagaacttttacattcagagtcatcattcctttgctaagtatattctctctctccctcccttcttccttttctccctccctattctcccaaccctgcaaagtggagagagggaatttgagcctgagcagaaagctccatgtaaatttcagagaggatactagctttggcccaggtagcactacttagtgattcatcgtatactaacactacagattcaaatgagagtggaataaatccattctaaaggtgtaactggaaaagtgaattttaagaagtagtgattaatgttaaaccagaacctcccatttctcccaggtttgtggagaattaagcagtctatttttatacttggaatctggtctgaatgtttcttgaaaagtaactcaaagtagtttaggctatgaccataagttatttttgtaaatacattttcttatcactgtattattgcatattattgtgtattcttttgcaaatcaggcttgatatttccttttggctatgcagtcaccttttagactttgcttgcaaatatattgatatagttaagatactattctttctttccccaactaggagtgtgtatgaattacatcttttgaacttactgattgtattactttgttttacttgatcaactttgtagtttaatttttttaaaaagctagctgttgggattactgatcagtttcatttttatatctatatttctacttttagttttattattttcatgttttggctttttccccaaatttcttagaaactcagtttactagttttcttttgcctcttttttttttctttgttttctacttttacttaaacattttaaatgaacacattttctcttgagttttgttttggcagctgcccaggtatttttatgtttcaattgtattttagtaactctactaaactgcttaacaaatcagtattgaaaatgatccattttttgtcagtgtttttatgaattgtataaaatgtcaacctctggtctctactgattacaatctaccttacacactcatatgtatcttctgtcactcttgttgagaaaatctgcagtggccccatattacctattaataaattccaaggactttaccttgatattcacattcccctaccatgttaccacagccaacttctggcttattccccccagtaccctttctcctgtctctgcagcaccctacccaccacgatttatagaaagtattctgtgtgttccagtctgctggaattggagaggggaggataaagaggggatgagcaatgggtacaataatacagttagatagaaataataaatctagtgtttggtagcacaagagggcaaatatagttaataatgtatatttgcaaataactaaaagagtggaattgaaatgtgcctaacacaagtaagtgatcagtgcttgaggtgatggatatcccagttactctgatttgatcattacacattgtatgcttgcatcacagtatcacgtgtaccccataaataggcacaactgttttgtatccataataaataaaaataatttttaaaaaattggaaaacatcttattccctttgtctggaattccttattcccaacttgttgcccagattccacttctcttcccatctctctcagggaaattaatcttccaagtcccctagtttaccatatgtagttacttgttgatacatcatctccctctgttcctattagtctgagcatcttgagcgaacgcattgttgctcctttttatgtatctcacacatttcaggcactcaaatatttttaacaattgtaaattagatgtgtgtttattgtgtattgctgccccatgatcctttttttctccctggaaaaactatatatatgtaaagcaagtatgttttcttgttctgctacgtaattatcttcatataagcttgctgttttttaaattttctcgttctgctacttaattctcttcatataaccttgctgttttttaaatctactcttgtgttcatttccgtattttccttaggaactttgtctgttttatctgtcatgatttaagagtagcatgaggaagcccacaattaaaatatttctgtgtatccttaaaaaagaaaaattgtaaaattatttccatattccatggtcatgttaggtttttgttatttaggttttccttattagtccttttagcattttaatactttcggctttgaaatctaatttatctaattttaaagatagtaaattgttgctcttgtcttcatccaggcgtgctaaacctctgtcatctgatttctgatagttggttcgacttttgactttggttccaagcgtaactcttgaatgtaacaggtttactttcttaatctaggaagcaacctttctttttacagagctgtggtaggcagaataatgacgcccccaagtatgtccacatcctaatccgtggaaccagggaatatgttctgttacatggcaaaggggaattaaggtagcagatggaattaagtttgctcatcagctgaccttaaaatagattattctggattctctggctgagcccaatgtaattacagggcccttaaatatagaagagggagacagaaaaggaggtcagagtgattcagtatgagaagaactgcattctccattgttgactttgaagatggaggaaggggccatgagctaaggaatgtggcagcctctagagctagaaaaggcaaagaaacattctctcctagagccttcagtagcatagtcctgctgacacctcaagtttagcccagcgagacccatattggactctgacctccagaattgtaagggttatgccttttaaaccactaggtttatgctttttaaaccactaggtttgtggcagttttgaatggcagcaataggaaattaataagagaacattcagctcatgtatatttttctaaccctagtatttgaatcatgaattatattttgtgggtccttttgtaagtttatcttgttttctatttttcatgtaatagacataaaattttaagtttcctttaaattatgtcaaaaaccacataaaataatcccttttccaacatttaaaacattttggtacttctcttttctttagttccactactctctttttttattaaataaggaaactgttttacagaggataatgaagttagcttacagcatttaccaccccccccaccaatttactttttatttatagtctgaaaatcctttaggataaaaattacctgtacatgttatctaatttacatatgaatcctgtgtcgtcattatcttagcatttgttaatgtttgaatccactaatttcttttttaaatagtctgttttcaagtccattgtttctggtaattatatttgtagccacaggctttagttgacaaattggttctgatttttttagattttggaatatttccctctgctttaagagagaaaacttctgcctctactaattgtgtactgtaattgtggtgataactccatttctattaacttgtgaatcaccttgacacaggctctcttcttgtccaaagtctaagggatgaagtcatttttatcttggtttctttaaatgttctttctttgtagcagcttataaaagcctgtttttgttttcgagtattaataatattagctaatgtgtattgagtacgctggttatcagactgtttcccacagaccttgggagtgggccttgagaccctttccaggtatctgcaaagtcaaaattataatactaagacattctttgccttggtcgacattggcactggtggtacaaaagtagtgcatcaaacagctggtgctggagcacaaatcaggacagtggcaccagctgcactagtcttctgtcactggattcttcaccaccacgtgctggacttgcagttaaaaaaaaaatgccagcttcacttacgaatgtccttgataaagcagaaaaatattaatctcatttaatcttgacccctgaatgcacatctagtttaatattccatgtgatgaaatgggaagaatgcataaaggcctgttgtatgctgaagtgcaatggttgactcaaggaaaaacgtgtgtgcctgagttacaagctgctgttttcatggagtatcatttttatttggaaggacaactgacagacaagactgtggttatttgtgttatggtgtttggcagacattttcttgaaaatgcaggaagccacaataaacatacgtgtgcatgtgtctttatagcagcatgatttatagtcctttgggtatatacccagtaatgggatggctgggtcaaatggtatttctagttctagatccctgaggaatcgccacactgacttccacaacggttgaactagtttacagtcccaccaacagtgtaaaagtgttcctatttctccacatcctctccagcacctgttgtttcctgactttttaatgattgacattctaactggcactattcacaatagcaaagatttggaaccaacccaaatgtccaacaatgatagactggatcaagaaaatgtggcacatatacaccatggaatactatacagccataaaaaatgatgagttcatgtcctttgtagggacatgggtgaaattggaaatcatcattctcagtaaactattgcaaggacaaaaaaccaaacaccacatgttctcactcatagatgggaattgaacaatgagaacacatggacacaggaaggggaacatcacactctggggactgttgtggggtgggggttggggggagggatagcattaggagatatacctaatgctaagtgacgagttaatgggtgcagcacaccagcatggcacatgtatacatatgtaactaacctgcacattgtgcacatgtaccctaaatcttaaagtataataataataaaaaaaagaaaaaaaaagacaaaaatactataataaaagatgcttctatcacacacacaaaaaaagaaagtgcaggaagcaaaacttcaaggaaaacaactcatggtattttttgtaaatggtaaaatttgatctttcatgggaaaaccagaatttttgaaaagttgtatctgctaccatgagcttgacaacctcccagtaattaaaatatttctgatgaagttggtgaagatagtaagtaatgtgattttttttgctattgtatatgaaatgtgtcaacatttgaaagatctttataactcagtaaaccaatattttccagtcgacctacattgcattatacaataatgctgggataaaagattcattgaaagtataagagagaccagtggatttcagtgtagcagagtacaaaaaggtcattgatacgatttcagattccacatcatagttaacctttaagaaactaccacttgttgagttttagtgtcctgttgaagaacgtctaccattatctgaaagagctattaaaatagttcttttctaactacagatctctgtgaggccagattttctttgtatacttgaaccaaaacaatgtattgcaacagaatgaatgtaaatatagatattagaatctaggtgtcttctatgatatcatacattaaaaattttgctaaactgtagaaacagtgtcgctactctcactaaatttgtgttggttttggaaatgtttttaaataatgttatgtatgttagtatgtaatgtgtttattattaccttcgaagagtagatattttttgaataacaactgtatcgtaaatattaaataccaatagggataacccatatcaaccagagctctttgggatcctcagtaagtgttagaactgaaaaggagttctttttaagagttaaacgtcaaaatttttgatactaaaaactttgagagccactgatttagtgctttatacaaagcacttgttatactcattatcttatattcgtagccaccttatgaggtacatattattgccctaactttatgggtaagaataccatgacacaatgatgctatgtatatttttttagcaacccctctgaatctcatgatcttcccagcgtagttttctctctgggaggcttgcttccaagtttaattttgtaggtccagtcttcttacaaccctcctcccttttttccaatcgaagtttcttatgttatttttcatagtacaaaaacagtacacgtaccttacagaaaactcagatatcataagcaaaagagtataaagactatccttaatcttcccgagtggagacctgttagctgctcagcagatatttatacagatgcttttctaaacatgttcatttatcagtgtaaagccggtatagtataatactcaattagaaggattttggagtcaaatggtttgactcccaactctgagctcttagacaagttatttaacatctgagctttctgttccttatctgtaactgcactgatctgtttttctgtgtctagagttttgccctttccagaatgtcaaataagtagcattgtacactatcttgtgttttccatctgaattattttacttatagtgcattttagattcatcaatgttgttgttgtcatccatagtttgttactttttactgctgattagtattccattgaacggatatatcaaaattcagttaaccattcaccagtttatggatgtgtgagttgttaccagtggcaattatgaataaagcttcttggaatatttgaatacaggcctttgtgtggacatacgttttcctttttcttgagtaaaatacctaggtgtgggattgctgggccatagaataagtatacacttaactgtataagaaacttccaaaatgttttctaaagtggctgtactattttgcattcccaccagcatatataagagatctagtgtgtgtgtaatcttatctcattgtcattttagtttgcattgtcctaacatctgaaaatactgagtattttttgtgtgcttatttgctttttgtatgccttctttgatgggatgtctctgaattttttggccattttaaatcgggttgttcacttatttttttagttgtaaaagtcctttttatatactggatacaggttactttgtcagatacgtgttttcagagtatggtctcccagtttgtggcttggctgtcattttgttaatgataggtatcttttggagagtaagagtttttcattttggagaagtccaatttcatatcccatctaagaaatgtttgcctaaccgtaggttgcaagtatttttttttcatatgtgttttggacattttatagttttgtgtatgacatttaggtctatgatccatgtcacataaatttttgtatatgttataaggttaagagtcaaggtgtactttcctcatttatccagttgtaccaccatttattgaaacataattatttctccattgagttgttttggcacctttgtggaaaattaactgactctatatgtatgggtctgttttccaactctctagtacgttctatatatctattcttatgccagtactacattgtgtttattactgtagctttatagtaagctttgaaagcatgtagtataaattgtccaactttgttctttttcagaattgttttgcccattctaggtcctttgcactgtcatatgacttttaaagtcagtatgtcaatttctacagaagaacctgctggctcccaattttcgctgggattgcattgattctttaaaataatttggttaatttggtgtgtgtggtaggctaaatcatgacccacaaagatacccacttccatggaacctgttaaagatcttgagatgatggggttatccaagtggggcaataaatgcaatcaatcacaggttcccttaaaagagggagataatattaagaggagaaggcagtgtggtggaaacagagacagagatttgaagattttatgcagctggttttgatgatagagaaaggggccatgagccaagggaatacagctctggaaactggaaaaaaacaagtaatagattctcccatagagtctccagaaggagtaggtcctgctgacatcttggttttagcccagtgaaaccctttttggacctctggcctcaggataataaatgtgtgccattttaagtcaccaattttgtggtagtttgttacagcacccataggaaactaatacacagaggatgtaaatcttaacagtattgagtgttctatgaacacagtatatgtctccatttatttagatctttaatttttcttggcagttatgaactgaatgtgtccctttaaaaatcacaagttgactctagtccccagtgtgatggtatttggaggtggggcatttgggaggtgattaggttatgagggtggaaccctcatggttggaactagtgcccttataaaaagagaccagagagctaactcactctcttttcaccatgtgaagggtattgagaagtctgccatctgccacccagaaggcagccctcgccagaacccagccatgctggcatcctgatctccaacttccagcctctggaactgtgaggaataaatttctgttgtttattagcttccccacagtcctaccagtgttttgtaggtttcagtatataggttttgcatatatgttgttacatttatccctaagtgttttatatttgtgatgctattgtaaatggtggattttttcataaacttttaatttttgaatagttataaatttataggaaagttgcagtaaatgatacatatttttaaatttctgtttccaatttgtgatagctactatatagaaatgcaataatttttgtaaatttaccttgtgtccttcaattttgttaaattcacttactagatctactagcttttttttagattacttaggatttcctacagggaatatcatgttgcctatagataatgacaggtttacttctttcttttaaaactatattcttttaatttctttttatcatcttattgttgtggctaggacctttagtacaatgttgaatagatgtgttgaagtggacatacttgctgtgtttcctgtcttaaggggaaagtattgagtctctcaccattaagcattataactgcaggtttttcatagatgctcttcttttcctaatttgtttaacgcttttaacttgaatgggtagcaaattacgtcaaatgctttttacacaactattgagatgatcatatgatttttctttttcagcctgctaataccacgaaggttgctaactgattttcaaatgttaatccaagattgcaatcttgcaatcctagctaaaccacacctagtcgtaatgtagtatccttatatattgctgaattcagttggctaaaatcttttcaggatttttgcatctctgttcatgagagatattggtctgtagttttctttctttgtcagttttgttatcagggtaatgctggcttcataaaataaattgggaaatgttcccccctcatcttttttgcaagagtttgtgaagaattggtggtatttcctcattaaatgtttggtagattttgccatggcctgacattttctttctgaaaaaggttttaactagaattgcagtttccatgtctttgtttcaagaaatttcctggcataaagttgtttataatatcccctacttatccctttagtattattaggatttgtagtgatatccctgttttcattcttgatattagtaatttgagcctactcttttttactgattattctggctgtagatttaccaattttcttactttctcaaagaaactgcttttagtttcattgatttttttctctaatccctttttactgtattttattgattaatgtgcttacatttatcattttcttctttccatttactttttaaaaatttccttccgtttcttacatggaggttccttacctccatgttctttctagtttcataagatagaatcttagattattgacttgatatcttttctaatgtaagtatttgatgctaaaatttcccttaagtactgctttagtgtatctcacaaattttggtatattgtgtttttgcctttagtccaaaatatttttcaattttcttcatagtctttgacctatggattatttcgcagtgtggcatttaattttcaagtattttgagaattttccagatatttttctattgttgatttctagtttgactccattgtgcttgtttactttgtatgatttcagtccttttaaatttgttgagctttgttttatggcccagaattcaatctatcttggtgaatgttccgtgtgtgtttgaaaggaatctgtattttgcttttgttgggaggaactcattaatattaattaggtcaagttggttgatagtgttgctacaatcatatatatccttagtaattttctgtttatgtgttctattagttactaagaaaggaatgttaatttccatttataacagtttgatttttttatttctccttttagattgatcagtactttctacatgtattgtgaaactttgttattaggcatatgacaaattgacccctttatcattatgaactacctctatttgtccctggaaatagtccttgttcaaaaatatactgtgtcttatgttgtggtaggcagaatgccccacccccacaaatacacagatacccaggccctaagccctgaaacctgtgaatatgttattattttacatggcaaaggggactttgaagctatatttattagcattcgtttctgctgttaccatgacaaattactctcagttctttaggtcagaagtccgggtacagcacaactcagatgggtcttctgcctagtttcacagggtcaaaatcaaagtgtcaggagggctctattcctttctggagcctccagggattaatctgctttcaagcacatttgggctattgtcagaatttagttccttggggttgtagggctgaggtcccatttaccttgctggctgtcagctgcgagttattctcagcttctgaagcctgcctgcattccttggctcatggttccttacctccatgttcaaagccagaagtaacaggctgaatccttctcaagtctggaatctctctgacttctgcctcatctctcttccaccacatttctctgacttactcttctgctttcttaagggcttatgggattacactgggcacacctggataatccagtataatcttcctattgtaaagttagctgattagtaaccttaattccatctgcaaagtcccttcacagtattactcagattagtgtttgattgaataatcaggggacaggaatcctgggaaacttctttagaattctgcctaccaaccacagttatggaccttaaaatagggagagtagcctggcttaaccaggtggactcagtttcatcacatgaactcttaaaagcggagaactttctctcagtggaagcagaagcgatatggcagaagtagtgagaaaacatcccaagcatgagaaagattgaatatgctatagcttgttactggctttgagatgtaggggcctatttacaaggacccaggagaggcccctactatcgcaagatcagctgctgcgtgacagcaagcaaagagacacatacctcagtcctacaaccacaagaaactggattctgccaacaacctgaatgagcttagaagtagattctgccagagtcccctgataagcattccaccaacagacatctttatttcagccttgtgagattctgagtagagaaaccaaccaagcccgtctcgccttttgtcatatagaactgtgagataataaatttacgttgttttaagctgctaagtttgtggtaatttgttacagcagcaatggaagactaaacagatattaatatagtcattccagctttcttttggttagtgtttatttggtataactttttctttccttttgcttttaatctatctgtgtctttatagatagataaagtgggattcttacagacagcatatagttgtcttgcttacttatccaatctgatcatctttgtctttcagttggccatttatatttaatatagttattgacagggttgagttttaactgttttcttgctgcagcctggaaactgcctctgatctgcaaactggggcaatagtagggtttacctcctttatttcctccttctcacctgttctccactgcctgttgtcaatgtctgaaaactgttcttttgtagactgtatcaagcttcttatttaggcgggaaggtaaattatattcctattattaagtcaaggctggaaatagaggtcctcaagagtataatttctaattatttcaaggacatcctctgtagcaattcccttttatatgagacgtgagcatgtgtgtatgtgtaatttattcattcatggaaagtataatacatacactaaaatgttcatgccatatgaatatgacagatggctgcctttttagaaatagaatcagttagtgatagaacttgaccattttcagagcatgtcagccttttccagtctctgtgtcttggtatagctagttccttctgcctggaatacttcctcatctcacttgctttcctgcctggcagcttcctacttgccctctggaaccagctctagggtcaccacatctctgcttctgagtgcctcctcagacacagtctgtatttcctcttccaagctctcatcacaaacattgtgctgtattatatgtttctgtgtggtcttccttctatgaggaagccttggaaagcaggagacttattttagtcttctttatgtttcttttattcccaacacattatgtctgccccatagaccttttcaataaatgattattgagttagtgactccttttacatgctgacaaatgtggctcttattactccccatttcagtatcacatatttgtaaaagtgaatccttcttaatcgttttacttttctcctagtaaattcctcatctatgcctgtctgctgctgttctctgtgctgctggcccttcgtttggatggcatcatacagtggagttactgggctgtctttgctccaatatggctgtggaagttaatggtcattgttggagcctcagttggaactggagtctgggcacgaaatcctcaatatcggtaatactgctttatacaacccattggtctctagcatgagggagcaatatcttgacttttctcacttttgatgaagtaaggaccattttattttctacctatctggggtcttagaactatagtataagctaacagatctcttctgtgtttttgaaaatttagtctttggtatgtattttcttacaaaagcagtgccatttgggggtaagttgccagccagctcacagatgcctatataatccaaaatgcacccaaaatacagaactggtatgccatactagactaagcagcatgaaaccaccctgtttttaggaaaagacactcatattatgtttggtcatgaaagatctttctccaatacagttttggaactggggctccccttgtcccaccctcctagtcccagagctttaggactattagcagtgtaggggaggtggcttgaccaggagaccatgagtccctgagacagcagctggggaatgaggaaagtcaaagattggatgccgagaaggaaagcagagcctttgggggcaggggagaggggtaccctttaccgtttccaactcttgccctccctgctcttggatgcctccgctggcccaaattcctgggagttggctcacgccagcatgcaacctgcttgttgctgggacctgcgagaggctttcccttctctgccacagagactgtaactacataaagggaaaaagggggacttaagactgggaggctattatgaacctccactgggaaaatgaggagtacaggaattcccagaaggcagctgctcatgtgggaaaagtgtaaagttgaaactaccgcaccttttttttttttttttttttttttttgagacagagtttcgctcttgttgcccaggctggagtgcaatggtgtgatctcggcccactgcagcctccacatcccgggttcaagtgattctcctgcctcggcctcctgagtagctgggattacaggcacctgccaccatgcccagctaattttttgtatttttagtagagatagggtttcaccatgccaggctagttttgaactcctgacatcaggtgatccacccgccttggcctcctgaagtgctgggattacaggtgtgagccaccacgtccggccactacatcaactttttaaatttttgtttactaaatatgaaaatgattcagattgtgtaaattacatatcacatacatgtctaagaactgtaaaacagttacacagagagccttggcaggtgagggacattcatgtatagctgtttcagagttcttagattttttttgaaagattgatgacctgtgtggctgtatgtgttttatttttttatgagatattttcagatatctaatattaattgcttctcaaagaatgcaaagttaaataaacatttaggttctactaattgatatttagaatatattcaaacttctctttgttggtcttatttaagatgttttgagcaaggaaaggaattgtgtatgtggggttgaatgtaaggaatgtacaggcgtggtcattctcatgttaacattaaccagtggaacatggttgggtcctacaggaataacctctgatagcattttctctatgatctaacttccggtgtatttgtcacccacaatacatgtatatcataaatgttcatctgtattttgaataaacattgtaggcctttcagatgcattatagagccttttcctgattagcggccttaccattgctcaattgtagatctgttaaggttattgtgcatgatacttagctaattaaactgattttgtttgagaacagttttaactcttgttcttctttctctttcatctgcaggtgttaatttatcttaatggaatagaaaggaaaatgaaaatcatttatacgttttatttgcatttaaaaatagcacctaacaatagttactactatcttgaaatataactggcacttgttcatagaactagagttatttttataatattgtgtgaagggtggtttacatggtttcttgaaaaatgaggatcatgagacttaaggggtatttgcctggttttagcagcagaagcaaatcagcttgaataatcttggaagtaactcttgttgttgaatttaaagatgtgaacagaagtgtttatgtacattgtcagggaaataagaactggctattacttttgagaatatccttatacggttaaaacattaaattctggtttggttgtaatgttcattttgtattatgtagtagttcttcgatgtttcagagattgcctaccaaagcttaggtttaagttagctttctacctgatttccctttgcttttgtcaaattttcaagtaaaattcaaagtataaatataagttggtatttgccctgaactgcttgcttatagtggagattctgaactgagggtgttttcttcttctctcccttttttagagcagaaggagaaacgtgtgtggagtttaaagccatgttgattgcagtgggcatccacttgctcttgttgatgtttgaagttctggtctgtgacagaatcgagagaggaagccatttctggctcctggtcttcatgccgctgttctttgtttccccggtgtctgttgcagcttgcgtttggggctttcgacatgacaggtcactagaggtgagatttcatatatttaagaatgttttccactttgggaggtcaaggcaggtggatcacttgaggtcaggagtttgagaccagcctggccaacatggtgaaaccccgtctctactaataatacaaaaattagccgggtgtggtggcatgcgccagtaatcccagcttctccggaggctgaggcgggagaatctcttgaacccaggaggcggaggttgcagtgagccaagattgaaccattgcactccagcctgggtgacagaatgaaactccgtcttaaaaaaaaaaaaaaagaatgttttcaaaagtaaaatattttgctcagttattcagatgtcaatttcttaccctttgttaggaagagcttgatcattaccaactctacatcatgagacaacaaggcaacaaaagatgatggaaataacaatttttctttcttcacttagaacactagcttttcacccaggacatcagccttctcccagcttcacatcctgtatcaatcagacagaaacagaactgataggttagatacagatatatgtataaagagagttaaggaactggctcacattactgtggggctggcaagtctgaaatctccagggcaggtgaacaggctggagacctaggaggagttgacactgcagtcctggcacagaattttttcctctccaggaaaccacagtttttgcttttaaggccttcacctgattgcatgaggcccacccatgctatggagggtagtctcctttattcaaagtcagtaccttcactgcaacagcaagcttagtgtttgattaaataactgggtactatagcccagccaagttgacactcaaaactgaccatctccccacctcagaccccatgatttagcacctcccctgctgtctggttagcttatcctgatgtgcccctgtgtttgtttattcattcaataaacatttatcaagtatttactagatgccaagccctttttccctaagcatagaggatatgcagatgaataaaataccaggactagtaataatagtaatgaaagtaattgcagataacgtttattgagcacttactgtgtgccaggcattgtgcgaggcacattacatgtggtagttttcttactaactaactctgtgaggtaggtccagagaagataagtcatttgttcatggccacatgtgaaggggcaggaccaggattccgtttgagtcagcccgactctaaagcccgggcacataactacataactgcatagaagctgagggcccaaagctgaatactgatgggttgaggggagaactagaggctgtagatgcctggttttgagccgtgtggatgaagagtgaagggagaagactgcagttggcttaggaagtaaacatagcagctgtagggtgggtcaggcatataagcctagaccccaggtatgggcgtgaggggaaggtatgtagacagagggacggtgatggagcaaggccctgtgggactcagggagaatgggacctagagcaccaggaagggtttggccttgaacaaggggagctattccctgattttcatgctggtggaaaggccacagcatgggtatagtggtaggtaggagtgagccgtggagggagagtatctgatggtccactttcaccctccctacaattcccagtttatatcagggacttgagcatccatggattttggtatccacagggggtcctggaaccaatcccccacagatactgagggacaactatacaaggactaggactgcattgggcctgaattacagaaagtaagtctttcatatattcacactctaggcattcctgcccttggaagaaacaacataccaggagctgagctccctcctcctgtgatgcaagaacagtacctatgttggtgagggggtggtctggagtaggctcatacagagatgggaaggaggagttgagggtctgccaggaagccctgtgttgggagggaagggatggcatttttgggacacattgaagcctagaggcaggaaacactccatcagctgagtggactgtggcgattcagatccgacgggagcacaaggtggaaaggaaggaactgtgggagttgagaagagagggagcctctacagagggattggggcaaataggggccacgtcctcagcccacagagcatgtgctgaagtgccccaggcaccccagtgcactcacagggcaccaggggatagtggacattttgaggaaaacagtaatacctgacatttgttgggacaccatacaaactactagcttgaaatagtttacaggtttatttttaggccacactgcattcctttcagtgacgtcgtatctttaagaagctgggttttcagcagttgctgtgaaaacaaaaaaggctaatgctgtgtgaaaatccgggtgaagaacaggtaacgagtgggagcaccttgtctgattccaaggcgtgggaaatggtgagctacctgacaggcacacgcatcccactgggaattagttttggttatttaagaataatattaacatttttctttagatttatatgaattattttttctggtggctacttagaaatacttactaagttagacgtaattacttaaatcagtgcaactgttggcattcccagccacattagggatttcttttggcctagaggtctatggaggaattactaaattccccatgtacctatgtactgagaacttttgggaagctctgggcctggtcccagatttcaattttgtgggcaagaatgtactttaccagagtgaggagcagcctgcagggcgtttgggctggaggcgggaggttagtaaggggttgctgaagtggtaggcggatggtgccgaagaaggcctcactaggcagtcatcatcaggataggaagtgggcacgggattcaggagaaatctggactttacagtggacaggatgtggtgactgaacgtgacagtgtgggaaaaagaatgcagggtgattcccgggctcatggcttgagaaatgagaccactgttgtgcctccaagtgacatgggaggctatagaaagtgacatgggaggctatagaaagtgacatgggaggccatagaaagtgacatgggaggccatagaaagtgacatgggaggccatagaaagtgacaagggaggccatagaaagtgacatgggaggccatagtgacatgggaggccatagaaagtgacatgggaggctatagaaagtgacatgggaggctatagaaagtgacatgggaggccatagaaagtgacatgggaggccatagaaagtgacatgggaggccatagaaagtgacatgggaggccatagaaagtgacatgggaggctatagaaagaggagatacaaggttctaagtgcaggcgataatgatctctatttgggactggcttcatttgaggtgcctttaggagagccgagtggcctatgcacagctgggtctgcta

SEQ ID NO: 3925 - DNA, 35271 bp, human; identical to SEQ ID NO: 3914

SEQ ID NO: 3926 - DNA, 22986 bp, human
gacgcggctggcgctggcgccatgaacccgctgtaaggcgcaggctgtgcagcacggggtgcgggggaggaggaggaggacgccgcggtgaagttctccgccatgaacctgaggggcctcttccaggacttcaacccgaggtgaggcggcgtcgttggcgcccccgggagtccgcgctgcgggctcgggcgcgggctggtgttcggctccggggaggcacggcgggcgagatgctgcagcccgaggacccgggcgcctgcccgagcctccctgcgggtgcaagcggtccccaggcaaaacagtcggcctcggcgcccgcccgcttcctcctcccgtgcccggtgctttcagcccctgcccggccacggccggaagggcccggccgcgagccccgtcctgccccaagggaaccccattcttttctgcttgctgtccctcattggtgtcccaacttcttcgtctcggttccatcctcttctgcgccgctgcgggccctccattctccgcgtcagggccgtctcactcgacccaacacccctacccccaccccagctgtttcctccagttcctcgcagtccttggggttttccttgggtttatgcccatccctctcttgtttgcttctttgttgaacggatacctgaaacactgttgaatccttggagtcagtgtcggggtatggcaataccttatataatgcatttctgggtgagcctgatcattttccatactcattttctcatcagtcttcactacaagtttatttgcaggaagtagatattgctgtccttcttttccagatggggaacacccagtggacagtgtggagaaaacactggctaagcactcaagcgcctgtccttgcacttgcccgactgttttgtaactgttctttaccccaggctgtgagctccctgaagctgagaccatctcctgctcatctcagtgtccccagcgcctcccacccaccgtatctggcacatagtaggcacatataaaatgtttgtggaactaaactgagcccaaagacttggattggagacgaggccatatgtaactgggtgattctctgcccttctttggcccttctgtaaaatgaggagttggcctaactgatctcttaaatgcactactctccgaaaggagtatccgtttcccttatttgccagttgggaagacgtgctcagtaaatatttgtgtgctgtaacctatgctaggtgctttagatgctggcggtctcagcatggggtgaagaagggcttgtacacttaagatgccttacagtactgtgcagtgctgtactgcgggggggccaactctggggacctatgccttggctgcttgttgaggatgaaaggaagttttaggggagtatttgtatgttgagggtgcagtctccctagggatggtgacattttaacttgtgagtcattgtgactttgtatgtgctcttattccactttgagttcatgttctggttaggagtgccagtgtctctaacacggtgcagacattatcattgttggcttcgaaggcatagaggaggtaacagaactaactgcagtcccttcctctgctgcatcagggggttaagattggtctgcagggtagtagggttggtgctgtggctggacaagccctgtatgtcttctatttggagatggtgataagaaagttaagtaaaaactgaattgttttgtgcccttgggcaactcacttatctattgttttatctgtagaatgagtataatctctcagtggggtagggaggccaattaaggattgattacaaagtgccttacaaatagaaagctacagtgacttgtttgcaaggtgacagagaattcagaagcctcaagaaactgccttaagtgatcaaacaggctaacagagttgccaaagcaaaatagtgctgcactgatactacctttaaccgttttttcctttagcccttttccccccaaaaaaattagtatatgaaattacagtgaaatacctggtatctaagcagatttatagtaattctcaacatattcatcaatctcttaattctacctgcattaaaatgtatttctacctgaaaagtttaaaggtcttttatactgtgccattttcctgattcattgttgccagaggtagtgagttccttaattttacagatatttcaagaggacattggccaggtattattggtaaatcagatttgtttttttagctggtagtgtttcacctctcctgagcactcctagtttttgacagtgtgctttagtctccttccatgctgaggaaggccttctctataggagaaagaaaactgaggggtgtacacaggaagttaccttatgctggggactcaaaccttgatgctactgctttgctccctgcctctatttttgaaccaattcaacatctccctcctaccccaggaccttgtcacacactgttctctttaccaggaatgtttccctctcttttcctctcctccagacctagtgaactcctatttatcctcacttggcacttgctaagggaagcattcctgacttccctgaccagatttactgctccctgtttctacagttcctgtagtatttactactcctccatcatagtgcatatttgtacccttgtgtctgtctggatgcttatttgattaatacctgcctcccccactaaactttaagctccatggggtcaaggccgtgactgtgtcagtatcgtagcctgcatacttggaatagtacctggctcaataaatatttgtggagtaaataactgaataactctccagagcctataagataaatctagagctgctgctttcaatcactgctttcctggtggtctgtggcctggttctctttcttctcacactcttcccaccttcagagtgcagccattgctttggagagatgggagagaacatggcactaaggcagaatatggctatatttactttgaagagcatgtctttgtcatagaaatagtcactgtcatggtttggtgggtcccaaggcatgggtcatggctccagatcccctttccagccttttggatcttggtaagtctgaacccactgctgcgttggcaaggctctggaaactatagtgacagagaatgattcacaagtgtcaacactcagatgtacagggctgccagctgacccactctacctatttccatctggcactgaactggttgatcatgaacttcttttcataattgctttttagttatgcaggttaagacatgccgaaacagatgtaccggacccacaaacaagtccttccttgaatgcctgaggcttcctaacagtgaaagagccctgttcttagagtaggcaaactgattctgaggcattgtaggtggtagggatctggtagtaggtagcattaggtgggctcccggcactcaccatggagccttgaaattttctgctactttgggggagttgctggttcagagaaggcccttccaccctggtagccatgtggcactggaaggctgtgaaaactctgctgggccttcttagtcatctgttgtgagctcctgatgggagtgtggtgtatccctcaggtgtgctagactggaacaaaggctgagaagtgttgctctgggggttccaacttgtgggcatggggtactgatgagatcagtagtgtttggagacttctgtatgctccatcttcagaagacattctggagtccatataagttatcttgtctcttgtttgaagcaggaaaaaggaatgcgattgctggtaatatagttcactaaagtcagctacctggcctctaacagttatttgcaaagtatattataacattgattcctcaaacatctagattcctatctcgtgccaagtgatgtactaggtgctctaagtacaaaaataaaggaatatagtcctcctctcaatgcgtaagcctagtggaagaagcagaaatgaaagggaaataagaattcaatagagtatgaggcattacagtgaaagaaaccaaatgtcttagaagtacaaatggcagagctactaattctgtctcgagcaggcagggaagagtctatagtggaaatgacttttgagctagattttgaattgagctagtcttttgagccagacttttgagctagaattgtagggttgtcatcagaccagagagtaggaagggtaccttgtgaggaagagagagagagatcagattgttactgtgtctatgtagaaaaggaagacataagaaactccattttgatctgtactaagaaaaattgtttctgctttgagatgctgttaacctgtaactttagtcccaaccctgtgctcacagaaacctgtgctgtaatgaatcaaggtttaatggatttagggctgtgcaggatgtaccttgttaacaatatgtttgcaggcagtatgcttggtaaaagtcatcgccattctccattctcgattaaccagggacacagtgcactgcggaaggccgcagggacatctgcccaagaaagcctgggtattgtccaaggtttccccccactgagacagcctgagatatggccttgtgggaaaggaaagaccttaccaccccccagcccgacacccgtaaagtgtctgtgctgaggaggagtagtgaaagaggggggcctctttgcagttgagataagaggaaggcttctgtctcctgctcatccctgggaatggaatgtctctgtgtaaagctgaccattcccattcgttctattctgagataggagaaaaccaccctgtggctggaggcgaagtatgctggcagcaatactgctctgttactctttgctacactgagttgtttgggtaaagagaaacataaatctagcctgcgtgcacatccaggcacagtacctttccttgaacttattcatgatacagattcctttgctcacgtttccctgctgaccttctccccacctgttgccctgctacactcccctcgctaagatagtaaaaataatgatcagtaaatactgaggtaactcagaggctagcgctggtgcgggtcctccgtatgctgagtgccggtcccctgggcccactgttctttctctatactttgtttctgtgtcttatttcttttctcagtctcgtcccacctgacgagaaatacccacaggtgtggaggggctggcccctttcagtatctcagaagggacaaagtacacaaaggcatggggtcatgatagtgcctggtatgttcaggtagtgaagaggtccatgtggtatgagcactgcagatgatatgtgtcgtatgaattaaaaatacatagttactgcaaatagtttttacaggttattgtttttaagaaagcagtatctaatgcacgagtgtactgtcagtactgtcaatgaactacttaccactcaagtgactgcttatctgttgttctgtcctctcaagccacctacagtcagaaaatggtcttgattttactgatgttgctgttaataatagctgtgacttcttgagtacccaccacatgccaggcccaatgtaggggctttgcatccattatccatgatctttacaacaaccctgcaaaattaggtatcagccttattttaaagtcttgacagcttgtgacttccctgaagttgcataggcaggaagaatctaagtcaacattcgaatccacgtcagtctcatgaagcctgtgctctttcctgcgtgccatgccatagttctagttaagtgacaactcctttcctccatgacattgtagatccagtatgctaaggaaccctctatttacaaattgtaagtgattaaacaaaacaaacctgttagtggcgcttatacatccaaatgagtgttgttattcaaagaggttacttggggaaagagaatgtatacacctattccattgttcatactccttgttactcatctggaattccctttaaagtcagtttacatatcacataagaagatccatctcattgctttatgatcatctatcattttcaaccaaaatagttccacctagtttgatcacacatcttattcactaaccttggctctgactgactgtttgccatttccaaaatttgaatccaccctcagtgaaaatttagcaccatttgggatagtcagaagatcagactgcaggttctcaaggtgcttccaagaagaaagcttcaaagatgatttgagtaatgaagtaccattggaattactgcattgcctcccaaggggactggttaaaggagagaaatctcatttgaatgtataatttccagttttaaaagtatcattcctattacttgataattacacacacattgttcttagctgtgttctttgagggccaggatttggaggtgctgaattacgtgctgaatgagtggatgttgggtacaaatagacatctaccactgggaagtctttgttgtacaggagagaccgtggattgaaggagttttagatagtttcctaggactccagaagttaagctttttaatatggagcttgagttttctaatcattttgcctgatatgtcatgcctgtacaagatgactggaatttaagacaaaagcctcgaactctggagatagatgctttataagtggagactcatactttgtcagctccaacctaatagtgacaacaatgattgctaaatgagattattacctacaatgtggcagaacttttgtctttcataatactgctaaagctagaatgggtaaaatgtatcatttacacagtgctttcacatacccttgtcttaatgaatcagtatatgaggaatcagatgaggagacagacctgggggaaaataactcacccaagaccacaccgctgatgaatggcagttgaggaacttaaatgcagatcttcctactggcctgggctctgcttttatttggcttttgtgcttttttgtatctactggttaaatgctcttaaacattttttatcttaataaaaccagctaaagtctccactaaaagactttaaatttggttaataaggtgtaagaggggcagttcccttgatagtttgtgagtatgtcaggttgtcatttggagccattctgtcaagctttagactgggatgtgccatccaaagtttgtgtgtgtgtatgtgcttgtgcgtgtgtacgtgcatgcaggcatgtgttaatgcgcgtgtatgtgctccagtgaagccagcagcttccactggaaaaaaactgataggtctaaaaagagtccagctgcattcttatgatatgcagaaaacagatactagaacttttacattcagagtcatcattcctttgctaagtatattctctctctccctcccttcttccttttctccctccctattctcccaaccctgcaaagtggagagagggaatttgagcctgagcagaaagctccatgtaaatttcagagaggatactagctttggcccaggtagcactacttagtgattcatcgtatactaacactacagattcaaatgagagtggaataaatccattctaaaggtgtaactggaaaagtgaattttaagaagtagtgattaatgttaaaccagaacctcccatttctcccaggtttgtggagaattaagcagtctatttttatacttggaatctggtctgaatgtttcttgaaaagtaactcaaagtagtttaggctatgaccataagttatttttgtaaatacattttcttatcactgtattattgcatattattgtgtattcttttgcaaatcaggcttgatatttccttttggctatgcagtcaccttttagactttgcttgcaaatatattgatatagttaagatactattctttctttccccaactaggagtgtgtatgaattacatcttttgaacttactgattgtattactttgttttacttgatcaactttgtagtttaatttttttaaaaagctagctgttgggattactgatcagtttcatttttatatctatatttctacttttagttttattattttcatgttttggctttttccccaaatttcttagaaactcagtttactagttttcttttgcctcttttttttttctttgttttctacttttacttaaacattttaaatgaacacattttctcttgagttttgttttggcagctgcccaggtatttttatgtttcaattgtattttagtaactctactaaactgcttaacaaatcagtattgaaaatgatccattttttgtcagtgtttttatgaattgtataaaatgtcaacctctggtctctactgattacaatctaccttacacactcatatgtatcttctgtcactcttgttgagaaaatctgcagtggccccatattacctattaataaattccaaggactttaccttgatattcacattcccctaccatgttaccacagccaacttctggcttattccccccagtaccctttctcctgtctctgcagcaccctacccaccacgatttatagaaagtattctgtgtgttccagtctgctggaattggagaggggaggataaagaggggatgagcaatgggtacaataatacagttagatagaaataataaatctagtgtttggtagcacaagagggcaaatatagttaataatgtatatttgcaaataactaaaagagtggaattgaaatgtgcctaacacaagtaagtgatcagtgcttgaggtgatggatatcccagttactctgatttgatcattacacattgtatgcttgcatcacagtatcacgtgtaccccataaataggcacaactgttttgtatccataataaataaaaataatttttaaaaaattggaaaacatcttattccctttgtctggaattccttattcccaacttgttgcccagattccacttctcttcccatctctctcagggaaattaatcttccaagtcccctagtttaccatatgtagttacttgttgatacatcatctccctctgttcctattagtctgagcatcttgagcgaacgcattgttgctcctttttatgtatctcacacatttcaggcactcaaatatttttaacaattgtaaattagatgtgtgtttattgtgtattgctgccccatgatcctttttttctccctggaaaaactatatatatgtaaagcaagtatgttttcttgttctgctacgtaattatcttcatataagcttgctgttttttaaattttctcgttctgctacttaattctcttcatataaccttgctgttttttaaatctactcttgtgttcatttccgtattttccttaggaactttgtctgttttatctgtcatgatttaagagtagcatgaggaagcccacaattaaaatatttctgtgtatccttaaaaaagaaaaattgtaaaattatttccatattccatggtcatgttaggtttttgttatttaggttttccttattagtccttttagcattttaatactttcggctttgaaatctaatttatctaattttaaagatagtaaattgttgctcttgtcttcatccaggcgtgctaaacctctgtcatctgatttctgatagttggttcgacttttgactttggttccaagcgtaactcttgaatgtaacaggtttactttcttaatctaggaagcaacctttctttttacagagctgtggtaggcagaataatgacgcccccaagtatgtccacatcctaatccgtggaaccagggaatatgttctgttacatggcaaaggggaattaaggtagcagatggaattaagtttgctcatcagctgaccttaaaatagattattctggattctctggctgagcccaatgtaattacagggcccttaaatatagaagagggagacagaaaaggaggtcagagtgattcagtatgagaagaactgcattctccattgttgactttgaagatggaggaaggggccatgagctaaggaatgtggcagcctctagagctagaaaaggcaaagaaacattctctcctagagccttcagtagcatagtcctgctgacacctcaagtttagcccagcgagacccatattggactctgacctccagaattgtaagggttatgccttttaaaccactaggtttatgctttttaaaccactaggtttgtggcagttttgaatggcagcaataggaaattaataagagaacattcagctcatgtatatttttctaaccctagtatttgaatcatgaattatattttgtgggtccttttgtaagtttatcttgttttctatttttcatgtaatagacataaaattttaagtttcctttaaattatgtcaaaaaccacataaaataatcccttttccaacatttaaaacattttggtacttctcttttctttagttccactactctctttttttattaaataaggaaactgttttacagaggataatgaagttagcttacagcatttaccaccccccccaccaatttactttttatttatagtctgaaaatcctttaggataaaaattacctgtacatgttatctaatttacatatgaatcctgtgtcgtcattatcttagcatttgttaatgtttgaatccactaatttcttttttaaatagtctgttttcaagtccattgtttctggtaattatatttgtagccacaggctttagttgacaaattggttctgatttttttagattttggaatatttccctctgctttaagagagaaaacttctgcctctactaattgtgtactgtaattgtggtgataactccatttctattaacttgtgaatcaccttgacacaggctctcttcttgtccaaagtctaagggatgaagtcatttttatcttggtttctttaaatgttctttctttgtagcagcttataaaagcctgtttttgttttcgagtattaataatattagctaatgtgtattgagtacgctggttatcagactgtttcccacagaccttgggagtgggccttgagaccctttccaggtatctgcaaagtcaaaattataatactaagacattctttgccttggtcgacattggcactggtggtacaaaagtagtgcatcaaacagctggtgctggagcacaaatcaggacagtggcaccagctgcactagtcttctgtcactggattcttcaccaccacgtgctggacttgcagttaaaaaaaaaatgccagcttcacttacgaatgtccttgataaagcagaaaaatattaatctcatttaatcttgacccctgaatgcacatctagtttaatattccatgtgatgaaatgggaagaatgcataaaggcctgttgtatgctgaagtgcaatggttgactcaaggaaaaacgtgtgtgcctgagttacaagctgctgttttcatggagtatcatttttatttggaaggacaactgacagacaagactgtggttatttgtgttatggtgtttggcagacattttcttgaaaatgcaggaagccacaataaacatacgtgtgcatgtgtctttatagcagcatgatttatagtcctttgggtatatacccagtaatgggatggctgggtcaaatggtatttctagttctagatccctgaggaatcgccacactgacttccacaacggttgaactagtttacagtcccaccaacagtgtaaaagtgttcctatttctccacatcctctccagcacctgttgtttcctgactttttaatgattgacattctaactggcactattcacaatagcaaagatttggaaccaacccaaatgtccaacaatgatagactggatcaagaaaatgtggcacatatacaccatggaatactatacagccataaaaaatgatgagttcatgtcctttgtagggacatgggtgaaattggaaatcatcattctcagtaaactattgcaaggacaaaaaaccaaacaccacatgttctcactcatagatgggaattgaacaatgagaacacatggacacaggaaggggaacatcacactctggggactgttgtggggtgggggttggggggagggatagcattaggagatatacctaatgctaagtgacgagttaatgggtgcagcacaccagcatggcacatgtatacatatgtaactaacctgcacattgtgcacatgtaccctaaatcttaaagtataataataataaaaaaaagaaaaaaaaagacaaaaatactataataaaagatgcttctatcacacacacaaaaaaagaaagtgcaggaagcaaaacttcaaggaaaacaactcatggtattttttgtaaatggtaaaatttgatctttcatgggaaaaccagaatttttgaaaagttgtatctgctaccatgagcttgacaacctcccagtaattaaaatatttctgatgaagttggtgaagatagtaagtaatgtgattttttttgctattgtatatgaaatgtgtcaacatttgaaagatctttataactcagtaaaccaatattttccagtcgacctacattgcattatacaataatgctgggataaaagattcattgaaagtataagagagaccagtggatttcagtgtagcagagtacaaaaaggtcattgatacgatttcagattccacatcatagttaacctttaagaaactaccacttgttgagttttagtgtcctgttgaagaacgtctaccattatctgaaagagctattaaaatagttcttttctaactacagatctctgtgaggccagattttctttgtatacttgaaccaaaacaatgtattgcaacagaatgaatgtaaatatagatattagaatctaggtgtcttctatgatatcatacattaaaaattttgctaaactgtagaaacagtgtcgctactctcactaaatttgtgttggttttggaaatgtttttaaataatgttatgtatgttagtatgtaatgtgtttattattaccttcgaagagtagatattttttgaataacaactgtatcgtaaatattaaataccaatagggataacccatatcaaccagagctctttgggatcctcagtaagtgttagaactgaaaaggagttctttttaagagttaaacgtcaaaatttttgatactaaaaactttgagagccactgatttagtgctttatacaaagcacttgttatactcattatcttatattcgtagccaccttatgaggtacatattattgccctaactttatgggtaagaataccatgacacaatgatgctatgtatatttttttagcaacccctctgaatctcatgatcttcccagcgtagttttctctctgggaggcttgcttccaagtttaattttgtaggtccagtcttcttacaaccctcctcccttttttccaatcgaagtttcttatgttatttttcatagtacaaaaacagtacacgtaccttacagaaaactcagatatcataagcaaaagagtataaagactatccttaatcttcccgagtggagacctgttagctgctcagcagatatttatacagatgcttttctaaacatgttcatttatcagtgtaaagccggtatagtataatactcaattagaaggattttggagtcaaatggtttgactcccaactctgagctcttagacaagttatttaacatctgagctttctgttccttatctgtaactgcactgatctgtttttctgtgtctagagttttgccctttccagaatgtcaaataagtagcattgtacactatcttgtgttttccatctgaattattttacttatagtgcattttagattcatcaatgttgttgttgtcatccatagtttgttactttttactgctgattagtattccattgaacggatatatcaaaattcagttaaccattcaccagtttatggatgtgtgagttgttaccagtggcaattatgaataaagcttcttggaatatttgaatacaggcctttgtgtggacatacgttttcctttttcttgagtaaaatacctaggtgtgggattgctgggccatagaataagtatacacttaactgtataagaaacttccaaaatgttttctaaagtggctgtactattttgcattcccaccagcatatataagagatctagtgtgtgtgtaatcttatctcattgtcattttagtttgcattgtcctaacatctgaaaatactgagtattttttgtgtgcttatttgctttttgtatgccttctttgatgggatgtctctgaattttttggccattttaaatcgggttgttcacttatttttttagttgtaaaagtcctttttatatactggatacaggttactttgtcagatacgtgttttcagagtatggtctcccagtttgtggcttggctgtcattttgttaatgataggtatcttttggagagtaagagtttttcattttggagaagtccaatttcatatcccatctaagaaatgtttgcctaaccgtaggttgcaagtatttttttttcatatgtgttttggacattttatagttttgtgtatgacatttaggtctatgatccatgtcacataaatttttgtatatgttataaggttaagagtcaaggtgtactttcctcatttatccagttgtaccaccatttattgaaacataattatttctccattgagttgttttggcacctttgtggaaaattaactgactctatatgtatgggtctgttttccaactctctagtacgttctatatatctattcttatgccagtactacattgtgtttattactgtagctttatagtaagctttgaaagcatgtagtataaattgtccaactttgttctttttcagaattgttttgcccattctaggtcctttgcactgtcatatgacttttaaagtcagtatgtcaatttctacagaagaacctgctggctcccaattttcgctgggattgcattgattctttaaaataatttggttaatttggtgtgtgtggtaggctaaatcatgacccacaaagatacccacttccatggaacctgttaaagatcttgagatgatggggttatccaagtggggcaataaatgcaatcaatcacaggttcccttaaaagagggagataatattaagaggagaaggcagtgtggtggaaacagagacagagatttgaagattttatgcagctggttttgatgatagagaaaggggccatgagccaagggaatacagctctggaaactggaaaaaaacaagtaatagattctcccatagagtctccagaaggagtaggtcctgctgacatcttggttttagcccagtgaaaccctttttggacctctggcctcaggataataaatgtgtgccattttaagtcaccaattttgtggtagtttgttacagcacccataggaaactaatacacagaggatgtaaatcttaacagtattgagtgttctatgaacacagtatatgtctccatttatttagatctttaatttttcttggcagttatgaactgaatgtgtccctttaaaaatcacaagttgactctagtccccagtgtgatggtatttggaggtggggcatttgggaggtgattaggttatgagggtggaaccctcatggttggaactagtgcccttataaaaagagaccagagagctaactcactctcttttcaccatgtgaagggtattgagaagtctgccatctgccacccagaaggcagccctcgccagaacccagccatgctggcatcctgatctccaacttccagcctctggaactgtgaggaataaatttctgttgtttattagcttccccacagtcctaccagtgttttgtaggtttcagtatataggttttgcatatatgttgttacatttatccctaagtgttttatatttgtgatgctattgtaaatggtggattttttcataaacttttaatttttgaatagttataaatttataggaaagttgcagtaaatgatacatatttttaaatttctgtttccaatttgtgatagctactatatagaaatgcaataatttttgtaaatttaccttgtgtccttcaattttgttaaattcacttactagatctactagcttttttttagattacttaggatttcctacagggaatatcatgttgcctatagataatgacaggtttacttctttcttttaaaactatattcttttaatttctttttatcatcttattgttgtggctaggacctttagtacaatgttgaatagatgtgttgaagtggacatacttgctgtgtttcctgtcttaaggggaaagtattgagtctctcaccattaagcattataactgcaggtttttcatagatgctcttcttttcctaatttgtttaacgcttttaacttgaatgggtagcaaattacgtcaaatgctttttacacaactattgagatgatcatatgatttttctttttcagcctgctaataccacgaaggttgctaactgattttcaaatgttaatccaagattgcaatcttgcaatcctagctaaaccacacctagtcgtaatgtagtatccttatatattgctgaattcagttggctaaaatcttttcaggatttttgcatctctgttcatgagagatattggtctgtagttttctttctttgtcagttttgttatcagggtaatgctggcttcataaaataaattgggaaatgttcccccctcatcttttttgcaagagtttgtgaagaattggtggtatttcctcattaaatgtttggtagattttgccatggcctgacattttctttctgaaaaaggttttaactagaattgcagtttccatgtctttgtttcaagaaatttcctggcataaagttgtttataatatcccctacttatccctttagtattattaggatttgtagtgatatccctgttttcattcttgatattagtaatttgagcctactcttttttactgattattctggctgtagatttaccaattttcttactttctcaaagaaactgcttttagtttcattgatttttttctctaatccctttttactgtattttattgattaatgtgcttacatttatcattttcttctttccatttactttttaaaaatttccttccgtttcttacatggaggttccttacctccatgttctttctagtttcataagatagaatcttagattattgacttgatatcttttctaatgtaagtatttgatgctaaaatttcccttaagtactgctttagtgtatctcacaaattttggtatattgtgtttttgcctttagtccaaaatatttttcaattttcttcatagtctttgacctatggattatttcgcagtgtggcatttaattttcaagtattttgagaattttccagatatttttctattgttgatttctagtttgactccattgtgcttgtttactttgtatgatttcagtccttttaaatttgttgagctttgttttatggcccagaattcaatctatcttggtgaatgttccgtgtgtgtttgaaaggaatctgtattttgcttttgttgggaggaactcattaatattaattaggtcaagttggttgatagtgttgctacaatcatatatatccttagtaattttctgtttatgtgttctattagttactaagaaaggaatgttaatttccatttataacagtttgatttttttatttctccttttagattgatcagtactttctacatgtattgtgaaactttgttattaggcatatgacaaattgacccctttatcattatgaactacctctatttgtccctggaaatagtccttgttcaaaaatatactgtgtcttatgttgtggtaggcagaatgccccacccccacaaatacacagatacccaggccctaagccctgaaacctgtgaatatgttattattttacatggcaaaggggactttgaagctatatttattagcattcgtttctgctgttaccatgacaaattactctcagttctttaggtcagaagtccgggtacagcacaactcagatgggtcttctgcctagtttcacagggtcaaaatcaaagtgtcaggagggctctattcctttctggagcctccagggattaatctgctttcaagcacatttgggctattgtcagaatttagttccttggggttgtagggctgaggtcccatttaccttgctggctgtcagctgcgagttattctcagcttctgaagcctgcctgcattccttggctcatggttccttacctccatgttcaaagccagaagtaacaggctgaatccttctcaagtctggaatctctctgacttctgcctcatctctcttccaccacatttctctgacttactcttctgctttcttaagggcttatgggattacactgggcacacctggataatccagtataatcttcctattgtaaagttagctgattagtaaccttaattccatctgcaaagtcccttcacagtattactcagattagtgtttgattgaataatcaggggacaggaatcctgggaaacttctttagaattctgcctaccaaccacagttatggaccttaaaatagggagagtagcctggcttaaccaggtggactcagtttcatcacatgaactcttaaaagcggagaactttctctcagtggaagcagaagcgatatggcagaagtagtgagaaaacatcccaagcatgagaaagattgaatatgctatagcttgttactggctttgagatgtaggggcctatttacaaggacccaggagaggcccctactatcgcaagatcagctgctgcgtgacagcaagcaaagagacacatacctcagtcctacaaccacaagaaactggattctgccaacaacctgaatgagcttagaagtagattctgccagagtcccctgataagcattccaccaacagacatctttatttcagccttgtgagattctgagtagagaaaccaaccaagcccgtctcgccttttgtcatatagaactgtgagataataaatttacgttgttttaagctgctaagtttgtggtaatttgttacagcagcaatggaagactaaacagatattaatatagtcattccagctttcttttggttagtgtttatttggtataactttttctttccttttgcttttaatctatctgtgtctttatagatagataaagtgggattcttacagacagcatatagttgtcttgcttacttatccaatctgatcatctttgtctttcagttggccatttatatttaatatagttattgacagggttgagttttaactgttttcttgctgcagcctggaaactgcctctgatctgcaaactggggcaatagtagggtttacctcctttatttcctccttctcacctgttctccactgcctgttgtcaatgtctgaaaactgttcttttgtagactgtatcaagcttcttatttaggcgggaaggtaaattatattcctattattaagtcaaggctggaaatagaggtcctcaagagtataatttctaattatttcaaggacatcctctgtagcaattcccttttatatgagacgtgagcatgtgtgtatgtgtaatttattcattcatggaaagtataatacatacactaaaatgttcatgccatatgaatatgacagatggctgcctttttagaaatagaatcagttagtgatagaacttgaccattttcagagcatgtcagccttttccagtctctgtgtcttggtatagctagttccttctgcctggaatacttcctcatctcacttgctttcctgcctggcagcttcctacttgccctctggaaccagctctagggtcaccacatctctgcttctgagtgcctcctcagacacagtctgtatttcctcttccaagctctcatcacaaacattgtgctgtattatatgtttctgtgtggtcttccttctatgaggaagccttggaaagcaggagacttattttagtcttctttatgtttcttttattcccaacacattatgtctgccccatagaccttttcaataaatgattattgagttagtgactccttttacatgctgacaaatgtggctcttattactccccatttcagtatcacatatttgtaaaagtgaatccttcttaatcgttttacttttctcctagtaaattcctcatctatgcctgtctgctgctgttctctgtgctgctggcccttcgtttggatggcatcatacagtggagttactgggctgtctttgctccaatatggctgtggaagttaatggtcattgttggagcctcagttggaactggagtctgggcacgaaatcctcaatatcggtaatactgctttatacaacccattggtctctagcatgagggagcaatatcttgacttttctcacttttgatgaagtaaggaccattttattttctacctatctggggtcttagaactatagtataagctaacagatctcttctgtgtttttgaaaatttagtctttggtatgtattttcttacaaaagcagtgccatttgggggtaagttgccagccagctcacagatgcctatataatccaaaatgcacccaaaatacagaactggtatgccatactagactaagcagcatgaaaccaccctgtttttaggaaaagacactcatattatgtttggtcatgaaagatctttctccaatacagttttggaactggggctccccttgtcccaccctcctagtcccagagctttaggactattagcagtgtaggggaggtggcttgaccaggagaccatgagtccctgagacagcagctggggaatgaggaaagtcaaagattggatgccgagaaggaaagcagagcctttgggggcaggggagaggggtaccctttaccgtttccaactcttgccctccctgctcttggatgcctccgctggcccaaattcctgggagttggctcacgccagcatgcaacctgcttgttgctgggacctgcgagaggctttcccttctctgccacagagactgtaactacataaagggaaaaagggggacttaagactgggaggctattatgaacctccactgggaaaatgaggagtacaggaattcccagaaggcagctgctcatgtgggaaaagtgtaaagttgaaactaccgcaccttttttttttttttttttttttttttgagacagagtttcgctcttgttgcccaggctggagtgcaatggtgtgatctcggcccactgcagcctccacatcccgggttcaagtgattctcctgcctcggcctcctgagtagctgggattacaggcacctgccaccatgcccagctaattttttgtatttttagtagagatagggtttcaccatgccaggctagttttgaactcctgacatcaggtgatccacccgccttggcctcctgaagtgctgggattacaggtgtgagccaccacgtccggccactacatcaactttttaaatttttgtttactaaatatgaaaatgattcagattgtgtaaattacatatcacatacatgtctaagaactgtaaaacagttacacagagagccttggcaggtgagggacattcatgtatagctgtttcagagttcttagattttttttgaaagattgatgacctgtgtggctgtatgtgttttatttttttatgagatattttcagatatctaatattaattgcttctcaaagaatgcaaagttaaataaacatttaggttctactaattgatatttagaatatattcaaacttctctttgttggtcttatttaagatgttttgagcaaggaaaggaattgtgtatgtggggttgaatgtaaggaatgtacaggcgtggtcattctcatgttaacattaaccagtggaacatggttgggtcctacaggaataacctctgatagcattttctctatgatctaacttccggtgtatttgtcacccacaatacatgtatatcataaatgttcatctgtattttgaataaacattgtaggcctttcagatgcattatagagccttttcctgattagcggccttaccattgctcaattgtagatctgttaaggttattgtgcatgatacttagctaattaaactgattttgtttgagaacagttttaactcttgttcttctttctctttcatctgcaggtgttaatttatcttaatggaatagaaaggaaaatgaaaatcatttatacgttttatttgcatttaaaaatagcacctaacaatagttactactatcttgaaatataactggcacttgttcatagaactagagttatttttataatattgtgtgaagggtggtttacatggtttcttgaaaaatgaggatcatgagacttaaggggtatttgcctggttttagcagcagaagcaaatcagcttgaataatcttggaagtaactcttgttgttgaatttaaagatgtgaacagaagtgtttatgtacattgtcagggaaataagaactggctattacttttgagaatatccttatacggttaaaacattaaattctggtttggttgtaatgttcattttgtattatgtagtagttcttcgatgtttcagagattgcctaccaaagcttaggtttaagttagctttctacctgatttccctttgcttttgtcaaattttcaagtaaaattcaaagtataaatataagttggtatttgccctgaactgcttgcttatagtggagattctgaactgagggtgttttcttcttctctcccttttttagagcagaaggagaaacgtgtgtggagtttaaagccatgttgattgcagtgggcatccacttgctcttgttgatgtttgaagttctggtctgtgacagaatcgagagaggaagccatttctggctcctggtcttcatgccgctg

SEQ ID NO: 3927 - DNA, 35186 bp, human; identical to SEQ ID NO: 3915

SEQ ID NO: 3928 - DNA, 28006 bp, human
cgggagcagcagcgtggacgcggctggcgctggcgccatgaacccgctgtaaggcgcaggctgtgcagcacggggtgcgggggaggaggaggaggacgccgcggtgaagttctccgccatgaacctgaggggcctcttccaggacttcaacccgaggtgaggcggcgtcgttggcgcccccgggagtccgcgctgcgggctcgggcgcgggctggtgttcggctccggggaggcacggcgggcgagatgctgcagcccgaggacccgggcgcctgcccgagcctccctgcgggtgcaagcggtccccaggcaaaacagtcggcctcggcgcccgcccgcttcctcctcccgtgcccggtgctttcagcccctgcccggccacggccggaagggcccggccgcgagccccgtcctgccccaagggaaccccattcttttctgcttgctgtccctcattggtgtcccaacttcttcgtctcggttccatcctcttctgcgccgctgcgggccctccattctccgcgtcagggccgtctcactcgacccaacacccctacccccaccccagctgtttcctccagttcctcgcagtccttggggttttccttgggtttatgcccatccctctcttgtttgcttctttgttgaacggatacctgaaacactgttgaatccttggagtcagtgtcggggtatggcaataccttatataatgcatttctgggtgagcctgatcattttccatactcattttctcatcagtcttcactacaagtttatttgcaggaagtagatattgctgtccttcttttccagatggggaacacccagtggacagtgtggagaaaacactggctaagcactcaagcgcctgtccttgcacttgcccgactgttttgtaactgttctttaccccaggctgtgagctccctgaagctgagaccatctcctgctcatctcagtgtccccagcgcctcccacccaccgtatctggcacatagtaggcacatataaaatgtttgtggaactaaactgagcccaaagacttggattggagacgaggccatatgtaactgggtgattctctgcccttctttggcccttctgtaaaatgaggagttggcctaactgatctcttaaatgcactactctccgaaaggagtatccgtttcccttatttgccagttgggaagacgtgctcagtaaatatttgtgtgctgtaacctatgctaggtgctttagatgctggcggtctcagcatggggtgaagaagggcttgtacacttaagatgccttacagtactgtgcagtgctgtactgcgggggggccaactctggggacctatgccttggctgcttgttgaggatgaaaggaagttttaggggagtatttgtatgttgagggtgcagtctccctagggatggtgacattttaacttgtgagtcattgtgactttgtatgtgctcttattccactttgagttcatgttctggttaggagtgccagtgtctctaacacggtgcagacattatcattgttggcttcgaaggcatagaggaggtaacagaactaactgcagtcccttcctctgctgcatcagggggttaagattggtctgcagggtagtagggttggtgctgtggctggacaagccctgtatgtcttctatttggagatggtgataagaaagttaagtaaaaactgaattgttttgtgcccttgggcaactcacttatctattgttttatctgtagaatgagtataatctctcagtggggtagggaggccaattaaggattgattacaaagtgccttacaaatagaaagctacagtgacttgtttgcaaggtgacagagaattcagaagcctcaagaaactgccttaagtgatcaaacaggctaacagagttgccaaagcaaaatagtgctgcactgatactacctttaaccgttttttcctttagcccttttccccccaaaaaaattagtatatgaaattacagtgaaatacctggtatctaagcagatttatagtaattctcaacatattcatcaatctcttaattctacctgcattaaaatgtatttctacctgaaaagtttaaaggtcttttatactgtgccattttcctgattcattgttgccagaggtagtgagttccttaattttacagatatttcaagaggacattggccaggtattattggtaaatcagatttgtttttttagctggtagtgtttcacctctcctgagcactcctagtttttgacagtgtgctttagtctccttccatgctgaggaaggccttctctataggagaaagaaaactgaggggtgtacacaggaagttaccttatgctggggactcaaaccttgatgctactgctttgctccctgcctctatttttgaaccaattcaacatctccctcctaccccaggaccttgtcacacactgttctctttaccaggaatgtttccctctcttttcctctcctccagacctagtgaactcctatttatcctcacttggcacttgctaagggaagcattcctgacttccctgaccagatttactgctccctgtttctacagttcctgtagtatttactactcctccatcatagtgcatatttgtacccttgtgtctgtctggatgcttatttgattaatacctgcctcccccactaaactttaagctccatggggtcaaggccgtgactgtgtcagtatcgtagcctgcatacttggaatagtacctggctcaataaatatttgtggagtaaataactgaataactctccagagcctataagataaatctagagctgctgctttcaatcactgctttcctggtggtctgtggcctggttctctttcttctcacactcttcccaccttcagagtgcagccattgctttggagagatgggagagaacatggcactaaggcagaatatggctatatttactttgaagagcatgtctttgtcatagaaatagtcactgtcatggtttggtgggtcccaaggcatgggtcatggctccagatcccctttccagccttttggatcttggtaagtctgaacccactgctgcgttggcaaggctctggaaactatagtgacagagaatgattcacaagtgtcaacactcagatgtacagggctgccagctgacccactctacctatttccatctggcactgaactggttgatcatgaacttcttttcataattgctttttagttatgcaggttaagacatgccgaaacagatgtaccggacccacaaacaagtccttccttgaatgcctgaggcttcctaacagtgaaagagccctgttcttagagtaggcaaactgattctgaggcattgtaggtggtagggatctggtagtaggtagcattaggtgggctcccggcactcaccatggagccttgaaattttctgctactttgggggagttgctggttcagagaaggcccttccaccctggtagccatgtggcactggaaggctgtgaaaactctgctgggccttcttagtcatctgttgtgagctcctgatgggagtgtggtgtatccctcaggtgtgctagactggaacaaaggctgagaagtgttgctctgggggttccaacttgtgggcatggggtactgatgagatcagtagtgtttggagacttctgtatgctccatcttcagaagacattctggagtccatataagttatcttgtctcttgtttgaagcaggaaaaaggaatgcgattgctggtaatatagttcactaaagtcagctacctggcctctaacagttatttgcaaagtatattataacattgattcctcaaacatctagattcctatctcgtgccaagtgatgtactaggtgctctaagtacaaaaataaaggaatatagtcctcctctcaatgcgtaagcctagtggaagaagcagaaatgaaagggaaataagaattcaatagagtatgaggcattacagtgaaagaaaccaaatgtcttagaagtacaaatggcagagctactaattctgtctcgagcaggcagggaagagtctatagtggaaatgacttttgagctagattttgaattgagctagtcttttgagccagacttttgagctagaattgtagggttgtcatcagaccagagagtaggaagggtaccttgtgaggaagagagagagagatcagattgttactgtgtctatgtagaaaaggaagacataagaaactccattttgatctgtactaagaaaaattgtttctgctttgagatgctgttaacctgtaactttagtcccaaccctgtgctcacagaaacctgtgctgtaatgaatcaaggtttaatggatttagggctgtgcaggatgtaccttgttaacaatatgtttgcaggcagtatgcttggtaaaagtcatcgccattctccattctcgattaaccagggacacagtgcactgcggaaggccgcagggacatctgcccaagaaagcctgggtattgtccaaggtttccccccactgagacagcctgagatatggccttgtgggaaaggaaagaccttaccaccccccagcccgacacccgtaaagtgtctgtgctgaggaggagtagtgaaagaggggggcctctttgcagttgagataagaggaaggcttctgtctcctgctcatccctgggaatggaatgtctctgtgtaaagctgaccattcccattcgttctattctgagataggagaaaaccaccctgtggctggaggcgaagtatgctggcagcaatactgctctgttactctttgctacactgagttgtttgggtaaagagaaacataaatctagcctgcgtgcacatccaggcacagtacctttccttgaacttattcatgatacagattcctttgctcacgtttccctgctgaccttctccccacctgttgccctgctacactcccctcgctaagatagtaaaaataatgatcagtaaatactgaggtaactcagaggctagcgctggtgcgggtcctccgtatgctgagtgccggtcccctgggcccactgttctttctctatactttgtttctgtgtcttatttcttttctcagtctcgtcccacctgacgagaaatacccacaggtgtggaggggctggcccctttcagtatctcagaagggacaaagtacacaaaggcatggggtcatgatagtgcctggtatgttcaggtagtgaagaggtccatgtggtatgagcactgcagatgatatgtgtcgtatgaattaaaaatacatagttactgcaaatagtttttacaggttattgtttttaagaaagcagtatctaatgcacgagtgtactgtcagtactgtcaatgaactacttaccactcaagtgactgcttatctgttgttctgtcctctcaagccacctacagtcagaaaatggtcttgattttactgatgttgctgttaataatagctgtgacttcttgagtacccaccacatgccaggcccaatgtaggggctttgcatccattatccatgatctttacaacaaccctgcaaaattaggtatcagccttattttaaagtcttgacagcttgtgacttccctgaagttgcataggcaggaagaatctaagtcaacattcgaatccacgtcagtctcatgaagcctgtgctctttcctgcgtgccatgccatagttctagttaagtgacaactcctttcctccatgacattgtagatccagtatgctaaggaaccctctatttacaaattgtaagtgattaaacaaaacaaacctgttagtggcgcttatacatccaaatgagtgttgttattcaaagaggttacttggggaaagagaatgtatacacctattccattgttcatactccttgttactcatctggaattccctttaaagtcagtttacatatcacataagaagatccatctcattgctttatgatcatctatcattttcaaccaaaatagttccacctagtttgatcacacatcttattcactaaccttggctctgactgactgtttgccatttccaaaatttgaatccaccctcagtgaaaatttagcaccatttgggatagtcagaagatcagactgcaggttctcaaggtgcttccaagaagaaagcttcaaagatgatttgagtaatgaagtaccattggaattactgcattgcctcccaaggggactggttaaaggagagaaatctcatttgaatgtataatttccagttttaaaagtatcattcctattacttgataattacacacacattgttcttagctgtgttctttgagggccaggatttggaggtgctgaattacgtgctgaatgagtggatgttgggtacaaatagacatctaccactgggaagtctttgttgtacaggagagaccgtggattgaaggagttttagatagtttcctaggactccagaagttaagctttttaatatggagcttgagttttctaatcattttgcctgatatgtcatgcctgtacaagatgactggaatttaagacaaaagcctcgaactctggagatagatgctttataagtggagactcatactttgtcagctccaacctaatagtgacaacaatgattgctaaatgagattattacctacaatgtggcagaacttttgtctttcataatactgctaaagctagaatgggtaaaatgtatcatttacacagtgctttcacatacccttgtcttaatgaatcagtatatgaggaatcagatgaggagacagacctgggggaaaataactcacccaagaccacaccgctgatgaatggcagttgaggaacttaaatgcagatcttcctactggcctgggctctgcttttatttggcttttgtgcttttttgtatctactggttaaatgctcttaaacattttttatcttaataaaaccagctaaagtctccactaaaagactttaaatttggttaataaggtgtaagaggggcagttcccttgatagtttgtgagtatgtcaggttgtcatttggagccattctgtcaagctttagactgggatgtgccatccaaagtttgtgtgtgtgtatgtgcttgtgcgtgtgtacgtgcatgcaggcatgtgttaatgcgcgtgtatgtgctccagtgaagccagcagcttccactggaaaaaaactgataggtctaaaaagagtccagctgcattcttatgatatgcagaaaacagatactagaacttttacattcagagtcatcattcctttgctaagtatattctctctctccctcccttcttccttttctccctccctattctcccaaccctgcaaagtggagagagggaatttgagcctgagcagaaagctccatgtaaatttcagagaggatactagctttggcccaggtagcactacttagtgattcatcgtatactaacactacagattcaaatgagagtggaataaatccattctaaaggtgtaactggaaaagtgaattttaagaagtagtgattaatgttaaaccagaacctcccatttctcccaggtttgtggagaattaagcagtctatttttatacttggaatctggtctgaatgtttcttgaaaagtaactcaaagtagtttaggctatgaccataagttatttttgtaaatacattttcttatcactgtattattgcatattattgtgtattcttttgcaaatcaggcttgatatttccttttggctatgcagtcaccttttagactttgcttgcaaatatattgatatagttaagatactattctttctttccccaactaggagtgtgtatgaattacatcttttgaacttactgattgtattactttgttttacttgatcaactttgtagtttaatttttttaaaaagctagctgttgggattactgatcagtttcatttttatatctatatttctacttttagttttattattttcatgttttggctttttccccaaatttcttagaaactcagtttactagttttcttttgcctcttttttttttctttgttttctacttttacttaaacattttaaatgaacacattttctcttgagttttgttttggcagctgcccaggtatttttatgtttcaattgtattttagtaactctactaaactgcttaacaaatcagtattgaaaatgatccattttttgtcagtgtttttatgaattgtataaaatgtcaacctctggtctctactgattacaatctaccttacacactcatatgtatcttctgtcactcttgttgagaaaatctgcagtggccccatattacctattaataaattccaaggactttaccttgatattcacattcccctaccatgttaccacagccaacttctggcttattccccccagtaccctttctcctgtctctgcagcaccctacccaccacgatttatagaaagtattctgtgtgttccagtctgctggaattggagaggggaggataaagaggggatgagcaatgggtacaataatacagttagatagaaataataaatctagtgtttggtagcacaagagggcaaatatagttaataatgtatatttgcaaataactaaaagagtggaattgaaatgtgcctaacacaagtaagtgatcagtgcttgaggtgatggatatcccagttactctgatttgatcattacacattgtatgcttgcatcacagtatcacgtgtaccccataaataggcacaactgttttgtatccataataaataaaaataatttttaaaaaattggaaaacatcttattccctttgtctggaattccttattcccaacttgttgcccagattccacttctcttcccatctctctcagggaaattaatcttccaagtcccctagtttaccatatgtagttacttgttgatacatcatctccctctgttcctattagtctgagcatcttgagcgaacgcattgttgctcctttttatgtatctcacacatttcaggcactcaaatatttttaacaattgtaaattagatgtgtgtttattgtgtattgctgccccatgatcctttttttctccctggaaaaactatatatatgtaaagcaagtatgttttcttgttctgctacgtaattatcttcatataagcttgctgttttttaaattttctcgttctgctacttaattctcttcatataaccttgctgttttttaaatctactcttgtgttcatttccgtattttccttaggaactttgtctgttttatctgtcatgatttaagagtagcatgaggaagcccacaattaaaatatttctgtgtatccttaaaaaagaaaaattgtaaaattatttccatattccatggtcatgttaggtttttgttatttaggttttccttattagtccttttagcattttaatactttcggctttgaaatctaatttatctaattttaaagatagtaaattgttgctcttgtcttcatccaggcgtgctaaacctctgtcatctgatttctgatagttggttcgacttttgactttggttccaagcgtaactcttgaatgtaacaggtttactttcttaatctaggaagcaacctttctttttacagagctgtggtaggcagaataatgacgcccccaagtatgtccacatcctaatccgtggaaccagggaatatgttctgttacatggcaaaggggaattaaggtagcagatggaattaagtttgctcatcagctgaccttaaaatagattattctggattctctggctgagcccaatgtaattacagggcccttaaatatagaagagggagacagaaaaggaggtcagagtgattcagtatgagaagaactgcattctccattgttgactttgaagatggaggaaggggccatgagctaaggaatgtggcagcctctagagctagaaaaggcaaagaaacattctctcctagagccttcagtagcatagtcctgctgacacctcaagtttagcccagcgagacccatattggactctgacctccagaattgtaagggttatgccttttaaaccactaggtttatgctttttaaaccactaggtttgtggcagttttgaatggcagcaataggaaattaataagagaacattcagctcatgtatatttttctaaccctagtatttgaatcatgaattatattttgtgggtccttttgtaagtttatcttgttttctatttttcatgtaatagacataaaattttaagtttcctttaaattatgtcaaaaaccacataaaataatcccttttccaacatttaaaacattttggtacttctcttttctttagttccactactctctttttttattaaataaggaaactgttttacagaggataatgaagttagcttacagcatttaccaccccccccaccaatttactttttatttatagtctgaaaatcctttaggataaaaattacctgtacatgttatctaatttacatatgaatcctgtgtcgtcattatcttagcatttgttaatgtttgaatccactaatttcttttttaaatagtctgttttcaagtccattgtttctggtaattatatttgtagccacaggctttagttgacaaattggttctgatttttttagattttggaatatttccctctgctttaagagagaaaacttctgcctctactaattgtgtactgtaattgtggtgataactccatttctattaacttgtgaatcaccttgacacaggctctcttcttgtccaaagtctaagggatgaagtcatttttatcttggtttctttaaatgttctttctttgtagcagcttataaaagcctgtttttgttttcgagtattaataatattagctaatgtgtattgagtacgctggttatcagactgtttcccacagaccttgggagtgggccttgagaccctttccaggtatctgcaaagtcaaaattataatactaagacattctttgccttggtcgacattggcactggtggtacaaaagtagtgcatcaaacagctggtgctggagcacaaatcaggacagtggcaccagctgcactagtcttctgtcactggattcttcaccaccacgtgctggacttgcagttaaaaaaaaaatgccagcttcacttacgaatgtccttgataaagcagaaaaatattaatctcatttaatcttgacccctgaatgcacatctagtttaatattccatgtgatgaaatgggaagaatgcataaaggcctgttgtatgctgaagtgcaatggttgactcaaggaaaaacgtgtgtgcctgagttacaagctgctgttttcatggagtatcatttttatttggaaggacaactgacagacaagactgtggttatttgtgttatggtgtttggcagacattttcttgaaaatgcaggaagccacaataaacatacgtgtgcatgtgtctttatagcagcatgatttatagtcctttgggtatatacccagtaatgggatggctgggtcaaatggtatttctagttctagatccctgaggaatcgccacactgacttccacaacggttgaactagtttacagtcccaccaacagtgtaaaagtgttcctatttctccacatcctctccagcacctgttgtttcctgactttttaatgattgacattctaactggcactattcacaatagcaaagatttggaaccaacccaaatgtccaacaatgatagactggatcaagaaaatgtggcacatatacaccatggaatactatacagccataaaaaatgatgagttcatgtcctttgtagggacatgggtgaaattggaaatcatcattctcagtaaactattgcaaggacaaaaaaccaaacaccacatgttctcactcatagatgggaattgaacaatgagaacacatggacacaggaaggggaacatcacactctggggactgttgtggggtgggggttggggggagggatagcattaggagatatacctaatgctaagtgacgagttaatgggtgcagcacaccagcatggcacatgtatacatatgtaactaacctgcacattgtgcacatgtaccctaaatcttaaagtataataataataaaaaaaagaaaaaaaaagacaaaaatactataataaaagatgcttctatcacacacacaaaaaaagaaagtgcaggaagcaaaacttcaaggaaaacaactcatggtattttttgtaaatggtaaaatttgatctttcatgggaaaaccagaatttttgaaaagttgtatctgctaccatgagcttgacaacctcccagtaattaaaatatttctgatgaagttggtgaagatagtaagtaatgtgattttttttgctattgtatatgaaatgtgtcaacatttgaaagatctttataactcagtaaaccaatattttccagtcgacctacattgcattatacaataatgctgggataaaagattcattgaaagtataagagagaccagtggatttcagtgtagcagagtacaaaaaggtcattgatacgatttcagattccacatcatagttaacctttaagaaactaccacttgttgagttttagtgtcctgttgaagaacgtctaccattatctgaaagagctattaaaatagttcttttctaactacagatctctgtgaggccagattttctttgtatacttgaaccaaaacaatgtattgcaacagaatgaatgtaaatatagatattagaatctaggtgtcttctatgatatcatacattaaaaattttgctaaactgtagaaacagtgtcgctactctcactaaatttgtgttggttttggaaatgtttttaaataatgttatgtatgttagtatgtaatgtgtttattattaccttcgaagagtagatattttttgaataacaactgtatcgtaaatattaaataccaatagggataacccatatcaaccagagctctttgggatcctcagtaagtgttagaactgaaaaggagttctttttaagagttaaacgtcaaaatttttgatactaaaaactttgagagccactgatttagtgctttatacaaagcacttgttatactcattatcttatattcgtagccaccttatgaggtacatattattgccctaactttatgggtaagaataccatgacacaatgatgctatgtatatttttttagcaacccctctgaatctcatgatcttcccagcgtagttttctctctgggaggcttgcttccaagtttaattttgtaggtccagtcttcttacaaccctcctcccttttttccaatcgaagtttcttatgttatttttcatagtacaaaaacagtacacgtaccttacagaaaactcagatatcataagcaaaagagtataaagactatccttaatcttcccgagtggagacctgttagctgctcagcagatatttatacagatgcttttctaaacatgttcatttatcagtgtaaagccggtatagtataatactcaattagaaggattttggagtcaaatggtttgactcccaactctgagctcttagacaagttatttaacatctgagctttctgttccttatctgtaactgcactgatctgtttttctgtgtctagagttttgccctttccagaatgtcaaataagtagcattgtacactatcttgtgttttccatctgaattattttacttatagtgcattttagattcatcaatgttgttgttgtcatccatagtttgttactttttactgctgattagtattccattgaacggatatatcaaaattcagttaaccattcaccagtttatggatgtgtgagttgttaccagtggcaattatgaataaagcttcttggaatatttgaatacaggcctttgtgtggacatacgttttcctttttcttgagtaaaatacctaggtgtgggattgctgggccatagaataagtatacacttaactgtataagaaacttccaaaatgttttctaaagtggctgtactattttgcattcccaccagcatatataagagatctagtgtgtgtgtaatcttatctcattgtcattttagtttgcattgtcctaacatctgaaaatactgagtattttttgtgtgcttatttgctttttgtatgccttctttgatgggatgtctctgaattttttggccattttaaatcgggttgttcacttatttttttagttgtaaaagtcctttttatatactggatacaggttactttgtcagatacgtgttttcagagtatggtctcccagtttgtggcttggctgtcattttgttaatgataggtatcttttggagagtaagagtttttcattttggagaagtccaatttcatatcccatctaagaaatgtttgcctaaccgtaggttgcaagtatttttttttcatatgtgttttggacattttatagttttgtgtatgacatttaggtctatgatccatgtcacataaatttttgtatatgttataaggttaagagtcaaggtgtactttcctcatttatccagttgtaccaccatttattgaaacataattatttctccattgagttgttttggcacctttgtggaaaattaactgactctatatgtatgggtctgttttccaactctctagtacgttctatatatctattcttatgccagtactacattgtgtttattactgtagctttatagtaagctttgaaagcatgtagtataaattgtccaactttgttctttttcagaattgttttgcccattctaggtcctttgcactgtcatatgacttttaaagtcagtatgtcaatttctacagaagaacctgctggctcccaattttcgctgggattgcattgattctttaaaataatttggttaatttggtgtgtgtggtaggctaaatcatgacccacaaagatacccacttccatggaacctgttaaagatcttgagatgatggggttatccaagtggggcaataaatgcaatcaatcacaggttcccttaaaagagggagataatattaagaggagaaggcagtgtggtggaaacagagacagagatttgaagattttatgcagctggttttgatgatagagaaaggggccatgagccaagggaatacagctctggaaactggaaaaaaacaagtaatagattctcccatagagtctccagaaggagtaggtcctgctgacatcttggttttagcccagtgaaaccctttttggacctctggcctcaggataataaatgtgtgccattttaagtcaccaattttgtggtagtttgttacagcacccataggaaactaatacacagaggatgtaaatcttaacagtattgagtgttctatgaacacagtatatgtctccatttatttagatctttaatttttcttggcagttatgaactgaatgtgtccctttaaaaatcacaagttgactctagtccccagtgtgatggtatttggaggtggggcatttgggaggtgattaggttatgagggtggaaccctcatggttggaactagtgcccttataaaaagagaccagagagctaactcactctcttttcaccatgtgaagggtattgagaagtctgccatctgccacccagaaggcagccctcgccagaacccagccatgctggcatcctgatctccaacttccagcctctggaactgtgaggaataaatttctgttgtttattagcttccccacagtcctaccagtgttttgtaggtttcagtatataggttttgcatatatgttgttacatttatccctaagtgttttatatttgtgatgctattgtaaatggtggattttttcataaacttttaatttttgaatagttataaatttataggaaagttgcagtaaatgatacatatttttaaatttctgtttccaatttgtgatagctactatatagaaatgcaataatttttgtaaatttaccttgtgtccttcaattttgttaaattcacttactagatctactagcttttttttagattacttaggatttcctacagggaatatcatgttgcctatagataatgacaggtttacttctttcttttaaaactatattcttttaatttctttttatcatcttattgttgtggctaggacctttagtacaatgttgaatagatgtgttgaagtggacatacttgctgtgtttcctgtcttaaggggaaagtattgagtctctcaccattaagcattataactgcaggtttttcatagatgctcttcttttcctaatttgtttaacgcttttaacttgaatgggtagcaaattacgtcaaatgctttttacacaactattgagatgatcatatgatttttctttttcagcctgctaataccacgaaggttgctaactgattttcaaatgttaatccaagattgcaatcttgcaatcctagctaaaccacacctagtcgtaatgtagtatccttatatattgctgaattcagttggctaaaatcttttcaggatttttgcatctctgttcatgagagatattggtctgtagttttctttctttgtcagttttgttatcagggtaatgctggcttcataaaataaattgggaaatgttcccccctcatcttttttgcaagagtttgtgaagaattggtggtatttcctcattaaatgtttggtagattttgccatggcctgacattttctttctgaaaaaggttttaactagaattgcagtttccatgtctttgtttcaagaaatttcctggcataaagttgtttataatatcccctacttatccctttagtattattaggatttgtagtgatatccctgttttcattcttgatattagtaatttgagcctactcttttttactgattattctggctgtagatttaccaattttcttactttctcaaagaaactgcttttagtttcattgatttttttctctaatccctttttactgtattttattgattaatgtgcttacatttatcattttcttctttccatttactttttaaaaatttccttccgtttcttacatggaggttccttacctccatgttctttctagtttcataagatagaatcttagattattgacttgatatcttttctaatgtaagtatttgatgctaaaatttcccttaagtactgctttagtgtatctcacaaattttggtatattgtgtttttgcctttagtccaaaatatttttcaattttcttcatagtctttgacctatggattatttcgcagtgtggcatttaattttcaagtattttgagaattttccagatatttttctattgttgatttctagtttgactccattgtgcttgtttactttgtatgatttcagtccttttaaatttgttgagctttgttttatggcccagaattcaatctatcttggtgaatgttccgtgtgtgtttgaaaggaatctgtattttgcttttgttgggaggaactcattaatattaattaggtcaagttggttgatagtgttgctacaatcatatatatccttagtaattttctgtttatgtgttctattagttactaagaaaggaatgttaatttccatttataacagtttgatttttttatttctccttttagattgatcagtactttctacatgtattgtgaaactttgttattaggcatatgacaaattgacccctttatcattatgaactacctctatttgtccctggaaatagtccttgttcaaaaatatactgtgtcttatgttgtggtaggcagaatgccccacccccacaaatacacagatacccaggccctaagccctgaaacctgtgaatatgttattattttacatggcaaaggggactttgaagctatatttattagcattcgtttctgctgttaccatgacaaattactctcagttctttaggtcagaagtccgggtacagcacaactcagatgggtcttctgcctagtttcacagggtcaaaatcaaagtgtcaggagggctctattcctttctggagcctccagggattaatctgctttcaagcacatttgggctattgtcagaatttagttccttggggttgtagggctgaggtcccatttaccttgctggctgtcagctgcgagttattctcagcttctgaagcctgcctgcattccttggctcatggttccttacctccatgttcaaagccagaagtaacaggctgaatccttctcaagtctggaatctctctgacttctgcctcatctctcttccaccacatttctctgacttactcttctgctttcttaagggcttatgggattacactgggcacacctggataatccagtataatcttcctattgtaaagttagctgattagtaaccttaattccatctgcaaagtcccttcacagtattactcagattagtgtttgattgaataatcaggggacaggaatcctgggaaacttctttagaattctgcctaccaaccacagttatggaccttaaaatagggagagtagcctggcttaaccaggtggactcagtttcatcacatgaactcttaaaagcggagaactttctctcagtggaagcagaagcgatatggcagaagtagtgagaaaacatcccaagcatgagaaagattgaatatgctatagcttgttactggctttgagatgtaggggcctatttacaaggacccaggagaggcccctactatcgcaagatcagctgctgcgtgacagcaagcaaagagacacatacctcagtcctacaaccacaagaaactggattctgccaacaacctgaatgagcttagaagtagattctgccagagtcccctgataagcattccaccaacagacatctttatttcagccttgtgagattctgagtagagaaaccaaccaagcccgtctcgccttttgtcatatagaactgtgagataataaatttacgttgttttaagctgctaagtttgtggtaatttgttacagcagcaatggaagactaaacagatattaatatagtcattccagctttcttttggttagtgtttatttggtataactttttctttccttttgcttttaatctatctgtgtctttatagatagataaagtgggattcttacagacagcatatagttgtcttgcttacttatccaatctgatcatctttgtctttcagttggccatttatatttaatatagttattgacagggttgagttttaactgttttcttgctgcagcctggaaactgcctctgatctgcaaactggggcaatagtagggtttacctcctttatttcctccttctcacctgttctccactgcctgttgtcaatgtctgaaaactgttcttttgtagactgtatcaagcttcttatttaggcgggaaggtaaattatattcctattattaagtcaaggctggaaatagaggtcctcaagagtataatttctaattatttcaaggacatcctctgtagcaattcccttttatatgagacgtgagcatgtgtgtatgtgtaatttattcattcatggaaagtataatacatacactaaaatgttcatgccatatgaatatgacagatggctgcctttttagaaatagaatcagttagtgatagaacttgaccattttcagagcatgtcagccttttccagtctctgtgtcttggtatagctagttccttctgcctggaatacttcctcatctcacttgctttcctgcctggcagcttcctacttgccctctggaaccagctctagggtcaccacatctctgcttctgagtgcctcctcagacacagtctgtatttcctcttccaagctctcatcacaaacattgtgctgtattatatgtttctgtgtggtcttccttctatgaggaagccttggaaagcaggagacttattttagtcttctttatgtttcttttattcccaacacattatgtctgccccatagaccttttcaataaatgattattgagttagtgactccttttacatgctgacaaatgtggctcttattactccccatttcagtatcacatatttgtaaaagtgaatccttcttaatcgttttacttttctcctagtaaattcctcatctatgcctgtctgctgctgttctctgtgctgctggcccttcgtttggatggcatcatacagtggagttactgggctgtctttgctccaatatggctgtggaagttaatggtcattgttggagcctcagttggaactggagtctgggcacgaaatcctcaatatcggtaatactgctttatacaacccattggtctctagcatgagggagcaatatcttgacttttctcacttttgatgaagtaaggaccattttattttctacctatctggggtcttagaactatagtataagctaacagatctcttctgtgtttttgaaaatttagtctttggtatgtattttcttacaaaagcagtgccatttgggggtaagttgccagccagctcacagatgcctatataatccaaaatgcacccaaaatacagaactggtatgccatactagactaagcagcatgaaaccaccctgtttttaggaaaagacactcatattatgtttggtcatgaaagatctttctccaatacagttttggaactggggctccccttgtcccaccctcctagtcccagagctttaggactattagcagtgtaggggaggtggcttgaccaggagaccatgagtccctgagacagcagctggggaatgaggaaagtcaaagattggatgccgagaaggaaagcagagcctttgggggcaggggagaggggtaccctttaccgtttccaactcttgccctccctgctcttggatgcctccgctggcccaaattcctgggagttggctcacgccagcatgcaacctgcttgttgctgggacctgcgagaggctttcccttctctgccacagagactgtaactacataaagggaaaaagggggacttaagactgggaggctattatgaacctccactgggaaaatgaggagtacaggaattcccagaaggcagctgctcatgtgggaaaagtgtaaagttgaaactaccgcaccttttttttttttttttttttttttttgagacagagtttcgctcttgttgcccaggctggagtgcaatggtgtgatctcggcccactgcagcctccacatcccgggttcaagtgattctcctgcctcggcctcctgagtagctgggattacaggcacctgccaccatgcccagctaattttttgtatttttagtagagatagggtttcaccatgccaggctagttttgaactcctgacatcaggtgatccacccgccttggcctcctgaagtgctgggattacaggtgtgagccaccacgtccggccactacatcaactttttaaatttttgtttactaaatatgaaaatgattcagattgtgtaaattacatatcacatacatgtctaagaactgtaaaacagttacacagagagccttggcaggtgagggacattcatgtatagctgtttcagagttcttagattttttttgaaagattgatgacctgtgtggctgtatgtgttttatttttttatgagatattttcagatatctaatattaattgcttctcaaagaatgcaaagttaaataaacatttaggttctactaattgatatttagaatatattcaaacttctctttgttggtcttatttaagatgttttgagcaaggaaaggaattgtgtatgtggggttgaatgtaaggaatgtacaggcgtggtcattctcatgttaacattaaccagtggaacatggttgggtcctacaggaataacctctgatagcattttctctatgatctaacttccggtgtatttgtcacccacaatacatgtatatcataaatgttcatctgtattttgaataaacattgtaggcctttcagatgcattatagagccttttcctgattagcggccttaccattgctcaattgtagatctgttaaggttattgtgcatgatacttagctaattaaactgattttgtttgagaacagttttaactcttgttcttctttctctttcatctgcaggtgttaatttatcttaatggaatagaaaggaaaatgaaaatcatttatacgttttatttgcatttaaaaatagcacctaacaatagttactactatcttgaaatataactggcacttgttcatagaactagagttatttttataatattgtgtgaagggtggtttacatggtttcttgaaaaatgaggatcatgagacttaaggggtatttgcctggttttagcagcagaagcaaatcagcttgaataatcttggaagtaactcttgttgttgaatttaaagatgtgaacagaagtgtttatgtacattgtcagggaaataagaactggctattacttttgagaatatccttatacggttaaaacattaaattctggtttggttgtaatgttcattttgtattatgtagtagttcttcgatgtttcagagattgcctaccaaagcttaggtttaagttagctttctacctgatttccctttgcttttgtcaaattttcaagtaaaattcaaagtataaatataagttggtatttgccctgaactgcttgcttatagtggagattctgaactgagggtgttttcttcttctctcccttttttagagcagaaggagaaacgtgtgtggagtttaaagccatgttgattgcagtgggcatccacttgctcttgttgatgtttgaagttctggtctgtgacagaatcgagagaggaagccatttctggctcctggtcttcatgccgctgttctttgtttccccggtgtctgttgcagcttgcgtttggggctttcgacatgacaggtcactagaggtgagatttcatatatttaagaatgttttccactttgggaggtcaaggcaggtggatcacttgaggtcaggagtttgagaccagcctggccaacatggtgaaaccccgtctctactaataatacaaaaattagccgggtgtggtggcatgcgccagtaatcccagcttctccggaggctgaggcgggagaatctcttgaacccaggaggcggaggttgcagtgagccaagattgaaccattgcactccagcctgggtgacagaatgaaactccgtcttaaaaaaaaaaaaaaagaatgttttcaaaagtaaaatattttgctcagttattcagatgtcaatttcttaccctttgttaggaagagcttgatcattaccaactctacatcatgagacaacaaggcaacaaaagatgatggaaataacaatttttctttcttcacttagaacactagcttttcacccaggacatcagccttctcccagcttcacatcctgtatcaatcagacagaaacagaactgataggttagatacagatatatgtataaagagagttaaggaactggctcacattactgtggggctggcaagtctgaaatctccagggcaggtgaacaggctggagacctaggaggagttgacactgcagtcctggcacagaattttttcctctccaggaaaccacagtttttgcttttaaggccttcacctgattgcatgaggcccacccatgctatggagggtagtctcctttattcaaagtcagtaccttcactgcaacagcaagcttagtgtttgattaaataactgggtactatagcccagccaagttgacactcaaaactgaccatctccccacctcagaccccatgatttagcacctcccctgctgtctggttagcttatcctgatgtgcccctgtgtttgtttattcattcaataaacatttatcaagtatttactagatgccaagccctttttccctaagcatagaggatatgcagatgaataaaataccaggactagtaataatagtaatgaaagtaattgcagataacgtttattgagcacttactgtgtgccaggcattgtgcgaggcacattacatgtggtagttttcttactaactaactctgtgaggtaggtccagagaagataagtcatttgttcatggccacatgtgaaggggcaggaccaggattccgtttgagtcagcccgactctaaagcccgggcacataactacataactgcatagaagctgagggcccaaagctgaatactgatgggttgaggggagaactagaggctgtagatgcctggttttgagccgtgtggatgaagagtgaagggagaagactgcagttggcttaggaagtaaacatagcagctgtagggtgggtcaggcatataagcctagaccccaggtatgggcgtgaggggaaggtatgtagacagagggacggtgatggagcaaggccctgtgggactcagggagaatgggacctagagcaccaggaagggtttggccttgaacaaggggagctattccctgattttcatgctggtggaaaggccacagcatgggtatagtggtaggtaggagtgagccgtggagggagagtatctgatggtccactttcaccctccctacaattcccagtttatatcagggacttgagcatccatggattttggtatccacagggggtcctggaaccaatcccccacagatactgagggacaactatacaaggactaggactgcattgggcctgaattacagaaagtaagtctttcatatattcacactctaggcattcctgcccttggaagaaacaacataccaggagctgagctccctcctcctgtgatgcaagaacagtacctatgttggtgagggggtggtctggagtaggctcatacagagatgggaaggaggagttgagggtctgccaggaagccctgtgttgggagggaagggatggcatttttgggacacattgaagcctagaggcaggaaacactccatcagctgagtggactgtggcgattcagatccgacgggagcacaaggtggaaaggaaggaactgtgggagttgagaagagagggagcctctacagagggattggggcaaataggggccacgtcctcagcccacagagcatgtgctgaagtgccccaggcaccccagtgcactcacagggcaccaggggatagtggacattttgaggaaaacagtaatacctgacatttgttgggacaccatacaaactactagcttgaaatagtttacaggtttatttttaggccacactgcattcctttcagtgacgtcgtatctttaagaagctgggttttcagcagttgctgtgaaaacaaaaaaggctaatgctgtgtgaaaatccgggtgaagaacaggtaacgagtgggagcaccttgtctgattccaaggcgtgggaaatggtgagctacctgacaggcacacgcatcccactgggaattagttttggttatttaagaataatattaacatttttctttagatttatatgaattattttttctggtggctacttagaaatacttactaagttagacgtaattacttaaatcagtgcaactgttggcattcccagccacattagggatttcttttggcctagaggtctatggaggaattactaaattccccatgtacctatgtactgagaacttttgggaagctctgggcctggtcccagatttcaattttgtgggcaagaatgtactttaccagagtgaggagcagcctgcagggcgtttgggctggaggcgggaggttagtaaggggttgctgaagtggtaggcggatggtgccgaagaaggcctcactaggcagtcatcatcaggataggaagtgggcacgggattcaggagaaatctggactttacagtggacaggatgtggtgactgaacgtgacagtgtgggaaaaagaatgcagggtgattcccgggctcatggcttgagaaatgagaccactgttgtgcctccaagtgacatgggaggctatagaaagtgacatgggaggctatagaaagtgacatgggaggccatagaaagtgacatgggaggccatagaaagtgacatgggaggccatagaaagtgacaagggaggccatagaaagtgacatgggaggccatagtgacatgggaggccatagaaagtgacatgggaggctatagaaagtgacatgggaggctatagaaagtgacatgggaggccatagaaagtgacatgggaggccatagaaagtgacatgggaggccatagaaagtgacatgggaggccatagaaagtgacatgggaggctatagaaagaggagatacaaggttctaagtgcaggcgataatgatctctatttgggactggcttcatttgaggtgcctttaggagagccgagtggcctatgcacagctgggtctgctatgcagcaggaaggctaagttggagacagatgtgagaactaaccatgaaggaggtaataatgcagaccaagggtctggttgaaatttcttctcccccagtccagggtgcagcgggtgagtgaaaatatgtgtgtttgtgtgtctgtcttcctagtcgggagagaagactgagtttgtggctctgcggagcatcaccatttaaggagggggaaaaggagacagaaggaattaccagaacactccagagggctccaagactgtatggtgggatcctagatggccaggaggaggggagcaaaaaggaaagagtcatccacagtatcagtaggatgccagttgaagtgtttttgctgcctcccggttatcggtgactttgatgaaagctgtcttctggtggtcatgggggtggaggccagatcacaaggaagctgggaatggtagatgagatagtaggggcttgcatattcattactgtctcgcagagagaaacctgaggctaagaggggtcttggatcaaaggatggggtgggtttatctggtttcggggcttttgtttttaatgagaaggagtcatttctgtgctgctaggagggatcaatggaataggtggggttaaagatacagtacggaatctacagttgatggcttgatgtgacaaggtcctcaaggagcctgaaaggaaggggtggggtccaagggcaaaaccgaggtatgagaagaaggatgcacaaggatggtttcgagtagacagtattgttggtagggacatgaaggaagcttagtggtctattgcagctagcctgtgttcccagtgaacctggaaacaaggttctcatctgtgctcaggcctcaggccagaaagggcaaggcagcagaggggcaaggcagcagaggggcaaggcagcaggctgagccccatttccccttgccataatactgctgtgcccctctggtaccgaaaatcaggagtttccagtgcaatataatattatacaagttacactgtattataatgtgtattgtcttttagtgtgttaaccaaattactgcagtattaaatgcaaattatactttgtttaactgattcttctcttcatttttagttagaaatcctgtgttctgtcaacattctccagtttatattcattgccttaagactggacaagatcatccactggccctggcttgtatgtaacttttaaaatccttaaataaacttcttttttattataaaagtaattcatattcactgtacaaagcttggaaaagacggacaagcagaagtaatagcctaatagtcacccataatcccaccatggggagataacatggttagtgtttttatgtctgtgttttatacaaacagtttggatataactgtgtgcaccattttgtatcctgatttttttgttttaatgttgtatcataaacattttatcatgttaataaaaggtctttataaac

SEQ ID NO: 3929 - DNA, 5668 bp, human
ggccacagactgggagaaaatatttgcaaagcacacatcaaaacactgacttgcacccagaacatacagagaactcttaaaaactcaaaactgcaaaaagaaacacctaaaaattggcaaaagagttgacaatttgcgaaggggatatacacatggcgaaaaagcacaggaaaagatgctcaacgccattacaggttagggaagacaaactacaaccaggatgagggcccgaaacacatggcttcagaatggtgaaactcagcaacactgacgaggccacgtgcctgggaggatgcagaggaactgggacactccagtgttactggcgggaaggcaggtggtacgggcactgtagaaaatggtttggccatctctgatgcagttaaaagcgcacttcccgtgggacttggctgccccactcctgggtataagatttacccccagagaagtgaaagcgcgcagccttgtagaaacccacacaccagtgtttgtagcagtcttgtttgcattttggatagcggccttgtttggttttcacaaaccaccctcagcggacagtcagataaactgtaggcatccatacaatggaataccactcagaactgagagggaacgacctgtggatacagggagggaacaacttggatgaatctcattagagacattatgtggatggcgggaagccagtctcaacaggttacttgtctcgcgatgccatctacataaagttccagcagagacaaaagtacagtgacagagaacagatcagtgtttgccggggctaatggtggggacggtgtgatagtgaagggacagcacggagagttttgcagggtgacagacctcttctgcatcctgccaacggctgtgcgaatctacttgtgtgaagactcagggaactcacaccaaaggaagacggtcacttttcctactgtatgatagataattaataaaaagggagaacggaggagtgtcgtcccaggaggcagggcaggagggcgaagacgtgtcacaggggagcctggccaagtggcgcccccggaactcgtcctctgggcttgtgtgtggatgagacaaggtctacctggtacgacagggacatactgggaatgcgcccttgccgtggaggcggggacccggcagcgctacgtatccagcatcaacctgtatccagcatcaacccgccaagttcactaacttggtaggggtgaggttagggatccttaggagcccaggcagccagactttctggggagcccattcccatttgtgttgccaaagtacccccagcaggttgtgggaatgttgcctgtgaagagagtctgttggggtgagatcttgtgtgtgtgcacagggtgacagttgtgtcccatttcccgggaagctgtgatggcagcagaacctagaggagcctgagagagtgtgggagagtgggcctctggaagagtagaggctgcggagccaggtgcagggctgtctgtcacccaaaggaagagggactgatgactcactgagcgtgtgtgtcccctggtggcagcaggccccatagtgaacataccataccttttctgtcctgagcgatgctcccagcagtcctgggagatggaacggtccttattcggctcacgggaaggaccgccttaactggacagacacagcaaggtgctaaagatgccttccatcagaggccaggttggaagctctaaagagacttctcttgctgttctctcacccacccccaggttgtgtgtgtcccgctgtggattctcatgtcctttctgtgcctggtggtcctctactacattgtgtggtccgtcttgttcttgcgctctatggatgtgattgcagagcagcgcaggacacacataaccatggccctgagctggatgaccatcgtcgtgccccttcttacatttgaggtaagcgttccacgggaagcctcttcagcccctgaagcttgcgcttcccctgacaggattctgcacccctagaaaggcagcctctgtccctcgagctcacagtgagcccactccaggagaggggagagaacacagccatctccgagagggagcttcggtgaaaggagagcatccttcctttctcttgggggcagcacgtggggctggcagggagaagagtgcacctttttagccatggtgcctctgtatggctccagtttccactctggggaaagcagagtgggatgtcagatttgtgtattggagtcacgtggagaattctagaatgggagctgttgactccttagaacaaacacccggaggagtttgccataaaactgctggcactgggaacttttcaagtggataggctattgccgagctctgaagagggacataaaagctcatttcgagctttccccagggataggtggtttcctgcctttttctggcggtgctgatgttccctcttgtgggagctcacgcgggggtggggtggtggggaggaactgcctaatgaagtctggcttccgcctctgcccattttcggtgctggcatcaaccgggactatgtctctttctttagattctgctggttcacaaactggatggccacaacgccttctccagcatcccgatctttgtccccctttggctctcgttgatcacgctgatggcaaccacatttggacagaagggaggaaaccactgtatgtactcagcatttcagaagtccttggtgtgtgtctggggggggaccagggagtggggggggggcggatagaagtctaggaagggatgagtccccgagggccccaatttagaagcttgtgtgggaaagtgagggctgaggaaattctgggaccttctaagggaagggcatgccgtaactctggtgttctgctggcctgcaccgggacttttctcgcagtgcacgctgccatttgaggtagaaccagacacggcaggcaacctctcagagatcccgttccctcctctgcaaaatggggatcaagacagattcttcccaggcccgggagggtttgatggaaaatccacatctcccacccaaacctgggattcatcctaggtccctgttggcctctctgcctcccccatatccttgctgccatcacccgagtcttgcctgtcttgccttgctaacactctattcccctccacctgcttgctgaggcagacacttccaaaacgatctctgcagagggtgccttcctggcaaggctgtgggctccatggcacggaagcccagagcattgcccttcggaaagccagtgggtttgggggcagggcctcactgcagcccagcagcccgggctgtgcttgctgtttgtgcctctgccccctaccccgcacccgggagcagggagggcttgcaccgagctgacactccagtagcctacagagaggagtagtgggactgggaaagtggctttaaggtggctccatgagttcaggccccctcctggccaggacccgtgcatgactaccgccctcacggattccagagggtgacagaaatcttgttcttgggtggcactgtcatccatgagtttatcctggctggagaagattagcggaagacaccgtagtctgcgcaccacagatattttgagactcactggagcagtagttctcaaacttgggcatccagcagaatcccaaaagggccaggaaaaggggaccgctggagcccaccctagcccgactcagtttctggaggtctgggctggggcccgagaatggcatccctaactaggccccgtggacgctgtccctgccggtccgggaaccccactccaagcaccacagagctagcatttgcacttcttccccattttgggtactcaagccctgttcaggctttgtgactcaggagtctggataaagtatgttatgacattgtaggagtgaaacttcttgttacggaaagaaagttaacaggaaggtcagttgagcctcgtgtgtgaaataaaaaattcttatttttcagggtggtttggtatccgcaaagatttctgtcagtttctgcttgaaatcttcccatttctacgagaatatggaaacatttcctatgatctccatcacgaagataatgaagaaaccgaagagaccccagttccggagccccctaaaatcgcacccatgtttcgaaagaaggccagggtggtcattacccagagccctgggaagtatgtgctcccacctcccaaattaaatatcgaaatgccagattagatgccacttccggggacagagcttaagtggactgggacgcactctctccgccttcctctgccccctcgttcaccccgcagaccagaaccagtactggagctgggtctccaggtacgtccatctcatgccttgtttgcatccagcgcctatcagccactcaccacgacgggacgcggaagtggcaggtgacgggggtgtgtgccagcagatgcggatgccaggaagagtgtgagaacaggggtgggattaccgtctgtctgggaggggctccaggtacccctcttccccgtcagacccactgggagatggctgcttgccaggcccccagaaggaacatctgtctatacggtgctgaaatcccaatcaaaagtattgtttagaaatgtatttctccacagggctgacctcctgcagctcgctgagcactcccaggtcctcagcactcccaggtcgtggctggggcagtcagtaggaactgtaactatgtctctgatgcaccacgtgtttagacacagcacagtccttttttctgttcctactgtggaagtagtttctctttgggcatgctgacagcagtttttcatagcctcacggatgagccctttctacgggagtgactccatgcttgtatacagagtatttatacaaatgttttagcatcttcatatgcggtgttaacccctagttctgtacagcatattctgttcaagtatttttttacaagcttgtgctgtaggcacatgccttctgctgcagaagtggacgcccgtggcacactccccccccccccgtggggtgccacgccttcatgggacattgccacttctgccctggaactcgtgcaggtacgtagtagctgctactgccacaacggcaacaccaagcaagagatggtccatgcttttctgacgttctcagaatagtggctagcttcaaacctgacaagcgctgcttgaagccggaacactagagaatgttgctgagagcagaaacggccacgcgggtcacgactatgcgtgggaaagtctcaagcttccctcctgccagcaacaagaaggctttggagtaggcatgatgttttcacgtgtgcgtgccgtttctccaagcactgcaggttccaccgtgtgtcagaggctgcaagtttaacatcctcctgcctgaaaacaaataggtcctttgctgaaaagagggtaaaaaaagagctttgatcttctcagccaggagaagagggtggtgttttcacgcgggcaactgctcgccggcctacatggggttaattcaagtctgctgcgagcacgactccgcccttggcactggcctccagcaagccctgttctctttggggtacaggggaacgggatggtttagactttcctgctcagtgtgtaaaaaatgtagctaaagccactatttttgctctccttaagctgttcaataaaccggttcctcatttt

SEQ ID NO: 3930 - DNA, 2799 bp, human
tgcctccgactccccactggactgcatggcgacggcgtgtggtggggcagtcagctaagccatttgcctaaggggctgtcgggcatctgcgtgctggggaccgacagtgtgggtgtgttaggaggatctgtatggagcacattgctgcctctggctaggacagggtggaaagggtggcgtggctacagcctgacccatgggcaccgtcctaccctttgttctgtgcttccgagtgtcagtcatgtgctggggtctgtgggcccatgactcagacggtgagctctgaccttcctgagccagggctttgctgtagttgtgcctggctcaggagctctaggacaaggggaccgctccaggtctgcatctacggtgtggcagggcccctcggcactcttgtgcactagtgtcatctttcccattgaaatgactgtgaggaccagaatgtgcacatgcagatgggcagctacttgtctgccttggccctttattacacaacttgctgggggtggagatgccaccccccggcagtcagagcccctttatgatgtcatggggctggttacatgactgccaaggggtgctgctggccacactgcactagcaagtttgccagatggaggacaagcgatcattgagtatggctcgctgtgaagaaagaaattcgagaggacaggatcatggcttggaaagggtgcctttccctccccagttgcagtcagagacctaccttcacccagcagatccttcccctgcctgggacgacccggggtccactgggagccctaacttgaggctgctgacagaagaaatcgctttccaacctctggccgaggaagcttcgttcagaaggccgcaccctgacggtgacgtcccgccccagggagaagataatctcctctccctcccctttccacagaaactgtggagactggtcagcagcaaccagttttcgtccatctggtgggatgacagtggggcttgtagagtgatcaatcaaaaactctttgaaaaggagattctcaaaagggacgtcgcacacaaagtgtttgccacaacttcgataaagagcttcttccgccagctaaacttgtatggcttccgaaaacggcgtcaatgcactttcaggaccttcacccgcattttctccgcaaaaaggctggtctccatcttgaataaggtaatgaacgacaagcctctggaggggttaagtcggtgggctctggggcctggtcgggtggaagtcccaggactgcctcctgggaagtgggcgacctcaggcagggtgtggggccatcgctgtgggcctgtgtccccctctgggtggaggtgacatgaactaagagtgaatgtggggagagggctgaggatggtgcgggcccctctcgagtgtgtaaaatatcacaggtgccaagtagccgtatctgcgtgtcgtcctccccggggccagccatgtcatctggcggttgctgtgtccccctgactccacagcacattaccctgtgaggtgagcaggccaggggagtctggtatttgtaccactgtcaccctagctggtgtctggagaggtgctcaagtggaagcactgaagggcgcctggcgcaggaggtgcagatgctcctgctgcccttggtaggtgggcccctggtgtggaagagccagtacccagggcctccaacccagccggggtgcattctgttgccagctgacactgcatgggggaggcccagaatcttcttccctcctggtctgcaacttcaaagaccctttccgccggccatggacaccctaatctgccattttgaggctttttccaagacggaaaggcccgccacaacttggtaaaccttgacgatgtgaacgcgagtccccagcttcctttggggactgggaccttttccagaaaggcctcctgggccagtagagttctcttgcacaggggcgtagatggttggtagttgtagtccatccttgtgacttgcagtttccttttgtttatttaaactttgacttatagttagagttctactgccatccttactttcaaagagactcccctcacctcctcgtgaggatgaagagaagagtgggtgtcaagtctgcaccaagacatcaggaggaggacaagccagaagctgctggatcctgtctggcaccagcagacactgagcaacaagatcacacgtctccgaatgagaatgaccaggtcacaccgcaacaccgggaaccggccggtcccaacacccaaatcaggagtggctctgctccaccagcaactcctgtgatggtgcctgattccgccgtggcgagtgacaacagtccagtgacccagccggccggcgagtggtcagagggcagccaggctcacgtcactccggtggccgctgtccctgggcctgcagcgctgcccttcctctatgtccctggatctcccactcagatgaattcttacgggcctgtggtggcccttcccacagcgtcccgtagtacccttgccatggacaccacaggacttcctgcacctggcatgctgcccttttgccatctctgggtaccggtgaccctagtggctgctggggctgcacagcctgctgcctccatggtcatgttcccccatctcccagctctgcaccaccattgcccccacagccaccgcacgtcacagtacatgccagctagcgatgggccccaggcgtacccagactacgcagaccagagcacatagagggcagcatttgggcagaatatgtgctggtcaataaatgtgtcagaaaatgagtaattttctgactgcacaaaaaa

SEQ ID NO: 3931 - DNA, 2471 bp, human
ttgtgtgtgtcccgctgtggattctcatgtcctttctgtgcctggtggtcctctactacattgtgtggtccgtcttgttcttgcgctctatggatgtgattgcagagcagcgcaggacacacataaccatggccctgagctggatgaccatcgtcgtgccccttcttacatttgaggtaagcgttccacgggaagcctcttcagcccctgaagcttgcgcttcccctgacaggattctgcacccctagaaaggcagcctctgtccctcgagctcacagtgagcccactccaggagaggggagagaacacagccatctccgagagggagcttcggtgaaaggagagcatccttcctttctcttgggggcagcacgtggggctggcagggagaagagtgcacctttttagccatggtgcctctgtatggctccagtttccactctggggaaagcagagtgggatgtcagatttgtgtattggagtcacgtggagaattctagaatgggagctgttgactccttagaacaaacacccggaggagtttgccataaaactgctggcactgggaacttttcaagtggataggctattgccgagctctgaagagggacataaaagctcatttcgagctttccccagggataggtggtttcctgcctttttctggcggtgctgatgttccctcttgtgggagctcacgcgggggtggggtggtggggaggaactgcctaatgaagtctggcttccgcctctgcccattttcggtgctggcatcaaccgggactatgtctctttctttagattctgctggttcacaaactggatggccacaacgccttctccagcatcccgatctttgtccccctttggctctcgttgatcacgctgatggcaaccacatttggacagaagggaggaaaccactgtatgtactcagcatttcagaagtccttggtgtgtgtctggggggggaccagggagtggggggggggcggatagaagtctaggaagggatgagtccccgagggccccaatttagaagcttgtgtgggaaagtgagggctgaggaaattctgggaccttctaagggaagggcatgccgtaactctggtgttctgctggcctgcaccgggacttttctcgcagtgcacgctgccatttgaggtagaaccagacacggcaggcaacctctcagagatcccgttccctcctctgcaaaatggggatcaagacagattcttcccaggcccgggagggtttgatggaaaatccacatctcccacccaaacctgggattcatcctaggtccctgttggcctctctgcctcccccatatccttgctgccatcacccgagtcttgcctgtcttgccttgctaacactctattcccctccacctgcttgctgaggcagacacttccaaaacgatctctgcagagggtgccttcctggcaaggctgtgggctccatggcacggaagcccagagcattgcccttcggaaagccagtgggtttgggggcagggcctcactgcagcccagcagcccgggctgtgcttgctgtttgtgcctctgccccctaccccgcacccgggagcagggagggcttgcaccgagctgacactccagtagcctacagagaggagtagtgggactgggaaagtggctttaaggtggctccatgagttcaggccccctcctggccaggacccgtgcatgactaccgccctcacggattccagagggtgacagaaatcttgttcttgggtggcactgtcatccatgagtttatcctggctggagaagattagcggaagacaccgtagtctgcgcaccacagatattttgagactcactggagcagtagttctcaaacttgggcatccagcagaatcccaaaagggccaggaaaaggggaccgctggagcccaccctagcccgactcagtttctggaggtctgggctggggcccgagaatggcatccctaactaggccccgtggacgctgtccctgccggtccgggaaccccactccaagcaccacagagctagcatttgcacttcttccccattttgggtactcaagccctgttcaggctttgtgactcaggagtctggataaagtatgttatgacattgtaggagtgaaacttcttgttacggaaagaaagttaacaggaaggtcagttgagcctcgtgtgtgaaataaaaaattcttatttttcagggtggtttggtatccgcaaagatttctgtcagtttctgcttgaaatcttcccatttctacgagaatatggaaacatttcctatgatctccatcacgaagataatgaagaaaccgaagagaccccagttccggagccccctaaaatcgcacccatgtttcgaaagaaggccagggtggtcattacccagagccctgggaagtatgtgctcccacctcccaaattaaatatcgaaatgccagattag

SEQ ID NO: 3932 - DNA, 1093 bp, human
gaggggcggggtagggccgggccgagagaaaccactggggagggtctggggtcggggctttgccatcagtggtgtgaggagcaggccggggcagtgggcaattgagcgaggaacagctgcgggaggactccgcggactcctgagaaccagcttaggggagcggcggcttggggaggtgtagggtggaatcacgagaaagctctgtgggagggcctggtgcacagctcagctgcagggtggagctgagggaaagccgggcgttcctggaggaggagcagggcgaggctgtggcaaagcgctgtgggagcagatggggcggggctgcgggaaagagctggagaaggaggagccaagctgcaccaaggctggcgggtgagaattgcgggggaggagctagtgcagagctggaggaaagagctgaaaggttgttggggtgggcagaggggtaggagaagcgagacggggctagaggaggcggagctgggagcggtgatgaaggggtagcagggcggggcagtgggaaagagctgtgggaggaggagctgggggtaagaagctggggctgtggctgcagcggggactgggtcagagcttctggaggagccgcctgcaagaggagggcgtagttgtgggaaagagctgtgggcggaaatggttaagtgccgggtggagcaggggctggcgtcggaatagctggggcggagctgcgggaggaggagctggggggcggaactgtgggaggaacagctggggcggagctgagggaggaggagcaggggggcagaacagctggggtggagctgtgggcggagctgcaagaggagaagttggggacggacttgcaggaggaaaagctaggggtggagctgtgggtggagttgggggagggagctgaggcccttctgtgatgcacccttaggcaagagtccaaactttcccgcggcgacctaactgcacctccagtgtcttcccccagagggcacagaagcagcaagaagggcgggaacacttgactggggtccatgcagctctaggctgagtcttgcagggctgagccccccaggcctgctctcctgtgtcctggccgctccgt

SEQ ID NO: 3933 - DNA, 76644 bp, human
ctgaaaggttgttggggtgggcagaggggtaggagaagcgagacggggctagaggaggcggagctgggagcggtgatgaaggggtagcagggcggggcagtgggaaagagctgtgggaggaggagctgggggtaagaagctggggctgtggctgcagcggggactgggtcagagcttctggaggagccgcctgcaagaggagggcgtagttgtgggaaagagctgtgggcggaaatggttaagtgccgggtggagcaggggctggcgtcggaatagctggggcggagctgcgggaggaggagctggggggcggaactgtgggaggaacagctggggcggagctgagggaggaggagcaggggggcagaacagctggggtggagctgtgggcggagctgcaagaggagaagttggggacggacttgcaggaggaaaagctaggggtggagctgtgggtggagttgggggagggagctgaggcccttctgtgatgcacccttaggcaagagtccaaactttcccgcggcgacctaactgcacctccagtgtcttcccccagagggcacagaagcagcaagaagggcgggaacacttgactggggtccatgcagctctaggctgagtcttgcagggctgagccccccaggcctgctctcctgtgtcctggccgctccgtcagtgcctgccagtggggtccagagggaccgtttttttaacgcctcttttgcaggtaatgagaaacatcccccctcttaatgtcttgcctcctccggcctaagtcgcccagcacacagcccaacttccctggcaaacttgcttttcaaactctcttctctcagtcacgggctcaggttctgtagtgctgccatgctttactcctctgtccctccccttatctagtctcccgcattgacttcataaccaagttctgggtccctgcctctggagtgcctgatgagacaaaacggctcctcgtcctgcatccccgctgctacttccagaattcaggcctcgtggtctggagcctgcactgttccatgagcctcctgagcaacctggagtcctctgtctttcttccctcaggtctgtcgtccacattccatcggctcagtttctaagtcacaaatctgtccccagcaatcctctagtgaaaacgctgctgggccttctcaggtttaagtcctagcagttcagggagtcggctcagctctccccacccttaagccaaacactctttgggttcacgctgtgctgttcagtcactggtccccaccagcctgctgttccaggtctccctgctttgcaccggcggttcccatggccttgtcctggtgcgctcctggcctccttcaaggcacaactttaaagtcaccttcacagccccactccgagtattagagactttcgtctccagctctgatagcattttgtacctcccctgtccccaccctacgttaggctcttgcaacccagggtggtaattgctctgtaagactgtggctgccgcagggtctcttgagttccttgaaggcaaggccggtgttttactcatttctgaaactgggtgcccagggcacagtatctgcttagtaagtgttgaatgagcaaagggcagctttcttgttttttctagtgagatgcgcctacttctccctggagaagcttgaggaagcagaaatgctggagatgaggtgaggaggagagggtccctctttatgggatgtaggccgtagggctgcaggggaccttcagatcaccagttccaagtcctatgtatgctagcatcccctcctgggttccttccccacaagaatggttgccagcttctgccgaacaccccagaatctgcttagagtggtttcagatcatgaatgaggatccccgggatggtgggtggccgttgctcctcccgtggcctcttgtttgaagaactagaactcgcataatgagctggatagccaccgtgtggctgctagcagggaagcccttggtggccacataagggctcccttttccaactctctcagctgctcctcactctcactcctgggtgtgctgggcagtggggtgcaatgtgcacgtaggtgcacactctccctgggcggcagcgagcagcagaggtctgatctgtggtcggatgacgagaggaagtgcaagtaaagcagctgcagcggtgagtgggcctaggaagaatggcatcaacaggccaggcagggatgcgggtggtgttcggctaaccctgagaaagggaccagaatgcacctgagtcttgattttcattcccaatagcaggtcagcacgaaacccaaaaacgctctgatttctgccttccatgccacactctcttcacctgctgccttctcactcctctcattaacaatgtcctggcaggaacaagactttcccctccctctcttctcgtctcttagcaggtcaggtcggccttcacctccctagacccgtcctgctcctgccttcccctgtggggccctccatggatgctctggagtcccgggcaatagtcagccaactgcagacatgcggggccttcttgggttccttgctgtgctcccttgaaaccactgtgcctgactgcaccccagtagcacacactgaactgacccccactcctggggccagcggtgtgtctcctcaagttctgcttgcttcttcaggccttgcttgcatgcctatcgtgccacacatcatatctcttttaggaagtccttgccttttccaaagatcctgctttgcagctgactgtaccctctgcctgcctcccccaggatactgcctccttcctgaaaccacagcccccgctcaggtcttccttccttcctcatcaccagggagccccctgcagagctcccggtccatcctggtggccttctgagcctcacctccccttccttcccctcccatcccttcccctcccctccccttccctctccccgcttcccttccctaccctaccctgcccccccaccccctgcccccaaccctgccctctcctgctctgtcctctccctccatggcaggctaacctccctggctagagctgtcccttgcgaatttgccatcaccttgcctctctgtgctcagcatccccggctgtgcagtccttctcttctgcccacatgctcccctagagaagcattctttttgctcagactaatttccgtgcaactcctcctgttttctgagcctgtcaccgccttcctcttcctttgcctccccactgacactttccagagtgcagccacctctcctcgctgtgcttttttgactctgaggcccaggaggaagttgcccttctctggagatggttcacgtttgatcctgcctagtgttccggggcacggccagtctgggaccgctttgaccctgattcatggtttcccttcagatgctttttggtcagcctgctttcctcgtctaggaaatggcttttgcccatttttctttttctttctttctttttcatttttttttagacggagttttgctcttgttgcccaggctggtgcaatctcggctcaccactacctctgccttctgggctcaagcgattctccttcctcagcctcctgagtgctgggattacaggtatgcgccaccatgcctggctaagtttgtatttttagtagagatggggtttctccttgttggttggactggtctcgaacttcgacctcaggtgatccacccgcctcggcctcccaaagtgctggggttacaggcgtaagccaccgtgcctggcttgcccatttttctattgagtcatttgccttgttggtatggagttgtaggagctctttctgaattctgcctctaaccccatgttggctttttgtatttcagagacctcgtccgcacaggggcttgttcttctgtgtctttgcagggctgttttggactcagtattcacctaagcactccaaattgtaagtaaccccagagatcatggagtgtcccactgcccctccatctgaaggctgtgacctctcccccaaggaggaggtgctcgcatgcgtccagtgccctgcccattagattagggagggttcccttttttgctctcttgcactcatttgtccgccttttagctttccttttctgccctgactctcacagggtcgtgcggatgtgcgatgtaggaggaggagagaggtaaagtggaggaataggagctggaggggaggaggagagaagaaaagaggagaaggagggggaagagagggagcgggttcaaggagggaaggaggaggagaaggagaggaggaggagatgagaccaaggagaagaggtgaaggaggagaggaggacacagaaaagagaagaaagaggagaggagacggagaagaggaggaggagtaacaaaggaggaagaagaggaagaggactagaagagcaagtaaggaggaggaggggggagtaggaggagaggagaaggacagaaggggaaggagaggcagatgtggaggagaggaggtggaggacaggaggggatgagaaagaggaggagaaaaggagaggagagggatgaggggggaggaggaagagaaaagaacaggaggagaagaggaggagaaaaggaggaggagtgaaagaaaagaggagaaggagaggagggggggaggacggggaggaagggagaaggagagaaataggaggagggaggaaaggaggagaggacgagaggaggagcagaggaggaggaggagaggaaggggaggagatttggaggaagaggggaggtggaagaagaaaggagaaggcggagaagaggagaaagcagagaggaggaggctgaagaaaggaggaccaggaggagaggacgaggaggaaaggaggaagaggaagagtggaataagaggagcagaggaaaaggaggagggggttggggaggagtggagaggagaggaggaggaacagagttggaggaggtgaaagagaaaagaggagaaggaggagaggaagagagaaggaaatgagaaggagaaaagtaggaagaagaagagagaagaggagaggatgaggaggaggagaggagaaggagagcaggaggtgggaggaggaggagagtaagaggaggaaatgaggaggaagaaaggaggacagaaggtggagaggaggaggagaggaggagaaggaaacgaggaggaggacgaggctgcaccacccttatcaggttccagttctcggtgcgccccgttctgcaagacactctcctgtggtcagccctggtctgcagaggattcccgcgctggatctctgaaggatgctggcgccctctctgcagcacattcctgatgcccttgctgacacgtgtcctctgggccctctcctgaaacctgattctccggggtgtcttctggcctcacctcttctgtccagttccagcaagctcactttgcttagcctttgaatcccttccttcactgtctgccatgacagttcaggcctttcaccgtcactcaggcctggaccatcactgttgcccatcccatgccatcaacaggtttgccccatcccttcggctccctaccagggcattcagttgtgttgagcagcagagtgtctccaagtccccactggttgagctgcatccgggtcccatcccacagggaccccctggccgctgcagatgcatgctgatcctgcagctcctcgagggtgtcatcgctttcccccttcccagacccagcacaccctgcctgcatggcgctgcgctgcaccttcactctggtcacgggtctggcagtcagctcaccaattcctcctgcttccctgggacttgccggcttttagcactgcaattcactcagcaaactgggactgttggtcaccctacctggcagccagtgataaggtgagggccactcctgggagggaggacacctgtggggaaaattcttgtgttatttatttctccttcgggatagggtgcctgcagcgcttcatgggagggggtgggctgatgctgcgggctcagaagtttcaagggcatctggggagaccagatattcagagaccttctagatgtgcctgttccatgtatcagggacgcaggttttcccaacagggctggtgtcattggcatgacagacctgccttggctgagcgttcacctgtctttggagttcagccaccttagcaagtcctgggtttgttcttcagactttgctgctcgcccattgcctggatcgggggctactttgtaaaccaccaggaagactccagtgtttctggttaatttttagatgtttgttaattgctcttggtctctcattaatcccctgtgggtcatccaggaaacatactcaccactgtctgttctctgagttttcatttccaggcatccgccctgcctggatctcctcacctgccaggaacttcctctccacaagccggccatcccagcaaaagttctaacaccaaaggtctggcaactagcctgccatcttgtgcctggagccgcctgcgtgccacctactcccgaagatgggaaccttgttgccagttgggcagatgcggggcaatcctgtaccaagaccccattttaccacctgctttctcagaccactctggaacccactgtctcagattgtgtcctccaggaagcagaccatgagagggagttggcagggccaaagatttactggggctaactaacactcaggaaagggataggaaggaaacagggctggagagcaggttgagcccgacctgacagtctcgagcagcccaacagggaggtgtggagcaagggttgcccactagaggggcctgcattgggtacgggtgatggggtccacatggtacctggcatatagcaggctgtgcaatccatattaactgactggataaattaatgcccagaaaaggtgccctggagaatgggtgtgtgctgaacacaatagggaagggcccagcatctgccttggcataggcagaactgtgctgtgccctgcaacaggccacctgagagctgctttgatcttgtgtgtacattagatgactgccaggggcatgaaggggatgtgcttccagggcatttgctggcagggcgtctcgtgatctcttggtattggtgtgagcacagcctggcaggagagggcagatctccatgcaaagtatgtcagaaagcagatggaagccaggccccctcctgaaagaggctccttgaaggtaggtgcacactcatgtctttgttacttgtaagggggcatcttacaggcaagaggagttaggtgaatgtgaagaggaaggaactactctgggcagggggctgggggacgcttcgtagaggagggggtgtttgagctgggccttgaaggtcaaaagggttttgttaggtgggaaatgggggaaggacagtctgaaagggttaggtacattcaaggagcccagagaaggttcgtggctggagcagacgcattcgtagagtgaagtcatgggagagaagaggctgggaaactagattggttccaactcctaaaggaccactgaaggagtgtgggctgcacgctgggtgcagcaggtgagtttcctcacttgggtttcactgtcagcattttaaaaaggcaaactggttttcttcctgagaagaattcattgattcacttgtggccagtaagtcatctgggccagaggttggtggggagatgataggggtgcaagtgtcatcttcaatcacagcataactgcccttgctttcttacctctcgtttagatatttcaatgcttgctcaggtcccctgcgccctccttccttctcccttcccagccatactacttatgggatgactttctctttgtaaaatgaccgttagtcttatcaaattaatcccaaagtaataccatcaatttccccctaaaataccaacaagacccctgcttgaaactgcttgtacattagagacagagaagagtccatgagaatcaacattttctgaggactccaactgtgtgccaagagagttcccctgctggtgcctcctctgtagtaaaggaaaggtaacattcctgcaaggctttgaagcttacagcgtgcttgcccttagattcttgtgttgtgttctgggtcagcaggaatgcctcgccaggtcctttttctcatcctaatgtgacactgaattcttcacaggctcctgggaccacattatcattctcttcactcgagagatgaggacactgaaattcagagaggggaagtgatttgcctcagcttgtactgtaagtgatcaaggcaggactcaaccagtctttttgaccctgactatggtgatttgatctctacaccacaagatggtggtggaatggtggaatatggtaactagaaggccctttctagctcaggacacatttgatgctgtgactgtttgggaattcagtcctgaccaatttaagaggttgtgtttcttagctgtctctggctcctggtttgcccagtttgattctgtgcctgcctagcaaaacctctctgtctgtggtctaagaagcctgacatctctgaactagtcctcttcctgtccactcaatatcgacagaatctcatggtatgtcctcctggctcagccatggaataaagccagctctgttgtttttgtccttgtgttgtgccccagcttaggaagaataactcttcaggctgcctctcccatgctaggtcacatgcaggtcacacattcccaggtaaattttgcactttgtttatctggaatttgtcttaatttccttgtccttgtttctgattgtgtactctcttcccttctgtctcattatctgggccctatgtcttttctcatggtttctcttctgtaagtctctagacccgatgcaagtacacagtgaagtgaatgaagttaaagataaagcttcagtgtctcttgcttgaacagccctggaaggagccctagcattatggtcctacagttgtatggtttggaaaatctacaaaagatattttaaccacagttggttcagggaatctttctttccactatgctgtctctatccctcttgcctgtgtgttgggtagcaatgcaatgaccatggtcatattgagaattcaactaaggggacattaagttgggattcatttagtttaggatatatttttgagatatctttcaggagtccacaggcaattccatatatttcccagtttttgccagctgccctttattggaatagcttgcaggaatacttctgctcactgtgctgatgcatccagtgttaggacaagaggggtgaggctgaagggtacattgtaatgtcactgtgacttgcagcacttggcatcaggggtatgttggcagtggaggagaaccaagattcacaatgtacagcaccagaagctagtctgtggaaaaatcttccagtcatcaatcagatgtgtaaaattgtaagtgaaggattccattttcactgaaaagcaaaagtgctctcttgtcagaaatatacccagcgtgcagtgtacgcaattgtaaatacaagatacatttatttgcacatttggaaggggattttgtgaaatggcatttttcagaattcctgtgattgtaggacatggacctgtagaaggactagaaacattgagtagtatgcagaagagttttgctgggcaggcacagaattaaactgcgcaaaccaggagccagagacagctaagaaacacaacctcttaaattggtcgggactgaattcccaaacagtcacagcatcaaatgtgtcctgagctagaaagggcacagtcatagttcctgtgactgctacccttagaaagacctgcttggaagttacgctccctgctggcatctggaaacttgactctcagaatttccctagtcaacagttaactgataagatggctcactgtgccttgactgttgatacagaaaacgtagtttatgctgaatatctgctttccttctgggagtctggaattttggtgcatgctaggcagaggaagtctctgttaccaaacaccagtgtaaagtgtgggcaatgagtctgggcttctctggccagaaacatcacacgtgccactgcatatttgttgccgagagaagcatgtgctctgtgtggcccctcatgggagggagagagcataaggaagtctgtgcatgggctcctccaaactttgcctgtcttttctgcttgtgatctggctgtgtgccctaactacattgctgtaataaatcttggttgtgattataactatatgctgaatcctgtgtttccaactataacaaacaagaaaagcaggaataacatactatagaagtgcatgaggcagttaagtactaaagataagtagctatttatgttatttttttctaaattttcagatgtttctaacatttgtcaacgttttcaaatgtgtgttcttttgttttttttttctcactttaaatatttgcttttgttcccaattttatactggtaattttgcattcttatacttaaagaaggccccagatgttacaagcttcaagccccacaaaacctggatctgtctctgtcttggatccaagacttgctgcctcatgttggttttcctgttgtcacttcatattacacagatggggaaattaaagccaagagaggggaagctaaccttacttggcaaaactgggacaggatccagttcttccaattcccagtttaatgagtgctctttccccctattctgtaaagttttttggtaacttgtctgtaaatatcggtcatggtacattgtccactgggtggcactcaagagattgaaatttgagttccttctctttgagtagttgggtagtcttgaactagtccctttccctcctgggacagattttcccagtttgtaaaataaaggggctggatttagtgctctttatagacctttctctctcagatatttcctgagtttttcattctagaaatgctggaatcatatatttgtaactgaaactagtaatcttcttgttcttgagtcttcttcatctctaaagtggacataaaatacatacctctcgtggttgttgtgaagcccgtggcactattcatggtagagcaggtgatcaaaagtcgcttgcatccttctgtccaattgggaacaaaagctttcatgtataattctcacacctctcccttggaatcagacaatcttatcagaaaacctaaaaatttttttcaatcaatttagaagtttattttgccaaggctaaggacatgcctgtgacactgcctaagaaggtcctggtgacatgcccaaggtggtcaggccacagtttggtttttagggagatataagacatcaactgatacatgtgagatgtacattcgtttggtctggaaaagcaggacaaatggaagttggaggacttccaggtcataggcaggttcagaaattttctgactggtattaataattggttgagttattatctaaagacctggaatcattagaagggaatgtctggtttacgataaggagttgtggagaccacagttttatcatgcagatgaaacctccaggtagcaggcttcagagagaatagattgtaaatgtttcttattagacttaaagagtctattgtatcagtcttaaggacagtgttcatgttgatggtaatgaggcatgtccgactcccccttcctcatcatgtcctgaactagtttttcaggttaactttggaatgcccttggccaagaggaggggtccattcaggtggttggggagcttagaattttatttttggtttacattctttccttctggccaggatttgccagaggcaacatcaatggacaaacttttattttgtcccatagcattgtggaggtggtttggctgcctgccccaggtccatcctgtcccttggtaggatctctatggccaagagacttacagccaaaagacttatagacagtttaaatgttctaggccagacaggaatggacgtggacaggcatttattactccttaacaattttgaagtaatgtaaaagccaacaaacagaaagtaaaaggcgaggttacaaaattgccttatctatctttaacttctatgcattgagctactgtagtcttggttttagttacagatttttagcaattggctatataagcaagcctaaattttaaaaagaagagaaaatgaagcatacatttaaaagttcttaaactttttttttgaaacagggtttcactttgtcactcaggctggagtgcagtgatgtgatcatagctttctgcagccttgacttccgggctcaagtgatcctcccacctccgcctccttagtagctaggaccacaggcatgcaccagcacacccagcaaattaaaaaaaaattttttttaaagatgagatctcactatgttgcccaggctggtctgaaattcctgtcctcaagcaatcctcctgccttagcctcccaaagtgctgagattacaggcatgagctaccatgcctggcctaaaacatttttaatggaagtataatttgcaaacagaaaacatgcccaaatattaagtgaatgcactgatgaacattcacaacttaacaagatagccagcacttaaatcacaaaatagaacaccgctaggacctctttgtaataccctccaagtcactacttctgcccaaaggtaatcgctattttgcaacattttttattactttatataaatgagatcgtacactgcgtaatcttattactgtctggatttttatattaaatattgcttgtgagattcatccatgttgtcatgtcagcaatactttattctcattgccatatactattccatttttatcagtataccatgatatatttacccattctgctatttgtacatactggaattgttcccaggtttttgtaatacaagcaaagctgctatgaacatgcttggatttactttctttggtgaatatgtattactgttatgtacatgtctagaggtaaaattgatgatttatgggatatgcatatgtttaattttagcagatattgaaaaacagatttttaaagcggctgtagcaatttacattaccaccagcaatgtgtgagttccatttgctctccgtccttgacagcacatgttgtcacttaggtgggtatgcagggggatccttttttggcatgtttacttatttttttacacagtgcaaactggtgtggtgtaccgttttatggcttttgcctaatgccatcactaaagttaccaaacaattccatcacctcagaaattgctttgtaccgcctcttggcattcatccccttctccattctcaaccctggcagccactgatctaatttccattcccatagttttccagattatcaaagaaacagaatgatatggttgtaaccttttggatgtagcttctttcaggtagcaaaatgcttttgagatttaactatgttgttgtgttttcagtagttcattcctttgtgtgtgtgtgtgatagtctgactctcttgcccaggctggagtgcagtggtgtgatctcagcccactgcaacccctgcctcccacattcaagggattctcatgcctcaacctcccaagtagctggaactacaggcgtgcaccattgcgcctggctaatttttatatttttagtagagacaaggtttcgccatgttgaccaggctggtctcgaactcctggcctcaagtgatgcacctgcctctgcctcccaaagtgctgggatgacaggcgtgagccactgcacccagtccagaagttcattgctttttattgctgggtcatattccattgtatagatgtatcacattttgtttatgagtcctatagttgagggatacttggtttgtttccattttttctctattatggatacattgttataaacatttgtgtacagggtttgtgtgaacatagtttttatttcttttgagtaaataggagtgggattgctgggttacttggtaaattgctgggttatagttctttttgagaacttgtcaaacttttgctgagtggctataccattttgcattcccactaggagggcttgagagttccagttgttccacattcttgccagcacctggtactgctagtttttctgtgtgtgtttttgttttgttttgccactctaaggtgtatagtggtatctctttctggttataatttgcatttctctaatgattattaatgttgaacatcttttaacatgcttatttgccatccatctaacttctgtggtaaattttctgtttatattctcgtccattcaaaatattgggttgcttgttttcttatggttaattttaaaagctttatttggaaataattatagatttaaaggaagttgcaaagaattgtattcccttcactcacccttccccaatgttaacatcttgcctaactatggtacaatattagtatcagaaaattgacattggtacaatccacagaggttattcagattttaccagttatacatatacttgtgtgtgtgtgtttctatgcaattttatcacatgtatagttttgtgtagcttccacgacaatcaacatacagaactgtgccatcaccacaacattcctctcatattacctctccacagcctcacccacttcctactctacatcccttacccttatcaaccactatttggtttaccatctgtataatgttgttattccaaggatgttatatacatggaagcatactatatagtatgtttccttttcatatttgctttttttcccactcagcataattcctggaggttccttcaagttgtgacatgtatcaatagttcattcctttttattgctggatagtatttcatagtatggatgtactataatttaagcattgtcaattttggtagtttccactttgagctattccaaataaagtttctgtgaatattcatatacaagtttctacattaacataagttttcatttctctggggtgaatgcccaagagtgccattgctgggtcatttggtaaatatatttttttgtttttctgagatggagtcttgttctgttgccaggctggagtgctgtggtgcattctcggctcactgcaacctccaactccctggttcaagcgattctcctgcctcagcctcctgagtagctgggattacaggcatgcgccaccatgcccagctaatttttgtatttttagtagtgacagggtttcaccatgttcgccaggatggtcttgaattcctgacctcataatctgcctgccttggcctcctaaagtgctgggattacaggcgtgagccactgtgcctggccaatccatttttagtgtttaaagaaactgcaaaccaccatggcacatgtatacctatgtaactaacctgcacattctgcacatgtaccccagaatttaaagtataataaataataatactaattttttttttaaaaaaagaaactgccaaactattttccagagtgattgtgcagttttacattttgaccagcgatgtcagtgatccatttgctccacatcttcattagcatttggtgttgtcacagtgttttattttagccactttgataggtttctagcaatatctcattgtggttttaatttgcattttcctgagggctaatgatattgaacatcttttcatgtgcttatttggcatctgtgtatccttttcagttaaatgtcttttgcctcttttctaattggattttttttttaatgttgagttttgagagttctttatatattccagatataagtcctttgtgggatatataatttgcaaatttttctctcagtttgtaatttgtcttttttcatctccttgaaagagtttttcacagagcaaagtttttaaatttgatgaggtataattttcaatttttacttttatgggtcatgcttttgatgccaaatgtaagaactcctcacctaatcttatgtctgaagattttctcttgtgtttttttgaaaagttttacatttttacatttcacactatgttccattttgagttaaagtttgagatttaagtcaaggctcatttttctttttctttctttccccccctccgccatgtatgtccagttgcttcaacaccacttgttgaaaaaactctgcctcttcctttgaattggttttgcacctttttcaaaaatcaattgggcatctttgcatggatctatttctgtctctgatactctttttcgtctctttttaagagtcagtgtctcactccatgcccaggctggagtgcagtgatgcaatcatggcttactcctaggcttaagcaattctcctgcctcagccttctgagtagctgggactacaggtgtgtgccaccatatgcagctttttttattattattattttttgtagagacagagtctcactctgttgcccaggctagtctcaaactcctggcctcaagtgatccttccaccttggcctcccaaagtatatgtttgctattctgttctgttgttctatgtgtctatacctccttcagtaccatactgtgtggatcattattactgttgaattttgagggttttttttttattctggatacaagttcttcttcagatttatgatttgcaaatattcttttccagtctgtggttagtctttttattctcttaagagtgctctttacaaatatctttcttttattaatttccaatatcgcctgataacgttctttttttttttttttttttagacacagtctcactctgtcacccaggctggagtgcagtgatgcaatcttggctcactgcaacctctgtctcccaggttcaagcgattctcatgcctcagcctcccaagtagctggaatcacaggcatgcactagcatgcccagctaatttttgtatttttagtggagacagggtttctccgtgttggccaggctggtcttgatctcctgacctcaagcaatctgcccgccttggcctcccagagtgctgggattacagacgtgagccaccacgcccagctcctgagaatatacttttaatgatttcagttcttttaaatttgttgagtttttttatggcccacagcatggttgatctctatgaacattccatgtgctgctgaaaaacgtgcattggatgtagttttaaaaatacgtatcagttaagtcaaggtgaatagtagtgctgtttaagtaatttatgtcatcactaattttctgcctacattttcctgcagttactaagagagaagtgttaaagtttcccattataattgtgtatttgtcattttattttttcagtagtgtcacagtttgtctaatatattttaagctctgttaagtacatgcacatttatactttttatatctaattggagaattgacctctttattattgtgtaatatctcaatttctgacaacattctttgttctgaagtttactttgtctgatattactatagctacttctgcacaatattttacttctagtaatattttagatcagataatttatttctttttagcactcttgatttgtttgtgaagatttatgtttccatctaatatattccttcggtataaaaaaacctcttaaagatttcttgtagtgtaggaatactggctaggatttccatcattatttttgttttcctgagaaagtccttatttctccctcattttaaaaatcagccttatggtgataaaatttacataccataaattcacccttttaagtgtacaattcagtaacttttagtgaatttacagttatgtaaccactaacataatctactcttaaaacattgccatcacctctgaagatccttcatgccagtttgtagtcagtcaccttcctatccccaaccctggcaaccactaatttactttttgttattgtagatttcctgtctttggaatttcctataaatagaatcacacaatatctagtcttttgtatctggcttctttcacttagcataatgtttttgaggctcgtcaatgttgtagcatatatcagtattttgttcctttgttttgctggctagtatttcattgtatggatgtatcatattttgtttatctgtttaatagttgataaacatttggattgttttcactttttggctattgcgaataattcagtcatgagcatacttacaagtctttgtgtgaacataggttttcattttatttattgcctaggtgttgaattgctggttcacatggtaaatttatatttagcatttgaaagaattaatggccaaactgttttccagagtggctccatcagttaatattcacaccagcaatgtcatcttctttattttttaatttattattatttcaattgttttttggggaacaggtggtatttggttacatggaaaagttctttcgtggtgatttctgagattttggtgcacccatcatacaagcagtatacactgtacccaatgtgtagtcttttatccctcacacccctcccacccttacccatgagtcctgagtccattatatcattcttatgcctttatgtcctcataacttagctcccacttataagtgagaacatataatgtttggcttttcattcctgagttactcacttagaataatggtctccaactccatggaggttggtgcaaatgccattatttcattcctttttatggccaaatcgtattccatggtgtatgtgggagatatatatatatatagatatagatatatatctcacattttctttattcactcattagttgatgggcatttaggctggttctatatttttgcaattgcaaattgtgctgctatgaacatgcatgtacaagtgtctttttcatataatgacttctttacctctgggtagatacccagtagtgattgctggatcaaacggtagatctacttttagtgctttaaggagtctccatactgttttctgtagtggttatagtagtttacattcccaccagcactgtaaaagtgttcccttttcaccacatccacaccaacatctattattttttaatttttaaattatggccattcttgcaggaattgtgtgtggttttgcctggcttatgatctgggaaacttgcatcctcctgttagtatgtctagttagctctgagaagtggcttggtttaatctagacctccttttctaaacacgtagaaattcctagggaaaatgaaatgttgttctatcactccaaggtttctttggggtcttttaagggataggttcctcttctgaaagctcaaagtcacccgtgattctgggtaagagcaggagtaggttaacctaagcagttgctcaataggttcatgcctgtaatcccagcactttgggaggccaaggcaggcagatcacttgaggtcaggggttcgagaccagcctggccaacatgatgaaacccccatctctactaaaaatataaaagttagccgggcgtggtggcaggtgcctgtaatcccagctactcgggaggctgaggcaggagaatcgcttgaactcgggaggtggaggttatagtgagccaagatcgaaccactgcactccagcctgggcaacagagtgagactgtgtctcaaaaaaaaaaaaaaaaaaaaagcacaaaggactgttcagtacttttacattagctaagaactaatttacgctaacttcttttttatatgcaaaagatagtcataggatcttaataagttgtgtaatcatgttatttgagattgtatactatatgtagctcatgtcacattagttattttcacctaaggataccttaacattaggcctacagaaaattaatataatacctttgttctctgcaaaaggctacaacaagtgatctctagaggtgttttctgactctcaaatctctaactcttggattctgcctcatccagaaaggtttgggttaccaaagcaaagtaccataaactggatgacttgaaaacaacagaaatttatttttcatagttctggaggctggaagtcttagatctgggtgctaatatgagttctggtgaggaccctctttggggttgcagatggccatcttcttgctgtgtgttctcacacagaagaaagagagtgagctagctctctggcctgttcttataagggtacttatctcatttaggatggtcccaccctcatgatctaatcaccttccaaaggacccatttcctaataccatcaccttaggggtcaggatttcaacatataaattttgcggggacacattcaatccataacagattctttcctgttattattttagaatgacatggactctttcccagtccatttgggttaggattcttattcagcctggaggcagagccgtaccctgtatggcctatcacattccttttagcctgggtctctggttacttgtagaacccttatttataattattgtctaatgctgggattctccagagtgctgcttggagaaatttagcctcttagagacagttgcaataaaagaattctatcaaaaagaattcactgaattgtgatcacaaacaaaataactttgtggggataaaatgtactccaacaagggaggcttatgtttgtttttcagcctctcctcccagtgctgcacttctaatctctctgcagaaagaaacatttcaacagagaacccagtggaaattatgacatgttatcttctcagagtcctgaactcccatccctacctcagaagagactcctctgttcacagaagctaaaggcagttccttcccaatggcaactatgtttggatgttggatctacactttctcaagcactgtgatcttcaaatgtaagtttagtaacataaatatctttttgcagcctgaaagaattttatgtctctgtgttatcaggtaatgtttcagtatctcatattttgctggtaacatttagaatgttaatctcataaggagattttagagttatagttaaatttctttatctgggttagatgggaatcctttattctggggaaagcaaagttctttctataagcctgggttctcataatatacagactgggaaacttgggaaagagtaggagcatcattagtttcattttataggtgggaataacaaagcatggagagacaaacatatttgccaaaatagttattctcaactccttgttttgggaattctagagtgtttcataggatttcaaagtacctcacaaaattgttctaaatttctcaaagccaaattcattttaattaactttaattttttttgaaaagttatagcattcttgggggtaggataggtacattttataaaaacaatacaaacaattgttttgcttagaaccagtgaaatgtcaaaactccaaaaatgtttgggaagcactggattagtcagtagcataacaagcaataaaacaacccaggtcaggtgcagagagatataaactcttgtctcatcctccatagatctgtattttcaaaggcagagtcttgtgtgactgcatgtctgaggatatgtctcttctggacagggtttttacagtacttgagaatgatcctaacaaccttttggggtgactcaatttttttcactgctagagaggtaaaacaaatattgatacagttgaacagtgagaaattgagtttggctggagcacaggcacataatggtagaattatgagcctgtgctaggctgtgtgggtttggccaaattgggtcaagtgaaaacagaaagatcagttagaaacttgcaatagtttcgataaaagatgttatggcggttgtccaactttattgtgaactctcttattgtactagtgtttaaaagcagataagctgttacctcttgaatcccacaggctgtctagttatactggtcaggatctcttccagctcaattttttaaaaaatcctttgccttgacttccaaaggcacctgttaagagtggacttctcaagctgtgtaaagtacttttggcataatcaagtctatgttgttccatgaagctctaagtccagagtaactgtctttagttgatcatattgaaagcaagaacatcatttcaaacaaaccaagtctgagatatttaacccacatgtgctttcagacctggtatgtatgagcttgagcaatgaagccttattccattttgatgttataaaaaatggagggatttccctgcagtcagtttcacagccactatttgacttatatttgaagggggaaagataagggctgtgttcttttgatctgaatttttctgttcttaaaagttttcttttctaagaacactagtcagtacctggagacactccgacatatttaaagaattaatttgctttattgaaaaaagttgtttctttaaacatttaaataattactttttcttcagtgacaaattagtttgctttaatgaaaaaaaaggtttttttcataactttcattacatgaacctttagcaaaggagatttctcccattatatacttcttatgatcaacaaattccatcatctccccactaagagaaagtactccaagatgatagaatgattttaaagttatgggactacaacagcagccacaggaaccttgagtaagtaccatgaaccctgaccctcagcgttaatttgtaagcctttggcagtgagatggaatgtcttccttcagtttgaaacaaaggaaacctattgcatcgcacgtaaatttgtatattgatgctatattgactttgtagctgccatgccttcatacagacacctcatccagcccccactgttccacttattgtgatggtttgtatatctttatttcaaagaagatctgtttgaaccgtgtttaatttcttctttgacctgctttcatcactgcccatgcctaccctggtggcattctcatccacgagactaccacatccatgccactaggtggcattctcatccatgagactactgcacccgtgcgcacgtcaagaagtagccaagccatgggctggattgtgcttttcctgagaggatgaaaggcttcatggatacatgctagtatccatgttcctctattctcaagtcaggcaccaagatgatgtttcatacctgcctgcctttcaaagtctcataaatgttcattgaatatccactctatgcaaggcactagggtagtcacagaggcaaggtttgagctaaactacaggccctgccctccaggagctcccggtctcatggcagggtgcagaagccagaatagagggccatggcatgggagagaactctgctgaccgggagctctgaagggttaggggtccatgagcctgatttatggggtcgttgccataggattaggggctccctggcatacagtgaatggagagactagcattgctgtgttatttcactgagagggcaccaatgttcagcctctgagaccaggggaggaaagcagtggccatgaatgttccctcccatcccggggactgactgggctcctcccacagtctcagacacagaggaagaagtgtactcacactgccccaacaccagtgagtggaaatatttataggtctctcatttggttttaatttttatttttttatttttcagaaattaaaaaaaaaatcacactcacaaaattaaccattacccacattcctaccaacaagaagtaaccattcttaaccttgtaatatgttggtttccagatttatgtttatgctttaaaaaattatgcagacaacatattagcacattgccccttttctcatttgttttaatccatgttcttcccatttatacaggagcaattcttgcattcagttatgggatactataaatgcctagtataatggcagcagagagaattactatggttgtataccttttctcgctccttgctcctcaaatgccttagagtttaaaatctattgtggaaagtttgtgaaatgcagaacggtgaaaataaacaaattaccagtggttctttggcttcgggagaactgtaattgatgttcattttggtatatttccctccagtattttttccatatggttttatttttaaaaattttaccccatatatatatacatatatatatacatactaactactcacaaaattaaaaattaaaaaaattaaaaatgtataaaatgaaagaaaaaaattagcctcattttgtatttactattttataatctgcctttttgcttaatcttctttgtcattatatgttcttctacctcatgatttttaatagctgcctagtattccattgtatagccatagttatttcatactttataattgctattgctagacatttagttggtttcctttttttgcttttataataatgtgtgttcctatacataaatcttgtaaatgtctgattttaaagataaatttctagcagcaaaacttcttagttaagaacatatacattaaaatacactcttattatatttttctttaccaaagtaatatatgtttattatagaacatgtacaaaatcacagatatacaaaaaaaacagcatataagttacttgtattcttcccactcagagacagccactattaacattttattgtaaccatccagccttcttttctctgtattctacatgctctttcataagctttttttattgaatgtattcagaatacctaagttcattgttcttttttaccttcactggttacatggcatttcactgaatgaacaaaccagaatttgtttgatgaatcttctaatgctggacatttcagttactttctgtttttctgtactataaacaatgcagaggtaagtagtgtgtgactacacctttccaagtccttgattgttccctgtgaagaaattcctagacgtgcaactgttgtttcacctgtatgttaatttttaaggcttttcatgggtattactaaatgttcctataacaatttttatcttagaggcagaatattggtatatcctttttttcccaaattcttgatattactattttgccaatttgactacaaagaattgattatcatattttaaaattaacatttatttaattacaagtaaaactgaactatttttttcttttttgcccaattttatgttttggtataggtttttccttgtttattaatagatttaaaaaataaatttgaaatattaatttcttgtcatttgttcaggttttctccttcaactgattgttgtgatgagttatatgtctagacttcctgatagtaaattgcactcctgaaataatccctccttgctcataatgtcttgccagatttggcttgctggcatttcatttaggatttttgcatctatattcctaagtgacattagtcttcagttttctttctctgtgtatttgtgtgggtgttcgtcaggttttgtgatcaggataactttaattttataaaatgaatgggcttattccttcttttattttataatgagaaccgcttttagagcatggaaattacctgttctttgtaaattaaaaagaacttgctcataaagctgtctgggcactgtaacaatcatcagaggaaaatgtgtaacaccctatttttccccacgttttctacttctttgtgattccagttagctaattttcctagaaaattgtcctttttattgagattttcaaactcgttaccatctttacagttttattgagatatgcatacaagtcacccatttaaagtgatttttagtgtattcagagctctagaccatcaccacaaccaccacaatagattttataacattttgaaaaccccagaaagaaaccccatgcccattagcagtcaccctctatttccccttaattcccccccttgtcctagataaccactaatctactttctatctccatagaattcccctattctggacctttcatataaatggaatcacacactgtatggtcttctatggcagccttctttcacttagtgtaacgttttcagagttcatccatactgtagcatgtagcagcactttattctctctcttttttaagttttcgtttttgattaacagactactttttagagcagttttaagtttacagaaaattgagcagatagtacagagaattcccttatactgccctcctctccactcctgaccataattttgcccacaaacatcttgcattggtgtggtatatttgtcataatcaatgaattgatattgacacattatgattaactaaagtccgtacatttgggttcattctttgtgttgtacagttctatgggttttgacaaatgtctaatgtcatatatctaccattacagtatcatacagagtagttttgatgaaaaggtaaaacacaggggacttttagggcagtctttccctcctccctgtgaacacctaccaaccactgatcttttgatttgcctttcccagaatgttatataattggaataatatagcatgtaatcttttcagaggcttctatcactaagtaatatgcatgtaagcttcttccctgtctttctttggcttaatggctcatttctttttatggctaagtaatattctattgtatggatttaccacagtttatcccttcaccttttaaagaacgtcttggttacttccaatttggggcaattatggataaagctgcttcagtcatttgtgtgcaggtttttgtgggcacataagttttcacctgatttaggtaaataccagtgagcatagactatgtttatctttgtaagaaactgccaaactggcttccaaagtggctttgtaattttgcattctgaccagcaatgtataagagttcctgttgctttacatcctcgccatcatttggtgttgtaagttgtttggatttttgtcattctgataggtttgtactggtagttcatggttttaatttgcaattctctgataacatacgatgttgagcatctttttacatgcttatttgccatccatacattttctttgatgcgatgtctgtttagatatttttcccatttttaaattgattgttttctttttttgtatagtggatacaaatcctttatcagatatgtgttttgaaaatatttctcacactctatggattctgttttcattctcttaacagtacctttcacagagcataaggtttttggtttaattttactaaagtccagtttctttttatggctaatattccatcatatggatataccacattttgtttattcatttatcacttgatggacacttgagttacttccttttggctattgtaaataatgttgttatgaacatttggtagaagttttttttttgaaacggagttttgcccttgttgcccaggctggagtgcaatctccgtgattctcctgcctcagcctcccaagtagctgggatcacaggcatgtgtcaccatgcctggctaattttgtatttttagtagagacggggtttctccatgttggtcaggctggtctcgaacacccgaccaaggcgatccacctgcctcagcctcccaaagtgctgggattacaggcgtgagtcaccgtgcccggcctggtagaagtttttatatgaatatatgttgtcatttctcttgagtagatacccagcagtagaactgctgagtcatatgataactcaatgtttaactcttaaaaaaaaaataaaaaaaaaactgaacaacttttccaaagcggctgcaccattttatattgccatgcctcctacattgctagtggcattttacgttgtcactagcagtgtagacgggttccgttttctccatatcctcaccaatgcttgttatcagtattttttgttatagccattgtagtgggtgtgaactggtgtctcattatgattgacttgtatttccataatgactcatgacattgaacatattttcatgtgcttattgaccatttgtatatcttctttgcctcttcacttttgatattcttttccatgggaatttcatggatttcactaaaatctttgtgcagatgatttccaatatttacttccaactttgacctttctcctgagattgtcgcagtttcccatctgtttcttagccattaatgccctaattgcagaatcagtgtgtcacaactgaaattcatcatctttcctcccaatcaatttattcttcctctgtgttccttatttctgttaatcatagattaactaatcttctaatgattagactattcttctaatcatccagactttcaatttggcatcatatttacatgtaagagaaatgagataggaaggaatcagtttgttgccaagttccacattactttcataatattttgcatatgttttctctttactttgtattctctccttcctgatctctatcctcttctgacttttttgatcccttactcttctggttctcctgtctttgatcgttttatttcaggttattcttatctgccccttaaattacctatctgcaagatctcagctcactgcaacctccacctcctgggctcaagtgatcctcccacctcagcctcctgagtagccagtaccataggtgcacaccaccatgcccagctaaagggtttcaccatgtcgcctaggcttgtcttgagcttctgaactcctgagctcaaatgatccacctgccttggccttccagagtgctaggattataggcatgagccactgtgtccaaccgtccacaatcttttacaaatcaatgtttaccttccttcttggctatttgtatgtagtcttaagatatgaactatcacttacacacataactcccaaataaatatttctagccttggaatattctgagaacttcagacacatatatcaaactatctgtaggacagatgtccaactggatagatggacatttgtagaatagatgtgcaattggatacatgtccaaacttaactctccccaccttagctgcccccaaacttgttcctcttgtcatatttccagtcaatggcatgaccatccatctgggttctcaggacatacatctgaccatcattcctcctttctccctctcccctaaagccaaatattcaccaagtcagtactattctaaaactctctttaatattctgtctttatccccatgctgcttctttgtccaggcttttatcatctctcatttagactatttcagtgattttcaatcttgcctttctgtctagtctcttaccatgccccccaacccgcttcgtgcagtctactgacacaaagtgaatttctaaattgaaaatttagtcatgccatttcactgcaaagaacaaatcaaaataagaacaagtacaacaatatttactgtctctctggtggctgcttacttttctaaaggatatagtttaagctctttagcctgtcatattgtactgctccctacctacttcttcagctttgtctcttgtcactccagaaatattcttctgtcttttaatgtgttccctctgctcagatgcttcttcctgccttctttacttagtgaaccaccatctgagatttcttggaggtagacacgatcacatggctggaatccaaaagggatggtcgataagaaccggcttcagtgaatgtggatttacatactttctgggagctctgtatgtaaaggaaatgcttccagcccttcctcgcttggctcttggcatataacttctgatggctctcctgctttagtagtcacttttggagcaatgagagatcagattcctttagtggcctgggaatgatgtcacatggtgttattgatagaagcctgcagagcttgggattctgagaagcaatcttcagactagaacttaccccaagagaatgagcaactctatggtagagggcgagagcctcgaacaggcccaataacctctagtccaaggactttgggaagttttatggtcccttctaggcctacaggatacaagcactcagggatagcagtgtttttgggtaaagaacagtgcggggctctgggctcaaattcctgggggcaaacaaatcaatttggctcccctcagctctgtgggactaaactttaaaactgcccctgggagtgacctccccaggataatctcagggtactcagtactcacctgagtagacaagccccaggaagacctggatgagtctttggaagtcatctttttagctcagttttgcctgctccaccaggatccacaccctttactatggaaatctgagtacgagttagggcagatgtcagtgaggagaaggattggagctcagtgacctttcctcagtagtgcttacttgtgaagcctgtgtccttaggaaattagcgctgcctctgccaaagtggctttttactgtgttatcctttcccagagtgcacttccagtctcgtttaggccagtgtagttcctgttgagttaagtggctgtgaaaaaaatgttttctgaaaggaattcggaggaaagataccttattccagtgaacagtttgcgaactcaggagacacagccttttgtataaaaggaagttatgtttcagagaacaaagagagtgtttgggttttatagcaaaagtttctgcctgagttcctaatcaggtttatttatgcaaatgaaatattgaaatgggcttagttctagttggttgatgcagctaagttctgattggtaaatacagctaagccctaattggttggtataggtgagctctgaaagtcccaaagttaaagagaggtgggagtttttgggaaactcagagtgacctttagtcagcaaatggctgcctggctgtattttaaatttaggcccagttagccacttgggatccatcttgaaggattgactcttttaggttcatatttgttcacatgtggctttcttcctctgataccttggtgagcctaatggagactaaaagcttagttaactttggctttagggaattaaattatttctggctgagacactaagtagaagctaaaattgcagaaatatctttataatactatgtgagagtttacaaaaactctcacatacattattcaatttattaaatcttcacacaagctagtgcctgtcccttagtaatcacatgtttagtgtatgaatgaacatggaggtttttgttttattttgctttgtagagagacagggtgtctctcactcttgcccaggcaggagtgcagtggtgcgatcatagctcactgcagccttgaacttctgggctcaagtgatcctaatgcttcagcctcccaagtagctaggactaaaggcatgcaccatcactaatgcctggctgtttttttttttgtagagacagggtttcccgggcatgtcttgaactcctggcctcaagtggtcatcctgcctcagcctctcaaagtgctgggatcataggcatgagccaccacacctggccaaacgtggggatttattgtgcctattttacagtttggcgaactgaggtctaagcagctgaattgagtttcctaaaattcaactctacagttagccaagtatggagcctacacttgaaattagatccatttcaggtgaacatttactaagcatctactaagtgacaggtacttatcagtgatgaataaacatgttccttggttttgagagcttataggcttgtcagaatatgagcaaataatttcaacacaatatgctaagtgtcatgatagagaactttgtgtgatgccgtggagtcatacggaggggcacctaatccagtctgataatgttgtgaaagactacctgaagaagtgacacctcagttaagttttgaaggttcattggagattggccaagggtaaagatattctaggctgagagatcagccccagtcagggcacagaggtgcaaaccagtatggtatgtttttaggattgctggagtattccttgccaaggggaaaatggcagaaatgatgacttagagaggtaggtgagattcagatcattgagtacgtagactttgctttgtacaccattagttactacacattgctgaattattgaaatcatctggggaacttaggcattttcttagttagctagatttgagagtcacatgtggaggcaatgagtgacatagactgccctgttgcatcactctggtgacagtctacatggaggcaggtagatttgaaagggatgctactagacgcctagagaccattttgaaggtcactgaattcatctaagagatatggtggactgtataaggcagtagcagtgaggacagagaggaagaggcagatgcaaaatggtgaaactcttacgatgttgtggggaggattggtgagggagagaaaagtgtctaaggtaattctccaggtttctggcatggctgtctgagtagatggtggtatttttgaccaagttcaggaatgaacagtggagatagaatgtacaaaaaaattggataaattcagcttggaacctgctgaatttgaggtactgtgggacttccagaggggagagcagctattttgttctggaactcaggatgtgtctaggctggaaatacaggtcaaggcctctatgtctgggcagtttaaacccaagtgaatagtaagacatctctcagagagaatgtgtggagagtgcatcttcaataattctaccccctttcgacttcaaaggctgttcccatggggaagcagaagcagcgtatttctctctctctctttttaatgtttgaggcaacaagggatactgaaaatgctataaaaggtggagttagaaaacctgagttcaagccctgcttctgacacttcaccactctgcaaccgtcagtagttcctgagcctctcttagcctccaggtcttcatctgtgaaacaagggtagtaggaataactgcttcacaggattattaagatagtccaatgagaatgtgtatgtggaaagtgctgtgtaaagaaccatagaaacatcatttttgttgttgttgttgtttgtttgtttgttttgtttttttcccctagaaacttggaccaatatgtaggaattacggggagacagatttggtccaatataaggaaagactaatactttgactgttggatgatgggaagagctttgggagatgggaagctctgaggctctggatatccttaagcaaaagccaggtttctgggcatatgctgagcgttttgttgtcaggggttgggtcatcctgcatgacctctgagttacctttcaggctcagatagagtttgagttactagaacacttatctacctattttctgaaattttctacactaagtagattttttaaattgtaaaagcaatacaagcgcatggtctttccctttgactctcttaaagtactgggcattttggatcctaagtggagacttggtttatataccctgaataatggggcaaactgcctcatgtcttactgcatgaggcatttatggacagacattttcttaatgttctttaatgagatctctttaaaataataatttttttcttattttcaagcagaaatgatattataaaaagctaacaaaatattgccaagtagaggtcttgatcgagtatactccaatgagtaggtaaaggtcatttgaaatcagcacactaattatttatatgcaaatgaatttgttagagagcttggaaagagttgttctctgaactgggttaaacatcccctaagagctcatgtttatactcttaatttactcagaaacctgttgttgctctttctttttttttttttaattatactttaagttttagggtacatgtgcacattgtgcaggttagttacatatgtatacatgtgccatgctggtgcgctgcacccactaactcgtcatctagcattaggtatatctcccaatgctatccctcccccctcccccaaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcatttcttatggctgcatagtattccatggtgtatatgtgccacattttcttaatccagtctatcattgttggacatttgggttggttccaagtctttgctattgtgaataatgcctcaataaacatacgtgtgcatgtgtctttatagcagcatgatttatagtcatttgggtatatacccagtaatgggatggctgggtcaaatggtagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacctagctctttctttaattgatagaggaaaggtgaaatatgccagccatgactgagttatcacaaatttagaaatggcatgaattgaatttatactttcctgtgtttattttattgccaatcactgatgtgacacacatttgctaaacaagttctaattttctgggtaactttccctacagaaagcttatttcgctaaatgaaagatctctactcatgccatttaatgaggaattatctttatgattgttgaggtgtcttcctggctctttgaaaaaatcacaaaaacaatagccccaaataatagtgattttatacctagaaaatattctacaaggaataagttgctgtaaaccatatagaggtgaacaattttgaaaagtcaagaatttaggaaagtacattcagtcttaattatggtagaataaaatttcatcttcctgatgcttccataggcccttcaagatgtttgcaaagcccttggtcagcttttgattattttttcattgtactgtatctatgaaaaaggttgccattgggaaagcataagtaggttgtgttttgcaattccttcttgtggaaggaaattgatagaaccttctagttgattttttgaaaaagtaaagatgtttaaatactcttgccttccctaccttactccacacttctggttctcatctacaagaactagtgcaccaagggagagagtactccagctgtggcgtcctggactttgaatcctgggatgagggggcaggtagggtagaggattcaagaacagaggaattatggagggatggaagctgggagggaggaagaaagagtaagaatctaaaaatgaaccaagggaggagccaaagagtgttggtcttgagccagatcacaggcagttgggtcagggttagaggtaacagttgtaaggaacaagtctaagccagccaaaccctggttgagccatggtgtccgaccttgtgggggacccctcagtatctttcttaatgcaacacattgttaaactttggtctgaccccagggagaggctgagcagctcagtaagcaggccattctttaaaagcctgagtgtctattcactgacaaccctgtggatctttctttgtatcagtaaattaccctatacaactcatgtccagacattttatagcagtctcacttttggtgggggtgatatagtgtgctgggaagagctctccatggagatttgtgggagagggggcaagaggcttgggttttagccagtgctctgccactaattggccatgaaacattaggcaagtcatctaaatgtttggtgcctcagtttccccatatatacaatgaggatcaaggaggcacagatgtatagttcatctatcagttgtgagttctaaagcatagaaaagaattctgtggctttggcatttggcttttttgacttgagaaaaataaatataccctaagcactacatttgagttgaacctatgaaaaccctgagagtcaaaactaaactataaatagtaaaatcctttccccagcttcttcgttagagccaggagtgttgaagacagtcaactttttagcatttgtggaaatggcaggaagcaaattgaatagggttgaacagttgtgctccttgacctctgagatgcaatatcttacataccagtactaaaccagaggttcactgtgttccagggactctgatggagttgatagaccccctagtgacgcacataccaccagcaagctgggtgaccttcctcctttgccaaaatcacacatggctcatttgctgagggctacagtaaaattaagtgctgcttcttgcttcttctgaactggcaccctgttggtcctgccagtgtgagacaaaagatgtaagggctaccagtggactttaaaatgttaattttaaaaatagcccttaattattaaaagtagccctaattatagcttactataggcaggccacacgtttctgaatagtttaacaaatgaggaaataagtgaagagttgataagtgctggtagattcatttgcatgctttcctacacccaaatggtaatactgcaacaccacagtcttcagccaaattacgagtacagcaaattaacacaatttgttaatttcctttttaattacactacgaacaggagtatttctgtattttggcttttttttgacatagagacttcatcttaaaagcagaaagactttaatatagctaaatctatatctataacaaataaagcttgtttcattttccttacccagctggctaagatttatacattaattattcaaccgatgcatcttaaacatcctagttaaaatacacactgttggccagaaattgttaaacctccagcatacttttgtttgcctgtaaggaataaatacttagaactgtaaatgggtaaacttaatctttccatgtggtgaggtcaacagaactcatggtgaacatacaaagaataggggactaattattattgagattcaggtaagtgatttcttaggcattttagctgtcatgctgtggaataattgtaaactcaccaggaaggaattgcaaaacacaacctacttatcctttccccagtggctatatagaatttttttctgtcctgcagtttgtgccaactctaatcattaaaaggaatgttattttaagtattgcttcctcaataacagtgtttgacagaaactctacagaatggtggctttgcccagagtgtggcttcagtatgctagtgtgatttaggcaatcagagctattggtaatggaatgcagatctctgtagcaattttatttaaagttttgcctagttaatattatatccaactaatgtaaccatctgtatccggccccatcagtgacaatataaaactgttaaacaccatttcataggcattaagtgctttggctttggtataattttatgatcatgtcttattcttattgtagtacttcattactatcttttttttttttttttttttttgagacggagtctcattctgtagcccaggctggagtgctgtggtgcaatctcagctcactgcaacctccacctcccaggtcctggttcgagcaattctcctgcctcagcctcccgagtagctgggattacagacacacaccaccatgcccagctaatttttgtatttttagtagagacggggtttcaccatgttgaccagactggtcttgaactcctgaccttgtgatccgcccgcctcggccttccaaagtgctgggattacaggtgtgagccgccgcgcccagccactatcatttaaatgtcagtaacagcagcagcaagtattctaggcatagcacagagaccaaggtaatgggtctcccagccttgtgactaaattcttcctgcctctaggtcttcacgtagtctgttgccttgtccaggaatgcccttcaaaccttggtttaaaggccttttcagataagtctctctttttccccctagtattcttgatcactgtacctatttgtcttctccatagtatttatcacaatttaaaattatacttgtattttttaaaaaaacttgtctcccccactagaatgtaagctatacaaggacagagaccatgcctatattttatttattattttaaaaaatttttattttttaattgtaaattaacaaattgtagttacatatatttatggggtacaaagtgatgttatgatttatgaagacaatgtggaatgattaaatcaagctaattaacatatccaccacctcaaatattaacccatatatccttttgcgtagcaaagtaaatagggactgtaaatattttttgggagggactttaagtagtttaatgaataaatgaggcaatgtggtataattataaggaggcagaggccctatatgctgaggacttccaagttaatcttgtggttacatttgacttgcctaggcctgtgtgactttataccagtataaccaaaggcttgctggacatttctacccgatgaccccagacatctcacagtcaacattccaacctataatctgtcttcttgcctctcaaatcttttttctcctcagtcataacttggatagtggcaccatcatgtatgccatctccccctccctcctctggaacatcagtcagcgcacagtcctgtcagtttgttctcctaaatgtctctcgcgtctgtctttttctttctacctccattgatgtggccttggttcaggtcctcattatcttatctctatctagactactgcaaatgcttcttcctcctccctgactccctgatcttattccctaaagaccacctccctccttccaaacaggcaaatgctgttctctctctctttctggatccagaagtcagtaagggctgccagtgtgcagaagtagctggaaccttactaacatatattcaaagattgcagagacatatgatttcttcaagattaatttcctttttgtttttctgctgtgaatccaatggaataagttattaaaatgcttcaagcttctgaaggaaagcatggaaacatgccagcaggaacaacataaaggtttcctttattttcctctagcatctatctgtgatggacgatgtgaccatgattcttcacttaaatatggaattctggaatatcataaaatcccagagcgtcagggctgggcaaagccagtctggatcctatgtctgaggctgagagaagggaagggctttatttaacatcacaaggccagttagctgtggaagtaggactcagacccagttctctgtattactcaagtgatcatgaggcttcatttagatgcattgttaaaacatttggcagctctgtgacccatcccccacatgaccgtggcatgacttccttcatctgatcattttttgcttctcttaagcctgagtgctaatcagtgtgattagaaagaaaggaacccattagctggtttgctccccaagttgaatattccaattaaaccatatttttgtggttttgtgtttatttttatttttacccttctctttacaataataaaagatgggaaaaatccaggacataataaagtgacatatgctttagtggtgattttcaaatggggtaccttagagcaccagggctttcttggagttgccttggggcctcttatatgtatcactcattgaggtgccaagtgaacagggccctgggctggcaacccccgtttcagccagacagctgtgtttgtatctgttttatatggacttacactaccattggatttaaataggtgattctatgttgtaaaagttttaaaaatgactgtgcctcaggaatacattagctagtttgctctccaagttgaatattccaattaaacaatatttttgtggttttgtgtttatttttattttaacctttctctttacaataataaaagacaggaaaaaatccaggcttgctcatgtgggtttggtaatttgaatatagattttctgtgactagttagtgtaccagtgcctaagactggggttttatggattcttggctatgtgttagtatgggtgtgtcaggtccacataaagggtcccaaccctccttctcaggccagggcgtatgaatgattgcttggtaggaggtgttattgttcagtgtctgatgctgactaccgacacgcaaggtggaatgtattctttctgagaaccaaacattgtagcggagtagtaaaacaccatgtaaatgtccgtggaagggcgcagttgtattgaacattgatgacatgtcattgtgaagggtctcaggaggtagtgttccagtttctggcatgggaggtgatcgtgggagggatatataggctttgaagcagggacaaattggacaaatggtgtctcccacttgactgtctttctttgttgcccagggacagcatacttttaatacttctccttggcatgatgaaaggtaaggccactcctgactttggtggcctggggcaagggtgcaaaatacagactcactgcaaattcccacttctcttcaaccttctcgctctgttccttcccctaagaggacttccacacattatatttgaggagccttgcttctcaaagtgtggaccccagtccgcagcatcagcattacctgagagcttgttagaactgtggactctcaggccccactctaggcctgctgaaccagaatctggattttaataagatgctaggtaattcacatgcacattaaattttgagaagcactgccatagcccacgtgttcaagctccatcaacactgagtggaggggcaacagctgccctgtggccacccctcagtcactcttcaggcctagggtttagtccatccttaggaagacagaactaggaaagaggatcacacaggctccaaaggcaggcttgaggcacatgggcagaggatttcaaggtcatgggtatcctgaggatagcctctaagagggaagcatagacttggggttggcaagaccccttggccctctataccccttgccctgtgaggagtgtggctgcagcagggccagagtaaggccctgccaaccatgaggcctagggcaggatctggttgtcccagtctaagagtgatactgttgaaaggtgtcccaaatattcaaggggatgaagatttgagtgggagtgattcatagctccctgaggtactggccagcagccagggtcttggtggctctttggagtgtgcggaagttatggtggtgggaccattactgctttaagagggaatcagtgtgaactgttataagcaaagtctttggtagctagagacgtatacattgacttatctgtagaaggtatacagcgaaggtgcctcctgtagtgcctaataacaatttgattagattagctactagcctccgtagaagacaggtggatgtggctgtggagggctttgaacaacttccttcaaacctaagaaacgggccacttttctcgaagaattgagagcagtgtctggtgtggttgggatgccgtggctgttggaggggcaaaatatgccattttgtgtccaccaccacctgtatgatgccacggttgtgggacagaggcaagtctgaaatgaagatcaacagattgctgtcccagctcccacaccccacctcttcctctgtaaaatgggtctaacagtccttgtcctgcctaccttgcggaggtgttgggtggctctagtgagacaatggatggaaaagtgctttgcagcctgtcaagtccgtgcatgaagaaatgatgatcattctgccatttgttgtctttcctttgtgagtgtgtcttcacctgcacttgagttttagatttaggttgccctctccttagcactgcagctttcaggtcacagcaacatacaaggttctgtgcaaagccatatctgcccctcttcctgacaccttccagcctcttccatgcagatacactgctgtgattctcatttttgagttccacagatttgggacggagattttatattggcaaatatttctgaagagacaaataattgcctctggaaagaggcttcttttctcttccaaaaattcatatttgctggtttaaattgatgtgactattttttggctagaactctgcagtatttcactgagcagtaattattcctttggtgttgcaggagttttctgagagaagggaactaaatctaagagagcgaatccatctggtacatatgttgaagctctctatgaggccactgacactgaaatgttaatgctaggtttctataaactggtatcatttagatattgatacaatatgagctagtactctgggtcactgaaccaaaggctgaattccatttccttatatggcactggattcctgcaccagtggattgatgactcttggcagagtaccatggtaagatagaccctgcattccagtcctgtcacccgattgtcagactctggctgtcccagccccaatcaggagtagacactaaaggccagcagctggcaaacttagtgtctcttagtacctcaagcattggtaggtaactaagcttgacgggatagtagaagtacctacacatagtaggtaattaattctagattagtctgataccttaagtgttaagtgcccctgagaagaacccctggggcccatggagactcactaatctgcagcttttctttttacattatggtgtgggtgaaaccaggatgtgttccaggactgaactggtggctgtcctgcttgggtggggatctggcatccagcctagccattgctaggtttttccctggggtgttggactctgtttctccaccaaactgccaactaacattcaattcaaataaaatgtcttagaaatatggtgctgccgccgtatgtaaggtgcagggtggcagcaccatgtttccaagattagtattgccactgtgcaaggtctttcctagccagattgttcagcttgcatttatcatgattttttcatctttgtaacttggatagccagtcagccctcttagggacaactctggggctctccaagttctgattcttcttgatctgtgctcattattctttttctgctcttcttacattgaagtcttggaaatcccaaccattgctataaaagttctgttgcaaagaatggaaaatagcctattttatcccatagcccagttacacatacatagggagctatggacatctcactgttcactttgagttgaacttgaaattcctgcctctcctcttcgggaagtattaaccaaagaagccacaaggggattcactagtctcctatgaaataaaatgctatcagataccaaacagctaactgtccagatttttcagcaaaaattggctgctttagttttttgaaattttttcctctctcctctgtagttcagtatgagagactcttcagggcaaattgtcagtgggaggaattcagagatgccatatgtcatcagtacatggctgaggagaagccaaaaaagtattaccgccgttttcccaaaaagctattagggaaggttattgattgttttccacacaccttccaccttcatcacagggtattgtgataactaaaaaggtactttcatgtagctcttaaaaacagttttctccttttttgttttcttaatatccactgtgcccaggtcacttcacagagctccaaagtgatgctcctttctttctccataggatttgtccttgcccttctggcaaatggacttgaattgctactgcttctgtcagctggtggctatgtttacttcaaggtctttgagtaggccagacaagtccaattacataaatcattattgactgctgtcaaccccctgtccctccctcttacacttgtttttctacccctacctccctctgctttctatataggattggagatgccatttttttccttcagactttcaggctttttaataaaaatggtgcttaaaggtacatgtcagcagacttttgggtgacctttaaagtagagtggtatttggtctgtacaaaataacccattctctatcatttatagattgtccacattatacctaattttaaaattcttgatgacatctattaggcttaagcccttaaactagttcatgagggtacaagggtattgtagcattaatgccctgtaggtaaagtgaatgttggtatttgatctttttttttaacattcttaaattattattattattatttattattattatactttaagttttagggcacatgtgcacaatgtgcaggttagttacatatgtatacatgtgccatgctggtgtggtatttgatcttttagttggtacctggaccatccttcagtggggctttcctgcttttcccctttccccttttgtgttgttggattaaggtatatttcatttattcttattctgtgttcatttcaacataagcatcacagacccattaattaagaacagctggctatgttctcctgccacatttctaatttctcaatgcccagttgacaaacagaatcctatctagagcaaagtcatttgttccaggctcagaacacatggagggcccagaaccatacgttgcacttttgtttcagttagaagtcttccatgggcttttcttccagtcacactaaagtagtatttgcagaaatgaagtttctttgggtcttgttttgtttttgtttttgaagatggaatctaagatcatctcagtttagttctttgcctttttgttgttgttgtttttgagctcatatatggggtatgtaggcctttggccatttgaagcattgcagggaatggtatgttttagttggtgcatttgttactgtaagaaatcagcaaatggtttgtggtgccttttaagatttatttagcacatatttttcctatgggctaggtgctgagctggatgctggggatgcacagatgagaaaggcacagcgcctgttctcagattgtctcacagtctagtaggaaagagagagacacatcaacagctaactctgatacctaacgatctggatagaaaatttcaggtcagggcactggcatgaacagagattgagaacagataaatgcgtggtttgttcagggaatcacttatgtagtaatatggatattggcagaaaatgactagagacaagatgtaaaggtagattcaggtcacattttgaagaactgagatttttagcttttagaagattatgttggtatcccttgaactcaagatgttgggtccaaggtagtgattctgtctacattcttagaacttttttgtagagtagcaggaggtagaagaaaaagttattgaagctgaaatagtgatccttagccttagggacagtgtgtgtcagaggttagagcatccagcatggctggtggccagagctttgcatcagtctgagatgtatgtgatgtatctttagctcagggaagagagaggacttgatttttgaggaaggcttgggaaggagggatagaagagctggatagttttgctgctccccagccagaaatttatagtttgatttcattattgccttgaaatattgggatgtcccagaacacacagccattcatatttaaaagtaagcatggcaacctcacgtctgattcggatataaagggctgatttggcttatttatatgatttcaattcacaggcagccataatcaagtgcttactaggcttgtaagagcagccagaggtcagaccatttaggaacacactggggatgataggagctattggttacagtgcaccctcatccaggcacatgtatcattaccctctggcccatagccacaagtatatccttgtccccaacccaccatcttccaaatgcacactatgattataacagggagcatggttggattgatgtggcagtccacatggaaacacagattttgccagaggtcctctttcctgatgttgtttcaccttcactgtgggctgtcattcatgttgcttcatatctatgttgctttgctgtaagatgcatgggtctttcatagactgctcttccttttttgctattggggtgtgaaaggtattgctcctttaaaaaagtacagcagggctgggcgctgtggctcacacctgtaatcccagcactttgggaggccaaggtgggcggattacctgaggtcaggagttcaagaccagcctagccaacatggtgaaaccccgtctctactaaaaatacaaaaaattagctgggcatggtggcaggcacctgtaatctcagctactcgggaggctgaggcaatagaatcgcttgaacccgggaagcggaggttgcagtgagccaagatcatgccattgcactccagcctggacaacaagagcgaaactctgtcttaaaaaaaaaaaaatagtacagcataaatccttccaaacatgagtagagaaactctctaaggaagaaaaatctctggatggaggtgccagggtctacttgggcaggtgttctattgtgacatagctgtctttttttctgtttagcccttggaaaaatgtgtgttttcttggattcaatgtaatttttaaaaataatacaatctccaagtccttctcacaaactggttctaaagtatccctaattacttagtataaaagctgtcttgatttatccatttctactgtttttagcattgctgtttagggaatgttgatcctggaggataaagttctacaaaatatctagagttaatgtttaatcgaaaggaacctgtcttaagggtcaagagatagttgagttcctctattaaaaacaatgaaggctagaccctgtcttctccattaggaatcctgagcattggtgaggaaattcatactaaaaccttgctgctaccaatctcttattccttatactggatctccagtaaaatgtgcatatatatatgcatatatatatgggtttaaaattatttttatcaatgcaataatatgaataatttttgtaatcaggcttataataacatcaacaaaaccaatcaggccggtactgcttcctcccaatcctgctcctcttgcttttggtacttaccttcatattttatgtaatatgcttatgctgccattacttgattcattattttagatattgtgtgtttacttcttgtgatgatagatgagaggctggctgtctcatagtccctatcagtcgagtatggctggtctgtgctgcataacaagacattcctagttaccaggggctttacagaacagaagtttatttcttgctcatgctacacattcaacttaagtgggcagggggcctctggctcatgttggtcactgaaggatggacatgggatgatggaggctccaactcaacacctgatcacatgatctatgaaatgggcaaataaagagttaattgcctgctgcctctcaaaacttcttcccaggtatgatataaattaattttactcacattttattggtcaaagcaagctacatgactatacttaatctgaaaagaggcctggaagtacaaccctaccatgtgcctgggaaaagatgctctggaatatttgtgaacagccctaatgatgaccatacagcctctccattttctttcctccattactccagtataagtaaatcatgtattttttcaaaattggtattcagtgtttgttattatagctttgcatttatgtccagtgccaagccaagcaatgcattatgctttcacttccttttttgaataatattttattttccccagagtcaataattgcctaatttcttatttgcttagttttctttttactcatttcttattttctgcacaacattcatcagatttatcaagtagtcctcagtattattttttgaacactgaaatatatcagataacctaccaattttattttttcttggagtcttccagcctcccgcttcagccttggctctctgggccttctgtacaggaatcatcctccctttgccagtttcctgtattaggaccctagtttttgggtcttttgtctcctttttaaaaattatttgcttacttgttttgctggagcacgtgctttaatagcttcctaaataaaggtttatgacaaattatattagtcagctttttagtaggctatgccgtggtgcaaatgattccaaaatcccaatggcttatacaagatttctttcttactggtatcctatgtctttcatgggttagcagtagttctagccaggtctttttcactctggcacctaggttaagggagcagcccctctctaggagaagcagttctcatggcagaggaaaaatagcactgattgaatcagtgttggctgtcaaagctgctgctctgaagtggtacacatcacttctgttcacatgtcattggaaaatcaagtcttatggccaagcttgatgtcaataagcctggaaaataaaaataatccttccacaggtaaaattatatttttgccaaaggaaataaatagctgtgttgcgtataaaattatgaattggtttttcgcagaattttgaaggcattgctccattgtctcctcgttttcagtgttgttatttaaaaggctgatgccaatctagttctggtataagagtcttccgtataagcattgtttttttcctttgctctgaaaccttttaggttctttttttttttagcccttataattcagacatgttttgacagtgtgacttggtatagatctttatgcattcattttactgatccttccttaggagctttaaatgtggaaatttatgtccttatttttcttacattatgactttgataattttctccccttcgttttttctttctgaaatttcaattatttggatattagacctcccatattgttcctctgcttttcttgtcttttcctctcttggtctttatgttcttctttttgggagattttcttattttaatccttttacttttttgcagtttgattatcatattttcagtgtccttaaattcctttgttttctgtgtcttcctttttgtagtatcctgcttatgcttatggatataaattttctcttatctctgaggatattaattatagttttaagttttcttctgttattgtatcatctctgttttctctgtttgtttgttttgacttctctcatattggaagagttcctcaaatgttttgtgatccttggctgtctattcatattgaagagtggaactctcttgtttcctggggacaaagggagaggataaaatagttatctaggtagctgcatgctgaaaagtatatatgggagcctgctgctccctatacagagttttaattcctgttttcctgtgtcttatcccaatttctgtggtacttggtatttctaaacccttaagccttcccaggattcaatggggactaattgtttcacttttcattggcatgtctttctgcaagcacttaggttctaacttgcttttcctttactctctgaaataaatattcgttcttcccatcatttcctgtcttcgaaacatttatggataattcttgtccactaatgtctccttccctgttttcttagtctgcgtggacttaacacctctttctctctgtctttctcttctctctctctctctctctctctctctctcacacacacacacacacacacacacacacacactttttatttgcattgttttaattccattaatgagacttcgggagggagagagataatcatgtgttatcagtctgccatgtttaaccagaagtcaagctgtggtagaattttttaaatgtagttttctttacctcatgctaaactgagcatggccttaaaatctacccctgttctttgaaataaaactagccttatacttggatagatgacatgctttcaccaccaaattttaaagacaaaacttgaatgttgatggaaattaaaatgtgtttagcactttctgacactatgcatggtaaataaataaatgaatgaatcagtgaaaagaaaggaaagtcaccataatggatactcttgagtttcccactccagctgcactctctacccttccttaccctgctctgggcccctggagactgacttctatgggctgcatcaaccaggctcccttgtcctctggcttccagttaggtttgacaatgcaacgtatcagtgggggagggagaaaggatcagagggttgagaggaaagccagatctcagtatttacttctccagcttcttctctgccaggtcacatttggcagtggctgtgttccactatttcatgccatagcttgtgttgggttgtccctctctgacagcctcagcttttaccaggttctggtaaccattactctccttctcacttcaggtcgagagatggtagtggtttcttcctgctactgatccaggaccaatgcaccttaccttataggttcccttaaccctgcccctaccttcagttacaccttttgaatgtgctgtgtttcctgccaagaccctgcttgatacaaatgttatggtagcactgtctcattatcatccatgtattcttgaacaacatactccacatcatgggcctcagtttccatatctgaaaagtactaaggtggcgataggtggtctggtctgtcatgtaagaactccttcctgttctgacatctctggttttatatgatgcagcagtggtcagtagccagctctagctctaagttctcttttatagactttgtggaccattgtggataattctgagtggtggatgatcacaaaacaatttcttcctgtctttgggaggcagtttgctggagcaaaaggattatagactttggagtcagaccagggttcaaatttgagtgtactactttcttactatatgacctttaatccattactaaacctctctaagtctcacattcttcatcttaagattagggtatatgatggacactgctagttatctatcctagccgttttcttttcccttgctaaaagaatactattttccattacatatgtagctgaacatttagttggatgttttgataaatgcagtttgcatagacataactagtatttactaccatctgattctctccttctgaaagcatgaaagactaatttccaagcttcctatagttaggtgggatcatatgattaggtctggccaatgagctgtgagggaaaattacctgtgacactttggggctgaagtagaaaaaagcaagtgtgcaatctctgtgtgctctcttacccctgctgaggcaatggggaacaatctccatggtggaacttccatcaatcaagggtccctaagtgactatatggaacatagacactcataaacttgcaggcaacatgtagcatgagtgagaagtaaaccattgttgtgttaggccattggggttttgtggttgatttgtcagctaatccacagctgaaaagcatccctacagttataggacattatctttcttgtagggttgtatggaacagactttctagatttgattcctagctctgttatctattaacttgtacgtccttggtcaagttacttaacctttctgtgccttggtttcctcatctgtagaatgagattaataataccttttcctcatgaggtcagtgtgggtactaaggaaattaatatacaggaagcacttaaaacaaggcctggcaggtagcaagtgctatgcagcattttctgtcagagatcatgtatttcagagtgtcaaatacagtgtctggctctcaccaacaacttaatgctttattacctttattgctgtcataagggttagaatgatccatgtaaagtcttcacatatggtggccacttaacacaatggcactattatttgatgactgatttttgtgcttaattctggatatatgcccctcattttttagttctcttaatcattgccctctaagatttccttcacaacatgggaggtagttaagtgtatggatttccaagagtagttctgaatacgaagttaagaagatgttgaaatggcagcaaagccttaatttaacagggaaggcattcatcaaaagtgttgttatccataagtttgaaaccaaggcgacccacagagaagctacacttgtgaaaatgagccttggataatgagtatttcattatatttgccatttagagcccttacacactgtctgtccatgctcttcattttgcagatgagaaaacttaagcctagagaagggaaatgaatagtctaggataacacagtcagttaacagcataagcagaactagagcccaagtacactgattcttgatctgtatctacattttgcatctgtaaagctatacaatatttccttctagtacttgaataagaaagtcattggcttttcatctcaaaactctcaaaagcttagcagaaactcagagatgtggtttcggaggaaccagaggaattcaggtgagcagtgtaaggtagaaaaagtcaggtttggtcttgtaacatttgtgccatttgaaaactgttgtcagacaactgcaaccctagactcaatgtgaaaattaaagtaactttgcttttatgtgctgtccttttcagagctcatcatccattttgttggtgccattttgctcatgtctttgaatacatcaaaagtggcttgattttctctttcctttgctgtctattcactggctgcaagaatgtcctgtccattccagattttggatgggctgtccagaatcaccacagacttcgcttcttagccagctagaggaaggcagaaatgaaagagccctgccagcgtgtttcctttctgtaagtttccttggacacgaacacaggagcagagtttctatggagcagctggtctccccattttggattttgctgaggcaggtagttgaactctttgaggaagtctgggttttctctgtcttgggaaattactgataacatcagagccagaaggaggtgagtaaaatggaaaagaaaattcataagagtcgtgccaagattgagatttccaaccccacccaattcttccccagctctcctttcagctgctacttgcttcccaggaagcaacaaacaataggctactgattgaatttaggtctgaacttcatacaattaaaggtgaggcaagtaaaacatagttacatttagaatcaaagtctccgtgtttccatcaggaggcacagtctgtatgtatactttagaaagtgggtctggttctgaagccaaacttgaaagcccattcattttggtaattattttcttttttaaagcaagaataatctttattccttggaaactaatttataaaattgttatcaataagatgaaaagattcatggtaattattttcttgttcatagtttcttgctggcttttttttggaactaatcacttccaggaaagtgcagaggtcttacagtgaagagaaggaaaagcatattaattgtagctggactgggtctagatcatgagagctggaatatcctaagatctgggacaaagggacagccattgggcagctgtactttatggtaggcaacatagcacaaagattcagttgtttcttttttaccccctccaggacaatttaaatgtctactctggttagtttctgagagtaggtaccatgttacttaaaaaattctactcattgtaaatgaagttgtatcaacacataacaactgccacttggaaatcatctttgtctttccctgatgtccctttttcgtatccttctctctagtactcattccttcagtcagtgaatttatgctgcaacttgactacatgccaggcacaacaccggcaccattgatataatgttgactaagacagtgttccacttgcttattgctgtgtgataaaccaccctcaaaacttagttgcttaatgtaaaaaccattttactatagctcacaattcagaaattcaggcagggctcatcttggtgattcttttgatcaacacggattacccagtgacactcagctggtaaatgcgctggtatggtaacctcctctctgtatccccctctccagtttcacacacatgtctgtctggtgctttggcaaggatggcaggaaggctaggctcagctggccctgtcaaccagagaacctacacacggcctcaacagcatggtgacctcagggtggttggacttcttatgtgtcagctcagggccccaagggctagtgttccagcgatccaagtggaaaatgtacaaccttttatgactcagcctctggagtcccaaaatgtcacttccactgcattctcttggtcaagcaagtcactgaggaccaacccagattcaaggggaaggtaatcagattctgcctctcaatgaaagaaatagcagagacttgatggacaactttaacgtgtcacagacagccagagctgcttgatgagattatatgccaatggaacaagcagcagactggtcagcaaatagtccaggggcagaggctaccttgaagaagtgactagaaagcctattgagtagtatagtgaataccgtttgaggactaagctgctgagagtctgaggttgctgccttgtgctctcttggaggattcctgtgatgccccccacctcctgctcagcattacatatcatactagaacaacaaccaactctgctggcaaacacacatgcacagggcacagtgcgtagtcctgtctctacacacagctgctggtttcattcggattggttaaaatctaattgtttgaatgaattcaggggttgctaagtgattagtacttatttaggctagttcagtcagaactggcaattggcattgttgttccatctgctgaggctgttccccctcttcttcctcttgctaatgctgctcattcttttgaattcagtatgaggagccccttcttcctggaaaaaaactttttgaccaccctcatcccaatttaatttagatgcgttcctcttgactcccaagcaccacccaaaaatgtactgttaatccagcagacatatctgcaacgggaatgtcaactattgaccaggttcttgctgagagagctacagatactggggtgattcagactgatacagtcgctccctacaccagtaaatctcccagtctggtggtgaaggcagatatcaaacgaatcgttaaaaatgtattgaatgttcctaataatgcctgactcagagtcacatgggtagtgatagggactgtgccatcttttctgttgttgtcatggtgcctggcatataataccatatcagtaaatgttttttatgtgcatgaatgaattttggtggtatatttattgaacatgtggataaagttatgtcagtagaatgtcatttatctttttattagagcccttctaagattttaccaggctgggccatgatgccttccattaagaaacagtggattggggtggagggagggagagcattaggaaaaatagctgatggatgcggggcttaatacctaggtgatgtgttgataaatgcagcaaaccaccatagcacacttttacgtgtgtaacaaacctgtacatcctgcacatgtaccctggaacttaaaaattaaaataaaaaataaacattggagacagggcctacatctggatccagtcgatcctttttgctgccagccaggttatgccagcctcctctcatcccttggtcagtctgatatctggggggctgcaaagtggtacctcacatatcaagttttgaccttcttctctgttaacctttgactttagctatcatgaccctatcgatagatgaacctgtttcctgctgcccatcatatcctatcctttggaataatttgtggcagtacttgactagggcttttctgacctagacctgtcctgagcagacacatgttgtcctctgccatgttctggggaacctaactggcagctaccttgatccttcctggttcacttgccttccaatattggcttttccctaatatgatttccagatcccaaggttgttggttagttttttgttttgttttgtttttgtttttgttttttttttaggcaaggtctctgttacccaggctggagtacagtggtgccatcacagctcactgcagcctcatctcctgggttcaagcaatcctcccacctcagccacccaagtaattgggactagaggcatgtactaccatgcctggataactttcttattttttgttaacacagaatctctatgttgctcaggctgttctcgaactcctgggctcaagcgatcctcctgccttggccactcaaagtgctgggattacagatatgagccaccgtgcccagtaatcccaagtttttagaacaacaacaaaaaagtatagtccttggaactagacataattgattttgaaaggatttctgtatttgctagctttatcattctgagcctaattttctcatctgcaaaaatggggataaaaatcgtgacatcacagggttattttaagtgtagtacctaccatgtaattgctgagaaagtggtagttccctcccatatcccatctcaatgtattgacttttgtattcaaagaagacattattgattactttctctccagtaccttatttactttagggtacttttcctagatggggatagtggcttgcttccagggctggccttgaccacaccgttatcagagcttctggactccaatgacatgactacctgactccctcacttggagaatctgggtcccatggcttctggcacaatgacttcactatggctgcagttctaccttttccctccaaccgtggctcagtgccaggatagaaggaaaatgcgaaagagtttgacaatatttcagagaggagacttttagcagaagttatagctttgctgtcctgggcagtgttatgaaggagctttcccacacattcctctggatcctaccttcatctgccacctttactcctggttctttcttctaagaggatacagtagtatatttgggtggcttgtgacatgacagtatctcttattttgacctcccatagcatttaagcatttattgtctgtaaatgtttaattatgtttttctctctgtgaatttcatgtatgattaaagtatgctagtcataaatcattcaagataacactaagctcttcaatggcaagggttatgaatgaatagcccagggcctgaacacaacctgagaactgctattttttttttttttttttttttgagacagagtctcgctctgtcgcccaggctggagtgcagtggtgcaatctcagctcactgcaggctccacctcccgggttcacgctgttctcctgcctcagcctcccgagtagctgggactacaggcgcccaccaccacgcccggctaattgtttgtattttttttagtagagacggggtttcaccgtgttggcaaggatagtctcgatctcctgacctcgtgatccacccgccttggcctcccaaagtgctgggattacaggcatgagctaccgcgcccggaccgagaactgctattttagggcataggatgaaaagagaagtcaatgaagaaaactgaggagaagtgagagaagcaggaggaaaaacagcaaaatggaatgttaaagaaccctgatgaggaaagtttaggagagacagacaacaggatgtaagcttcaggatattttggagggttttgggcacatttcatttacagggtcataagggtagtgaagttggaatccagcactgttctcatcagtgtcaaggagggcaggaccagctttctctttatgtaaaccctcaaactttaatgggcactagaatccacaatcctgggccttacctacagagatccggtttcaatatgtaggaccaggaactctgtattttaacaaacatcacaggtgatcatgatgctggtggttccaaaaaaaacatgggtctccggttaacaaagtagtccaaggttgtattggtagtttgacagccctatcatgtcttgtgatgaggtaaagtccctaagtcacaaagtcagaatgatagaagggcccttagagggatgatctaccaacgcaactcagtgggggcactgtattagttcgttctcacactgctataaagacatacctgagattgcgtgatttataaagaaatgtttaattggctcacggttctgcgggctgtacaggcttctgcttctagggaggcctcatgaaacttaccatcatggcagaaagcgaaggggaagcaagcacatcttcacatggccagcaggagttgggtgaggtgctacacatgtttaaacaaacagtgctaggaggatggtgctaacccattacaaactacccccatgatccaatcacctcccaccaggcccttcctgtaacactggggattacacttcaacatgagatttgggtgggggcacagagccaaaccatatcaggcactattggaattttaggtgggaccatgcttccttgcaggggactgtttgtcctgtgcaatgcaagatgtgtagtacactttgttcccaccaactagattccagtagcacccctcagtcattctgatgaccaaaaaaccccaaccccatatatttcctcattcctcctaagggggcagtaccatccccactgagaaccactgccagtataatcccttcattttatgtgggagggaaatgggtctcagagcaggggaggaattcttcaaagtccctcagtgagcatttttgaagtaatatactctcaagtctgttattcttcatcctgtatttctgtaactaagtttgggaacctaaatgcaggcttgcctccccagttggatggtcagctttactagaaaagatagagacagtcatcttactaggtccctgttgtctctgacagcatcaagtatcatgctggctacacacaggcacctcccagatactcactgaactgaattgaaccacaaaactctgtggagctccttgaagatgaacaagattcagaaccctcctaggcagtaagtcttctttcaggagggaccgaattgtttgtttagattgcactttgaagagaaacattaactcattagcatattcttggtacatcaagaacattcatctggaccctgagccccgctagagtgtacatgccaggagggcagggaatgttgcctttcttcattgtttatcttcagctcctagactggtgcctggtacatagggagacactcagtaaatatttatgtatgaagaaatggctccaccttacaataaaagattgtttactttcttcagacaagtataaaataagcaaatgttttcaaggattattatgtccttggtgaaaagtaaaaagtaaatatgagttaaaagaatatgagtaccttgtatttgcaaagaagatttctaaaattcaaaggcttttctcatctactaaggaaaaggtagagaaatgtgccctttttgaacctacagtgaccgatgctgatggctagactaatgtcctcagagagaggctgctggtgctggtgctcagcacaccatcccttcctctgacctgttcagcactgtcaagagtgacatggagagaccaccgatggcctgtgaggagattcacagatgggggagctgggcagccaagtgaaggcatcggctcacacagtcattggctgtcagaaagtaacagtaaaccaaacccaagaggatgaaatgtaacagggaaatgtgggtttcaaaccccaatgaaccacgcaagagtgatctgctttaatagcaccaggtaggaggaagccttcagggtttcaattgatagaaagaccagcagtacctaacaggttgatgttgctgctccaaaagactgagtgacctcaaaccaccttactgaaggctagtgcctagagtacaagaagcagtggtccatacctgcacacacctgttctgtttacttcttacttgtgttcctgtcatacaaggcacctagacaaatgagagtccattcagaaagttaccaggatgtggatgactttgtaacctggttgtatagagaacagtggaaataactggagataatttactttaatattatgagaggagtctggggaccattatagcaacttgcaaagatttgaagggttgacatgtagggcaaagaacagtctggttctgtaatctcctgagaacagaatcaacactaacggattgaaatgcctgcaagtcagattattggctcaacacaagggaaaaccttctaatgactatgctatccacgacttcggtgggctagttcatttggtagtgagttccttgtcactggaagagttcaagtagtgaactgaccacttacctggcagggaagccatagagggggtttaaacgtctgatgagattgaactttatgacttttaacatttcgttcaagcctgaacacaagcctgttcaagtttgggttttgcattttcaaggtgataagtgaatctgattcaatatatgtgaatattatctatattgaaatattcaatatagattcaatattatatagatatctgtaatatattatatataataatatattatatataatataatatatttaatattatatataatatatgttatatataatataatatatttgatatatataataatatattatatatcatatataatatataatatatgatatataatatatcatatattatatataataatatataatatatcatatatataataatatattattatatcatatattatatataataatatattatatataatataatatatttaatatattatatataatatatttaatatattatatataatatatttaatatatataataatatgttatatataatatatttaatatatataataatatgttatatataatatatttaatatattatatataatatatgatatataatatataattatatattatatatcatatatgatataatatattatatataattatatattttatatcatatatgatataatataatatatcatatatgatatataatatatatcatatataataatatataatatatatcatatataataatatataatataatatatgatataataatataatatatataatatatatactattataatatatataatatatataatatatatactattataatatatataatatatataatatatatattatatatattatatatatctgtcaccaaagtaaggtagagttatgatttgggacataagtgaccatcactctttaaatgcctatcattgtgtagattttagaaaatttcatcaaatctcttataagaacacatgcttaatgtgcactaagaaacctgattatcaaagcagtccctctaccaagaaaaccccctgcactccctagctcaccttctacccacccaggtattttcatttttatctgtgggtgtctagatcaggtttgctcaggactaattcacagcaaggtgagaagcaaactaatacaggtacctgtgatttggacagcactgctctcagggtcagggtcaagatcaagggccttactttgttctctggcctgtcttgtttgcttaggtcagggcagtcttgcttattttctggctgttgagcatcttgtgctgttccttcgacattttcactcttcacagttactaacttgtcttcttttgataggttcttttttttgttaaggtaagacctacatgataaaaatgcaaataaaacagaagtatattcagtggaatgtaaggcccgcctgtcctaactaatcctgtgttccttagttccctcctccagaggcagctgctatgattaccttctttcagatccttccatagtgagtctgtgcaaacataagcactatatagatatctgtgtggtcttaaagcctcccatctggctctgcccaccagtttgtgtgatcttttgctcatcttcagctcctacaatagctcatttatttggagccaaccctctctgctaacctgtcttggcttcactattttctactgctcacctgctctcatactgccactctgacttggtaagaccttaatctgggacagggagaagtagaaatcatcatttaggaagagtaaagcatttctagtttctatttccattccatattttctagccctgtgaaattaaattatgcctgttcatctgctactgactcactatattccacaagcaagcaatttgcatttttcttcacagcagcatctttttcctcaggatgctgtggcaactaatgttttaagattctaagaaaaagtcataataataaaacctttccatcctaggcatctaaaaattgaattgtgaccaaagcataaagaaatattattaaagaagctcaacagtttacaaacccagcaatgccatgttgaagattaaacctcgtaggttgggaattcatttagggcacatttgcattctgtgtttttagatgtggctacatgcacaagtcacctaacacatcaccacagaatacaatgtgtcaaagtatttagaatatgagagcatcacacagataagggagcagtttttatctgggaaggtgagaaaagggagtgagggagtaaattggcccatagaattttagagtttgaaggggcctcaaagatgagccagtagtgtaggctaagtacctttggctgcatcactaccaagtggttgtctagcctatggtttgagtacctccactgacagagtgctcgttatatctcaaggcagcttatttcatcaggctgccctattagaaagcttttctttaggccataccaaaatctattttctactgcttgttcctagattaaacttcttcgggctacacagccacaccaaattctttgcaagtatgaaagctctttatacatgtaaaagcagttttcaagtactcctgtctagagtaagcatttaaaattccttcagtggacatcaaatgacattgtttcccacccatccatcatctgtgtgggcacaaaaccttcacctatggagtaaaatgtgtcagttgcttctcttgtgtcttgtttttggcctaagtaagttcaatgagataaccacgaattaaaagaatcttggaaaggaatcaaatatggaagtatttgagaatgagataataaaggcaagtctggtcatacaatttcagaagcttatgcctttaatcagttaggctaatagtgaggccatgagcatagacatcagaaaactagggataaccctcaccatgatctgcagaatgaagatgttaggaaaccatagactctgtgataggaaagtcctttagcaatcagctaatgaaactccatcattttatagatagggagactgagatttgaagaggccaagagacatgcacaatgtcttacagctacattggcagagcaaacactaattaatccatgtcttttgatttccaattcagtgcttttctgtatgtgttttcttaacttgagacacaagcaacagccagatagtaaaggatatccttttatcaccttctctccagtcactgttaaccaattgtatttcactccaaaatatatttcaaaagttacagagttacgtaagaatgctcttaagattcttggaccgatctccaaagcatccctgccttattcaccaaaaacttagcagtttgtgtctttttgagttttgaattaatgtgagcatcagtgaggataagtccccattactgtgaggaatttgtacaatgagcgtctaataacatggataccacaagggagtattgataagacatttgggaataagaaaggaaatattggccaataatgcatattattgcgtgataaaaccctgatgtcatataatcatgttatggcaacatcattctaaacagaaactcaaaatcgctgaattcctccggacgtgtgtgcaatgtacatgggtcttcacgtgtacattggaaatgcacattaaagtggaaatggggagctgttgctgggattccaggatattggagacagacaaggtattcaccctgcaggcacttcgtggatatttttaatttgaaaaacaaggacaatcccaatgtctagatttcccatttgtgtagccccccaaaagatttcagtagcagacctcctatgagtctaggtccttctcaagccgagggttctcaggtagaaattatactgattgagatgagccgttggccttatttgagaatgacccaagtctggttttgtcagacttgggtcattctatttaaattcaggtatagaccctattttctagaccccattttctagagaatctgtgccaacaaaactttgaaaatttgaagacaaaattaacatttgagagaaaggattatagaaaacctgctaaatgccttcttaaaaatgggcccagtcctactttccaatcctataagatagcatgccatcacttatctatgccataatttatactgtattgattttattgtcacaactttgggaatactctgtcatgtgtatttatgatggcccataaatctttggaataacatttagagaccaagtcactatttggagtcaaggaaatagagggctgtgtagacagattagagcccattaatggacccagtgtgtagacctaagaaacctgcctaagataacttctcttgaaaattgagtaaaagaagcccttaaataatagtagctcaaaatggaaagctgtgagctgtgtagcccaaagtgatgactctatttgaaagcccttattttttcctgtccaggaatcctcaaatggtatgtttgtaaaaggaattgacaaaagcatgcagctatacgaggcagcaagattctctggatgagcagatcacagctttcacatattagcatgtcctgaacatgtaactcccagttatagatctggaattacttgcatcatcaattcaatactttgggacttagggctccagttgtattggtgccagatggagaattaatatgttgtctaactcagactagttaaggggttttgctccttggagggagtgggagagaatgtgactgttttgctctcattttcctcatcctgcattagaaacaaagcaaaaagttggctggaatcagtattagcattgcccacagctgctgaactctgatttaaccagatgccatagctatagcaacggggaaatattggaattttgaaattaacatgctactgaaagttgctaaatatatcacgctttgtggaggggttcatattgtaggtatttccattatttctcaaatgacaaagtaagtcaggctttagacagaaagttaatttattatatatggtggttgctgaagtctcccctacttgatctatatctataaatgtgttttttgaagccaaatgagataaatcagtttgattgtccaaggcatagatggaaattggggctgtcataaagccatcttcagatgcgtgtgggtgtcagaatattcatctttggggtttagtggaaagaacctcaggctaggagtcaggaaacctaagtctcagcctctatgattaaattattaggtgatcttgggcagatctcaggttccccattttttaaatgccaggtgttgaactcttctgccttccaattctaggattctggaatagttagggttctatttcccccggctgtggctctagggggtacttactgacatcctgtgaaataagaaagagagacccacatcccaggatccctggatcagagtggtgggtgacatgtaaagagaactgtgatttccccctacaggcttttccctggataagaaagtgttttctccactcaacaaaccctataatgggcctgttggcttcatgctccttcagtcctcctttccccacaactgggcctatgtgactctcagaatgaggccctgcaccttactccactctacctagcaaggctctgaggccctaccttgtagtcaagagagatctgaaggatccacagtcttaaaagcaggtcatggatgcagtatggctgcaagttgatcttggacttttcccctcagtcctaataaatagattgttgccaccttcctgggactggcacaccttgccttctcttccatatccaggagctcattatctgtctactacctactttctttaattattagagagcctggtccctaccttggctttgtacttggtgtctttttccactgaggactgaaattctgttgtccttttcagtcttcctggggtctgtgcttgtccactgccagaattctctgggatcactcatctgcctatccatggagatatttgtctaaggcttctgtccaagactccacaatgtctcatagcctactagccagcatagccttttgttgcttactgttgatcctcagtgaggctgctggcctgccttgcctggacctctgcctgctgcttattaccagaccctcttaaggtgtgcttcatctgctctgtggggacattgccctctaactcatgtctgggcctacacaacacagattattagtctctacttctcatctcttattggagaccctaacctcaaagccataatgggcctgcctagtctctatgttttagatttccccaggctggtctattctagtcccagccaagtttcagttataacttgtgaagactatatgggcagtccttgggccaggttgccctgcctgggccaggtttgtgggcccatcccttgagatgaaagctactgtgtctagtttctcagtcactatgcaccagttaatgaacaaccttgtaaaactttgcttttgatgaccttgtaggctaatttcaagttaatattctgagatggatgatgaaggagaatttttgtgtctttgtagcctacagtaggtagagggatgctgttgggaatttttgagccaccctgagaaaattaggtgaaggtgagaaatgcctgtgtgatcattttggaagctaagttgcatatgaatctaaggtggcattgttagtagtagtagtacttagtctagtagtattcagctccttgccaaggtgcttctggcttaatgaaatgacccagagcttcagctccatagcagggtcacgtgtattggctagctacatgtccttgtgttgaggacttacactttttgaacctcaattttcttacatgtcaagtgaggttttgtggatgatatctttataagctttcagacaatgtcaaggaataccggttagtgggtagtgtatgtgaaagtgttttaagaactgtaatgcatcatacaggttatctagtcttccttcccagatggatggagtttacagacatgggacttctttcccagcattggtggacagagaagatttggatcaacatcctgaggtcagagtgaaggcaaacagcttgacatggagctagatgagaccagcgagacagtacacaaagccaagtacttcggggccagcagagctaatgcatgaggaagtttgaaggagaggaatttcctgagtggagaggaatttcctgacctagagtacaggggctactggcttctttttgtttggtgcctgctgttgcttgtctggtagcttagactcaagttattctggaagcagttaaagggtagaagaagagcagacctaatgtgtgggactattcttataaggtatgacaggatttagggaccaggcaaagggtgcaaagccagtatcagctagtccaaggtaaacccagttcaaaggagaagagtaaatgacctaagtgagcagcaaaggcagaccatatttggacactaataatggtgaattttatgtgtcaacttgactagcttatggtgcccagttgtttggtcaaatactagtctagatattgctgtttagggatttttttagatgagattaacatttaaatcagcaaactttgagtaaagcattaccctccataatgtgggtgggcctcatccaattcattgaaagctttgagattaaaaaaaaaaaatgtggtttcccaaagaagaaaacatttggcctcaaaaccgtaacatggaaaccctgcctgagtttctaggctgcttgaccagccatgcaaattttggattccagactgtaacatcacttcttacccgggtttctagcctgtctgcatgtgcagacttaccatctcccacaatcatctgaactagttccttaaaatctctaacacctgaaaggaacaggactccacaaagaccaacctctctgacagtcctgctgaaatagtaaaacgatcaagcatagagtttttgtgctaaacattccaggggtgcttatttattgaggaacagtgtttctaatcttcaagaaattttattccctgagaaatttccccatttattttaatttgcttgtgcagtcttttaagtgggttatattactttgtacatggatcgctttgctgtgcttttatatgaaaatcattattagtagtcaacataagatacaaagtgtactgcttctataaagcttatcttacagcatatatatagcctgctgaaaatatattgctcatttgttattaaaaatcctacccaagtaaaaaaaaaaaaaaatctctctctctccctctctctctctctccatacgcagacacacacacacacccccatgcacgcacgcgtgcatgcactatggttggaatgttgtttgtccccttcaaaattcatgttgaaatttgattgccattgtgacaatatttaggaagtggggcctttgagaggtgattggatcgacagggctctgccctcatgagtggattaatgctgttgagtaggagtgagtatgttataaaagggcaagtttggcccccttttgctctctccctctcagctcttttgctcttctgccatgtgaggaatagtgtttctccctctggaggatgtagcattcaagaagccgtcttggaagtggagacagctttgactcgatgccaaatcagctggtaccatgatcatggacttccagcttccagaactgtggaaaacatatttctgttgtttataaattacccagtctgtggtattctgtcagaacagcacaaaatgaactaagacaatgtgtttgtgtgtgtttatgtgtgtgcatgcacatgtatgagcgtgtgcatgtgtgtgagtgtgtgtgtgtatctcctatttgttctctctggataaccatgactgaaacagatatcatgaagatagcaatgcggctttgagcagagacagttgcaggattatggagagccttgagtgagctgtcattatgagttcttttaccccaatagtcataaaatattgagtaatatttgagtaataataattaattattactatgtctactaagtgagcatatattgtgccatagaggttggttggcatgatttctattgactcagatttctgagatgctaatccagagcctgagtggaagtctctcatcttcctgtcagagaagctttactctcctgaagagagcaccaaaagctgggtatcctccatcagggaatggggatcagactagaaaaggcctccagctctgtcaggttaatactgggatcaagaaggactttttatattaatggagtcaatgccattgaaagttagcattcatttagtccacttcttcattgtatacatagggagagtgaacctgagagaagagaagccacctttataggccacacagcaagttggtggcacagccaggcctcacactcacatctcctgacaataagtaaggtagagaagaaaggagaaggaaagagataaaggttgtttgctagaagagaagtctggattccggttgtgctttttctatgagccatttggtgagtaattgtcccaaagtttggaagtgtcccagttttcacaactggatagaatggagggaaaatagaaaagtttgaaaagtaaagtgaaataacatagacaacatatttataagggcccctaactgctaaattacaaaattgaaaatgatctatatagttttcattgatgagtaaatctgctttctggtggacttctctagtggcaacaaggctactgcactcagtctcaccaccttgaccaaaggccaagtttgcccttgttaaaataaaggtacactgtgcttgctgtggggccaggcttccttatttctctcctatatttgttcaggaatttggttctgtcccatgaggatactaaattgcattgatcaatgaaaatggcatctgtgcttgtttgttttaacttgactttgatagcttcatccattaaactttcaatgaagttgtaatttctttaaaaaaaaaaaccctaaatttaaaaacatgctggcagttcataattaccttggtatatatcaagatgaatcagtgaaggtgactctctttcctttgcatttagtattgttgctttgtgcctgtattttctatttaggatttattagtgtaaatcccccttatacatcattgaaagcattaggatttatgtagtgttaaatccatatcaggatttatatggaattaaatccaatctaagagacaggtggataacctagtggggttttgtacccataatttctaccgctctttgtggaaaagcatttcattacaaactttcagatttgggaaggcagtgttctgcaaatggcacctattagtaccaatgtggagcgttttactgcactttccatgtagtccctgggctcctcactgagaagcatcctcatggcaaagcatctttcatggccacgaggaggacattaacctcttctctgctccttccctgtttggagcacagcacagctttgattaactctttaaagagccttctgtttacaccctctcacagatctgcagacagtatttgcaaagcacattgcaatttttgacagcaggcaccactggggtggggaagatacttgtcagctttttcctttggtgactttccttccatttttttttatcttttgagggaatgaaaactgctccaagttggtgcttgctattctccttttttatttcttttctcttctttgtatatgcttttccccatcccatataccaactgatggggtgattgagtgactttcatccattcagtcaagtatttactgagtcctacttcatgcaaagtactgtacaatgtactgagtttttagagttatttctttctggggttgttgtccctttttaaattataaaaataatacatacttatggtaaaaatgcacagtacaaaagcatataaaatgaaaagaagatcctcttccacatcaagctcctagtttcactcctttgtataacatcaataacaatttcttacatatccctataaaaattttctatatgtatataagtgtgtatgtaatgtatacattcatacatatatgtacatataggtaacatacacacatttacttatatatgctttcttagaaaactcagactggagcatggtaaacacaagttttgtacatccacttccatgttgtatcaggccatttgctttgctataaagaaatacctgaggctgggtaatttacaaagaaaagaggtttaattggctcatggctctacaggttgtacaggaagtttgctgctggcatctgcttctggtgaagccctcagaaagcttacaatcatgtggaaaacgaaggtggagcaggcacatcatatggtgagagagagaacaagagagagacggagaaggtcccagtctcttaaaaaaacagatctcatgtgcactcaaagtgacaactcacttatcaccaaggtgatgatgctaagcagctaaaggggctgaccagtcacctctcaccaggtcccacctccaacattaggaatcacatttcaacatgagatttggagaggacacacattgaaaccatgtcacatgtgtatctttccatgctttccatgtcagcacatgcagtcttgctgactcccttaaaggctacatggttgaaatgtaactttaggaaaaccctgaggttttgataagttttgtatatagggcactgaatttgattttgaatgtgtaaattcagtgttcatttgctgtcttcaggtttcttttactttttctctatattgagggcactacccagttatgcattctgacacttgaagacttctggtggcttgcaaatgctccatggagatgaaaattaacttgattggttttccttcctgagcaccatgtgtccactctggccttgggcgactctcaaagtgggtttcaaaccaggcttcagagtttgtcccaatactttctaatagtttattttatccttttcataagttttctcctaccgcttcagtccatattttctggtctggccttatcaactataaagttcttgtttatttggaacttgaggtcagtgacttctgacctcactagctttcattctagctcactcttatttaggcatttactatatgcataatttcctttaatcctcatgacaaacccatgagggaggtgcagtaattatctccaaagtgacagatgaggcacaggaaggctaaggacattgtctacggtcacacagctggtagatggaagaactagaatttgaacccaggtttatctgaccctaaaaaatatgcttttaatcaatatatatactgcctcccttaaatcagtatttctagcttttctatgagcctgcgattctctagtggcaagccacaataatagccacactgtgaacataacactgcatgccagactccataccagagggtggagctgagttttctcatgctggaacagcattttcttacaagctaaaccatgggagggatcttgggtgggaagaagcacttcctgcttataatacaagccaaaaagagattcccacagtatgaagcccacagtttttcctgtgtaatgacattatgaagacctcaggcagaatctccagctattgtgcatttttgtttaatacatttatactgtaaattagttagagctatggacttgcaactcctactttgacccaaaacaccaagacacaagagggaatggtcttttattttattttcctgatcagaactctctagtttccttatcagtgttgctcaccctgggtgttgcctctgaattcagatttgtgtgaatggggttttctaagagaaaccttggtaaccaagagacagtttctgtctctgccttcttctggtggactccaatcctggctctccagctgccttgccttcacgttttagggattcagaatcaggatgcgatcatggcccaatcacagaattgaacatttctaagttcctcagtatccaaaaggaaaggcatttcagatgttaggtaactgtcctttattcactgtctgatagaaatttaatggttacaaaggggtttgtttttaggtttttagttttattatttttagtttatttccagcactggaaaattagcctgaaaatctggaaagggaaaggccaaaccgatcacagttggccctggaatcgtgggggcattcccaataataaatgtctagatggtgtgtttattccagttccaatccaatccaattcaatgaatatttgttgaatgcctgctgtgaagaagataaagaatgaataagacatggctctcactctccaggagttcacactgtaatgagaaattgacatgtgcactgttaattctcatacaaagaaggcaataataaaggtctatacagaagtttaaacaaggtgttaaggggatattggaggagtaaaaaattatgtcgaattagagtatctggaaggaatgctgtttgaaagaaggtggttttgagctttgtcttaaaggggtgatgagattattataggaagacattgaggtgaaaggtagtttagtttgaagaaccacacactctgcaggtgtgcagtcccagggaacgcatggcaattagtctggtaaggtggagagcagcatggcatacagctggagcggtaagtccgacccagtttatgaagagccttgaatactagactaagagtttggacttgctctgtaggttaaggggactcttgaatacctacccctcaaaatcacaaaggagtctgtttcctgtcatcatagcacttggttcttctcggtagccccttttacagacaaattccttctagttacatttgtactcatttggtgaagattctctatgggaaatacttgactttaaaaaacttgacacatagtttgatgtaaacgactctgatatatcaataatgtattttattcatttatctcccaattgtgtatgtaactacatatactttgtataatcattgactatgattacagtctgtgttgatataacctaagagtggttatgcatgatctgggtggtattgcatctggaatttatcctactctgtaacatgttccattgagcttacaccaaaccagtctagctatgccatcagatttctctttaccagctctatttatggtctttctctgacattactataagaatgtcaggttaaattatatcagatgcttctctctccaagatatgttaactttgctccatcctctttcaccattcagcttgtcattctatcatgaacaggaattagcttcgtttggcatgatttgtatttgaagaatctgtattgactactgtttatcacttgggtttcccctagatactcataaatgactgccttaataattgtcctcacagcttaccagatattgaaattaaatttatgagtttaattccctgagttccctggggactttttttttttttaaagaaaaatggaacacagcagtttcatgactcacaacaactcttccataataaccaatgtgataaaaacattttttcagggaaacaaatttcagttttagccttccaaatgactattacgaaaattaacaactaataaaaaattgaaatactaaaagacatcatgtatcctctcaaactatttatttattgtactcatacatattcttaagtgcaataaaatctgcctagaaatcattaatccactagtatatagtccttacttggtgctggcaactgaaaatttggtctttttatatacaaattgttacacgcatgaaaagtagtccaataatggcactttttataggttatttcataagtactcttggttggacatatgctaaagtattgttacaggttgctgaggcaacccgcctgctacagttgtggttaactctaaaatttactgataatgctgacctgagacttgagtcttatcttcactgaatgcagtacaggtgtattgtaggtaggctgtaggaggaccatagctacctctaaatctttacagaagattttgaatgtggcttttgttgcatagaaaataaataaaataaaataaatctctacagaagactggcaagagattggtgcatatttaatagcaaacagtgggatgctttgaaagggatggataacatagaacattgaacagcaagagctttagtggggtttaggttttagtagttgtccagccaagactctgcctgttactgaagctagggatatgtggagtgaccaatttacatcagtcatagtagagaagtaattgcttttatctgacaaaagcagtctggacccagtcaacaacatgctgatgctacagtccctattcttgatgttttattggaaagtggtaagacttctttttctctctgagctggtaccaccaatttgcagtggtatgttctagaagcaaatcatatttcagagctctttggttgtgtaatttttttcaataggcatgatgagtattctggaagctgtatcatggtgccttttgcttggctgtgtgtcattactataatgcataggttttttacttgtttgtgtgattgtttttattccaaagactgccatccagggccatgcagcaaacaagcaacagggaaatatcccactatgcaatcctattttgagatgatatttaggatgagagaacatgcattagttacctaccagcttgacaggaatggatttccaaatctgacacaccatagcctgaattctcaccagtttgctcctggaaaggcccgctcatggtaagctccttagagtttgttagtagtggggaagccttgagtttcaggagaacgtgtttggatggcattttaagaagccattccatttttggtagagtagaaaaagtctgcatctgagtctgtagtacagtctgttctctggatgaacacaatgtctctctcacatttttctgatatttattctgcaaatcagcagcatgagcccctgccactcttctaaataagcttccaggcattacctgcatgctgtgttcctgtggtgggatggcagtaatctctgctaagataaacgggagcttctgtggataaagcataaacgcagtgaagtgtgtgtggctggaagatttaatgcctctacaggtaatttttttagagggggatctggcatttgatcaaatccagagtcattatgtaaatttaatcaccttgcaacacactagtaattttattatctccttttcatttgacagtgcttagatacaagttgagcttggaattccagaggtagagcactgctgattggagacatattaagtaaaatgtactgtggaaatgagataaaacctttattcttgctaatgattgtcattgtatgtattcaggtgtccaacaaaggattttagaataaagtgtgcctttaaagtttc

SEQ ID NO: 3934 - DNA, 285969 bp, human
cttgccacaaggagacgctgttcagtttaccggatcctgtcccgcgccagccaaccaggacaaggccggggagctcgagacaggcagcctagaccaagaaccggaaggaggaaaaggaaccggagggaggaagaggaggggcgggacgagaccaccaggcaggatttttaagcccagagctgcgagaccagcaggaaggaactgggagaaaccaatggggaggggatgggggcggggctgagaggaggagggcggagctgggggaggggaagggcgggagtgaggaaaccgctggggcggggttgagagtggggcggggacttgaggggatggggcggggacttgggatggggcggggactcgagggggtggggcggggctgagagaaaccattgggggcggggctatgggcgatctgggcgaggagaggctgcaggaggagctcgcggactcctgagaaccagcgcggggagggagggggctggtgagaggaggaaggtggggctgaaagaaaccagtggggaggggttgggggcggggctttggaagctggtgctggagaagcagggcagggctgggggaggagtggggcggggcggggttcggggggggctggggctcggggaggggtggggcggggctgagggaaccgccggggaggggctcgggggcggggctttgaaaacagcctttggagaagcggggctgggggggcggggcagggccgaggggaacctctggggtggggctggggggtggggtttgcacgcagccacaggagaaacagggcggggctcagaaaagggttggatcgggctgagagagaccgctgaggggggtgctgggggcggggctttggaagcacccgcgggagaaacagggaggagatggggagaggcggggctcggcgcggggcggggcttcggaggcagccgcgggagaagcaggggggggttcggggcagggcgggtctgagcgaagccattggggagcggctgggggcggggccttttaaccagccgcaggaggagccgggtggggctggggcggggcggagctgagagaaaccgctgaggatgggctgggggcggggccttggaagcaggcgttggaggggcggggtagggccgggccgagagaaaccactggggagggtctggggtcggggctttgccatcagtggtgtgaggagcaggccggggcagtgggcaattgagcgaggaacagctgcgggaggactccgcggactcctgagaaccagcttaggggagcggcggcttggggaggtgtagggtggaatcacgagaaagctctgtgggagggcctggtgcacagctcagctgcagggtggagctgagggaaagccgggcgttcctggaggaggagcagggcgaggctgtggcaaagcgctgtgggagcagatggggcggggctgcgggaaagagctggagaaggaggagccaagctgcaccaaggctggcgggtgagaattgcgggggaggagctagtgcagagctggaggaaagagctgaaaggttgttggggtgggcagaggggtaggagaagcgagacggggctagaggaggcggagctgggagcggtgatgaaggggtagcagggcggggcagtgggaaagagctgtgggaggaggagctgggggtaagaagctggggctgtggctgcagcggggactgggtcagagcttctggaggagccgcctgcaagaggagggcgtagttgtgggaaagagctgtgggcggaaatggttaagtgccgggtggagcaggggctggcgtcggaatagctggggcggagctgcgggaggaggagctggggggcggaactgtgggaggaacagctggggcggagctgagggaggaggagcaggggggcagaacagctggggtggagctgtgggcggagctgcaagaggagaagttggggacggacttgcaggaggaaaagctaggggtggagctgtgggtggagttgggggagggagctgaggcccttctgtgatgcacccttaggcaagagtccaaactttcccgcggcgacctaactgcacctccagtgtcttcccccagagggcacagaagcagcaagaagggcgggaacacttgactggggtccatgcagctctaggctgagtcttgcagggctgagccccccaggcctgctctcctgtgtcctggccgctccgtcagtgcctgccagtggggtccagagggaccgtttttttaacgcctcttttgcaggtaatgagaaacatcccccctcttaatgtcttgcctcctccggcctaagtcgcccagcacacagcccaacttccctggcaaacttgcttttcaaactctcttctctcagtcacgggctcaggttctgtagtgctgccatgctttactcctctgtccctccccttatctagtctcccgcattgacttcataaccaagttctgggtccctgcctctggagtgcctgatgagacaaaacggctcctcgtcctgcatccccgctgctacttccagaattcaggcctcgtggtctggagcctgcactgttccatgagcctcctgagcaacctggagtcctctgtctttcttccctcaggtctgtcgtccacattccatcggctcagtttctaagtcacaaatctgtccccagcaatcctctagtgaaaacgctgctgggccttctcaggtttaagtcctagcagttcagggagtcggctcagctctccccacccttaagccaaacactctttgggttcacgctgtgctgttcagtcactggtccccaccagcctgctgttccaggtctccctgctttgcaccggcggttcccatggccttgtcctggtgcgctcctggcctccttcaaggcacaactttaaagtcaccttcacagccccactccgagtattagagactttcgtctccagctctgatagcattttgtacctcccctgtccccaccctacgttaggctcttgcaacccagggtggtaattgctctgtaagactgtggctgccgcagggtctcttgagttccttgaaggcaaggccggtgttttactcatttctgaaactgggtgcccagggcacagtatctgcttagtaagtgttgaatgagcaaagggcagctttcttgttttttctagtgagatgcgcctacttctccctggagaagcttgaggaagcagaaatgctggagatgaggtgaggaggagagggtccctctttatgggatgtaggccgtagggctgcaggggaccttcagatcaccagttccaagtcctatgtatgctagcatcccctcctgggttccttccccacaagaatggttgccagcttctgccgaacaccccagaatctgcttagagtggtttcagatcatgaatgaggatccccgggatggtgggtggccgttgctcctcccgtggcctcttgtttgaagaactagaactcgcataatgagctggatagccaccgtgtggctgctagcagggaagcccttggtggccacataagggctcccttttccaactctctcagctgctcctcactctcactcctgggtgtgctgggcagtggggtgcaatgtgcacgtaggtgcacactctccctgggcggcagcgagcagcagaggtctgatctgtggtcggatgacgagaggaagtgcaagtaaagcagctgcagcggtgagtgggcctaggaagaatggcatcaacaggccaggcagggatgcgggtggtgttcggctaaccctgagaaagggaccagaatgcacctgagtcttgattttcattcccaatagcaggtcagcacgaaacccaaaaacgctctgatttctgccttccatgccacactctcttcacctgctgccttctcactcctctcattaacaatgtcctggcaggaacaagactttcccctccctctcttctcgtctcttagcaggtcaggtcggccttcacctccctagacccgtcctgctcctgccttcccctgtggggccctccatggatgctctggagtcccgggcaatagtcagccaactgcagacatgcggggccttcttgggttccttgctgtgctcccttgaaaccactgtgcctgactgcaccccagtagcacacactgaactgacccccactcctggggccagcggtgtgtctcctcaagttctgcttgcttcttcaggccttgcttgcatgcctatcgtgccacacatcatatctcttttaggaagtccttgccttttccaaagatcctgctttgcagctgactgtaccctctgcctgcctcccccaggatactgcctccttcctgaaaccacagcccccgctcaggtcttccttccttcctcatcaccagggagccccctgcagagctcccggtccatcctggtggccttctgagcctcacctccccttccttcccctcccatcccttcccctcccctccccttccctctccccgcttcccttccctaccctaccctgcccccccaccccctgcccccaaccctgccctctcctgctctgtcctctccctccatggcaggctaacctccctggctagagctgtcccttgcgaatttgccatcaccttgcctctctgtgctcagcatccccggctgtgcagtccttctcttctgcccacatgctcccctagagaagcattctttttgctcagactaatttccgtgcaactcctcctgttttctgagcctgtcaccgccttcctcttcctttgcctccccactgacactttccagagtgcagccacctctcctcgctgtgcttttttgactctgaggcccaggaggaagttgcccttctctggagatggttcacgtttgatcctgcctagtgttccggggcacggccagtctgggaccgctttgaccctgattcatggtttcccttcagatgctttttggtcagcctgctttcctcgtctaggaaatggcttttgcccatttttctttttctttctttctttttcatttttttttagacggagttttgctcttgttgcccaggctggtgcaatctcggctcaccactacctctgccttctgggctcaagcgattctccttcctcagcctcctgagtgctgggattacaggtatgcgccaccatgcctggctaagtttgtatttttagtagagatggggtttctccttgttggttggactggtctcgaacttcgacctcaggtgatccacccgcctcggcctcccaaagtgctggggttacaggcgtaagccaccgtgcctggcttgcccatttttctattgagtcatttgccttgttggtatggagttgtaggagctctttctgaattctgcctctaaccccatgttggctttttgtatttcagagacctcgtccgcacaggggcttgttcttctgtgtctttgcagggctgttttggactcagtattcacctaagcactccaaattgtaagtaaccccagagatcatggagtgtcccactgcccctccatctgaaggctgtgacctctcccccaaggaggaggtgctcgcatgcgtccagtgccctgcccattagattagggagggttcccttttttgctctcttgcactcatttgtccgccttttagctttccttttctgccctgactctcacagggtcgtgcggatgtgcgatgtaggaggaggagagaggtaaagtggaggaataggagctggaggggaggaggagagaagaaaagaggagaaggagggggaagagagggagcgggttcaaggagggaaggaggaggagaaggagaggaggaggagatgagaccaaggagaagaggtgaaggaggagaggaggacacagaaaagagaagaaagaggagaggagacggagaagaggaggaggagtaacaaaggaggaagaagaggaagaggactagaagagcaagtaaggaggaggaggggggagtaggaggagaggagaaggacagaaggggaaggagaggcagatgtggaggagaggaggtggaggacaggaggggatgagaaagaggaggagaaaaggagaggagagggatgaggggggaggaggaagagaaaagaacaggaggagaagaggaggagaaaaggaggaggagtgaaagaaaagaggagaaggagaggagggggggaggacggggaggaagggagaaggagagaaataggaggagggaggaaaggaggagaggacgagaggaggagcagaggaggaggaggagaggaaggggaggagatttggaggaagaggggaggtggaagaagaaaggagaaggcggagaagaggagaaagcagagaggaggaggctgaagaaaggaggaccaggaggagaggacgaggaggaaaggaggaagaggaagagtggaataagaggagcagaggaaaaggaggagggggttggggaggagtggagaggagaggaggaggaacagagttggaggaggtgaaagagaaaagaggagaaggaggagaggaagagagaaggaaatgagaaggagaaaagtaggaagaagaagagagaagaggagaggatgaggaggaggagaggagaaggagagcaggaggtgggaggaggaggagagtaagaggaggaaatgaggaggaagaaaggaggacagaaggtggagaggaggaggagaggaggagaaggaaacgaggaggaggacgaggctgcaccacccttatcaggttccagttctcggtgcgccccgttctgcaagacactctcctgtggtcagccctggtctgcagaggattcccgcgctggatctctgaaggatgctggcgccctctctgcagcacattcctgatgcccttgctgacacgtgtcctctgggccctctcctgaaacctgattctccggggtgtcttctggcctcacctcttctgtccagttccagcaagctcactttgcttagcctttgaatcccttccttcactgtctgccatgacagttcaggcctttcaccgtcactcaggcctggaccatcactgttgcccatcccatgccatcaacaggtttgccccatcccttcggctccctaccagggcattcagttgtgttgagcagcagagtgtctccaagtccccactggttgagctgcatccgggtcccatcccacagggaccccctggccgctgcagatgcatgctgatcctgcagctcctcgagggtgtcatcgctttcccccttcccagacccagcacaccctgcctgcatggcgctgcgctgcaccttcactctggtcacgggtctggcagtcagctcaccaattcctcctgcttccctgggacttgccggcttttagcactgcaattcactcagcaaactgggactgttggtcaccctacctggcagccagtgataaggtgagggccactcctgggagggaggacacctgtggggaaaattcttgtgttatttatttctccttcgggatagggtgcctgcagcgcttcatgggagggggtgggctgatgctgcgggctcagaagtttcaagggcatctggggagaccagatattcagagaccttctagatgtgcctgttccatgtatcagggacgcaggttttcccaacagggctggtgtcattggcatgacagacctgccttggctgagcgttcacctgtctttggagttcagccaccttagcaagtcctgggtttgttcttcagactttgctgctcgcccattgcctggatcgggggctactttgtaaaccaccaggaagactccagtgtttctggttaatttttagatgtttgttaattgctcttggtctctcattaatcccctgtgggtcatccaggaaacatactcaccactgtctgttctctgagttttcatttccaggcatccgccctgcctggatctcctcacctgccaggaacttcctctccacaagccggccatcccagcaaaagttctaacaccaaaggtctggcaactagcctgccatcttgtgcctggagccgcctgcgtgccacctactcccgaagatgggaaccttgttgccagttgggcagatgcggggcaatcctgtaccaagaccccattttaccacctgctttctcagaccactctggaacccactgtctcagattgtgtcctccaggaagcagaccatgagagggagttggcagggccaaagatttactggggctaactaacactcaggaaagggataggaaggaaacagggctggagagcaggttgagcccgacctgacagtctcgagcagcccaacagggaggtgtggagcaagggttgcccactagaggggcctgcattgggtacgggtgatggggtccacatggtacctggcatatagcaggctgtgcaatccatattaactgactggataaattaatgcccagaaaaggtgccctggagaatgggtgtgtgctgaacacaatagggaagggcccagcatctgccttggcataggcagaactgtgctgtgccctgcaacaggccacctgagagctgctttgatcttgtgtgtacattagatgactgccaggggcatgaaggggatgtgcttccagggcatttgctggcagggcgtctcgtgatctcttggtattggtgtgagcacagcctggcaggagagggcagatctccatgcaaagtatgtcagaaagcagatggaagccaggccccctcctgaaagaggctccttgaaggtaggtgcacactcatgtctttgttacttgtaagggggcatcttacaggcaagaggagttaggtgaatgtgaagaggaaggaactactctgggcagggggctgggggacgcttcgtagaggagggggtgtttgagctgggccttgaaggtcaaaagggttttgttaggtgggaaatgggggaaggacagtctgaaagggttaggtacattcaaggagcccagagaaggttcgtggctggagcagacgcattcgtagagtgaagtcatgggagagaagaggctgggaaactagattggttccaactcctaaaggaccactgaaggagtgtgggctgcacgctgggtgcagcaggtgagtttcctcacttgggtttcactgtcagcattttaaaaaggcaaactggttttcttcctgagaagaattcattgattcacttgtggccagtaagtcatctgggccagaggttggtggggagatgataggggtgcaagtgtcatcttcaatcacagcataactgcccttgctttcttacctctcgtttagatatttcaatgcttgctcaggtcccctgcgccctccttccttctcccttcccagccatactacttatgggatgactttctctttgtaaaatgaccgttagtcttatcaaattaatcccaaagtaataccatcaatttccccctaaaataccaacaagacccctgcttgaaactgcttgtacattagagacagagaagagtccatgagaatcaacattttctgaggactccaactgtgtgccaagagagttcccctgctggtgcctcctctgtagtaaaggaaaggtaacattcctgcaaggctttgaagcttacagcgtgcttgcccttagattcttgtgttgtgttctgggtcagcaggaatgcctcgccaggtcctttttctcatcctaatgtgacactgaattcttcacaggctcctgggaccacattatcattctcttcactcgagagatgaggacactgaaattcagagaggggaagtgatttgcctcagcttgtactgtaagtgatcaaggcaggactcaaccagtctttttgaccctgactatggtgatttgatctctacaccacaagatggtggtggaatggtggaatatggtaactagaaggccctttctagctcaggacacatttgatgctgtgactgtttgggaattcagtcctgaccaatttaagaggttgtgtttcttagctgtctctggctcctggtttgcccagtttgattctgtgcctgcctagcaaaacctctctgtctgtggtctaagaagcctgacatctctgaactagtcctcttcctgtccactcaatatcgacagaatctcatggtatgtcctcctggctcagccatggaataaagccagctctgttgtttttgtccttgtgttgtgccccagcttaggaagaataactcttcaggctgcctctcccatgctaggtcacatgcaggtcacacattcccaggtaaattttgcactttgtttatctggaatttgtcttaatttccttgtccttgtttctgattgtgtactctcttcccttctgtctcattatctgggccctatgtcttttctcatggtttctcttctgtaagtctctagacccgatgcaagtacacagtgaagtgaatgaagttaaagataaagcttcagtgtctcttgcttgaacagccctggaaggagccctagcattatggtcctacagttgtatggtttggaaaatctacaaaagatattttaaccacagttggttcagggaatctttctttccactatgctgtctctatccctcttgcctgtgtgttgggtagcaatgcaatgaccatggtcatattgagaattcaactaaggggacattaagttgggattcatttagtttaggatatatttttgagatatctttcaggagtccacaggcaattccatatatttcccagtttttgccagctgccctttattggaatagcttgcaggaatacttctgctcactgtgctgatgcatccagtgttaggacaagaggggtgaggctgaagggtacattgtaatgtcactgtgacttgcagcacttggcatcaggggtatgttggcagtggaggagaaccaagattcacaatgtacagcaccagaagctagtctgtggaaaaatcttccagtcatcaatcagatgtgtaaaattgtaagtgaaggattccattttcactgaaaagcaaaagtgctctcttgtcagaaatatacccagcgtgcagtgtacgcaattgtaaatacaagatacatttatttgcacatttggaaggggattttgtgaaatggcatttttcagaattcctgtgattgtaggacatggacctgtagaaggactagaaacattgagtagtatgcagaagagttttgctgggcaggcacagaattaaactgcgcaaaccaggagccagagacagctaagaaacacaacctcttaaattggtcgggactgaattcccaaacagtcacagcatcaaatgtgtcctgagctagaaagggcacagtcatagttcctgtgactgctacccttagaaagacctgcttggaagttacgctccctgctggcatctggaaacttgactctcagaatttccctagtcaacagttaactgataagatggctcactgtgccttgactgttgatacagaaaacgtagtttatgctgaatatctgctttccttctgggagtctggaattttggtgcatgctaggcagaggaagtctctgttaccaaacaccagtgtaaagtgtgggcaatgagtctgggcttctctggccagaaacatcacacgtgccactgcatatttgttgccgagagaagcatgtgctctgtgtggcccctcatgggagggagagagcataaggaagtctgtgcatgggctcctccaaactttgcctgtcttttctgcttgtgatctggctgtgtgccctaactacattgctgtaataaatcttggttgtgattataactatatgctgaatcctgtgtttccaactataacaaacaagaaaagcaggaataacatactatagaagtgcatgaggcagttaagtactaaagataagtagctatttatgttatttttttctaaattttcagatgtttctaacatttgtcaacgttttcaaatgtgtgttcttttgttttttttttctcactttaaatatttgcttttgttcccaattttatactggtaattttgcattcttatacttaaagaaggccccagatgttacaagcttcaagccccacaaaacctggatctgtctctgtcttggatccaagacttgctgcctcatgttggttttcctgttgtcacttcatattacacagatggggaaattaaagccaagagaggggaagctaaccttacttggcaaaactgggacaggatccagttcttccaattcccagtttaatgagtgctctttccccctattctgtaaagttttttggtaacttgtctgtaaatatcggtcatggtacattgtccactgggtggcactcaagagattgaaatttgagttccttctctttgagtagttgggtagtcttgaactagtccctttccctcctgggacagattttcccagtttgtaaaataaaggggctggatttagtgctctttatagacctttctctctcagatatttcctgagtttttcattctagaaatgctggaatcatatatttgtaactgaaactagtaatcttcttgttcttgagtcttcttcatctctaaagtggacataaaatacatacctctcgtggttgttgtgaagcccgtggcactattcatggtagagcaggtgatcaaaagtcgcttgcatccttctgtccaattgggaacaaaagctttcatgtataattctcacacctctcccttggaatcagacaatcttatcagaaaacctaaaaatttttttcaatcaatttagaagtttattttgccaaggctaaggacatgcctgtgacactgcctaagaaggtcctggtgacatgcccaaggtggtcaggccacagtttggtttttagggagatataagacatcaactgatacatgtgagatgtacattcgtttggtctggaaaagcaggacaaatggaagttggaggacttccaggtcataggcaggttcagaaattttctgactggtattaataattggttgagttattatctaaagacctggaatcattagaagggaatgtctggtttacgataaggagttgtggagaccacagttttatcatgcagatgaaacctccaggtagcaggcttcagagagaatagattgtaaatgtttcttattagacttaaagagtctattgtatcagtcttaaggacagtgttcatgttgatggtaatgaggcatgtccgactcccccttcctcatcatgtcctgaactagtttttcaggttaactttggaatgcccttggccaagaggaggggtccattcaggtggttggggagcttagaattttatttttggtttacattctttccttctggccaggatttgccagaggcaacatcaatggacaaacttttattttgtcccatagcattgtggaggtggtttggctgcctgccccaggtccatcctgtcccttggtaggatctctatggccaagagacttacagccaaaagacttatagacagtttaaatgttctaggccagacaggaatggacgtggacaggcatttattactccttaacaattttgaagtaatgtaaaagccaacaaacagaaagtaaaaggcgaggttacaaaattgccttatctatctttaacttctatgcattgagctactgtagtcttggttttagttacagatttttagcaattggctatataagcaagcctaaattttaaaaagaagagaaaatgaagcatacatttaaaagttcttaaactttttttttgaaacagggtttcactttgtcactcaggctggagtgcagtgatgtgatcatagctttctgcagccttgacttccgggctcaagtgatcctcccacctccgcctccttagtagctaggaccacaggcatgcaccagcacacccagcaaattaaaaaaaaattttttttaaagatgagatctcactatgttgcccaggctggtctgaaattcctgtcctcaagcaatcctcctgccttagcctcccaaagtgctgagattacaggcatgagctaccatgcctggcctaaaacatttttaatggaagtataatttgcaaacagaaaacatgcccaaatattaagtgaatgcactgatgaacattcacaacttaacaagatagccagcacttaaatcacaaaatagaacaccgctaggacctctttgtaataccctccaagtcactacttctgcccaaaggtaatcgctattttgcaacattttttattactttatataaatgagatcgtacactgcgtaatcttattactgtctggatttttatattaaatattgcttgtgagattcatccatgttgtcatgtcagcaatactttattctcattgccatatactattccatttttatcagtataccatgatatatttacccattctgctatttgtacatactggaattgttcccaggtttttgtaatacaagcaaagctgctatgaacatgcttggatttactttctttggtgaatatgtattactgttatgtacatgtctagaggtaaaattgatgatttatgggatatgcatatgtttaattttagcagatattgaaaaacagatttttaaagcggctgtagcaatttacattaccaccagcaatgtgtgagttccatttgctctccgtccttgacagcacatgttgtcacttaggtgggtatgcagggggatccttttttggcatgtttacttatttttttacacagtgcaaactggtgtggtgtaccgttttatggcttttgcctaatgccatcactaaagttaccaaacaattccatcacctcagaaattgctttgtaccgcctcttggcattcatccccttctccattctcaaccctggcagccactgatctaatttccattcccatagttttccagattatcaaagaaacagaatgatatggttgtaaccttttggatgtagcttctttcaggtagcaaaatgcttttgagatttaactatgttgttgtgttttcagtagttcattcctttgtgtgtgtgtgtgatagtctgactctcttgcccaggctggagtgcagtggtgtgatctcagcccactgcaacccctgcctcccacattcaagggattctcatgcctcaacctcccaagtagctggaactacaggcgtgcaccattgcgcctggctaatttttatatttttagtagagacaaggtttcgccatgttgaccaggctggtctcgaactcctggcctcaagtgatgcacctgcctctgcctcccaaagtgctgggatgacaggcgtgagccactgcacccagtccagaagttcattgctttttattgctgggtcatattccattgtatagatgtatcacattttgtttatgagtcctatagttgagggatacttggtttgtttccattttttctctattatggatacattgttataaacatttgtgtacagggtttgtgtgaacatagtttttatttcttttgagtaaataggagtgggattgctgggttacttggtaaattgctgggttatagttctttttgagaacttgtcaaacttttgctgagtggctataccattttgcattcccactaggagggcttgagagttccagttgttccacattcttgccagcacctggtactgctagtttttctgtgtgtgtttttgttttgttttgccactctaaggtgtatagtggtatctctttctggttataatttgcatttctctaatgattattaatgttgaacatcttttaacatgcttatttgccatccatctaacttctgtggtaaattttctgtttatattctcgtccattcaaaatattgggttgcttgttttcttatggttaattttaaaagctttatttggaaataattatagatttaaaggaagttgcaaagaattgtattcccttcactcacccttccccaatgttaacatcttgcctaactatggtacaatattagtatcagaaaattgacattggtacaatccacagaggttattcagattttaccagttatacatatacttgtgtgtgtgtgtttctatgcaattttatcacatgtatagttttgtgtagcttccacgacaatcaacatacagaactgtgccatcaccacaacattcctctcatattacctctccacagcctcacccacttcctactctacatcccttacccttatcaaccactatttggtttaccatctgtataatgttgttattccaaggatgttatatacatggaagcatactatatagtatgtttccttttcatatttgctttttttcccactcagcataattcctggaggttccttcaagttgtgacatgtatcaatagttcattcctttttattgctggatagtatttcatagtatggatgtactataatttaagcattgtcaattttggtagtttccactttgagctattccaaataaagtttctgtgaatattcatatacaagtttctacattaacataagttttcatttctctggggtgaatgcccaagagtgccattgctgggtcatttggtaaatatatttttttgtttttctgagatggagtcttgttctgttgccaggctggagtgctgtggtgcattctcggctcactgcaacctccaactccctggttcaagcgattctcctgcctcagcctcctgagtagctgggattacaggcatgcgccaccatgcccagctaatttttgtatttttagtagtgacagggtttcaccatgttcgccaggatggtcttgaattcctgacctcataatctgcctgccttggcctcctaaagtgctgggattacaggcgtgagccactgtgcctggccaatccatttttagtgtttaaagaaactgcaaaccaccatggcacatgtatacctatgtaactaacctgcacattctgcacatgtaccccagaatttaaagtataataaataataatactaattttttttttaaaaaaagaaactgccaaactattttccagagtgattgtgcagttttacattttgaccagcgatgtcagtgatccatttgctccacatcttcattagcatttggtgttgtcacagtgttttattttagccactttgataggtttctagcaatatctcattgtggttttaatttgcattttcctgagggctaatgatattgaacatcttttcatgtgcttatttggcatctgtgtatccttttcagttaaatgtcttttgcctcttttctaattggattttttttttaatgttgagttttgagagttctttatatattccagatataagtcctttgtgggatatataatttgcaaatttttctctcagtttgtaatttgtcttttttcatctccttgaaagagtttttcacagagcaaagtttttaaatttgatgaggtataattttcaatttttacttttatgggtcatgcttttgatgccaaatgtaagaactcctcacctaatcttatgtctgaagattttctcttgtgtttttttgaaaagttttacatttttacatttcacactatgttccattttgagttaaagtttgagatttaagtcaaggctcatttttctttttctttctttccccccctccgccatgtatgtccagttgcttcaacaccacttgttgaaaaaactctgcctcttcctttgaattggttttgcacctttttcaaaaatcaattgggcatctttgcatggatctatttctgtctctgatactctttttcgtctctttttaagagtcagtgtctcactccatgcccaggctggagtgcagtgatgcaatcatggcttactcctaggcttaagcaattctcctgcctcagccttctgagtagctgggactacaggtgtgtgccaccatatgcagctttttttattattattattttttgtagagacagagtctcactctgttgcccaggctagtctcaaactcctggcctcaagtgatccttccaccttggcctcccaaagtatatgtttgctattctgttctgttgttctatgtgtctatacctccttcagtaccatactgtgtggatcattattactgttgaattttgagggttttttttttattctggatacaagttcttcttcagatttatgatttgcaaatattcttttccagtctgtggttagtctttttattctcttaagagtgctctttacaaatatctttcttttattaatttccaatatcgcctgataacgttctttttttttttttttttttagacacagtctcactctgtcacccaggctggagtgcagtgatgcaatcttggctcactgcaacctctgtctcccaggttcaagcgattctcatgcctcagcctcccaagtagctggaatcacaggcatgcactagcatgcccagctaatttttgtatttttagtggagacagggtttctccgtgttggccaggctggtcttgatctcctgacctcaagcaatctgcccgccttggcctcccagagtgctgggattacagacgtgagccaccacgcccagctcctgagaatatacttttaatgatttcagttcttttaaatttgttgagtttttttatggcccacagcatggttgatctctatgaacattccatgtgctgctgaaaaacgtgcattggatgtagttttaaaaatacgtatcagttaagtcaaggtgaatagtagtgctgtttaagtaatttatgtcatcactaattttctgcctacattttcctgcagttactaagagagaagtgttaaagtttcccattataattgtgtatttgtcattttattttttcagtagtgtcacagtttgtctaatatattttaagctctgttaagtacatgcacatttatactttttatatctaattggagaattgacctctttattattgtgtaatatctcaatttctgacaacattctttgttctgaagtttactttgtctgatattactatagctacttctgcacaatattttacttctagtaatattttagatcagataatttatttctttttagcactcttgatttgtttgtgaagatttatgtttccatctaatatattccttcggtataaaaaaacctcttaaagatttcttgtagtgtaggaatactggctaggatttccatcattatttttgttttcctgagaaagtccttatttctccctcattttaaaaatcagccttatggtgataaaatttacataccataaattcacccttttaagtgtacaattcagtaacttttagtgaatttacagttatgtaaccactaacataatctactcttaaaacattgccatcacctctgaagatccttcatgccagtttgtagtcagtcaccttcctatccccaaccctggcaaccactaatttactttttgttattgtagatttcctgtctttggaatttcctataaatagaatcacacaatatctagtcttttgtatctggcttctttcacttagcataatgtttttgaggctcgtcaatgttgtagcatatatcagtattttgttcctttgttttgctggctagtatttcattgtatggatgtatcatattttgtttatctgtttaatagttgataaacatttggattgttttcactttttggctattgcgaataattcagtcatgagcatacttacaagtctttgtgtgaacataggttttcattttatttattgcctaggtgttgaattgctggttcacatggtaaatttatatttagcatttgaaagaattaatggccaaactgttttccagagtggctccatcagttaatattcacaccagcaatgtcatcttctttattttttaatttattattatttcaattgttttttggggaacaggtggtatttggttacatggaaaagttctttcgtggtgatttctgagattttggtgcacccatcatacaagcagtatacactgtacccaatgtgtagtcttttatccctcacacccctcccacccttacccatgagtcctgagtccattatatcattcttatgcctttatgtcctcataacttagctcccacttataagtgagaacatataatgtttggcttttcattcctgagttactcacttagaataatggtctccaactccatggaggttggtgcaaatgccattatttcattcctttttatggccaaatcgtattccatggtgtatgtgggagatatatatatatatagatatagatatatatctcacattttctttattcactcattagttgatgggcatttaggctggttctatatttttgcaattgcaaattgtgctgctatgaacatgcatgtacaagtgtctttttcatataatgacttctttacctctgggtagatacccagtagtgattgctggatcaaacggtagatctacttttagtgctttaaggagtctccatactgttttctgtagtggttatagtagtttacattcccaccagcactgtaaaagtgttcccttttcaccacatccacaccaacatctattattttttaatttttaaattatggccattcttgcaggaattgtgtgtggttttgcctggcttatgatctgggaaacttgcatcctcctgttagtatgtctagttagctctgagaagtggcttggtttaatctagacctccttttctaaacacgtagaaattcctagggaaaatgaaatgttgttctatcactccaaggtttctttggggtcttttaagggataggttcctcttctgaaagctcaaagtcacccgtgattctgggtaagagcaggagtaggttaacctaagcagttgctcaataggttcatgcctgtaatcccagcactttgggaggccaaggcaggcagatcacttgaggtcaggggttcgagaccagcctggccaacatgatgaaacccccatctctactaaaaatataaaagttagccgggcgtggtggcaggtgcctgtaatcccagctactcgggaggctgaggcaggagaatcgcttgaactcgggaggtggaggttatagtgagccaagatcgaaccactgcactccagcctgggcaacagagtgagactgtgtctcaaaaaaaaaaaaaaaaaaaaagcacaaaggactgttcagtacttttacattagctaagaactaatttacgctaacttcttttttatatgcaaaagatagtcataggatcttaataagttgtgtaatcatgttatttgagattgtatactatatgtagctcatgtcacattagttattttcacctaaggataccttaacattaggcctacagaaaattaatataatacctttgttctctgcaaaaggctacaacaagtgatctctagaggtgttttctgactctcaaatctctaactcttggattctgcctcatccagaaaggtttgggttaccaaagcaaagtaccataaactggatgacttgaaaacaacagaaatttatttttcatagttctggaggctggaagtcttagatctgggtgctaatatgagttctggtgaggaccctctttggggttgcagatggccatcttcttgctgtgtgttctcacacagaagaaagagagtgagctagctctctggcctgttcttataagggtacttatctcatttaggatggtcccaccctcatgatctaatcaccttccaaaggacccatttcctaataccatcaccttaggggtcaggatttcaacatataaattttgcggggacacattcaatccataacagattctttcctgttattattttagaatgacatggactctttcccagtccatttgggttaggattcttattcagcctggaggcagagccgtaccctgtatggcctatcacattccttttagcctgggtctctggttacttgtagaacccttatttataattattgtctaatgctgggattctccagagtgctgcttggagaaatttagcctcttagagacagttgcaataaaagaattctatcaaaaagaattcactgaattgtgatcacaaacaaaataactttgtggggataaaatgtactccaacaagggaggcttatgtttgtttttcagcctctcctcccagtgctgcacttctaatctctctgcagaaagaaacatttcaacagagaacccagtggaaattatgacatgttatcttctcagagtcctgaactcccatccctacctcagaagagactcctctgttcacagaagctaaaggcagttccttcccaatggcaactatgtttggatgttggatctacactttctcaagcactgtgatcttcaaatgtaagtttagtaacataaatatctttttgcagcctgaaagaattttatgtctctgtgttatcaggtaatgtttcagtatctcatattttgctggtaacatttagaatgttaatctcataaggagattttagagttatagttaaatttctttatctgggttagatgggaatcctttattctggggaaagcaaagttctttctataagcctgggttctcataatatacagactgggaaacttgggaaagagtaggagcatcattagtttcattttataggtgggaataacaaagcatggagagacaaacatatttgccaaaatagttattctcaactccttgttttgggaattctagagtgtttcataggatttcaaagtacctcacaaaattgttctaaatttctcaaagccaaattcattttaattaactttaattttttttgaaaagttatagcattcttgggggtaggataggtacattttataaaaacaatacaaacaattgttttgcttagaaccagtgaaatgtcaaaactccaaaaatgtttgggaagcactggattagtcagtagcataacaagcaataaaacaacccaggtcaggtgcagagagatataaactcttgtctcatcctccatagatctgtattttcaaaggcagagtcttgtgtgactgcatgtctgaggatatgtctcttctggacagggtttttacagtacttgagaatgatcctaacaaccttttggggtgactcaatttttttcactgctagagaggtaaaacaaatattgatacagttgaacagtgagaaattgagtttggctggagcacaggcacataatggtagaattatgagcctgtgctaggctgtgtgggtttggccaaattgggtcaagtgaaaacagaaagatcagttagaaacttgcaatagtttcgataaaagatgttatggcggttgtccaactttattgtgaactctcttattgtactagtgtttaaaagcagataagctgttacctcttgaatcccacaggctgtctagttatactggtcaggatctcttccagctcaattttttaaaaaatcctttgccttgacttccaaaggcacctgttaagagtggacttctcaagctgtgtaaagtacttttggcataatcaagtctatgttgttccatgaagctctaagtccagagtaactgtctttagttgatcatattgaaagcaagaacatcatttcaaacaaaccaagtctgagatatttaacccacatgtgctttcagacctggtatgtatgagcttgagcaatgaagccttattccattttgatgttataaaaaatggagggatttccctgcagtcagtttcacagccactatttgacttatatttgaagggggaaagataagggctgtgttcttttgatctgaatttttctgttcttaaaagttttcttttctaagaacactagtcagtacctggagacactccgacatatttaaagaattaatttgctttattgaaaaaagttgtttctttaaacatttaaataattactttttcttcagtgacaaattagtttgctttaatgaaaaaaaaggtttttttcataactttcattacatgaacctttagcaaaggagatttctcccattatatacttcttatgatcaacaaattccatcatctccccactaagagaaagtactccaagatgatagaatgattttaaagttatgggactacaacagcagccacaggaaccttgagtaagtaccatgaaccctgaccctcagcgttaatttgtaagcctttggcagtgagatggaatgtcttccttcagtttgaaacaaaggaaacctattgcatcgcacgtaaatttgtatattgatgctatattgactttgtagctgccatgccttcatacagacacctcatccagcccccactgttccacttattgtgatggtttgtatatctttatttcaaagaagatctgtttgaaccgtgtttaatttcttctttgacctgctttcatcactgcccatgcctaccctggtggcattctcatccacgagactaccacatccatgccactaggtggcattctcatccatgagactactgcacccgtgcgcacgtcaagaagtagccaagccatgggctggattgtgcttttcctgagaggatgaaaggcttcatggatacatgctagtatccatgttcctctattctcaagtcaggcaccaagatgatgtttcatacctgcctgcctttcaaagtctcataaatgttcattgaatatccactctatgcaaggcactagggtagtcacagaggcaaggtttgagctaaactacaggccctgccctccaggagctcccggtctcatggcagggtgcagaagccagaatagagggccatggcatgggagagaactctgctgaccgggagctctgaagggttaggggtccatgagcctgatttatggggtcgttgccataggattaggggctccctggcatacagtgaatggagagactagcattgctgtgttatttcactgagagggcaccaatgttcagcctctgagaccaggggaggaaagcagtggccatgaatgttccctcccatcccggggactgactgggctcctcccacagtctcagacacagaggaagaagtgtactcacactgccccaacaccagtgagtggaaatatttataggtctctcatttggttttaatttttatttttttatttttcagaaattaaaaaaaaaatcacactcacaaaattaaccattacccacattcctaccaacaagaagtaaccattcttaaccttgtaatatgttggtttccagatttatgtttatgctttaaaaaattatgcagacaacatattagcacattgccccttttctcatttgttttaatccatgttcttcccatttatacaggagcaattcttgcattcagttatgggatactataaatgcctagtataatggcagcagagagaattactatggttgtataccttttctcgctccttgctcctcaaatgccttagagtttaaaatctattgtggaaagtttgtgaaatgcagaacggtgaaaataaacaaattaccagtggttctttggcttcgggagaactgtaattgatgttcattttggtatatttccctccagtattttttccatatggttttatttttaaaaattttaccccatatatatatacatatatatatacatactaactactcacaaaattaaaaattaaaaaaattaaaaatgtataaaatgaaagaaaaaaattagcctcattttgtatttactattttataatctgcctttttgcttaatcttctttgtcattatatgttcttctacctcatgatttttaatagctgcctagtattccattgtatagccatagttatttcatactttataattgctattgctagacatttagttggtttcctttttttgcttttataataatgtgtgttcctatacataaatcttgtaaatgtctgattttaaagataaatttctagcagcaaaacttcttagttaagaacatatacattaaaatacactcttattatatttttctttaccaaagtaatatatgtttattatagaacatgtacaaaatcacagatatacaaaaaaaacagcatataagttacttgtattcttcccactcagagacagccactattaacattttattgtaaccatccagccttcttttctctgtattctacatgctctttcataagctttttttattgaatgtattcagaatacctaagttcattgttcttttttaccttcactggttacatggcatttcactgaatgaacaaaccagaatttgtttgatgaatcttctaatgctggacatttcagttactttctgtttttctgtactataaacaatgcagaggtaagtagtgtgtgactacacctttccaagtccttgattgttccctgtgaagaaattcctagacgtgcaactgttgtttcacctgtatgttaatttttaaggcttttcatgggtattactaaatgttcctataacaatttttatcttagaggcagaatattggtatatcctttttttcccaaattcttgatattactattttgccaatttgactacaaagaattgattatcatattttaaaattaacatttatttaattacaagtaaaactgaactatttttttcttttttgcccaattttatgttttggtataggtttttccttgtttattaatagatttaaaaaataaatttgaaatattaatttcttgtcatttgttcaggttttctccttcaactgattgttgtgatgagttatatgtctagacttcctgatagtaaattgcactcctgaaataatccctccttgctcataatgtcttgccagatttggcttgctggcatttcatttaggatttttgcatctatattcctaagtgacattagtcttcagttttctttctctgtgtatttgtgtgggtgttcgtcaggttttgtgatcaggataactttaattttataaaatgaatgggcttattccttcttttattttataatgagaaccgcttttagagcatggaaattacctgttctttgtaaattaaaaagaacttgctcataaagctgtctgggcactgtaacaatcatcagaggaaaatgtgtaacaccctatttttccccacgttttctacttctttgtgattccagttagctaattttcctagaaaattgtcctttttattgagattttcaaactcgttaccatctttacagttttattgagatatgcatacaagtcacccatttaaagtgatttttagtgtattcagagctctagaccatcaccacaaccaccacaatagattttataacattttgaaaaccccagaaagaaaccccatgcccattagcagtcaccctctatttccccttaattcccccccttgtcctagataaccactaatctactttctatctccatagaattcccctattctggacctttcatataaatggaatcacacactgtatggtcttctatggcagccttctttcacttagtgtaacgttttcagagttcatccatactgtagcatgtagcagcactttattctctctcttttttaagttttcgtttttgattaacagactactttttagagcagttttaagtttacagaaaattgagcagatagtacagagaattcccttatactgccctcctctccactcctgaccataattttgcccacaaacatcttgcattggtgtggtatatttgtcataatcaatgaattgatattgacacattatgattaactaaagtccgtacatttgggttcattctttgtgttgtacagttctatgggttttgacaaatgtctaatgtcatatatctaccattacagtatcatacagagtagttttgatgaaaaggtaaaacacaggggacttttagggcagtctttccctcctccctgtgaacacctaccaaccactgatcttttgatttgcctttcccagaatgttatataattggaataatatagcatgtaatcttttcagaggcttctatcactaagtaatatgcatgtaagcttcttccctgtctttctttggcttaatggctcatttctttttatggctaagtaatattctattgtatggatttaccacagtttatcccttcaccttttaaagaacgtcttggttacttccaatttggggcaattatggataaagctgcttcagtcatttgtgtgcaggtttttgtgggcacataagttttcacctgatttaggtaaataccagtgagcatagactatgtttatctttgtaagaaactgccaaactggcttccaaagtggctttgtaattttgcattctgaccagcaatgtataagagttcctgttgctttacatcctcgccatcatttggtgttgtaagttgtttggatttttgtcattctgataggtttgtactggtagttcatggttttaatttgcaattctctgataacatacgatgttgagcatctttttacatgcttatttgccatccatacattttctttgatgcgatgtctgtttagatatttttcccatttttaaattgattgttttctttttttgtatagtggatacaaatcctttatcagatatgtgttttgaaaatatttctcacactctatggattctgttttcattctcttaacagtacctttcacagagcataaggtttttggtttaattttactaaagtccagtttctttttatggctaatattccatcatatggatataccacattttgtttattcatttatcacttgatggacacttgagttacttccttttggctattgtaaataatgttgttatgaacatttggtagaagttttttttttgaaacggagttttgcccttgttgcccaggctggagtgcaatctccgtgattctcctgcctcagcctcccaagtagctgggatcacaggcatgtgtcaccatgcctggctaattttgtatttttagtagagacggggtttctccatgttggtcaggctggtctcgaacacccgaccaaggcgatccacctgcctcagcctcccaaagtgctgggattacaggcgtgagtcaccgtgcccggcctggtagaagtttttatatgaatatatgttgtcatttctcttgagtagatacccagcagtagaactgctgagtcatatgataactcaatgtttaactcttaaaaaaaaaataaaaaaaaaactgaacaacttttccaaagcggctgcaccattttatattgccatgcctcctacattgctagtggcattttacgttgtcactagcagtgtagacgggttccgttttctccatatcctcaccaatgcttgttatcagtattttttgttatagccattgtagtgggtgtgaactggtgtctcattatgattgacttgtatttccataatgactcatgacattgaacatattttcatgtgcttattgaccatttgtatatcttctttgcctcttcacttttgatattcttttccatgggaatttcatggatttcactaaaatctttgtgcagatgatttccaatatttacttccaactttgacctttctcctgagattgtcgcagtttcccatctgtttcttagccattaatgccctaattgcagaatcagtgtgtcacaactgaaattcatcatctttcctcccaatcaatttattcttcctctgtgttccttatttctgttaatcatagattaactaatcttctaatgattagactattcttctaatcatccagactttcaatttggcatcatatttacatgtaagagaaatgagataggaaggaatcagtttgttgccaagttccacattactttcataatattttgcatatgttttctctttactttgtattctctccttcctgatctctatcctcttctgacttttttgatcccttactcttctggttctcctgtctttgatcgttttatttcaggttattcttatctgccccttaaattacctatctgcaagatctcagctcactgcaacctccacctcctgggctcaagtgatcctcccacctcagcctcctgagtagccagtaccataggtgcacaccaccatgcccagctaaagggtttcaccatgtcgcctaggcttgtcttgagcttctgaactcctgagctcaaatgatccacctgccttggccttccagagtgctaggattataggcatgagccactgtgtccaaccgtccacaatcttttacaaatcaatgtttaccttccttcttggctatttgtatgtagtcttaagatatgaactatcacttacacacataactcccaaataaatatttctagccttggaatattctgagaacttcagacacatatatcaaactatctgtaggacagatgtccaactggatagatggacatttgtagaatagatgtgcaattggatacatgtccaaacttaactctccccaccttagctgcccccaaacttgttcctcttgtcatatttccagtcaatggcatgaccatccatctgggttctcaggacatacatctgaccatcattcctcctttctccctctcccctaaagccaaatattcaccaagtcagtactattctaaaactctctttaatattctgtctttatccccatgctgcttctttgtccaggcttttatcatctctcatttagactatttcagtgattttcaatcttgcctttctgtctagtctcttaccatgccccccaacccgcttcgtgcagtctactgacacaaagtgaatttctaaattgaaaatttagtcatgccatttcactgcaaagaacaaatcaaaataagaacaagtacaacaatatttactgtctctctggtggctgcttacttttctaaaggatatagtttaagctctttagcctgtcatattgtactgctccctacctacttcttcagctttgtctcttgtcactccagaaatattcttctgtcttttaatgtgttccctctgctcagatgcttcttcctgccttctttacttagtgaaccaccatctgagatttcttggaggtagacacgatcacatggctggaatccaaaagggatggtcgataagaaccggcttcagtgaatgtggatttacatactttctgggagctctgtatgtaaaggaaatgcttccagcccttcctcgcttggctcttggcatataacttctgatggctctcctgctttagtagtcacttttggagcaatgagagatcagattcctttagtggcctgggaatgatgtcacatggtgttattgatagaagcctgcagagcttgggattctgagaagcaatcttcagactagaacttaccccaagagaatgagcaactctatggtagagggcgagagcctcgaacaggcccaataacctctagtccaaggactttgggaagttttatggtcccttctaggcctacaggatacaagcactcagggatagcagtgtttttgggtaaagaacagtgcggggctctgggctcaaattcctgggggcaaacaaatcaatttggctcccctcagctctgtgggactaaactttaaaactgcccctgggagtgacctccccaggataatctcagggtactcagtactcacctgagtagacaagccccaggaagacctggatgagtctttggaagtcatctttttagctcagttttgcctgctccaccaggatccacaccctttactatggaaatctgagtacgagttagggcagatgtcagtgaggagaaggattggagctcagtgacctttcctcagtagtgcttacttgtgaagcctgtgtccttaggaaattagcgctgcctctgccaaagtggctttttactgtgttatcctttcccagagtgcacttccagtctcgtttaggccagtgtagttcctgttgagttaagtggctgtgaaaaaaatgttttctgaaaggaattcggaggaaagataccttattccagtgaacagtttgcgaactcaggagacacagccttttgtataaaaggaagttatgtttcagagaacaaagagagtgtttgggttttatagcaaaagtttctgcctgagttcctaatcaggtttatttatgcaaatgaaatattgaaatgggcttagttctagttggttgatgcagctaagttctgattggtaaatacagctaagccctaattggttggtataggtgagctctgaaagtcccaaagttaaagagaggtgggagtttttgggaaactcagagtgacctttagtcagcaaatggctgcctggctgtattttaaatttaggcccagttagccacttgggatccatcttgaaggattgactcttttaggttcatatttgttcacatgtggctttcttcctctgataccttggtgagcctaatggagactaaaagcttagttaactttggctttagggaattaaattatttctggctgagacactaagtagaagctaaaattgcagaaatatctttataatactatgtgagagtttacaaaaactctcacatacattattcaatttattaaatcttcacacaagctagtgcctgtcccttagtaatcacatgtttagtgtatgaatgaacatggaggtttttgttttattttgctttgtagagagacagggtgtctctcactcttgcccaggcaggagtgcagtggtgcgatcatagctcactgcagccttgaacttctgggctcaagtgatcctaatgcttcagcctcccaagtagctaggactaaaggcatgcaccatcactaatgcctggctgtttttttttttgtagagacagggtttcccgggcatgtcttgaactcctggcctcaagtggtcatcctgcctcagcctctcaaagtgctgggatcataggcatgagccaccacacctggccaaacgtggggatttattgtgcctattttacagtttggcgaactgaggtctaagcagctgaattgagtttcctaaaattcaactctacagttagccaagtatggagcctacacttgaaattagatccatttcaggtgaacatttactaagcatctactaagtgacaggtacttatcagtgatgaataaacatgttccttggttttgagagcttataggcttgtcagaatatgagcaaataatttcaacacaatatgctaagtgtcatgatagagaactttgtgtgatgccgtggagtcatacggaggggcacctaatccagtctgataatgttgtgaaagactacctgaagaagtgacacctcagttaagttttgaaggttcattggagattggccaagggtaaagatattctaggctgagagatcagccccagtcagggcacagaggtgcaaaccagtatggtatgtttttaggattgctggagtattccttgccaaggggaaaatggcagaaatgatgacttagagaggtaggtgagattcagatcattgagtacgtagactttgctttgtacaccattagttactacacattgctgaattattgaaatcatctggggaacttaggcattttcttagttagctagatttgagagtcacatgtggaggcaatgagtgacatagactgccctgttgcatcactctggtgacagtctacatggaggcaggtagatttgaaagggatgctactagacgcctagagaccattttgaaggtcactgaattcatctaagagatatggtggactgtataaggcagtagcagtgaggacagagaggaagaggcagatgcaaaatggtgaaactcttacgatgttgtggggaggattggtgagggagagaaaagtgtctaaggtaattctccaggtttctggcatggctgtctgagtagatggtggtatttttgaccaagttcaggaatgaacagtggagatagaatgtacaaaaaaattggataaattcagcttggaacctgctgaatttgaggtactgtgggacttccagaggggagagcagctattttgttctggaactcaggatgtgtctaggctggaaatacaggtcaaggcctctatgtctgggcagtttaaacccaagtgaatagtaagacatctctcagagagaatgtgtggagagtgcatcttcaataattctaccccctttcgacttcaaaggctgttcccatggggaagcagaagcagcgtatttctctctctctctttttaatgtttgaggcaacaagggatactgaaaatgctataaaaggtggagttagaaaacctgagttcaagccctgcttctgacacttcaccactctgcaaccgtcagtagttcctgagcctctcttagcctccaggtcttcatctgtgaaacaagggtagtaggaataactgcttcacaggattattaagatagtccaatgagaatgtgtatgtggaaagtgctgtgtaaagaaccatagaaacatcatttttgttgttgttgttgtttgtttgtttgttttgtttttttcccctagaaacttggaccaatatgtaggaattacggggagacagatttggtccaatataaggaaagactaatactttgactgttggatgatgggaagagctttgggagatgggaagctctgaggctctggatatccttaagcaaaagccaggtttctgggcatatgctgagcgttttgttgtcaggggttgggtcatcctgcatgacctctgagttacctttcaggctcagatagagtttgagttactagaacacttatctacctattttctgaaattttctacactaagtagattttttaaattgtaaaagcaatacaagcgcatggtctttccctttgactctcttaaagtactgggcattttggatcctaagtggagacttggtttatataccctgaataatggggcaaactgcctcatgtcttactgcatgaggcatttatggacagacattttcttaatgttctttaatgagatctctttaaaataataatttttttcttattttcaagcagaaatgatattataaaaagctaacaaaatattgccaagtagaggtcttgatcgagtatactccaatgagtaggtaaaggtcatttgaaatcagcacactaattatttatatgcaaatgaatttgttagagagcttggaaagagttgttctctgaactgggttaaacatcccctaagagctcatgtttatactcttaatttactcagaaacctgttgttgctctttctttttttttttttaattatactttaagttttagggtacatgtgcacattgtgcaggttagttacatatgtatacatgtgccatgctggtgcgctgcacccactaactcgtcatctagcattaggtatatctcccaatgctatccctcccccctcccccaaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcatttcttatggctgcatagtattccatggtgtatatgtgccacattttcttaatccagtctatcattgttggacatttgggttggttccaagtctttgctattgtgaataatgcctcaataaacatacgtgtgcatgtgtctttatagcagcatgatttatagtcatttgggtatatacccagtaatgggatggctgggtcaaatggtagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacctagctctttctttaattgatagaggaaaggtgaaatatgccagccatgactgagttatcacaaatttagaaatggcatgaattgaatttatactttcctgtgtttattttattgccaatcactgatgtgacacacatttgctaaacaagttctaattttctgggtaactttccctacagaaagcttatttcgctaaatgaaagatctctactcatgccatttaatgaggaattatctttatgattgttgaggtgtcttcctggctctttgaaaaaatcacaaaaacaatagccccaaataatagtgattttatacctagaaaatattctacaaggaataagttgctgtaaaccatatagaggtgaacaattttgaaaagtcaagaatttaggaaagtacattcagtcttaattatggtagaataaaatttcatcttcctgatgcttccataggcccttcaagatgtttgcaaagcccttggtcagcttttgattattttttcattgtactgtatctatgaaaaaggttgccattgggaaagcataagtaggttgtgttttgcaattccttcttgtggaaggaaattgatagaaccttctagttgattttttgaaaaagtaaagatgtttaaatactcttgccttccctaccttactccacacttctggttctcatctacaagaactagtgcaccaagggagagagtactccagctgtggcgtcctggactttgaatcctgggatgagggggcaggtagggtagaggattcaagaacagaggaattatggagggatggaagctgggagggaggaagaaagagtaagaatctaaaaatgaaccaagggaggagccaaagagtgttggtcttgagccagatcacaggcagttgggtcagggttagaggtaacagttgtaaggaacaagtctaagccagccaaaccctggttgagccatggtgtccgaccttgtgggggacccctcagtatctttcttaatgcaacacattgttaaactttggtctgaccccagggagaggctgagcagctcagtaagcaggccattctttaaaagcctgagtgtctattcactgacaaccctgtggatctttctttgtatcagtaaattaccctatacaactcatgtccagacattttatagcagtctcacttttggtgggggtgatatagtgtgctgggaagagctctccatggagatttgtgggagagggggcaagaggcttgggttttagccagtgctctgccactaattggccatgaaacattaggcaagtcatctaaatgtttggtgcctcagtttccccatatatacaatgaggatcaaggaggcacagatgtatagttcatctatcagttgtgagttctaaagcatagaaaagaattctgtggctttggcatttggcttttttgacttgagaaaaataaatataccctaagcactacatttgagttgaacctatgaaaaccctgagagtcaaaactaaactataaatagtaaaatcctttccccagcttcttcgttagagccaggagtgttgaagacagtcaactttttagcatttgtggaaatggcaggaagcaaattgaatagggttgaacagttgtgctccttgacctctgagatgcaatatcttacataccagtactaaaccagaggttcactgtgttccagggactctgatggagttgatagaccccctagtgacgcacataccaccagcaagctgggtgaccttcctcctttgccaaaatcacacatggctcatttgctgagggctacagtaaaattaagtgctgcttcttgcttcttctgaactggcaccctgttggtcctgccagtgtgagacaaaagatgtaagggctaccagtggactttaaaatgttaattttaaaaatagcccttaattattaaaagtagccctaattatagcttactataggcaggccacacgtttctgaatagtttaacaaatgaggaaataagtgaagagttgataagtgctggtagattcatttgcatgctttcctacacccaaatggtaatactgcaacaccacagtcttcagccaaattacgagtacagcaaattaacacaatttgttaatttcctttttaattacactacgaacaggagtatttctgtattttggcttttttttgacatagagacttcatcttaaaagcagaaagactttaatatagctaaatctatatctataacaaataaagcttgtttcattttccttacccagctggctaagatttatacattaattattcaaccgatgcatcttaaacatcctagttaaaatacacactgttggccagaaattgttaaacctccagcatacttttgtttgcctgtaaggaataaatacttagaactgtaaatgggtaaacttaatctttccatgtggtgaggtcaacagaactcatggtgaacatacaaagaataggggactaattattattgagattcaggtaagtgatttcttaggcattttagctgtcatgctgtggaataattgtaaactcaccaggaaggaattgcaaaacacaacctacttatcctttccccagtggctatatagaatttttttctgtcctgcagtttgtgccaactctaatcattaaaaggaatgttattttaagtattgcttcctcaataacagtgtttgacagaaactctacagaatggtggctttgcccagagtgtggcttcagtatgctagtgtgatttaggcaatcagagctattggtaatggaatgcagatctctgtagcaattttatttaaagttttgcctagttaatattatatccaactaatgtaaccatctgtatccggccccatcagtgacaatataaaactgttaaacaccatttcataggcattaagtgctttggctttggtataattttatgatcatgtcttattcttattgtagtacttcattactatcttttttttttttttttttttttgagacggagtctcattctgtagcccaggctggagtgctgtggtgcaatctcagctcactgcaacctccacctcccaggtcctggttcgagcaattctcctgcctcagcctcccgagtagctgggattacagacacacaccaccatgcccagctaatttttgtatttttagtagagacggggtttcaccatgttgaccagactggtcttgaactcctgaccttgtgatccgcccgcctcggccttccaaagtgctgggattacaggtgtgagccgccgcgcccagccactatcatttaaatgtcagtaacagcagcagcaagtattctaggcatagcacagagaccaaggtaatgggtctcccagccttgtgactaaattcttcctgcctctaggtcttcacgtagtctgttgccttgtccaggaatgcccttcaaaccttggtttaaaggccttttcagataagtctctctttttccccctagtattcttgatcactgtacctatttgtcttctccatagtatttatcacaatttaaaattatacttgtattttttaaaaaaacttgtctcccccactagaatgtaagctatacaaggacagagaccatgcctatattttatttattattttaaaaaatttttattttttaattgtaaattaacaaattgtagttacatatatttatggggtacaaagtgatgttatgatttatgaagacaatgtggaatgattaaatcaagctaattaacatatccaccacctcaaatattaacccatatatccttttgcgtagcaaagtaaatagggactgtaaatattttttgggagggactttaagtagtttaatgaataaatgaggcaatgtggtataattataaggaggcagaggccctatatgctgaggacttccaagttaatcttgtggttacatttgacttgcctaggcctgtgtgactttataccagtataaccaaaggcttgctggacatttctacccgatgaccccagacatctcacagtcaacattccaacctataatctgtcttcttgcctctcaaatcttttttctcctcagtcataacttggatagtggcaccatcatgtatgccatctccccctccctcctctggaacatcagtcagcgcacagtcctgtcagtttgttctcctaaatgtctctcgcgtctgtctttttctttctacctccattgatgtggccttggttcaggtcctcattatcttatctctatctagactactgcaaatgcttcttcctcctccctgactccctgatcttattccctaaagaccacctccctccttccaaacaggcaaatgctgttctctctctctttctggatccagaagtcagtaagggctgccagtgtgcagaagtagctggaaccttactaacatatattcaaagattgcagagacatatgatttcttcaagattaatttcctttttgtttttctgctgtgaatccaatggaataagttattaaaatgcttcaagcttctgaaggaaagcatggaaacatgccagcaggaacaacataaaggtttcctttattttcctctagcatctatctgtgatggacgatgtgaccatgattcttcacttaaatatggaattctggaatatcataaaatcccagagcgtcagggctgggcaaagccagtctggatcctatgtctgaggctgagagaagggaagggctttatttaacatcacaaggccagttagctgtggaagtaggactcagacccagttctctgtattactcaagtgatcatgaggcttcatttagatgcattgttaaaacatttggcagctctgtgacccatcccccacatgaccgtggcatgacttccttcatctgatcattttttgcttctcttaagcctgagtgctaatcagtgtgattagaaagaaaggaacccattagctggtttgctccccaagttgaatattccaattaaaccatatttttgtggttttgtgtttatttttatttttacccttctctttacaataataaaagatgggaaaaatccaggacataataaagtgacatatgctttagtggtgattttcaaatggggtaccttagagcaccagggctttcttggagttgccttggggcctcttatatgtatcactcattgaggtgccaagtgaacagggccctgggctggcaacccccgtttcagccagacagctgtgtttgtatctgttttatatggacttacactaccattggatttaaataggtgattctatgttgtaaaagttttaaaaatgactgtgcctcaggaatacattagctagtttgctctccaagttgaatattccaattaaacaatatttttgtggttttgtgtttatttttattttaacctttctctttacaataataaaagacaggaaaaaatccaggcttgctcatgtgggtttggtaatttgaatatagattttctgtgactagttagtgtaccagtgcctaagactggggttttatggattcttggctatgtgttagtatgggtgtgtcaggtccacataaagggtcccaaccctccttctcaggccagggcgtatgaatgattgcttggtaggaggtgttattgttcagtgtctgatgctgactaccgacacgcaaggtggaatgtattctttctgagaaccaaacattgtagcggagtagtaaaacaccatgtaaatgtccgtggaagggcgcagttgtattgaacattgatgacatgtcattgtgaagggtctcaggaggtagtgttccagtttctggcatgggaggtgatcgtgggagggatatataggctttgaagcagggacaaattggacaaatggtgtctcccacttgactgtctttctttgttgcccagggacagcatacttttaatacttctccttggcatgatgaaaggtaaggccactcctgactttggtggcctggggcaagggtgcaaaatacagactcactgcaaattcccacttctcttcaaccttctcgctctgttccttcccctaagaggacttccacacattatatttgaggagccttgcttctcaaagtgtggaccccagtccgcagcatcagcattacctgagagcttgttagaactgtggactctcaggccccactctaggcctgctgaaccagaatctggattttaataagatgctaggtaattcacatgcacattaaattttgagaagcactgccatagcccacgtgttcaagctccatcaacactgagtggaggggcaacagctgccctgtggccacccctcagtcactcttcaggcctagggtttagtccatccttaggaagacagaactaggaaagaggatcacacaggctccaaaggcaggcttgaggcacatgggcagaggatttcaaggtcatgggtatcctgaggatagcctctaagagggaagcatagacttggggttggcaagaccccttggccctctataccccttgccctgtgaggagtgtggctgcagcagggccagagtaaggccctgccaaccatgaggcctagggcaggatctggttgtcccagtctaagagtgatactgttgaaaggtgtcccaaatattcaaggggatgaagatttgagtgggagtgattcatagctccctgaggtactggccagcagccagggtcttggtggctctttggagtgtgcggaagttatggtggtgggaccattactgctttaagagggaatcagtgtgaactgttataagcaaagtctttggtagctagagacgtatacattgacttatctgtagaaggtatacagcgaaggtgcctcctgtagtgcctaataacaatttgattagattagctactagcctccgtagaagacaggtggatgtggctgtggagggctttgaacaacttccttcaaacctaagaaacgggccacttttctcgaagaattgagagcagtgtctggtgtggttgggatgccgtggctgttggaggggcaaaatatgccattttgtgtccaccaccacctgtatgatgccacggttgtgggacagaggcaagtctgaaatgaagatcaacagattgctgtcccagctcccacaccccacctcttcctctgtaaaatgggtctaacagtccttgtcctgcctaccttgcggaggtgttgggtggctctagtgagacaatggatggaaaagtgctttgcagcctgtcaagtccgtgcatgaagaaatgatgatcattctgccatttgttgtctttcctttgtgagtgtgtcttcacctgcacttgagttttagatttaggttgccctctccttagcactgcagctttcaggtcacagcaacatacaaggttctgtgcaaagccatatctgcccctcttcctgacaccttccagcctcttccatgcagatacactgctgtgattctcatttttgagttccacagatttgggacggagattttatattggcaaatatttctgaagagacaaataattgcctctggaaagaggcttcttttctcttccaaaaattcatatttgctggtttaaattgatgtgactattttttggctagaactctgcagtatttcactgagcagtaattattcctttggtgttgcaggagttttctgagagaagggaactaaatctaagagagcgaatccatctggtacatatgttgaagctctctatgaggccactgacactgaaatgttaatgctaggtttctataaactggtatcatttagatattgatacaatatgagctagtactctgggtcactgaaccaaaggctgaattccatttccttatatggcactggattcctgcaccagtggattgatgactcttggcagagtaccatggtaagatagaccctgcattccagtcctgtcacccgattgtcagactctggctgtcccagccccaatcaggagtagacactaaaggccagcagctggcaaacttagtgtctcttagtacctcaagcattggtaggtaactaagcttgacgggatagtagaagtacctacacatagtaggtaattaattctagattagtctgataccttaagtgttaagtgcccctgagaagaacccctggggcccatggagactcactaatctgcagcttttctttttacattatggtgtgggtgaaaccaggatgtgttccaggactgaactggtggctgtcctgcttgggtggggatctggcatccagcctagccattgctaggtttttccctggggtgttggactctgtttctccaccaaactgccaactaacattcaattcaaataaaatgtcttagaaatatggtgctgccgccgtatgtaaggtgcagggtggcagcaccatgtttccaagattagtattgccactgtgcaaggtctttcctagccagattgttcagcttgcatttatcatgattttttcatctttgtaacttggatagccagtcagccctcttagggacaactctggggctctccaagttctgattcttcttgatctgtgctcattattctttttctgctcttcttacattgaagtcttggaaatcccaaccattgctataaaagttctgttgcaaagaatggaaaatagcctattttatcccatagcccagttacacatacatagggagctatggacatctcactgttcactttgagttgaacttgaaattcctgcctctcctcttcgggaagtattaaccaaagaagccacaaggggattcactagtctcctatgaaataaaatgctatcagataccaaacagctaactgtccagatttttcagcaaaaattggctgctttagttttttgaaattttttcctctctcctctgtagttcagtatgagagactcttcagggcaaattgtcagtgggaggaattcagagatgccatatgtcatcagtacatggctgaggagaagccaaaaaagtattaccgccgttttcccaaaaagctattagggaaggttattgattgttttccacacaccttccaccttcatcacagggtattgtgataactaaaaaggtactttcatgtagctcttaaaaacagttttctccttttttgttttcttaatatccactgtgcccaggtcacttcacagagctccaaagtgatgctcctttctttctccataggatttgtccttgcccttctggcaaatggacttgaattgctactgcttctgtcagctggtggctatgtttacttcaaggtctttgagtaggccagacaagtccaattacataaatcattattgactgctgtcaaccccctgtccctccctcttacacttgtttttctacccctacctccctctgctttctatataggattggagatgccatttttttccttcagactttcaggctttttaataaaaatggtgcttaaaggtacatgtcagcagacttttgggtgacctttaaagtagagtggtatttggtctgtacaaaataacccattctctatcatttatagattgtccacattatacctaattttaaaattcttgatgacatctattaggcttaagcccttaaactagttcatgagggtacaagggtattgtagcattaatgccctgtaggtaaagtgaatgttggtatttgatctttttttttaacattcttaaattattattattattatttattattattatactttaagttttagggcacatgtgcacaatgtgcaggttagttacatatgtatacatgtgccatgctggtgtggtatttgatcttttagttggtacctggaccatccttcagtggggctttcctgcttttcccctttccccttttgtgttgttggattaaggtatatttcatttattcttattctgtgttcatttcaacataagcatcacagacccattaattaagaacagctggctatgttctcctgccacatttctaatttctcaatgcccagttgacaaacagaatcctatctagagcaaagtcatttgttccaggctcagaacacatggagggcccagaaccatacgttgcacttttgtttcagttagaagtcttccatgggcttttcttccagtcacactaaagtagtatttgcagaaatgaagtttctttgggtcttgttttgtttttgtttttgaagatggaatctaagatcatctcagtttagttctttgcctttttgttgttgttgtttttgagctcatatatggggtatgtaggcctttggccatttgaagcattgcagggaatggtatgttttagttggtgcatttgttactgtaagaaatcagcaaatggtttgtggtgccttttaagatttatttagcacatatttttcctatgggctaggtgctgagctggatgctggggatgcacagatgagaaaggcacagcgcctgttctcagattgtctcacagtctagtaggaaagagagagacacatcaacagctaactctgatacctaacgatctggatagaaaatttcaggtcagggcactggcatgaacagagattgagaacagataaatgcgtggtttgttcagggaatcacttatgtagtaatatggatattggcagaaaatgactagagacaagatgtaaaggtagattcaggtcacattttgaagaactgagatttttagcttttagaagattatgttggtatcccttgaactcaagatgttgggtccaaggtagtgattctgtctacattcttagaacttttttgtagagtagcaggaggtagaagaaaaagttattgaagctgaaatagtgatccttagccttagggacagtgtgtgtcagaggttagagcatccagcatggctggtggccagagctttgcatcagtctgagatgtatgtgatgtatctttagctcagggaagagagaggacttgatttttgaggaaggcttgggaaggagggatagaagagctggatagttttgctgctccccagccagaaatttatagtttgatttcattattgccttgaaatattgggatgtcccagaacacacagccattcatatttaaaagtaagcatggcaacctcacgtctgattcggatataaagggctgatttggcttatttatatgatttcaattcacaggcagccataatcaagtgcttactaggcttgtaagagcagccagaggtcagaccatttaggaacacactggggatgataggagctattggttacagtgcaccctcatccaggcacatgtatcattaccctctggcccatagccacaagtatatccttgtccccaacccaccatcttccaaatgcacactatgattataacagggagcatggttggattgatgtggcagtccacatggaaacacagattttgccagaggtcctctttcctgatgttgtttcaccttcactgtgggctgtcattcatgttgcttcatatctatgttgctttgctgtaagatgcatgggtctttcatagactgctcttccttttttgctattggggtgtgaaaggtattgctcctttaaaaaagtacagcagggctgggcgctgtggctcacacctgtaatcccagcactttgggaggccaaggtgggcggattacctgaggtcaggagttcaagaccagcctagccaacatggtgaaaccccgtctctactaaaaatacaaaaaattagctgggcatggtggcaggcacctgtaatctcagctactcgggaggctgaggcaatagaatcgcttgaacccgggaagcggaggttgcagtgagccaagatcatgccattgcactccagcctggacaacaagagcgaaactctgtcttaaaaaaaaaaaaatagtacagcataaatccttccaaacatgagtagagaaactctctaaggaagaaaaatctctggatggaggtgccagggtctacttgggcaggtgttctattgtgacatagctgtctttttttctgtttagcccttggaaaaatgtgtgttttcttggattcaatgtaatttttaaaaataatacaatctccaagtccttctcacaaactggttctaaagtatccctaattacttagtataaaagctgtcttgatttatccatttctactgtttttagcattgctgtttagggaatgttgatcctggaggataaagttctacaaaatatctagagttaatgtttaatcgaaaggaacctgtcttaagggtcaagagatagttgagttcctctattaaaaacaatgaaggctagaccctgtcttctccattaggaatcctgagcattggtgaggaaattcatactaaaaccttgctgctaccaatctcttattccttatactggatctccagtaaaatgtgcatatatatatgcatatatatatgggtttaaaattatttttatcaatgcaataatatgaataatttttgtaatcaggcttataataacatcaacaaaaccaatcaggccggtactgcttcctcccaatcctgctcctcttgcttttggtacttaccttcatattttatgtaatatgcttatgctgccattacttgattcattattttagatattgtgtgtttacttcttgtgatgatagatgagaggctggctgtctcatagtccctatcagtcgagtatggctggtctgtgctgcataacaagacattcctagttaccaggggctttacagaacagaagtttatttcttgctcatgctacacattcaacttaagtgggcagggggcctctggctcatgttggtcactgaaggatggacatgggatgatggaggctccaactcaacacctgatcacatgatctatgaaatgggcaaataaagagttaattgcctgctgcctctcaaaacttcttcccaggtatgatataaattaattttactcacattttattggtcaaagcaagctacatgactatacttaatctgaaaagaggcctggaagtacaaccctaccatgtgcctgggaaaagatgctctggaatatttgtgaacagccctaatgatgaccatacagcctctccattttctttcctccattactccagtataagtaaatcatgtattttttcaaaattggtattcagtgtttgttattatagctttgcatttatgtccagtgccaagccaagcaatgcattatgctttcacttccttttttgaataatattttattttccccagagtcaataattgcctaatttcttatttgcttagttttctttttactcatttcttattttctgcacaacattcatcagatttatcaagtagtcctcagtattattttttgaacactgaaatatatcagataacctaccaattttattttttcttggagtcttccagcctcccgcttcagccttggctctctgggccttctgtacaggaatcatcctccctttgccagtttcctgtattaggaccctagtttttgggtcttttgtctcctttttaaaaattatttgcttacttgttttgctggagcacgtgctttaatagcttcctaaataaaggtttatgacaaattatattagtcagctttttagtaggctatgccgtggtgcaaatgattccaaaatcccaatggcttatacaagatttctttcttactggtatcctatgtctttcatgggttagcagtagttctagccaggtctttttcactctggcacctaggttaagggagcagcccctctctaggagaagcagttctcatggcagaggaaaaatagcactgattgaatcagtgttggctgtcaaagctgctgctctgaagtggtacacatcacttctgttcacatgtcattggaaaatcaagtcttatggccaagcttgatgtcaataagcctggaaaataaaaataatccttccacaggtaaaattatatttttgccaaaggaaataaatagctgtgttgcgtataaaattatgaattggtttttcgcagaattttgaaggcattgctccattgtctcctcgttttcagtgttgttatttaaaaggctgatgccaatctagttctggtataagagtcttccgtataagcattgtttttttcctttgctctgaaaccttttaggttctttttttttttagcccttataattcagacatgttttgacagtgtgacttggtatagatctttatgcattcattttactgatccttccttaggagctttaaatgtggaaatttatgtccttatttttcttacattatgactttgataattttctccccttcgttttttctttctgaaatttcaattatttggatattagacctcccatattgttcctctgcttttcttgtcttttcctctcttggtctttatgttcttctttttgggagattttcttattttaatccttttacttttttgcagtttgattatcatattttcagtgtccttaaattcctttgttttctgtgtcttcctttttgtagtatcctgcttatgcttatggatataaattttctcttatctctgaggatattaattatagttttaagttttcttctgttattgtatcatctctgttttctctgtttgtttgttttgacttctctcatattggaagagttcctcaaatgttttgtgatccttggctgtctattcatattgaagagtggaactctcttgtttcctggggacaaagggagaggataaaatagttatctaggtagctgcatgctgaaaagtatatatgggagcctgctgctccctatacagagttttaattcctgttttcctgtgtcttatcccaatttctgtggtacttggtatttctaaacccttaagccttcccaggattcaatggggactaattgtttcacttttcattggcatgtctttctgcaagcacttaggttctaacttgcttttcctttactctctgaaataaatattcgttcttcccatcatttcctgtcttcgaaacatttatggataattcttgtccactaatgtctccttccctgttttcttagtctgcgtggacttaacacctctttctctctgtctttctcttctctctctctctctctctctctctctctcacacacacacacacacacacacacacacacactttttatttgcattgttttaattccattaatgagacttcgggagggagagagataatcatgtgttatcagtctgccatgtttaaccagaagtcaagctgtggtagaattttttaaatgtagttttctttacctcatgctaaactgagcatggccttaaaatctacccctgttctttgaaataaaactagccttatacttggatagatgacatgctttcaccaccaaattttaaagacaaaacttgaatgttgatggaaattaaaatgtgtttagcactttctgacactatgcatggtaaataaataaatgaatgaatcagtgaaaagaaaggaaagtcaccataatggatactcttgagtttcccactccagctgcactctctacccttccttaccctgctctgggcccctggagactgacttctatgggctgcatcaaccaggctcccttgtcctctggcttccagttaggtttgacaatgcaacgtatcagtgggggagggagaaaggatcagagggttgagaggaaagccagatctcagtatttacttctccagcttcttctctgccaggtcacatttggcagtggctgtgttccactatttcatgccatagcttgtgttgggttgtccctctctgacagcctcagcttttaccaggttctggtaaccattactctccttctcacttcaggtcgagagatggtagtggtttcttcctgctactgatccaggaccaatgcaccttaccttataggttcccttaaccctgcccctaccttcagttacaccttttgaatgtgctgtgtttcctgccaagaccctgcttgatacaaatgttatggtagcactgtctcattatcatccatgtattcttgaacaacatactccacatcatgggcctcagtttccatatctgaaaagtactaaggtggcgataggtggtctggtctgtcatgtaagaactccttcctgttctgacatctctggttttatatgatgcagcagtggtcagtagccagctctagctctaagttctcttttatagactttgtggaccattgtggataattctgagtggtggatgatcacaaaacaatttcttcctgtctttgggaggcagtttgctggagcaaaaggattatagactttggagtcagaccagggttcaaatttgagtgtactactttcttactatatgacctttaatccattactaaacctctctaagtctcacattcttcatcttaagattagggtatatgatggacactgctagttatctatcctagccgttttcttttcccttgctaaaagaatactattttccattacatatgtagctgaacatttagttggatgttttgataaatgcagtttgcatagacataactagtatttactaccatctgattctctccttctgaaagcatgaaagactaatttccaagcttcctatagttaggtgggatcatatgattaggtctggccaatgagctgtgagggaaaattacctgtgacactttggggctgaagtagaaaaaagcaagtgtgcaatctctgtgtgctctcttacccctgctgaggcaatggggaacaatctccatggtggaacttccatcaatcaagggtccctaagtgactatatggaacatagacactcataaacttgcaggcaacatgtagcatgagtgagaagtaaaccattgttgtgttaggccattggggttttgtggttgatttgtcagctaatccacagctgaaaagcatccctacagttataggacattatctttcttgtagggttgtatggaacagactttctagatttgattcctagctctgttatctattaacttgtacgtccttggtcaagttacttaacctttctgtgccttggtttcctcatctgtagaatgagattaataataccttttcctcatgaggtcagtgtgggtactaaggaaattaatatacaggaagcacttaaaacaaggcctggcaggtagcaagtgctatgcagcattttctgtcagagatcatgtatttcagagtgtcaaatacagtgtctggctctcaccaacaacttaatgctttattacctttattgctgtcataagggttagaatgatccatgtaaagtcttcacatatggtggccacttaacacaatggcactattatttgatgactgatttttgtgcttaattctggatatatgcccctcattttttagttctcttaatcattgccctctaagatttccttcacaacatgggaggtagttaagtgtatggatttccaagagtagttctgaatacgaagttaagaagatgttgaaatggcagcaaagccttaatttaacagggaaggcattcatcaaaagtgttgttatccataagtttgaaaccaaggcgacccacagagaagctacacttgtgaaaatgagccttggataatgagtatttcattatatttgccatttagagcccttacacactgtctgtccatgctcttcattttgcagatgagaaaacttaagcctagagaagggaaatgaatagtctaggataacacagtcagttaacagcataagcagaactagagcccaagtacactgattcttgatctgtatctacattttgcatctgtaaagctatacaatatttccttctagtacttgaataagaaagtcattggcttttcatctcaaaactctcaaaagcttagcagaaactcagagatgtggtttcggaggaaccagaggaattcaggtgagcagtgtaaggtagaaaaagtcaggtttggtcttgtaacatttgtgccatttgaaaactgttgtcagacaactgcaaccctagactcaatgtgaaaattaaagtaactttgcttttatgtgctgtccttttcagagctcatcatccattttgttggtgccattttgctcatgtctttgaatacatcaaaagtggcttgattttctctttcctttgctgtctattcactggctgcaagaatgtcctgtccattccagattttggatgggctgtccagaatcaccacagacttcgcttcttagccagctagaggaaggcagaaatgaaagagccctgccagcgtgtttcctttctgtaagtttccttggacacgaacacaggagcagagtttctatggagcagctggtctccccattttggattttgctgaggcaggtagttgaactctttgaggaagtctgggttttctctgtcttgggaaattactgataacatcagagccagaaggaggtgagtaaaatggaaaagaaaattcataagagtcgtgccaagattgagatttccaaccccacccaattcttccccagctctcctttcagctgctacttgcttcccaggaagcaacaaacaataggctactgattgaatttaggtctgaacttcatacaattaaaggtgaggcaagtaaaacatagttacatttagaatcaaagtctccgtgtttccatcaggaggcacagtctgtatgtatactttagaaagtgggtctggttctgaagccaaacttgaaagcccattcattttggtaattattttcttttttaaagcaagaataatctttattccttggaaactaatttataaaattgttatcaataagatgaaaagattcatggtaattattttcttgttcatagtttcttgctggcttttttttggaactaatcacttccaggaaagtgcagaggtcttacagtgaagagaaggaaaagcatattaattgtagctggactgggtctagatcatgagagctggaatatcctaagatctgggacaaagggacagccattgggcagctgtactttatggtaggcaacatagcacaaagattcagttgtttcttttttaccccctccaggacaatttaaatgtctactctggttagtttctgagagtaggtaccatgttacttaaaaaattctactcattgtaaatgaagttgtatcaacacataacaactgccacttggaaatcatctttgtctttccctgatgtccctttttcgtatccttctctctagtactcattccttcagtcagtgaatttatgctgcaacttgactacatgccaggcacaacaccggcaccattgatataatgttgactaagacagtgttccacttgcttattgctgtgtgataaaccaccctcaaaacttagttgcttaatgtaaaaaccattttactatagctcacaattcagaaattcaggcagggctcatcttggtgattcttttgatcaacacggattacccagtgacactcagctggtaaatgcgctggtatggtaacctcctctctgtatccccctctccagtttcacacacatgtctgtctggtgctttggcaaggatggcaggaaggctaggctcagctggccctgtcaaccagagaacctacacacggcctcaacagcatggtgacctcagggtggttggacttcttatgtgtcagctcagggccccaagggctagtgttccagcgatccaagtggaaaatgtacaaccttttatgactcagcctctggagtcccaaaatgtcacttccactgcattctcttggtcaagcaagtcactgaggaccaacccagattcaaggggaaggtaatcagattctgcctctcaatgaaagaaatagcagagacttgatggacaactttaacgtgtcacagacagccagagctgcttgatgagattatatgccaatggaacaagcagcagactggtcagcaaatagtccaggggcagaggctaccttgaagaagtgactagaaagcctattgagtagtatagtgaataccgtttgaggactaagctgctgagagtctgaggttgctgccttgtgctctcttggaggattcctgtgatgccccccacctcctgctcagcattacatatcatactagaacaacaaccaactctgctggcaaacacacatgcacagggcacagtgcgtagtcctgtctctacacacagctgctggtttcattcggattggttaaaatctaattgtttgaatgaattcaggggttgctaagtgattagtacttatttaggctagttcagtcagaactggcaattggcattgttgttccatctgctgaggctgttccccctcttcttcctcttgctaatgctgctcattcttttgaattcagtatgaggagccccttcttcctggaaaaaaactttttgaccaccctcatcccaatttaatttagatgcgttcctcttgactcccaagcaccacccaaaaatgtactgttaatccagcagacatatctgcaacgggaatgtcaactattgaccaggttcttgctgagagagctacagatactggggtgattcagactgatacagtcgctccctacaccagtaaatctcccagtctggtggtgaaggcagatatcaaacgaatcgttaaaaatgtattgaatgttcctaataatgcctgactcagagtcacatgggtagtgatagggactgtgccatcttttctgttgttgtcatggtgcctggcatataataccatatcagtaaatgttttttatgtgcatgaatgaattttggtggtatatttattgaacatgtggataaagttatgtcagtagaatgtcatttatctttttattagagcccttctaagattttaccaggctgggccatgatgccttccattaagaaacagtggattggggtggagggagggagagcattaggaaaaatagctgatggatgcggggcttaatacctaggtgatgtgttgataaatgcagcaaaccaccatagcacacttttacgtgtgtaacaaacctgtacatcctgcacatgtaccctggaacttaaaaattaaaataaaaaataaacattggagacagggcctacatctggatccagtcgatcctttttgctgccagccaggttatgccagcctcctctcatcccttggtcagtctgatatctggggggctgcaaagtggtacctcacatatcaagttttgaccttcttctctgttaacctttgactttagctatcatgaccctatcgatagatgaacctgtttcctgctgcccatcatatcctatcctttggaataatttgtggcagtacttgactagggcttttctgacctagacctgtcctgagcagacacatgttgtcctctgccatgttctggggaacctaactggcagctaccttgatccttcctggttcacttgccttccaatattggcttttccctaatatgatttccagatcccaaggttgttggttagttttttgttttgttttgtttttgtttttgttttttttttaggcaaggtctctgttacccaggctggagtacagtggtgccatcacagctcactgcagcctcatctcctgggttcaagcaatcctcccacctcagccacccaagtaattgggactagaggcatgtactaccatgcctggataactttcttattttttgttaacacagaatctctatgttgctcaggctgttctcgaactcctgggctcaagcgatcctcctgccttggccactcaaagtgctgggattacagatatgagccaccgtgcccagtaatcccaagtttttagaacaacaacaaaaaagtatagtccttggaactagacataattgattttgaaaggatttctgtatttgctagctttatcattctgagcctaattttctcatctgcaaaaatggggataaaaatcgtgacatcacagggttattttaagtgtagtacctaccatgtaattgctgagaaagtggtagttccctcccatatcccatctcaatgtattgacttttgtattcaaagaagacattattgattactttctctccagtaccttatttactttagggtacttttcctagatggggatagtggcttgcttccagggctggccttgaccacaccgttatcagagcttctggactccaatgacatgactacctgactccctcacttggagaatctgggtcccatggcttctggcacaatgacttcactatggctgcagttctaccttttccctccaaccgtggctcagtgccaggatagaaggaaaatgcgaaagagtttgacaatatttcagagaggagacttttagcagaagttatagctttgctgtcctgggcagtgttatgaaggagctttcccacacattcctctggatcctaccttcatctgccacctttactcctggttctttcttctaagaggatacagtagtatatttgggtggcttgtgacatgacagtatctcttattttgacctcccatagcatttaagcatttattgtctgtaaatgtttaattatgtttttctctctgtgaatttcatgtatgattaaagtatgctagtcataaatcattcaagataacactaagctcttcaatggcaagggttatgaatgaatagcccagggcctgaacacaacctgagaactgctattttttttttttttttttttttgagacagagtctcgctctgtcgcccaggctggagtgcagtggtgcaatctcagctcactgcaggctccacctcccgggttcacgctgttctcctgcctcagcctcccgagtagctgggactacaggcgcccaccaccacgcccggctaattgtttgtattttttttagtagagacggggtttcaccgtgttggcaaggatagtctcgatctcctgacctcgtgatccacccgccttggcctcccaaagtgctgggattacaggcatgagctaccgcgcccggaccgagaactgctattttagggcataggatgaaaagagaagtcaatgaagaaaactgaggagaagtgagagaagcaggaggaaaaacagcaaaatggaatgttaaagaaccctgatgaggaaagtttaggagagacagacaacaggatgtaagcttcaggatattttggagggttttgggcacatttcatttacagggtcataagggtagtgaagttggaatccagcactgttctcatcagtgtcaaggagggcaggaccagctttctctttatgtaaaccctcaaactttaatgggcactagaatccacaatcctgggccttacctacagagatccggtttcaatatgtaggaccaggaactctgtattttaacaaacatcacaggtgatcatgatgctggtggttccaaaaaaaacatgggtctccggttaacaaagtagtccaaggttgtattggtagtttgacagccctatcatgtcttgtgatgaggtaaagtccctaagtcacaaagtcagaatgatagaagggcccttagagggatgatctaccaacgcaactcagtgggggcactgtattagttcgttctcacactgctataaagacatacctgagattgcgtgatttataaagaaatgtttaattggctcacggttctgcgggctgtacaggcttctgcttctagggaggcctcatgaaacttaccatcatggcagaaagcgaaggggaagcaagcacatcttcacatggccagcaggagttgggtgaggtgctacacatgtttaaacaaacagtgctaggaggatggtgctaacccattacaaactacccccatgatccaatcacctcccaccaggcccttcctgtaacactggggattacacttcaacatgagatttgggtgggggcacagagccaaaccatatcaggcactattggaattttaggtgggaccatgcttccttgcaggggactgtttgtcctgtgcaatgcaagatgtgtagtacactttgttcccaccaactagattccagtagcacccctcagtcattctgatgaccaaaaaaccccaaccccatatatttcctcattcctcctaagggggcagtaccatccccactgagaaccactgccagtataatcccttcattttatgtgggagggaaatgggtctcagagcaggggaggaattcttcaaagtccctcagtgagcatttttgaagtaatatactctcaagtctgttattcttcatcctgtatttctgtaactaagtttgggaacctaaatgcaggcttgcctccccagttggatggtcagctttactagaaaagatagagacagtcatcttactaggtccctgttgtctctgacagcatcaagtatcatgctggctacacacaggcacctcccagatactcactgaactgaattgaaccacaaaactctgtggagctccttgaagatgaacaagattcagaaccctcctaggcagtaagtcttctttcaggagggaccgaattgtttgtttagattgcactttgaagagaaacattaactcattagcatattcttggtacatcaagaacattcatctggaccctgagccccgctagagtgtacatgccaggagggcagggaatgttgcctttcttcattgtttatcttcagctcctagactggtgcctggtacatagggagacactcagtaaatatttatgtatgaagaaatggctccaccttacaataaaagattgtttactttcttcagacaagtataaaataagcaaatgttttcaaggattattatgtccttggtgaaaagtaaaaagtaaatatgagttaaaagaatatgagtaccttgtatttgcaaagaagatttctaaaattcaaaggcttttctcatctactaaggaaaaggtagagaaatgtgccctttttgaacctacagtgaccgatgctgatggctagactaatgtcctcagagagaggctgctggtgctggtgctcagcacaccatcccttcctctgacctgttcagcactgtcaagagtgacatggagagaccaccgatggcctgtgaggagattcacagatgggggagctgggcagccaagtgaaggcatcggctcacacagtcattggctgtcagaaagtaacagtaaaccaaacccaagaggatgaaatgtaacagggaaatgtgggtttcaaaccccaatgaaccacgcaagagtgatctgctttaatagcaccaggtaggaggaagccttcagggtttcaattgatagaaagaccagcagtacctaacaggttgatgttgctgctccaaaagactgagtgacctcaaaccaccttactgaaggctagtgcctagagtacaagaagcagtggtccatacctgcacacacctgttctgtttacttcttacttgtgttcctgtcatacaaggcacctagacaaatgagagtccattcagaaagttaccaggatgtggatgactttgtaacctggttgtatagagaacagtggaaataactggagataatttactttaatattatgagaggagtctggggaccattatagcaacttgcaaagatttgaagggttgacatgtagggcaaagaacagtctggttctgtaatctcctgagaacagaatcaacactaacggattgaaatgcctgcaagtcagattattggctcaacacaagggaaaaccttctaatgactatgctatccacgacttcggtgggctagttcatttggtagtgagttccttgtcactggaagagttcaagtagtgaactgaccacttacctggcagggaagccatagagggggtttaaacgtctgatgagattgaactttatgacttttaacatttcgttcaagcctgaacacaagcctgttcaagtttgggttttgcattttcaaggtgataagtgaatctgattcaatatatgtgaatattatctatattgaaatattcaatatagattcaatattatatagatatctgtaatatattatatataataatatattatatataatataatatatttaatattatatataatatatgttatatataatataatatatttgatatatataataatatattatatatcatatataatatataatatatgatatataatatatcatatattatatataataatatataatatatcatatatataataatatattattatatcatatattatatataataatatattatatataatataatatatttaatatattatatataatatatttaatatattatatataatatatttaatatatataataatatgttatatataatatatttaatatatataataatatgttatatataatatatttaatatattatatataatatatgatatataatatataattatatattatatatcatatatgatataatatattatatataattatatattttatatcatatatgatataatataatatatcatatatgatatataatatatatcatatataataatatataatatatatcatatataataatatataatataatatatgatataataatataatatatataatatatatactattataatatatataatatatataatatatatactattataatatatataatatatataatatatatattatatatattatatatatctgtcaccaaagtaaggtagagttatgatttgggacataagtgaccatcactctttaaatgcctatcattgtgtagattttagaaaatttcatcaaatctcttataagaacacatgcttaatgtgcactaagaaacctgattatcaaagcagtccctctaccaagaaaaccccctgcactccctagctcaccttctacccacccaggtattttcatttttatctgtgggtgtctagatcaggtttgctcaggactaattcacagcaaggtgagaagcaaactaatacaggtacctgtgatttggacagcactgctctcagggtcagggtcaagatcaagggccttactttgttctctggcctgtcttgtttgcttaggtcagggcagtcttgcttattttctggctgttgagcatcttgtgctgttccttcgacattttcactcttcacagttactaacttgtcttcttttgataggttcttttttttgttaaggtaagacctacatgataaaaatgcaaataaaacagaagtatattcagtggaatgtaaggcccgcctgtcctaactaatcctgtgttccttagttccctcctccagaggcagctgctatgattaccttctttcagatccttccatagtgagtctgtgcaaacataagcactatatagatatctgtgtggtcttaaagcctcccatctggctctgcccaccagtttgtgtgatcttttgctcatcttcagctcctacaatagctcatttatttggagccaaccctctctgctaacctgtcttggcttcactattttctactgctcacctgctctcatactgccactctgacttggtaagaccttaatctgggacagggagaagtagaaatcatcatttaggaagagtaaagcatttctagtttctatttccattccatattttctagccctgtgaaattaaattatgcctgttcatctgctactgactcactatattccacaagcaagcaatttgcatttttcttcacagcagcatctttttcctcaggatgctgtggcaactaatgttttaagattctaagaaaaagtcataataataaaacctttccatcctaggcatctaaaaattgaattgtgaccaaagcataaagaaatattattaaagaagctcaacagtttacaaacccagcaatgccatgttgaagattaaacctcgtaggttgggaattcatttagggcacatttgcattctgtgtttttagatgtggctacatgcacaagtcacctaacacatcaccacagaatacaatgtgtcaaagtatttagaatatgagagcatcacacagataagggagcagtttttatctgggaaggtgagaaaagggagtgagggagtaaattggcccatagaattttagagtttgaaggggcctcaaagatgagccagtagtgtaggctaagtacctttggctgcatcactaccaagtggttgtctagcctatggtttgagtacctccactgacagagtgctcgttatatctcaaggcagcttatttcatcaggctgccctattagaaagcttttctttaggccataccaaaatctattttctactgcttgttcctagattaaacttcttcgggctacacagccacaccaaattctttgcaagtatgaaagctctttatacatgtaaaagcagttttcaagtactcctgtctagagtaagcatttaaaattccttcagtggacatcaaatgacattgtttcccacccatccatcatctgtgtgggcacaaaaccttcacctatggagtaaaatgtgtcagttgcttctcttgtgtcttgtttttggcctaagtaagttcaatgagataaccacgaattaaaagaatcttggaaaggaatcaaatatggaagtatttgagaatgagataataaaggcaagtctggtcatacaatttcagaagcttatgcctttaatcagttaggctaatagtgaggccatgagcatagacatcagaaaactagggataaccctcaccatgatctgcagaatgaagatgttaggaaaccatagactctgtgataggaaagtcctttagcaatcagctaatgaaactccatcattttatagatagggagactgagatttgaagaggccaagagacatgcacaatgtcttacagctacattggcagagcaaacactaattaatccatgtcttttgatttccaattcagtgcttttctgtatgtgttttcttaacttgagacacaagcaacagccagatagtaaaggatatccttttatcaccttctctccagtcactgttaaccaattgtatttcactccaaaatatatttcaaaagttacagagttacgtaagaatgctcttaagattcttggaccgatctccaaagcatccctgccttattcaccaaaaacttagcagtttgtgtctttttgagttttgaattaatgtgagcatcagtgaggataagtccccattactgtgaggaatttgtacaatgagcgtctaataacatggataccacaagggagtattgataagacatttgggaataagaaaggaaatattggccaataatgcatattattgcgtgataaaaccctgatgtcatataatcatgttatggcaacatcattctaaacagaaactcaaaatcgctgaattcctccggacgtgtgtgcaatgtacatgggtcttcacgtgtacattggaaatgcacattaaagtggaaatggggagctgttgctgggattccaggatattggagacagacaaggtattcaccctgcaggcacttcgtggatatttttaatttgaaaaacaaggacaatcccaatgtctagatttcccatttgtgtagccccccaaaagatttcagtagcagacctcctatgagtctaggtccttctcaagccgagggttctcaggtagaaattatactgattgagatgagccgttggccttatttgagaatgacccaagtctggttttgtcagacttgggtcattctatttaaattcaggtatagaccctattttctagaccccattttctagagaatctgtgccaacaaaactttgaaaatttgaagacaaaattaacatttgagagaaaggattatagaaaacctgctaaatgccttcttaaaaatgggcccagtcctactttccaatcctataagatagcatgccatcacttatctatgccataatttatactgtattgattttattgtcacaactttgggaatactctgtcatgtgtatttatgatggcccataaatctttggaataacatttagagaccaagtcactatttggagtcaaggaaatagagggctgtgtagacagattagagcccattaatggacccagtgtgtagacctaagaaacctgcctaagataacttctcttgaaaattgagtaaaagaagcccttaaataatagtagctcaaaatggaaagctgtgagctgtgtagcccaaagtgatgactctatttgaaagcccttattttttcctgtccaggaatcctcaaatggtatgtttgtaaaaggaattgacaaaagcatgcagctatacgaggcagcaagattctctggatgagcagatcacagctttcacatattagcatgtcctgaacatgtaactcccagttatagatctggaattacttgcatcatcaattcaatactttgggacttagggctccagttgtattggtgccagatggagaattaatatgttgtctaactcagactagttaaggggttttgctccttggagggagtgggagagaatgtgactgttttgctctcattttcctcatcctgcattagaaacaaagcaaaaagttggctggaatcagtattagcattgcccacagctgctgaactctgatttaaccagatgccatagctatagcaacggggaaatattggaattttgaaattaacatgctactgaaagttgctaaatatatcacgctttgtggaggggttcatattgtaggtatttccattatttctcaaatgacaaagtaagtcaggctttagacagaaagttaatttattatatatggtggttgctgaagtctcccctacttgatctatatctataaatgtgttttttgaagccaaatgagataaatcagtttgattgtccaaggcatagatggaaattggggctgtcataaagccatcttcagatgcgtgtgggtgtcagaatattcatctttggggtttagtggaaagaacctcaggctaggagtcaggaaacctaagtctcagcctctatgattaaattattaggtgatcttgggcagatctcaggttccccattttttaaatgccaggtgttgaactcttctgccttccaattctaggattctggaatagttagggttctatttcccccggctgtggctctagggggtacttactgacatcctgtgaaataagaaagagagacccacatcccaggatccctggatcagagtggtgggtgacatgtaaagagaactgtgatttccccctacaggcttttccctggataagaaagtgttttctccactcaacaaaccctataatgggcctgttggcttcatgctccttcagtcctcctttccccacaactgggcctatgtgactctcagaatgaggccctgcaccttactccactctacctagcaaggctctgaggccctaccttgtagtcaagagagatctgaaggatccacagtcttaaaagcaggtcatggatgcagtatggctgcaagttgatcttggacttttcccctcagtcctaataaatagattgttgccaccttcctgggactggcacaccttgccttctcttccatatccaggagctcattatctgtctactacctactttctttaattattagagagcctggtccctaccttggctttgtacttggtgtctttttccactgaggactgaaattctgttgtccttttcagtcttcctggggtctgtgcttgtccactgccagaattctctgggatcactcatctgcctatccatggagatatttgtctaaggcttctgtccaagactccacaatgtctcatagcctactagccagcatagccttttgttgcttactgttgatcctcagtgaggctgctggcctgccttgcctggacctctgcctgctgcttattaccagaccctcttaaggtgtgcttcatctgctctgtggggacattgccctctaactcatgtctgggcctacacaacacagattattagtctctacttctcatctcttattggagaccctaacctcaaagccataatgggcctgcctagtctctatgttttagatttccccaggctggtctattctagtcccagccaagtttcagttataacttgtgaagactatatgggcagtccttgggccaggttgccctgcctgggccaggtttgtgggcccatcccttgagatgaaagctactgtgtctagtttctcagtcactatgcaccagttaatgaacaaccttgtaaaactttgcttttgatgaccttgtaggctaatttcaagttaatattctgagatggatgatgaaggagaatttttgtgtctttgtagcctacagtaggtagagggatgctgttgggaatttttgagccaccctgagaaaattaggtgaaggtgagaaatgcctgtgtgatcattttggaagctaagttgcatatgaatctaaggtggcattgttagtagtagtagtacttagtctagtagtattcagctccttgccaaggtgcttctggcttaatgaaatgacccagagcttcagctccatagcagggtcacgtgtattggctagctacatgtccttgtgttgaggacttacactttttgaacctcaattttcttacatgtcaagtgaggttttgtggatgatatctttataagctttcagacaatgtcaaggaataccggttagtgggtagtgtatgtgaaagtgttttaagaactgtaatgcatcatacaggttatctagtcttccttcccagatggatggagtttacagacatgggacttctttcccagcattggtggacagagaagatttggatcaacatcctgaggtcagagtgaaggcaaacagcttgacatggagctagatgagaccagcgagacagtacacaaagccaagtacttcggggccagcagagctaatgcatgaggaagtttgaaggagaggaatttcctgagtggagaggaatttcctgacctagagtacaggggctactggcttctttttgtttggtgcctgctgttgcttgtctggtagcttagactcaagttattctggaagcagttaaagggtagaagaagagcagacctaatgtgtgggactattcttataaggtatgacaggatttagggaccaggcaaagggtgcaaagccagtatcagctagtccaaggtaaacccagttcaaaggagaagagtaaatgacctaagtgagcagcaaaggcagaccatatttggacactaataatggtgaattttatgtgtcaacttgactagcttatggtgcccagttgtttggtcaaatactagtctagatattgctgtttagggatttttttagatgagattaacatttaaatcagcaaactttgagtaaagcattaccctccataatgtgggtgggcctcatccaattcattgaaagctttgagattaaaaaaaaaaaatgtggtttcccaaagaagaaaacatttggcctcaaaaccgtaacatggaaaccctgcctgagtttctaggctgcttgaccagccatgcaaattttggattccagactgtaacatcacttcttacccgggtttctagcctgtctgcatgtgcagacttaccatctcccacaatcatctgaactagttccttaaaatctctaacacctgaaaggaacaggactccacaaagaccaacctctctgacagtcctgctgaaatagtaaaacgatcaagcatagagtttttgtgctaaacattccaggggtgcttatttattgaggaacagtgtttctaatcttcaagaaattttattccctgagaaatttccccatttattttaatttgcttgtgcagtcttttaagtgggttatattactttgtacatggatcgctttgctgtgcttttatatgaaaatcattattagtagtcaacataagatacaaagtgtactgcttctataaagcttatcttacagcatatatatagcctgctgaaaatatattgctcatttgttattaaaaatcctacccaagtaaaaaaaaaaaaaaatctctctctctccctctctctctctctccatacgcagacacacacacacacccccatgcacgcacgcgtgcatgcactatggttggaatgttgtttgtccccttcaaaattcatgttgaaatttgattgccattgtgacaatatttaggaagtggggcctttgagaggtgattggatcgacagggctctgccctcatgagtggattaatgctgttgagtaggagtgagtatgttataaaagggcaagtttggcccccttttgctctctccctctcagctcttttgctcttctgccatgtgaggaatagtgtttctccctctggaggatgtagcattcaagaagccgtcttggaagtggagacagctttgactcgatgccaaatcagctggtaccatgatcatggacttccagcttccagaactgtggaaaacatatttctgttgtttataaattacccagtctgtggtattctgtcagaacagcacaaaatgaactaagacaatgtgtttgtgtgtgtttatgtgtgtgcatgcacatgtatgagcgtgtgcatgtgtgtgagtgtgtgtgtgtatctcctatttgttctctctggataaccatgactgaaacagatatcatgaagatagcaatgcggctttgagcagagacagttgcaggattatggagagccttgagtgagctgtcattatgagttcttttaccccaatagtcataaaatattgagtaatatttgagtaataataattaattattactatgtctactaagtgagcatatattgtgccatagaggttggttggcatgatttctattgactcagatttctgagatgctaatccagagcctgagtggaagtctctcatcttcctgtcagagaagctttactctcctgaagagagcaccaaaagctgggtatcctccatcagggaatggggatcagactagaaaaggcctccagctctgtcaggttaatactgggatcaagaaggactttttatattaatggagtcaatgccattgaaagttagcattcatttagtccacttcttcattgtatacatagggagagtgaacctgagagaagagaagccacctttataggccacacagcaagttggtggcacagccaggcctcacactcacatctcctgacaataagtaaggtagagaagaaaggagaaggaaagagataaaggttgtttgctagaagagaagtctggattccggttgtgctttttctatgagccatttggtgagtaattgtcccaaagtttggaagtgtcccagttttcacaactggatagaatggagggaaaatagaaaagtttgaaaagtaaagtgaaataacatagacaacatatttataagggcccctaactgctaaattacaaaattgaaaatgatctatatagttttcattgatgagtaaatctgctttctggtggacttctctagtggcaacaaggctactgcactcagtctcaccaccttgaccaaaggccaagtttgcccttgttaaaataaaggtacactgtgcttgctgtggggccaggcttccttatttctctcctatatttgttcaggaatttggttctgtcccatgaggatactaaattgcattgatcaatgaaaatggcatctgtgcttgtttgttttaacttgactttgatagcttcatccattaaactttcaatgaagttgtaatttctttaaaaaaaaaaaccctaaatttaaaaacatgctggcagttcataattaccttggtatatatcaagatgaatcagtgaaggtgactctctttcctttgcatttagtattgttgctttgtgcctgtattttctatttaggatttattagtgtaaatcccccttatacatcattgaaagcattaggatttatgtagtgttaaatccatatcaggatttatatggaattaaatccaatctaagagacaggtggataacctagtggggttttgtacccataatttctaccgctctttgtggaaaagcatttcattacaaactttcagatttgggaaggcagtgttctgcaaatggcacctattagtaccaatgtggagcgttttactgcactttccatgtagtccctgggctcctcactgagaagcatcctcatggcaaagcatctttcatggccacgaggaggacattaacctcttctctgctccttccctgtttggagcacagcacagctttgattaactctttaaagagccttctgtttacaccctctcacagatctgcagacagtatttgcaaagcacattgcaatttttgacagcaggcaccactggggtggggaagatacttgtcagctttttcctttggtgactttccttccatttttttttatcttttgagggaatgaaaactgctccaagttggtgcttgctattctccttttttatttcttttctcttctttgtatatgcttttccccatcccatataccaactgatggggtgattgagtgactttcatccattcagtcaagtatttactgagtcctacttcatgcaaagtactgtacaatgtactgagtttttagagttatttctttctggggttgttgtccctttttaaattataaaaataatacatacttatggtaaaaatgcacagtacaaaagcatataaaatgaaaagaagatcctcttccacatcaagctcctagtttcactcctttgtataacatcaataacaatttcttacatatccctataaaaattttctatatgtatataagtgtgtatgtaatgtatacattcatacatatatgtacatataggtaacatacacacatttacttatatatgctttcttagaaaactcagactggagcatggtaaacacaagttttgtacatccacttccatgttgtatcaggccatttgctttgctataaagaaatacctgaggctgggtaatttacaaagaaaagaggtttaattggctcatggctctacaggttgtacaggaagtttgctgctggcatctgcttctggtgaagccctcagaaagcttacaatcatgtggaaaacgaaggtggagcaggcacatcatatggtgagagagagaacaagagagagacggagaaggtcccagtctcttaaaaaaacagatctcatgtgcactcaaagtgacaactcacttatcaccaaggtgatgatgctaagcagctaaaggggctgaccagtcacctctcaccaggtcccacctccaacattaggaatcacatttcaacatgagatttggagaggacacacattgaaaccatgtcacatgtgtatctttccatgctttccatgtcagcacatgcagtcttgctgactcccttaaaggctacatggttgaaatgtaactttaggaaaaccctgaggttttgataagttttgtatatagggcactgaatttgattttgaatgtgtaaattcagtgttcatttgctgtcttcaggtttcttttactttttctctatattgagggcactacccagttatgcattctgacacttgaagacttctggtggcttgcaaatgctccatggagatgaaaattaacttgattggttttccttcctgagcaccatgtgtccactctggccttgggcgactctcaaagtgggtttcaaaccaggcttcagagtttgtcccaatactttctaatagtttattttatccttttcataagttttctcctaccgcttcagtccatattttctggtctggccttatcaactataaagttcttgtttatttggaacttgaggtcagtgacttctgacctcactagctttcattctagctcactcttatttaggcatttactatatgcataatttcctttaatcctcatgacaaacccatgagggaggtgcagtaattatctccaaagtgacagatgaggcacaggaaggctaaggacattgtctacggtcacacagctggtagatggaagaactagaatttgaacccaggtttatctgaccctaaaaaatatgcttttaatcaatatatatactgcctcccttaaatcagtatttctagcttttctatgagcctgcgattctctagtggcaagccacaataatagccacactgtgaacataacactgcatgccagactccataccagagggtggagctgagttttctcatgctggaacagcattttcttacaagctaaaccatgggagggatcttgggtgggaagaagcacttcctgcttataatacaagccaaaaagagattcccacagtatgaagcccacagtttttcctgtgtaatgacattatgaagacctcaggcagaatctccagctattgtgcatttttgtttaatacatttatactgtaaattagttagagctatggacttgcaactcctactttgacccaaaacaccaagacacaagagggaatggtcttttattttattttcctgatcagaactctctagtttccttatcagtgttgctcaccctgggtgttgcctctgaattcagatttgtgtgaatggggttttctaagagaaaccttggtaaccaagagacagtttctgtctctgccttcttctggtggactccaatcctggctctccagctgccttgccttcacgttttagggattcagaatcaggatgcgatcatggcccaatcacagaattgaacatttctaagttcctcagtatccaaaaggaaaggcatttcagatgttaggtaactgtcctttattcactgtctgatagaaatttaatggttacaaaggggtttgtttttaggtttttagttttattatttttagtttatttccagcactggaaaattagcctgaaaatctggaaagggaaaggccaaaccgatcacagttggccctggaatcgtgggggcattcccaataataaatgtctagatggtgtgtttattccagttccaatccaatccaattcaatgaatatttgttgaatgcctgctgtgaagaagataaagaatgaataagacatggctctcactctccaggagttcacactgtaatgagaaattgacatgtgcactgttaattctcatacaaagaaggcaataataaaggtctatacagaagtttaaacaaggtgttaaggggatattggaggagtaaaaaattatgtcgaattagagtatctggaaggaatgctgtttgaaagaaggtggttttgagctttgtcttaaaggggtgatgagattattataggaagacattgaggtgaaaggtagtttagtttgaagaaccacacactctgcaggtgtgcagtcccagggaacgcatggcaattagtctggtaaggtggagagcagcatggcatacagctggagcggtaagtccgacccagtttatgaagagccttgaatactagactaagagtttggacttgctctgtaggttaaggggactcttgaatacctacccctcaaaatcacaaaggagtctgtttcctgtcatcatagcacttggttcttctcggtagccccttttacagacaaattccttctagttacatttgtactcatttggtgaagattctctatgggaaatacttgactttaaaaaacttgacacatagtttgatgtaaacgactctgatatatcaataatgtattttattcatttatctcccaattgtgtatgtaactacatatactttgtataatcattgactatgattacagtctgtgttgatataacctaagagtggttatgcatgatctgggtggtattgcatctggaatttatcctactctgtaacatgttccattgagcttacaccaaaccagtctagctatgccatcagatttctctttaccagctctatttatggtctttctctgacattactataagaatgtcaggttaaattatatcagatgcttctctctccaagatatgttaactttgctccatcctctttcaccattcagcttgtcattctatcatgaacaggaattagcttcgtttggcatgatttgtatttgaagaatctgtattgactactgtttatcacttgggtttcccctagatactcataaatgactgccttaataattgtcctcacagcttaccagatattgaaattaaatttatgagtttaattccctgagttccctggggactttttttttttttaaagaaaaatggaacacagcagtttcatgactcacaacaactcttccataataaccaatgtgataaaaacattttttcagggaaacaaatttcagttttagccttccaaatgactattacgaaaattaacaactaataaaaaattgaaatactaaaagacatcatgtatcctctcaaactatttatttattgtactcatacatattcttaagtgcaataaaatctgcctagaaatcattaatccactagtatatagtccttacttggtgctggcaactgaaaatttggtctttttatatacaaattgttacacgcatgaaaagtagtccaataatggcactttttataggttatttcataagtactcttggttggacatatgctaaagtattgttacaggttgctgaggcaacccgcctgctacagttgtggttaactctaaaatttactgataatgctgacctgagacttgagtcttatcttcactgaatgcagtacaggtgtattgtaggtaggctgtaggaggaccatagctacctctaaatctttacagaagattttgaatgtggcttttgttgcatagaaaataaataaaataaaataaatctctacagaagactggcaagagattggtgcatatttaatagcaaacagtgggatgctttgaaagggatggataacatagaacattgaacagcaagagctttagtggggtttaggttttagtagttgtccagccaagactctgcctgttactgaagctagggatatgtggagtgaccaatttacatcagtcatagtagagaagtaattgcttttatctgacaaaagcagtctggacccagtcaacaacatgctgatgctacagtccctattcttgatgttttattggaaagtggtaagacttctttttctctctgagctggtaccaccaatttgcagtggtatgttctagaagcaaatcatatttcagagctctttggttgtgtaatttttttcaataggcatgatgagtattctggaagctgtatcatggtgccttttgcttggctgtgtgtcattactataatgcataggttttttacttgtttgtgtgattgtttttattccaaagactgccatccagggccatgcagcaaacaagcaacagggaaatatcccactatgcaatcctattttgagatgatatttaggatgagagaacatgcattagttacctaccagcttgacaggaatggatttccaaatctgacacaccatagcctgaattctcaccagtttgctcctggaaaggcccgctcatggtaagctccttagagtttgttagtagtggggaagccttgagtttcaggagaacgtgtttggatggcattttaagaagccattccatttttggtagagtagaaaaagtctgcatctgagtctgtagtacagtctgttctctggatgaacacaatgtctctctcacatttttctgatatttattctgcaaatcagcagcatgagcccctgccactcttctaaataagcttccaggcattacctgcatgctgtgttcctgtggtgggatggcagtaatctctgctaagataaacgggagcttctgtggataaagcataaacgcagtgaagtgtgtgtggctggaagatttaatgcctctacaggtaatttttttagagggggatctggcatttgatcaaatccagagtcattatgtaaatttaatcaccttgcaacacactagtaattttattatctccttttcatttgacagtgcttagatacaagttgagcttggaattccagaggtagagcactgctgattggagacatattaagtaaaatgtactgtggaaatgagataaaacctttattcttgctaatgattgtcattgtatgtattcaggtgtccaacaaaggattttagaataaagtgtgcctttaaagtttcccaccttcttaaagctcccaatgaattgcaaagggcctgtttggaatggactgtattaaatctacttcaaatgaaaacctttacactgagtgaaatatggttcaacaattcttaacacaaggcctttacacttgtgtagcccattttggtttggcctatcttgtcactagaatgctgtctgagcttggattatttatgccctaagatttacttaaaattgaagggagtatttccattcatcaacactagttttgatagatgcttaaaaggtgcagtgaggttgatgatcctgaatacacaaattattgatcaccacatcaagttggatttccctaaagatgtatggctttctgaccttgtgatttacactaatgattatgtcttaataaaagtaataaagctaaatactttatacgtgatctaaggagtgagattagaaaggaagcaagaggagagacatactgtgttgaactgaccttgctaaggcagaagaaatggcattttatggtgtttttttctttccttcacttctctgttttacttcttccgctttttatctcttaatttgaaagaaactcttgggaatatctcttctcctgcagacaaagacatcatgagctcccccatccataccctagaacatgtaggcccttggtcaaccatagagtctttcctttaatcaggtgatatctctccttttgtaccttgcaggcacggaagccaatgacttgggcaaatgcccctaattcaggatcaactcagatgaccaggtttcccctacctagagtgctacttattgcagtgaaaacttttcttctttccaaaaacctttaattaaacgtttaataactccctgactcataatatggcttcataatgggacatcaaaatggtataatctaggattaagatttaagtgccttactatctagtttcccgttgagctgagtatctgttctctgtttaccactcatgcctcaattttcttattctaaaatggaagtaatgatcactacctacctccaagggttgatacaggattcagtgaggcatttgatgtgaaagtatccaacactcagtttggcatagaatatatgttcagtgaaggcaagtggaatttgagtgatcttgtgagtgctaagaggttataatccagggttagtatgcaaccctaatagtggggctaccatgcacagtcacagtgagggtctgagtcaaatgaggataactgggctctggctttggtgtctccttttgtgggttgcagctggtaaaataagtcctcttttgtcacaacatcatacaaaagtaggttcacacatgtacactcacacacacgtggtttgggtgagagagtatatcaaataatcccacagtagagagatgatgagattgctcttaagggatgtcctaatttggataaaacttgtgtgactttaggaaatggacttaccctctctctctcagtttctttctgtctctctctctctcgtctatccattcatccaaccatctgtccattcatccaataagcacttatgaagtatacccatcactatatttctatcaccattactgagtagcgatgatagaaagactgatacttttcctttccttaaagagcttatactcttgttggagagagggacaagcaaacagttataaaacactcttaatccatttgggctgctataacaacataccttagactggaaaattttataaatatcataaatttatcaccaacagttcttgaggcttgaaagtccaaaaattgaggtgccagcaggtttagttgtctagtgaaggctctctcctttatagatggtcccttcttgctgcatattcacacggtgaaaagggcaagaggctaataaactctctgagcactctttataagagcactaatcccattcatgaggatccaccctcatgacctaatcacctcctaaaagtcccatctcttaatattattactttggggattaggtatcaacatgaatttgggagtgacacaaacattcagaccatagcaaatactatttcaaagtgacaaaagcatgcagagggtatcatgggaataaagagaaggttcctttcccagcctggagtggaaatgaatggtcagagaagacttcaggaagaggtgatgcttgggctaagtcctaaagggtaaagaggtgtttacatagtaaaaagtggcgggggcgggtggaagtgtgtgtttaagctgagggcaaaccctcaggaattgctctgcagttcctatactgtccagtactggtaagagttctgatcagatttgatagccatacatgaaatgtggactcagtgtttgtttgtagcccaccagatgtgttgagaacactgtggataagtgcatattttagtgcttctgtaaagccctagaaagtaaatattttaggctttgaaggccatgaggtctcttttgcaactatgcaactatgcagtgctatctcatcacagatttaatttgcatttttctaatagttaacaatgttgaaagtatcatgtgcttatttgctatctacacatctatgttgaaatgtaatgttgaaatgtttgatgtattttccccattttctaagtggacttttttcttactactgagttttgagagttctttattatattctagataaaaggcctttgtaagatatgtgatttgaaaatattttcttctagtctgtagctagtcttttcattctcttaacagtgtatttcactgaacaaaactttttaattttgataaaatccaatttatcaacttctgtttttatggatcatgcttttgatgtcatatccaagtactcttcaagtaactcaaggtcaggaaaattttctcctatttttttctaagcattttattgttttatgttatatgtttagatctataatccaccttgagtaaatttttgtttaaggtgtaaggttaggttaatgttattttttttcatactgttatacaatgatttcagcaccatttgttgaaaaaacatatcatttctccattgaaatgcttttgcatttttgtcaacaatgagttggctatgtttatgtgagccaatttttagactctgttttctgttttattgatctgtgtgtccttccctttgacaataccacaccgtcttgattactgtgtatatacagtaggtcttaaaatcagttaatgttatttctacagttttattctttttctttaaaattgttttagctcttttagttcctttgctttttatataaattctacattccacttatctgtaaatacaaaaagttctatgggatattgattagaattgcattaaattatgctgtttctttcagtccataagcatggtataactctatttaaatcttctttgatttctttcatcagggttttatggttctcaggatgcagagtctgtacatattttgttacacttatacctaagtatttaaatttgttttgagctattataaattttaaatgtatacatatatttaaattttggttttcagtggtgcattgctggtatatagaaatatgcttgatttttgtgtgttgacttgtattccatcacctttatagtactcacttatttttaggagtttttatgtagacttcttgagattttctgtgtagatagtcatgctgtttacaaacagagttttctttctttttttctgatatctgtgccttttattgattgatttttgccttattgcattggctaagacttccataatgatgtggaataggtggtaagagtggatgtcttacattgctaccagtcttcaggagaaaacatttagattttcaccattaagtatgatgttatctgtaggttttttggagatgttcaagttgagaaaagtttacttctatttctagtttgctgagatttatttttaataattaatggatgttggcttttgtcaagtgctttttctatatcaattggtacaattatgtggcctttttagacttagtatgatcagttatatcaattgaattattctattattgaagcaaccttacaatcttgtgataaactccacttgattgtggtgtcagaaagggcctctgataaatctccagatatgtactcagtttatttctctttgccctgtaatgtaaatgcagttatactggtatcataagggtacatttcggtactagggaaaggtcagagagagaatgctgagaggtggaaggcattctgcttgaatgaggagccaaggaaggcaatggaagctaggggagagaatgtaagaactgatccgtgagcaagccaaaagtgagccaatccatcaggctacaaccattgagtgagtgcctgctatgtgccgagcagttgacacaggctaaaaggttctaaaaagagtcaagattggataacaaagaaagaaggcccttgaggaacttgatcatgctgggggctagaagtgagagggtttgtatattctagttctggaatttggctgatgagcactggacccaggacccaggtggctgcctggagcagcctgaggtcctttcttggcctgctggtaggtaaaataaatgagaggagaagagtctgggaaaggtggcctctgtggcttatctggcacctgcaatttgattagatgtatataacctgtgtcttaaaatccctcgcattgggcatggcaggccaacatgcaaccagcaggtactgagataggaccatgggctctgagagggagagataattagagattttcttcaaaactgaggacttgaccttcctgcttacttactgtgatcactataatgccactgccttaggcaatgatacccagtttgatctcctctcagatactgttaggtcagtgtctccatccattattttctgtggaagctctggcagcctgagagtttgagcaaaaccaacctgaccaccgattttttagtatatagcttggtattgtcaaccatgattgcacattaggattgccagagacagaaccagcttaatagacatgtgaccagtgcatttacacaggaccccatgctcagaagggagggccatgctgggagattaatgttctattattattattattattattattattattatactttaagttttagggtacatgtgcccattgtgcaggttagttacatatgtatacatgtgccaagctggtgcgctgcacccactaactcgtcatctagcattaggtatatctcccaatgctatccctcccccctccccccaccccacaacaaccacaatgagataccatctcacaccggttagaatggcaatcattaaaaagtcaggaaacaacaggtgctggagaggatgtggagaaataggaacacttttacactgttgctgggactgtaaactagttcaaccattgtggaagtcagtgtggcgattcctcagggatctagaactagaaataccatttgacccagccatcccattgctgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgagattaatgttctgtggtttccatttgaaacttaatgatttttatcttttttatcttcaaacctgtgttttgtaagtgaagtgtaatgagacaatgaagcatgtactgggggcttgaaatcttgattcacatatggatctacctcctacaaactccccacatctccaggatgggtttttggccaccactcccttgatttctggtgcccgtggccttacctgggcccccctttctcatccttgttcatccatccccagcaggagcctggatgttgggagagtcaggatcagatgcatgcaccttgcagcccctctagggagggcatgacatcgatcatctctgctccagtttcacagcaccaggcacattcagtgggaaacacagtggcagcaagcctcttgtctatccctgatttaggtacctaagtgtaccctggtaaagaggttgtaatatccttgggggatgtctgtcttctgtgggaggggatggtgggcccatgggaagagagatgctaaacctcaatttccttaccttctgataaggcacagcatgtcagtctgatggctggtgaaagggacccagtagttgtcaggcccaatcacacacccaagacacaagtcattgggtggagctcctgggtgcctgcaagggtctaccctcagcccatgaatatccccatgcccaagagagtatcgtttgggcctgcttcatgtctggagagaccctctctttctcctttcaaccttcctgaatctgacttgcattagtctcttctagccagctcaaggcaccttccagagatgaagtatgaaatacaaattgtacaatgttggtgattctgcataggagttaaatgctctgatattttaatttaagatatcattgtgtcgtacaatataaagatgaacactaaaatgtctattaatgatttaaaattttactttttctttacttagagtgacactgaatagcaaagaggaaacaccatgacaggttgaatgagaaaccacagaagaaaggaaaacatctgtatattttagtacctttaaagacactttttctctgttttttgaataaggcacaccacgttttcattttgcactgggccccaaaaatcatgtatccagtcttgtctgggggtatatttaaaatatatggatatatccaaattaattggcattggatagggctctaggcatatgcatttttaaaggcattccagagaatctgttgtagaaagaaagtagaaataagcaaagagcgaaagctagaataaaccctgtgatactagattagcgtcagagagatcaatatgaaaaatcagtaaatatgtctgtctatctgtctatctgtaaagataagtagatacagaaatgaatgttgatatggtgttgtcatagtctgttcaggctactataacagagtgccttagactgggtaatttataaacaatagaaatatattgctcacagttctagagtctgggaagtccatgatcaaagagccagcagattctgtatctggtgagggttctttgcttcatagatggtggaaggggtaaggagctaagatgctcctttagacctcttttataaggccactaatcccattctttaggtttctgcccttatcacttaatcacttcccaaaatgacccacctctttataccaacacattaggaataagatttcaacatataaattttggagggacacaaatattcagaccatagcaggtgtattcatggatatgtatctatgtgtatatgtatatgtatatagttgtccctccatatccataggttctacattcgtgggttcaagcaactgtggattaaagtatttgggaaaaaaaacaataaaaaataacaatataacaataaaaaacatacaaaggaaaaacaatatggtctaacaactattgacatagcatttacattatattagctattgtaagtagagaggatttaaagtatacaaggggatgtgtgtaatttatatgcaaatactacaccatttaatataaggaacttgagcattcatggtatccaacatggattttggtatccacagggagttctggaagcaatcgtctgtggatactgaaggttgactgtatttcttttcttttttttattttattttatttttatttttttattattattatactttaagttttagggtacatgtgcacaatgtgcaggttagttacatatgtatacatgtgccatgctggtgtgctgcacccattaactcgtcatttagcattagttatatctcctaatgctatccctcccccctccccccaccccacaacaatccccagagtgtgatgttccccttcctgtgtccatgtgttctcattgttcaattcccacctatgagtgagaacacgcggtgtttggttttttgtccttgtgatagtttgctgagaatgatgatttccaatttcatccacgtccctacaaaggacatgaactcatcttttttatggctgcatagtattccatggtgtatacgtgccacattttcttaatccagtctatcattgttggacatctgggttggttccaagtctttgctattgtgaatagtgccacaataaacatacgtgtgcatgtgtctttatagcagcatgatttataatcctttgggtatatacccagtaatgggatggctgggtcaaatggtatttctagttctagatccctgaggaatcgccacactgacttccacaatggttggactagtttacagtcccagcaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatggtcttttggctgcataaatgtcttcttttgagaagtgtctgttcatgtcctttgcccactttttgatggggttgtttgtttttttcttgcaaatttgtttgagttcattgtagattctggatattagccctttgtcagatgagtaggttgcgaaaattttctcccattttgtgggttgcctgttcactctgatggtagtttcttttgctgtgcagaagctctttagtttaattagaccccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagttttagctttctacatatggctaaccagttttcccagcaccatttattaaatagggaatcctttccccattgcttgtttttctcaggtttgggttgactgtatttcatagctctgtccactgagagggcctagaagcagcaacactgaagtagaattaagcttacctagaactacatcttgtttcctaaataccattctcaattaaaaagaattagacctccttagagaaatagctaatgagagagagaatacaccacagtagtaatctcagaggacaagatatttacatagctacaaactattagctcccaaatttgtattaattactatggtggttttaatatgtgttcacaaattatttgatactcctccctacaggtggtagagattaattccccttcattgagtgtgagctggactttctgtctcagttctaataaagtatgaaacggaaatttagtagttttaccatttactatttatattttctatttgatatataagtaggttgaaagtaaaaagatatatcacacaaatattcagaggaaagtgggaatggctgtattaacattaggtaaatagacgcaagaacaaagaaaattactaaggtagaaggggtcattaaatgatgattaaattgtcagtaaccaagaagacagcaatcctaaatgggtatgtgccaaacaacagagctgcaaaatatgtgaagcaaaattcaatagaattgaaaacagacaaattcacaattatagttggagtcttcaaactcctctctcaacaacttatagaacaattagaaagtcagcaaagatataaaagaacacaacaactctatcaaccaacagaatctagtgtttataaaaacctccacctcacaacagcagaatatacatttttttcaagcatccatggaacatataccaagataaactatatactagactgtagagcaacttcaagaagtttagaagaattgaaatcaacagaaagataccaggaaaatatccaaatacttggaaacaaagcagcacacttctcaataatccatggagcaaaaaataaattaatcagagtgaaaataaaaatacaacatatcaaaatttgtgggacacagctaaaggagtattgagagggaaacaaatagcagtaaatgcttatatcagaaaaagggaaagatacactaagatcagaaacaaggcaaggatagctgctctcatcactcttattcaatgtagtatagtactagaaattctagccagtataataaagcaagaaaaagaaataataagcacttgaattggaaaagacaaaataaagccctcccaatttgcaggtggcatgattgtctatgtagaaaatcccaaagaatctacaataaaacttctagagttaataattgagtttagtaaggttgcaagacacaatgtcaacccacaaaaatcaactacattttcaaatactgtgaacacatcaaaaccaaaattcaaaacacaataccatttacaattgctacaaaaaaaatgaaatacttgggtataaacttaacaaaatgtaacaaaacatgtagaggatatgtatgccaaaaattacaaaatgctgatgaaggaaatcaagaagacttaacattaatggagagaaatactgtgtttgtggattggaagtctcaacccagtaaagttgtcaaatctgccccaaattgatctacaggtttaatgcaattttaatcaaaatttcaataaagtttgtttgtaggtaaacttattctaaaatttgtatgatgcccctctttattcctgataatcttccttgttctgaattctgctttgtctgaaattaatatagatactccagttttcttttatgttagactggtatatctttctccatctctgtacttttatataagtctttatattgaaagtagatttcttggagaaaagatataggtgtgtcttgtttgatttttttatcccctctgttttaattgatgcctttaggtcactcaaatttaaagttattattgatatattaatatggattacatttgtaactattttctattgtgttttcattttcatatcccaactcttttgtctgccttctttgtttttaattgatattttatataattatattttatctcttttcttacaatatcaattatacttcttttaaattttttaatggttgccctacagtttaaaatatacattgctaactatgagtctaccttcaaataacactgtaacactttactcatagtgcaggtgccccataacagagttatcaaatcttccctccaatcctctgtgacgttgatatttatttcacttatccatatgctataatcaaccaatacattgttgctattgttactttaaacagttatctttgggctgggcatggtggctcatgcctgtaatcccagcactttgggatgccgaggcgggcggaccatctgaggtcaggagtttgagaccagcctgaccaacatggagaaaccccgtctctactaaaaatacaaaattagctgggcgtggtggtggcaacctgtaatctcagctatttgggaggctgaggcaggagaattgcttgaacctggtagatggaagttgcagtgagcagatattgtgctatcgcattccaggctgggcaacaagagcaaaactctgtctcaaaaaaaaaaaaaaaaaaaaaaaggtgttcttttagatcagctaagaattagaaaaataaataaaagattttattttaccttcatatattccttctccaacagtctacactcatcctttctttctgtagaactgagtttctgatcactataaccttttccccctaaagaactccttttaacatttcttgcagggccagttggttttcatttctgtcagtttttgttttgtttttctgagaaaactgtttcattttcacttctgaaggatactttcactggatatagaattgcggtttgctggtttttttttctttcaagactaaatatttcactgtactctcttcttttttgcatgtttccttgagaagcctgatgtaattcttatccttattcctttataagttgttttctctccctctcttgtctttcaaggtttttttcctttggttttctgcagttttgctagaggggactggagtaggtaggagcaatgcccttccccagctcagataaggccctagaaaaatcttttcccctgtaaagttgtcctatgttaaggggaaggcatatatcacaatgattattttttactctcgccgacagacccacaagataattttactcagatctttactgtaagaacttgttggatttttttgaaggtaaagacaacaaaatgttggggttttccctatgcctgcagtcctcaatttgtcattctcatagtagtctacactcagcctgcagcaatttgttaaaattaccagttttggtattcctagtttgtgactccagtgactctggtccaagcaagcaaattgcagctatgtctctctggatgttcctgactctctagatttcagggtggtggtttgccctacaacctcatttgtctgaaggattcatgaaaagtcattgattttaagtttgtccagcttcttcttgtaaggatgggagtgatgatttccacgatcttgtcagaacttaaatcagagtaatattccaaaatttatatgaaaagacacaggtcctagaataactagaacaattttgaaaaagagtaataaagttggaggaatcggtctacctaacattaaggctaactacatagctgtggtaaccaagaccatgcagtattgccagatgagttagatatataggtcaatggaacagaatagagaacccagaaatagacccacataaatattcccaactgaattttaacaaagatgcaaaggtgattcaatgaaggaaggatagacttttcaacaaatggtgctgtgttggaacaactggatattcataggcaacacaaacaaagttcaacttaagccttacaccttatgtagacatttactcaaaatggatcatgtaagtttttaaaacataaaactaaacatattttagaaaactggaaaaaatcttccagctctaaggctaggcaacagattcttagacttgacaccaaaagcatgatccataaaaggaaaaagtaattggtaaattggaactcatcaaagttaaaaactttctgtggaagtttttatgaaacatccttttaaatatgaaaatacaagctataaactggaagaaagtatttgtaaatcatatccaacaaagaatatataaataactctcaaaactcaatagagtaaaaaaaatcctattagaaaataagcaacaaacagcaacagacatttcactgaagaagatatacagatgacaaataggcacatgaaaagttgttcaatcaacatcaccattaaagaaatataagttaataccataatgtgatattactatacctccatgcatggatctttccacattgcttatgggtaatagtatgaccactctggaaaatggtttagtggtttcttacaaaactaataatacacctactatactattcagcaatcatattactgggtgtgtatctcagagaaatgaaaacatacatccatacaaaaacctgtacatgaaattcgttcatagcagagctgttttcaatgatcaaaaaacagaaacaacccaggtgtttggttaataggtgaatggttaaaaaaattatggtacatccataccatggaatactactcagtgattaaaaaaaaagaatgaactactgatatatacaacttggatggatctcattggcattatgctgaatgaaaaaaggcaatctcaaaaggtcactgttaggttccaggtaggtgggacatggctttattcagcagtttcttcacactgtcggtgctgcatttatgcacctcacagaccataatggctcagaggcaggtgatgagccctcccacgttatggctacatagctgtgattatgtaatgcatgggattgtgcgcctgtgctccaatcccactgtgtcatactgtgcaggatgtgtacctcagcctatacttgactgcagcacagccattgtccttacaatcacatactgtaaggacagtatgtgattccatttatataatagtctcaaaaatgataaaaagatggagaactgattggtgctgtacaaaggttagcagtgttggtgaggggagttgtgactataaagaggtagcataaggaagatatttgtggtgatggaatagttccatttctggattgcagtggtggttacaagaatacagacgtgattaaatggcatagaattacacatatgctttgcaccaatgccaatttcctgatgttggtatagtactatagttacataagatgtatccattagaaaaaattgagtgagagtttcacaggacctctctgtatttacaacttcatctgattctacaattatatcgataaaatacttcttaaagtagcttacagtggagaaacctggcagaaatctccttaaccaaggaatcaagactaacatcactggtaagtttatgttcatatcttgaaccccttatactgtgtcataagaaacgcacttcacctctgtgctatccttccccaaaatatataatcccagtctaattatgagaaaacattacacaaacccaaattggggggtattctacaaagtacttgaccatttatctttaaaattattgagatcatgaaaaacaaggaaacattaataaatttccatagattggaagcaaataagatatgatgactaaatgtgacataatattctggattgcatcctggaacatgaaaaggacattaatgggaaaactggtgagctacattatacaaaataactgatcagtgctcttcaaggtgtcaagattatcaaagacataaaagaatggatgaactgccatagattggaggagacaatgcaatgtgaaatcctgaatttgaccctgaacagaaaatgcaatgtagtggagaaactggtaaaatgcagataaaatctagtttagttaatcatattgtaccaaagttcatttcttagttttgataactctgatggttataaaagatgttgacatgaagaatgctggatgaagtgtgtgcagcaactgtttgctgtttttgcaacttttctgtaattttaaaattatttcaaaataaacttttaaagaaagcctcctgggagattctaatgtgtagccagagctgagaaccactgctacctcattcatttggtcctgcctcatgggtttccactatactctcctactccctagtctgcccttcctccatcaaaattgctgtgctctgaagggatgttttcaactggctgctggcctaaataggatgagacaaaaattaaaacgtttctaccactatcccagtgggaaactaattccaaagctaatagcatatgggcactatcctatctactctagccaggtgtcattgtacagtaagaatttccacctcagagattgattccttttcataaagcatcattacatcatcatttttcaagcagcacttctggatgtcagcagatgaattcagtaagaattatgggtcatgcgaactggtgtatcagggctttttctgtaacaccacaaaacactgggcttctgtggaggagagagctaaatttgtctagcgtctcctacaatccattttaactctctagacaggaaaggaaagcccttgctttgaggcaggaggctggttttgcaggtagttagagccaggtacttaaagacagcgagaagaaaggatggccttagagagtgatgtcctggtcgtagagaactgccttaagtagagatagtccacatcttgaatagcaaactcctgttgctatgacagcttccaagagcatacttgtctcatcagagcctggggcttattcaattggctccaccctcttcctggagtgcactgtttattaaaagggccctgccctttattctactaggattagtcattatgtgttagtgaactgccctttttctccctccacttcagcttttcatctgcatcctagaagcaagggccgtgtctttgggcctgctgagagtccttcaagagagaaaattaagaacagctaggggtaggcacaatgccttcatatgcctccagcaaaaagggcagctcagatactccaagaaggagagaaaaataatgagagttggagaaacgggctgagacatgggaactgtgcaaaggctgattactggataagattaggctcagggcaaaagtgcttactgagatattggaactcttaggacttattaatctagtgtttagcacttggagtctatagattaacaggtaaaactaaactgggacagactggcgaaagctgtgaaaatgccctgaggcagcttatagttaagaataagattaacaagaaaatgattaaagactgagctttactgcacagtaagttacaaattggaccctttgcatacagactttcatcttttccctgttgttctgtgtgggattgcatggtttacatgtaaaagtaaatttatttatttcttggtttgtttattctaaagaaatagatttctatacataaaatattgatgtttatttggagtagtatatccttatgaaactaaatgataaacttatagagtgtgaagggatgttagagttgacatactttgacactaaacattgtatttttaagtttaaatagcaatatctcacaatatttagtgctgttgtctaattcaagaaactacacacagaactgatacttcaagctatgcaaccacagcagtaacaaccacagtgatgccttatcttatttgcaagattgtctctttaatgggtgaacgaacctttggaaggatgaatgtatgacctaaacctaatagaatgagagtaggatcactgacatcagtctgagaaatctgttttgaagtgataaccaaagtggtctcctcagtcaaaaaactgcagtaagtattccccttcctgtgtccaagtgttctcattgtttgggggagggatagcgttaggagatacacctaatgtaaatgacgagttaatgggtgcagcacaccaacatggcacatgtatacatatgtaacaaacctgcacattgtgcacatgtaccctagaacttaaagtataattaaaaaaaggaaaacaaacactaacatttcaataaataatgctgctctaaaaaaaactgccgtaagtattaataaataaccttagaagttactgagcatcgggtcttcttaaataacatatcttttcaggagtgcagctaccccaaaagaaagacaacaatcttaatatactagacaaagcagaatgaatgaactaatcaaaacaatgattgaaaacaaactagaatatcattgaaaagttaagagacaatgttggtaacttgaggcaggaataggcagttacaaacaacatcattcagaaatagcagctatgaaaatataagttgaaataacttgatgggggggggtaaaaacaacagatacagatcaagaatgaattaatgacatggaatactagattgaacaactttcccagaagtcatcagaaagggataaatagttgggaaatataggaaaaatactgtagaggaaaaatactttagaaggagaaatgtccaatcagttgaataagagtaccagaaagagagagggagaagagtatgtggaggggatgtaagtatttgaagaaacaaagaccaagaattctccaatcttaggggagtatggatgatctcagtttaaaaagattcagagtttgccaaccaggatttatgagacaaagcgtatatctagacacatagtagtaaaattttaaaaaaagaagccttcccaggaagaaaaagcagataacctacaaaggaacaaaatcatattggcaccttagtactcaaaagcaacccagatagaagaaaacagtggaacgttaattttcagtattgagggaaaaaacttagaatctagaattttatacccagctaagtatcatttaaatgtaagaatgaaatattttaaggcatccaaggcctcaaaaagtttgccacaaagactgtctttgaaataagttcaatgaaagagaatttataataaatatgagtgagttgacttccccagtcccctcttgcaaatgttcctttaatttctcagatctgtcaaccttcctcttactgtggcgacatctccaggatagagttcttttgagggagccattctggagtttttaggctattctgtaacaatctcaagtggctaatttttgcttttattacaatcttatctttcctgctaagcttataaactacctgaggacacaatattattcatttctgtattcccagtagtacctttctcagggttttgcacatgggaggtatttattaaatgtctgtgccagaaaggaagagaggaaaagaggaagggaggaagttataggccagaagatgaagctagggttgcttccattcaagagaatggttgttctctctggtttttgtgcacagaggattaagtgacatcctagtgtgtgtcaatattgtgcacttcagcagatcatctcctgtgttaagtctgactatgagtgacttgaagataattgagcattattcatttcaccatcaaaatattaaaagcagcttagtttgaatccacttgaattaatcatttacttggttctccatgacacttaagctccctctgagtcattcatgatggaaaattatatgctcgcatgctagtaaacattcccaggccaggaaaaagatgggaaagtaatccacaaggggttctaaggttgttttttcggggggaatttttcagtgcatctccacagagttggtgaaaaatctcccttcttccctcttcagtgaggcagtactttttgcttatctgtggttctataacaagtgcccactgaggctgtatgggtgatgcacacctttcagcatccaaactctaagacctgtcttgtattggacccctttgctttccagggaagaggtgggtaggtagttagtgttccacacttactttcccttgacattatttgttgatatttggaggcaggcagaacaagagacatcaaggttgataggtgcatcagagttaggtcttttcccttctgtaaacaaatgccatcttttccattcatctaaaaagcatttgtagatgtttaagatgcttgcctgtgaactattttcaggcttttcctagttatttttttgctagtcccaaagaaaacgggctgggcagagcagaaaatggcagtggcaggtcgccaaaacaaatatatgacacatgcatatcctggaggccaacattatcacatcagcaaatgccagcagagagttcttcctcaccattatctcctccatgttttctcaccaccaattcagtttttggtcatgtgtttttataataacattgagttgagggtgttagcagcaattttgacatatggaattaattgcattatttctcaggtatttggaattcttaaaattccagaaaatcatgtaacatttggacaccacatggatttaattcagtatatagtcatgaagcatctgctcagtgcaaggtcagccctgggcagtgcctaggtacacttatcagtgtgaaggaagtgccaagggaagagtacaaatgaattggaggttcaaagcagggataggatttcctggtgaaacaaaaggaaagacttcttgaaaaggtagccttggggactagacataaacaacagatataatttctacaggcagaggcatgttaggaggcaggaacaacttgagcaaaagtaacaaggtgggagatcataggatccatttagggctagtaatagtcgctatatattgagtcatcactctgtgccatgcatcgtattaagtgttttacatgcattctcttatataactgccacagcagtctcatttgttataggtagcatcattccgaccttacaaattaggagaataaagctcagaacaattatgtaacttggtcacctgctaagagatggcagaacaggaattcaaaccaagtctgtcagactccaaagcctagctttgtagccactaagttttatgactcagaaataaacgtgactgggaagaaagggtaggaccatgctgtgaagagctttaggctttagatgctaagcgaaggatcctgaacttaaaagtgccagattgtgaaataaaagggaaaggagttttcctgtaacaggaaatgaatagtcaataagaggtcaacaggttagagaccaatgaccaggtccaaaacttctctgttttcttcatttgttttgtaccttcctgggaggagaatgggttgagtaggaaagaaacctccctgttcctcttagagcttttgtatggaatttccacttcttgggggtcctttttgttttgttcaattcctcgctattgtgcatggtcttacctctgaggagggaaggtcagaatctgaacttctgtggccaactagaaaattgaattgcttaaatttcagttcctattgcattatattgggtaactaaagcccctgttatctttttcatttttgattagttttggtattttatgtagcttcttctcagacacaaaaagataattcattaattgtccatggatataatcatcctcttcaatcttgtctagaaactggaaggccctgttgccctcacctgtagttagcacctcttttaccaaccttgatgtgggatcctgaaggagcaagttcttggagtcttgccttctgactgaccctggtgcttccccatgtggccctgcatgttgtggcatggtgttccccctccctttgaaattgtcggtaacaaagtatcttttttctctctctctcttttttttttttttttttttgagacagagtctcactcggtctcccaggctgaagtgcaatggagcaatcttggctcactgcaacctccgcctcccgggttcaagtgattctcctgcctcagcctcccgagtagctgggattacaggcatatgccaccacacctggctggttttgtatttttagtagagatggggtttcaccatgttggccaggctggtctcgaactactgacctcaagtgatctgcctgcctcggcctcccaaagtgctgggattacaggcatgagccaccacgcctggccacaaactatcttttcaatgacagatgtctcctgatctttggcctcacaccatctgaataataaacctacattttaaaacagcagtccctaacctttttggcaccagggaccagttttgtggaaaacagtttttccatggaccaaaagtggggactggggaggtagtttcaggatgaaactgttccacctcagatcatcaggcattggattctcataaggagcccgcaacctagatctcttgtatgtgcagttcacagtagggtttgcattcctatgagaatctaatgctgccactgatctgacaggaggcagagctcaggcagtaatgctggcttgcctgctgctcgcctcctgctgtgtggccagttcctaacaggccacggactggtattggtccatggcctgggggttgggaacccctgttttaaaagaccaaaaactctgtcaatacaatcaaccaaatctagagggtggggaattctgcaggaaaaatggcctgattttttactaacttaactgcttaaaatataacttctattgttattgcaaatttgctttctttgattaatagtgagactgaaatgtgtgtatttgtttagcagttatatttcttcgtgtgaggaagtgaattgagtattcctgcccattatccatttactcagaatgtgttttaaagcaaactggatcaaaatgtttcatggacttaaatgtaaaatataaactataaaactttttagaggaaaacataggaaaaaatttcagatctaggatttggtgaagaattcttagacttgatacccaaagcatgatctataaaaggaaatgtttgtaaattagagctcttaaaaaaaagttttacaaaattaaaagttaaaaaattttgctctatgaaagaccctgttaagggaataaatgacaagttacagacagggagaaagtatttgcgaaccacatatccaacaaatgactcatatctgggatatacaaagaatctcacaactcaacaggaaaaaaatccaattaagagatgagcaaaagacatgaagagacatttcaccaaataggattcacagatggcaaataattacatgaaaagatgttcaatatcattaggcatcagagaatgcaaattaccataatgagatgtcactacatgcctattagaatatctaaaatgaaaaatagtgataacaccaaatgctggtgaagatgtggagaaactcaatctctcatatactgtttgtgggaatttaatatggtacaaccactctgaaagaaagtatggaaatttttaaaaaactgagcatgcaattaccataaaacctaggaatttcactcctggacattcattctagataagtgaaaactcatgtgcacataaaaatatgtacacaaatgttcatagcatgttttttgttttgttttgtttttgaggcggagtttcactcttgttgcccaggctggagtgcaatggcatgatcttggctcactgcaacctccacctcccgggttcaagtgattctcctgcctcagcctcccgagtagctgggattacaggcacctgccatcatgcccggctaatattttgtatttttagtatagacagggtttccctatattggccaggctggtctcgaactcctgacctcaggtgagctgcccaccttggcctcccaaagtgctgggattacaggcgtgagccaccatgcccggcccgttcatagcagttttattcataataaccctaaactggaaacaacccaaatgtcctcaaatgggggaatggataaacaaactctagtacatccataccatggactactacttgacaaatcttgcatggatattaaggatttgatgtttagtgaaaaaagccaatttcaaaaggtcaataccatatgattccaattgtataactctcttgaaatgataaaacacagtgatggagaatagttgttgccaggggacaggaacaaggatgaggagtgggtgtgattataaaggagataaagttgtagcatgagggaatgcctttgtggtggtgcaagcagtgttttgattgtgatgtttattgtgtgaatctacacgtgataatattgcacaggactatacctcacacacatgagtgcatttaaatactggtgaaaactgaaaagctctgtaatttagttaattgtattttcctatagtcacctgtgatgcaccattagggaaagccaggggaagcattcggtggattctgtaaactatttttgcaacctcctgtaagtctataattatttcaaaagaaaaagcttcaaaagcaatgctagaattttaattggaatagcattgaattacccattaatttgggggtcactgacaccttcacaatgttaagtcttcccaggttcattctatttgttgcctttaaaaatgtttttcatttatccaaataacactttcatcaaccaagataaggtaaaataatttaatgttaacctatttcaagtttaaagcaaataattatttgaaagcattttactccaaattctttgcatgacataaaagttcttagctttttagatattcattttcacagtggtttttagtgtgtgctctctgaattagtagtatgcatatctctaacttttcagtctaagtaaagaaaataagattttatataaaatgtagaaaacttacaacattagaggtcaatgtaaccactccctatccttttctctatggttgtcaaatgtattccatctacatatgaagcctacaagtaaatgccataatttttggtctaaggaatcctatgtatttgaagaaattaagaggaatgaaatggctttttaaatatttacccagatatttctaatttctgctttattttttaaattaatgtatgcatttccatctggattcatcttccttcagcctggtgaagaacttccttttgtcaagaagtcaagcagtatccaggcagcattggcttagatgaagctaattgcttagtgaagctaataggatcacttgtctagctgctaggtcagcttgtcacattttcatagattcagccagtaaggaaaaacaagcccagatagattcagtttattacttagagagtaacagcaagatcaacatggcattagctgcctgtatccatagtccaacaggattacactgaaccagaggaaccagatgacatgaataacaggttactctgacactgaaaaaccagctctaaactatagccaaacatgtttatacagctgtgtcataagggagtgagacaaggtggaaagttctgtgctcaccgacattagggagacggatgaaaaacagccttgggatggttcctcaccaggctgtttatattcccttgctccaagaggaattgcatggtgttctccaaagacccaggtcagattatggtaaaaccttgcctaagtggcccatatggagactaaaatgatcattggggcaccatgcggtagagctgttctcctacaactttagcatttcttgtggttcaggtttgctggcaaagaattttttctttccttattctttaacaatttcacgattttatgtttttaattttaaatttttgtggttatatagtagttgtatatatttatggggtgcataggccagtttgatacaggcatacaatgcataataaccacaccagggcaaaggaaacagtcaacaaagtgaagagacaacccatacaatgggagaaaatatttgcaaactatccatctgacaagggattaataacaatattttttagaattttgttgtatctcaaagtatctttgttttgccttcattcttaaaaacatatttttgctgagcatagaattctgggttgactttaaaaaatattttaatttttgtaggtacagagtaggtgtatatatttatggggtacataagatgttttgagatgagcatgcaatgtgtaataatcacatcatgtagaatggggtatccatcccctcaagcatttatcatttatgttacaaacaatccagctatactcttcgttatttttaaatgtagagttaatttattattgattatagtcaccctcctgtgctatcaaatactaggtcttactcattctttcaaaccattttcttgttcccactaaccatccccacttcccacccacccttttactacccttcccagcctctgctaaccatcctttttctctttgtctctatgagttccattgttttgatttttagatcacactagtaagtgagaacatgtaatgtttgtctttctgtgcctggcttatttcatttagcataatgatctcaagtttcatccacgttgttgcgaatgacaagatcttgttctttcttatggctgcatagtactccattgtgtgtaagtgccacattttctttatccattcatctgttgatgaacacttaggttgcttccaaattttcgctattgtgaacagtgctacaacaaacatgggagtgccgatctactgattttctttcttttagttatatacccagcagtaggattgctggaaaatatggtagctgtatttttagttttttgaaaacctccaaactgtttgccatagtggttgtgctaatttatattcccatcaacagtgtacgagggttcccttttctctacaccctcaccagtatttgctattgcctgtcttctggatataagccattttaactggggtgaggtgatacctcattgaagtttttatttgcatttctctgctgaccagtggtgttgagcatcttttcatatgcctatttgccatttgtatgtctttatttgaaaaatgcctattcaggtcttttgcccgtttattaatcagtttaatagatattttcctatagagttatttgggcttcttatatattctggttattaatcccttgtcaaacgggtactttgcagatattttctcccattctgggggttgtctcttcactttgttgattgttttctttgctgtgcagaagcttttaaaacttgatgtaatcccatttgtccgtttttgctttggttgcctgtgcttgtggagtattactcaagaaatttttgcccagaccaatgtcctacagagtttcccggatgttttcttatagtattttatagtttgatgtcttagatttaagtctctaatccattttgatttaatttttgtatatcgtgatttgattttgatttgatttttgtaggggtctagtgtcattctcctgtacataaaaccagttttcccagcaccatttattgaaaagactgtgttttcaccaatttatgttcttggcaccttcataaaaaatgagtttactgtagatgtgtggacttgtttctggtttctctattctgttccattggtctatgtgtctgcttttataacagtaccatgctgttttggttactattgctctgtggtataatttgaagtcaggtaatgtaattccttcagttttgttctttttgcttaggatagctttggctattctgggtcttgtgttgttccatataaattttaagatttttttctacttagtgtttttataggaattgcattgaatgcgtaggttgctttgagtagtatagatattttattttattttatttattattttttttagacggggtcttgctctgtagcccaggctggattgcagtggcacgatctcggctcactgcaagctccgcctcctgggttcacgccattctcctgcctcggcctcccgagtagctaggactacagttgcctgccaccatgcccggctaattttttgtatttttagtagagacagggtttcaccgtgttaaccaggatggtctcgatctcctgacctcatgatctgcccacctcagcctcctgaagtgctgggattacaggcgtgagccaccgcacccggccagtatagacattttaacaatattgattctttaaatcaatgaacatgaaatacctttacatttttttggtatcctcaatttctttcatcagtgttttatacttttcattatagagatctttcacttctttggttaagttaatttctaggtatttaattttatttgtggctgttaaaaatgggattactctcttgatttctttttcaaattgttcactgttggcatatagaaatgctattgatttttgtgtgttgcttttgattgtgtcctgcaactttactgaatttgtttaacagttctaatagttttctggtttatctaagctgaatctgctttaaaggggcttagatacagcttagatcacaacacccaagtcctttcaaagtccactatctctgggcccagttcagcactaggattctcccaggagttgctgctgttttggcttagactgcctttcaagtttatttagagacacagagcactttaacctgtggttgcgagactagcaggaactcaagttctgaccactgggactgctgattcccctctggctaggtctggcttaaatgttccctccattcagctgagtttggtctgtttttgttttctgttatagggcagcactgagttcaatgcctaacaattgctgcaatcttgctctccatgacacacaggaatgctctccgaaccacactgccactgctgggagatgagggaggggtggctttggtgattcaagactttttcctacctcttcagtgcctcctttagaaatatgaagttaaaaccaggtgctgtgtgtgctcacctgattttggttcttatgaaggtgcttttttggtgtgtagatagttgttaaattcatgtccttgcagatgaaccatcaggagaggtttatattccaccaccttgttctttcccaagtccaggttggcttctttttcttaccactttgaagatgttggtcttgtctcttttggcctccatcatttctgatgtcagtaattgagtcatttttcctcctctgtgtgtaaaatgttgttattttctggctgtttttttgattttctcattatatttggttttcagcagtttgactatattccaagactttgttttctgtcctcttgggatttgctgagcctctggaatctttaaatttagggaaatttaaaccattacacatgcaatttttttctatcccattctcctcctcctcctctccttctagaactctaacttcatgtacgttacacctttggatattgtcccacacattcctgaggctttgttcattttttttctcgtgtgtttttctctttgttctctgtatatctataggaacgcatgattttgaaagtttcatcttaagtttactgaaacttccctcttttatttccattctgctgttaagcctattcagtgattttttaaagttagatattgtattttccaattgtgtaattttcattttttatggtttatatttctctgctgtgattttctatcttttcatttattgtgaaaatactttcttttactcctttgagcataattctactagttgccttaaatttattgtctgctaattctaacatctgaatcatcttaggttttctctttgttgattgtattatctcttggaatggatcacaatttcctagttcttcatatattgagtaaccttggattgtattctgagtcttctgaatattatattatggagactctgggttctgtgtctgaaaaatactgattttattgttttagcagacagttaacttggttagactgaaactaaattctgtctcttggttggtagctaaaatgtgagttcagtgcttttatctttagctaaagtctgtcccatgtatgtgtggttcaggggccaactgagacttggatagtttgtatatacaggaattagtgctccttctatcttgccctctctctcctttacaggattctccccacaactgtccagtggctcagtttgtcccaagctctgttctttagttcttcatatcagaatgattgtcagtttattcttagtgtgctagccacttggcagctttggcttgccctcagtctaaaagctgtaaaaataggttgctcatgttatgccatacctttattcaaatgtcaactccttttaagaatatgtctgcttctgttcactttccagtctcttcatatcattgtttctttatattttgttcagtgtttaaaattgctgttttcaggaggattgcaatcagtaggagtttattcagtcatatcagaagcagaagcaatgatcctgctcaattttgatttcactcctagcagcttatctttaatgtggtattctgtcctagaaaggaatcttgacaagtcatttttgagagctcatagtggctagattcctacagcctctttagtccttcttgccgtaggccttttatactcacttagtactggagagtggacaacctccaccagtttcagctgctattctcaattgttccactatgcttttcagtgaatattcattagccgtttttccttgtgaactcctgttccactagggttttggctgtcttggattgtaatgtgtaactatggggagccactaaaacttaagccttgcctagtgcgcctcccaacccaataagtttgatggtggggagctatgttgctggggagagagcctctagcataacaaatggtaactcagccttggcattgctttttttcagaagaatcctctgtagttgtagttctctagttttcagggtgtcgagatacaggtagaagtggggaaaaaactcttaaaggctggccaatccacatgcagttgatatctagtacccatcatctcagccagccctgagttcacacctagtgggtactagtctactgtttaaatgtctcccggtggcaaagcagggaaaagaatggtgttctcagggtagtaagtagagaaaatgggcacattaaaaaattgttttcctaccttaactcctgtccattgttcttggccctcttcttttctaggctgccttttccctaatttaccctactcagattcctgacctatccacaggctcttctgtttttccagtggtttcctcatcattttttagctatttggtagaaatatccatctctggattatgtgacatggccagggtttggttctagagagaggactagttgtaattttgcaattttgataagaactggcataactgcttctatctataaaaaaatgaaattacctaaaattctgtaggtatgtatttcaggacatttcaggacattggaacttaaaaaggtgagattcctgaaccctagaagacccttgataatttaaaacaatggtaacaatgaagaataattaattgatcatcagctttggattcttacccagttaatgacatagacatattaccaccaggggtacagatgtaaaatacatctttacagacataagatctaatggcataggagataattttcatttttgtaaaatgtctcatcgataggctgcaaaataatgaacgatttttttctgtggcattactgaccagacattgggccagggttgtaatatttgttatctaataaaactaaaaatatctggttaattattttttcctttgcttatgggctttgcttatagtctgatgaaagtaagttatactttatagtttctaaggagattaggatgatagaaagtttgaatgaaaaaagccatatcaaattactctagttcttaattttgccagagccattaaaacccaattagatacacaccaaattcctgtttattagaagctggcatagttgtgggagcacttttaactacatgcggtcttttgcaaaaaggcattgcgtcattttaataacaagcacgttttccatgaatatactcattcacatcaacaaaacagcttcagccatttacaatccagtgattcgaactgtttaagcaaataagtgtatgagccattagacagcttctttccttcttacatcttctctctcattaatactccatccccacccccatgcctgttgaagcactattcatgtcctccaggagcagctcaaatagtatcaagcccaatcattcctccacaagacaaaattgattgcttcctttcttattcttctccctatctctaatgccaagtgcagaacatggcctgtagtaaatatgttaagtgaatgcagtaagagtaaaaccaactgtgaaatggtaccattttgggagactggccgtgaagatggtgctttcagaaaggcctttctcctctactgccaagacccaagcaagcatgttaagacggactacttacccaagactggctatggctgtttctaatagaagcagagaaaaccaagagatatggcatttacccacaaacactgctattaacttgcttgtgcttgggggagtagggcaaggtactcctgatttgtgtgcttgaccagggcatgccacggacatagagtcaggcctctttcatcaatcatatgcttctgtagccaccattgtgcaatagcataggagtggataatcaccgtgttttgatgatttttcgaaggtggaataaagagtggtattagaatctaaggtgttgattgtcttctataggaaacatcctctcctgttccatcagaaactcttcaaaattcgaaaccttttaaattagaagttattggagatccctttctagttacattgacaaatgagttatttacctctgccctctccttattatgtatttcatttgaggtaaacacaatgcttatttaacttttgcatcctcagattaactgcaagtggaacaacctaatacatttccccaacattggagtttgaattcttttttttttggatatatatgattttatattttctcaacattaaactcaaggaaagtcactgttttatctcttttatcttactcagaccatggtggaaaataaactcattaatttttgttgtaaaggagaggagaagctggtgcatgtcaattaagtgaagtttatttaaaagatcttatacgtataattaatctatcctaaaatatgatctttctctattgcattgtgcctttgtggacgtcagtattatcaaataaaaataagttccaatttagtgtgttaataggtgcactttaaatatattttaaaaatttctttccaaagcaatttaaagtgtatataaggaaaacataaataacatatttcacaacttaaatgcttttttatgcaaattctaatatctgtttcagaaatcatttctataagaaaatgaaatcttaaaagctgtgcaatacaaatgtgcattttatttaaaaaaaaggaaaacagagaaaccaatgaaaagaaagagtgtttaagagctatttcagagtaaaaacttaatatattaattctttgagaagtaatttttgttggaaaggaggagctggtgcatgtcaattaagtggaatttatttaaaagatctcataaatattattaatctatcctaaaacattatctttctgtactgcattgtgcctttgtggagtttgaattctaaggacaacatttttcattctcaaatgaagctgacttcaagaaagaacagcagaccaagcagcaatgctggcctcctctgtcttgcagagcactcttataatgaaagggcttgtggaatttggctccatttcctacagccatgggataagggttgcatgtaaacaataatatcctgtgctgtttgggcctcatttaactgtctttattactttagaaggaactgccaagtggtgctgtttctcatagctcatgctttacataccagcggtattgtagggtctgcttcaaagatggcactccacaccacgaagcttgtggctgttggcacacttggttgtcaccaggcttcatgttgacacattccttcaagtcacaccaaaggtgcactttccatgaagaatgaatctggtacactgaaggtgggcctgttattgcagaaggcctttgcagttaccatttgggtgttttcctagaaagctatagcagctctgcacctagaatgactgtgtttgctgaattacaaacagagaggtgatttttgcaaagtaagctgttacattattgacagagcactaagctggagtcaggagatctatgctgtactccccagctgactagctctttagctctaggggaaacatccttgatttccctggcttgttttctaaccttgaaatgatgagattatgctagataatctctaaattcctctctggcctaaatttgatcaggcaaattaaaacagtaaacaacaaacagtgagtcaagaaacagaagttcccaatccaagctctgctgctcagtaattgtgacttgagacaagtcatttaaccattcagactcaggtctccattgctggggagaccaaagtcttctctacctgccccacctggtggttgtgcctgttgaatagggaaacatctttttcactcaacacatactgaacaattgctctgtggcaccagcttgatagatagcgaagaagcacaggttattagattatctgttactactactaatattaactacagtttagtgatcactttctatttccaggaatgtacatacaatattacatttagtcttcattttatggaggaggaaatttgaggttcagagaggtttaataatttgttcagactcatgtagctctgcagagctggagctgagatttgaaccagcattcttctgttctttattttaatggttacaaaatatctcacctctgacaaggagcttgtgttactatcattatttttctgggccatagtgtctgaatcccaagatctaaaatctgttggggggcaggcagatgaggggactgatctggcttgggctgaaggagagattctctttacagacacaggctgaggcagcacagccagggtagtaaaaatacctgagggacagccctcaggtatttttcaagcctttctctggcttgtagacttattttcaagtctacaagccagaggaagtccaagtggattgcccaaactgaggaaccaaaatcagcagtcactgagatgactggtcaggtgagtgcggaataaagcaagcactgtgagtcacaggaaggtgagagtgctttggtacagtttccaaggcttggcattgtttgcaacgagttttgagtgaagctcatggtatggtatgtggttagagcaacccctctaaaaagccatgcagagggcagaaaaagccctcagttttctcaccagtagaagaaaggctcattggctaaatgagctctgagtgcatcccttagtcaaacattctcttagccagcagatatgcagagctgggctacaccagggttctgagcaataaacaagtgctcttggtaggccattttttctctctttggaacgtgacgctgagtttctgagatgctgggattcgcttttggtgtgtcaggagctgcactggcaggtccccatcccccacaaagcaacccctgttctgttggccaacacttcccagggcagccctcccatcaagggaagtgggctttctagcctttgggaggttgtacaactgcacctagttgccatagacacagccaagctttttgtatgtctgcttcactcctccaagactgctgcttctcagaccatactgatgatgctttctcctacttcctagcctaaaagagaatggtttgcttacttggtctttggtttagaagtggctgtttgtcctaacattggactcgtgcacctgaaatcatggcctcaatggcagaagcaggccagtcagggaggagagagggctgacccctggtattggatatggccactaaccaggacccaggcttgggaaagtggcattgttacaggcaaaggcagacaagaaggtgagaagaatactctccacgcagacctaggtgcctcggtgatattctagaaaatggtcagtgctgaggaatacagcataaccaacataataacaataattacaatagcacaagaagacacttgtatggacactggtaagtatttagcatacactaattcttttggtcctcacaacaatcctgtgaggcagcaatattatctcctcactttacataggaggtaactaaggcacagaggagttaaataacctattcaaaatcacacagcttagggagtatgtgggtattacttggctcttctgccagttgggcaatcatcatctgcaagacctctaaccagtggccacaccctagccactgagtcaaggtgccagttccagagagaaaggtgggcaaaaacaaggcagggagagtgactcatctatccagcattagtctagtattgaggaccatcctctgtgccaggtgttgaaggaagatttaagtaagatgatatctcatttaggctagcgtttagttttcaaggagggtaggaaggtaggcaggacaactctaggacttaagagtgggagttaaggcagaagaccagctgttaagcatgggtcagtgtaagaggtaggcttgggaagagttctaatctgggagcattacagatctttcaggcagctgttctagggggtcccagacaggggagagcaccctaattctaatgctccagcccagggctgaagccaggcattgacttcatgcctgtgaattggctggtcagggaactggagtgagccttagcctctaggtggaagctccaactgtagggatctgagtaggaaaagggaattgaattgggggctgatgggaaaaaatctaagaataacaccccagctcctgtggaacctgattttccttctcctatccctttggcagcataggtgccagatgtggtggaaagggaaatgaatttggagccaagagatatgggctccatatgttagtagaaactatgatgtttgaacatccttgttgggatagctgaaattcttagtagaaattgcagaagaccagaggacatctgggaaatatacatggattgaagtggagaaaaataatcttttggggaaaatctccatgaccaaaaaccatcttattgttgtttttgtcttttaattgttttcactaagggggcataataatcaagtcatgtatgtaaaaggctttctaagctgtatggcagaagccctgtgcatgaccttgtcagcatcttcattgttacagattggagattggcaacctcaggagttcacaggaggagactggaactttgcttcttcccacccaagccccttttctctgtaatgggaaagtatcatttggagctgattcacacttctttgctgtgctcacttgtctcctctagagccatcagcaggggccactgctacctgcaggcagggcttgcataggtgcatgaagaggagagcagagccccttgcccttggctggcaagcttagctaagaaaattgggaagttaagtatctgtcataggatattacgagggtaacctgacagcctggaaagcacttagtgaagcacctggcccacatcagcatttggtaaatgttggccttcgctattctccttttcccctcctcctctccatcatccctctcattctcctttcccacctcaccccaccatcccgcattttcagagggctttctcaaacctcaggctaatggcttgatggactcaggaccaagctgacctggctccgacctagtggcccagtttgggtaactagattttgggccctggacccttgcattcccagcatgagcactctggggttgagatattgcctggcctttggcgcttccccttccagcccctgtgacttacgcccttccctctactctcagagctccctgatgccagtctctagctatcccaacacatttgttggatatgacttctcctttggtaatagtggcccacacagcagagattcccacttgggtgtggagtctttttgtcctcacctgccatcctacacagtgactctatacaatgacctctaattaaccaagtatttatctcagaaccttcccagcaaccctatgtagttgcacagttcattcatttatccatttattcattcaacaaacactcattgagcacctactgtgtgccctgggaggtgcaaccagggtggcacagtggaaagagcatgggaagtcttggaagaggccttcaggcagtatggcagagtgggtaaagcctgaactcctgagtctcacaaacccacacttgaaccctggctctaccactcacagctatatggccttgagcaaatcacctcatctccccatgcctcaatctcctcatatgtaaaatgggcatatgaatatcccttacctcacaggacttactcataagcctcatttcctactctgtgctgtcatataatttgtatgttccttttatttctacatcgtatcataacatgttataattctatctgccttccaagctatattctgagctcccagcaggcacaactacttgtttatgtttgtatctctagtgcctcccatagtgtctgctccagaatatacattcaataagtcgttgctgaagtgttaacactatgctgtaattatttttccaggcctgtcttcctcattaagctgtgagcttctggagggacgatatttcatttgtctcaatatctgcagaacatagcaggggtttggcttggagtagacactcagtgaatgttggttaaatgaatgactggggagtgggggattgagggaaggaatgaatgaaggaacagatggaagctgatgattaagacagtgtcttacaggctcactgttagtgaggtcaccatcagcttcaaattaatttggatatatggtaggaatttggggtaagagatagttgcattttctgaggccttatcctccttaaccttgtagaatttaacactgttgaccactctttccttggcattatttccctctttggcctctgtaagacaaaactattttgggtttccttgtgtttttctgactcttttttttttttttttaagacggggtctcactcctctcatccaggttgtagtgcagtggcacgatcacagctcactacagccttaacttgctgggctcaggtgattctcccacctcaacctcctgattagctggaactacaagcatgtgccaccatgtctggctaatttttgtattttttatagagacggggtttcagccacggtgcccaggctgatctcgaactcctgggcttaagtaatccacccatgtcagcctctgaaagtgctgggaatacaggcatgaaccactgcacccagccaagtcttttttttcctcctgcttcctcaccattacctcttccatttcctccctaccaccgctagcaccccagtgtgatataaatattctctagggcttggacctggccctgccctctccttttctggtgaaaattaatctaatcccaaggctttgctctttagaggcatctgtatagatgactcccaaatctctctccagttctgacatttcttctgagctccaagtctgagtcttcagcctcctgctgcatatttaaacctggtcctttggctgacttcccaaacttcatgtctcaaaatcctcatctttttttccccaaactgacttctcttcccatcttctctctttttattagcagtaatacctttcagtttttcagttcttctatcttctcatatagcgataatgcctatatatattttccttatacaattcacaaggaatatatatatgaattattatatataatgaattattaattgtgataatggcagagtcattttatatatatatcacaactagtagtactagttgtgatatatattattgatgtgataatggcagagtagttatatatattatatatagttatatatatagttatatattataactataatatatattataactatataatatattataactagttatataatataatatatataactagttataatatattatataactagttatatataatataatatatataatatatagttacatattataactatagttatatataataacttttaagttaaatcttttaagttggcttctgtttccttttgtcatgatagcttccttgatttttggttatataggatgtttcaggctcatcttatacaattccaaacccaaactgggggtcaaccatttatccaaagagctctaactccccttaatgggaaatgatatttagagagcacagtctgagagctgggtttcctcatagctactagattgtcatgtattttctttttagtgaaagagctgggagatacatattttttaaacaatagaagtgatgagtttatactgatatttcaaagtcaaatttaagaggatagggtttttacttatcttttatgtttgtaactgtatctcttctctcttactctaaaagtcttggttcctaatgacatcaacaaaattacttgctttaccctacctgatatttgtaacaattttaaaataacaattcaagtgttactactaagactatggaatgcagtttaagattgctttgctattttgttgttcttaaagtaaagtcctgttagggaggtagtcaaagtattatattttaatgtcggttgaactaatttctttccctgtggagttatgtttccaacttgatacgcagtttaattcctttgcttcattttttccctcagttttagggattgttttcctttctcttttggatttatctttacattgattatacgttccaaagttggaatcatgtaagagaagatattcttgaagtcttgtttccattctgctcaccattctttttccttcttccctttttagcaatcatttttattaggttttgttttatagatctattatgtgtttgaatattaaacaaatgagagttagtagttgtattccacccatatttcttacacaaaatgtatcatgtgctataaacactgccctgcttctttgttttttccacttaacaacatgtcctacagattatcatatgtcatcgtatggagctcttcctcattccttttttataactgcatcctatgccagcctgaagagaaatcatagcttgttcaaccagggagtccctgttgacagatatttgggttggttctaatcttttgctattacaaagaatgctaccatcagtaattgaggtgcctgtctcctggttctcctggctccaagcctgctttgccttctgcctccttttgcacacgtgatcacttcagaacccagcagttcttcctttgtcctcttctctgtttctgcttttccatccgtgctgcactcaaccaatttcacatgtgttgtctttgcctgaatcatagcagtagcagtgaaatccctgcttatctttctccccaatcccagtatgtgctgaataccatggccatattcatctcctgaaatattattttcactatgatctcttctcaccctactcaaaaatcttcaataataacatacaatccaagttccttaatttggaatagaagggcctccatgaactaatccaaatctcctttcccaatacttattccctctgctttggtctgtagatacattactcagcatatgtgatttcccaaaattcatgttaattattgcctttataccttacctgttctttaaacctccaattaaattctagagcctcatatactcttccagaatcccaggcattctcccctgaactcttactctgtgtgatatcagtttcaaactcagcaaagacttagcccctaggcaaatggaaaatcttattgaatctatctgttcactactgtgagatctaagaaatctattgatacattcatcaagtattagatgaacaccacaacagcatccaaaggtgaggcaagtgggccctttgattgcttagggctccttctggtagtgagcaagaagtatgtgggcatctgtctgcctggacgcacagataggaagatattccagggtggcaatacttgactgagagacatagtagtagactgtgtgtctcttacaaaggataatttctttccagttcaagaagaataaattggacccttgtctggggaaaggggctcatccactgggccggagtcacaaggtccccaatcctgggagtttctacctttcgcccatcaagacaaaatgtggcagtatgttctgtgagggcttgaaactcatgtaaacctgacattgtcctggccaccagccatgtgcatggtggttggcaaatcacacattactgaacactgcattttatactgctttctttgtgcacttttgttgtttggactgtattagccttagtttcttacaattcctttttaaatttcaccatctggggctagaactatttttggtttatttatttacaatttaacctcctcctccctttatttccaaaaggatttgcagaaacttaccagtttaagtatcatgtaaagtaagacatagagaagagttgcatgtttcaagaaggagtagatattaccagatacctcatgatcagaacactatgcatgttgagcactgactttaactgaattttttgcagtcaagggtgagggttacagtggcataaataacttgagaaccagaagagggctatattcctctttaaatgtcaacttcttcctgacacaaaactcaaatagggatttgtcacaggaatattgaataaacacattaggtaacatagtgattcatgtctttaatttttacaaacaacacagaaataccagtcaaatcaacactgcttatgtgaactgaagtaggattttgttttcattcttgttattgtgtatatccacagctaattgaagggtaagctgacacaaccactttcgaaagctgtttagcagtatctactaaagctaagcaaatacctaccctatgacccagaaatttcactgcctgtgttcagcaaaagacatatgcaagaatgtccattagagcattaatttagtactggtcaattaatgaaaataaccaaaatgttcatcaacagtaaatatataaataaattgcaatacatttacacaatagactacgctacagtaatgaaaatgaacaaagtatacctacatgcaagaatgtgaaaggctctgcaaacatactgattgaaataagtcagaccctaaataatacatactgtctgattcaatttctataaagattttaaaaaaacagattaaactaaactgtggtattagaaatcaggatagtagttaatttccaaggggaaagaaaggagaattataggtgcatgatggggcttttggagactggcaatgttctgttttgggtctgggtagtggttacttgtgtgtattcactttatgctaactcattgaactgtacagatatggactgtgcccctttctatatgtgtgtaatgcttcaacaaaagtgtcaatagtgatgcatgcacatgttaaaatttcaaactatattaaagagtgtgcaattaaaaggaagttatcctctcactctaaagtcctatttcctctcttcagtctatcattactactagtttctagtatattcttttagaaatgtgctgtaaaagaacaatgatgtgtatgtctctacaggtatatatttattctttttgtaatttacaaaaatataaactcactacatatgttattctaccacatgctttttttcatgtaacagtatgtcttagacatcttttcctattattgcgtggaagctatcaaccttattctttgtaatgactccataaattattctactgtgaaaacacaccatgtttaaccagttctctgttagtgaacatttaggatttttccagtttttaaatattacagtgacatattaaacattaaacatatcttttgacacatgtccttgcacacatgtataggtatgatggactttaacaccctttggctagattctttagcacataacgtaaatatcccatagagtcaaaaccacccttaaaacttcctcaggaggctgggtgtggtggctcacgcccgtaatcccagcactttaggaggccgaggtgggcggatcacgaggtcaggagatcgagaccatcctggccaacatggtgaaaccctgtctctactaaaaatacaaaaaaacaaaaacaaaaacaaaaaaacaaaacaaaaaaaaactagccgggcgtggtggtgggcacctctagtcccagctactcgggaggctgaggcaggagaatggtgtgaacccaggaggcggagcttgcagtgagccgaggtcacgccactgcactctagcctgggcgacagagcaagactccgtctcaaacaaacaaacaaaacaaaaacaaacaaaaaaacttcctcaggaaggctgacatgccatatcttcattattccagcagagcctatttgcccccaatattggagtagatcactgagtcattggctaagcaccagatgaagaggttagcttgtggttatgagctatgttgaatgaaatatgtgtgtctttaaacaccacaatcactgtgagatgctcactgtatgagagacacacagggactgaaccttaccgatggagtagaagaaccacagcttttaccttatgttctctctagggcacagcaggatcattgagcggaatggtgggcacaacctgctacgccatttcaattgttgtcttgtctttccctcaactctctcctctctctaactttctgtctctgtctccctgcctctctcctctgtataccgagtgtatatatttgaatttacataactcacatatgcatatggtatggttccactctgtatccacaggatcaattccaagaagaggaattttggcatatatatgcatgcatgtatcgtcaaatcatgtacgtgtgtgttgtatagatacatctttttaattatgaaaaatttcaaatatatacaaaagcagatagaactatatgagtcccctatacccatcatccagcctcaacaatgatcaacacccagccactcttgtttcatctgtacccacatctgctttacctctttttgtaatctcatgaagccattcacagacatcataacacttgatctgtaaataattcagtatgtatttctaaaggattaagattcttttaaaaacatatccacaatacaaaaattacatctaaaaatgaacaaaactgtgttaaaatctacaaatatcccgtcaatgttaaagtttccaactctcttacagttgtcataaatggatattcatttgtttgaataaaactccaaatatgggctagatactataattgatatggcctttaagtttcttttaatctacaggttcccctccttctttctttttgccatttattttttgaagaaaatgagtacttttacatgtagcatttcctatactggattttacttattgcatttttgttgttaagtttaacattctctgcagtcttctgtgttttctctgaattaatagttggttttagaggcttaagtttctttgctttttgttttgtttttggtcgactatttcatatacagtttgtgctctacatttagaggcacgcactatctggttgtctctgtttttgtgatgctagcagccactgacaattaaacctagattcattcattcattaagggttgcaaaaatggtgatgttcttattttgttattccttctttatttgttagctggaatatttctgtacatctcctacttggttatccagtggtacagtttatataagaaggcaggataaatgcctaattccaaataatgagctagctcactatccactaatataatcaatgagtgattattttcaaaatataataatgaattcatggatttaaacatattttatgtgttttgattgattgttcttatattgaggctcacattggcccctctttggccatagggaacctctttaaattggcccctgagtcctttttacatgaatcttgtggtttttgaaagcttccttgctaggcatgataagatattctgggatcattatgtaaatttcctgccccagatctgaagacctatatttttagataccaacatggtatagtgaaaagatcacagtctttggagtcagagaaactgggattgaatcctggccctatctcatgctgcctgtatgaccatggtaaaactacttaatatctacccactttaagtttcttcatttttatacaaagcaggaggtactcagaaattcaggttccctctccatttcctgatctcttcttactcagatgacaacatcacatctattattacttaggcttctgtgcttacagcatggaatgttctctttcacatatggtagacactcaattcatacttacaaattgaccttgaggatagatgccatcaaatagatgatgccaacacgtgttgagctctgtgaaagtaggcactgtctcaatgcagctgtttttttttaatttctcctttattttcaaactacccattacgaatattagtaaatagaatccttatcatctctatcccctccccagaattgaggtgggatgatgatgccagctttcagttgtgttaaaggaggaaataaaagaagcatgaataattcaaaaggataatccaaggcaatgagtcaccccaaagtcactcgtttcagtttgaaagacattatttgatatatatagcagatttcccttcttaaattagctttacttacactactattaaaatggcttttcattcctcgaggtcacggaagctagagagggtaataaatccaaaatgtgctgaacaagccacagaagccaactcaggatgaagtgtttacactggatattctgccctgacactcaagtgttgctatgatgctgtcctcaacttaggatcagaattacgaaattgccaggcgacctcaacgttccagccctggcagccaggggagcagcagctgttgcaaagagcacagccttttgacagctaactgaaagatactaagttaaggtggaaagagagatgagaaaaagagtcaccttaattaagcagtatgctgtgatgctaagctgatgccatagattttgggggagctcactggagaattcttttgccttgtggctactttcctcaaagtatccagtgaactacatgacagtattcactcagaaggcactgactagggaaagctgtttgaccacctcctacagggcctgtttttgaagctgttggttttgtggtggaatggaggcagctggctgaggtgactagaaagccactgagtttcctgaaagctaaattttggggctatttcctctcttgggctggctacccaggatcccttttcccataagctccaagagtagattcctaacacaagggcttactctgtgccagaactttgaggggctctttccatgcattctctcattgaatcctcatatccagaatggcaaggtgcgtgttagatatccatttgttagacaagaaattgaaggttcagagaaactcaatgacatgtccccctgcccaccccagacaggatcacacatccagcagatagaagaattacaatttcaacatgagtatctgaccccaaaatgggtgttctctcaaggatgctgtgctgccttccttcagcttagctcctctctcctcacaggtctcacaggcacttgtctccctcctttgctccggctactctcctcctaggtttcacttcctgattgtccatactttcattttcggggacttcattgccaatcagcgcctaatgggcagggagggaagagcacacataccaaataggggaaggtgaccaagattgtgaaggccttgcaccattttcttcccatttgctctctgttcattctcttcttatcgctggatctgaaagtctcctagctctgaagttaaaattctagatcggtgttctgccaaggacaaatgtatttaaggcctggtcaattaggtcaactattagaagcagacctatcccaggaaacctgttattcctggttaatataactttgattccttgctaactcctttcctgccctcttgtcatttactctggtggccctccaaggaacagtgaagtgaccccgggactcatgggtatagtatggttggggctgctagctggaccctggacagactgcacctgcattgctcttactagcttagccacacacctcaggattcatgatggaacaaaaaatgtgtctccaaacgatatgtctccctgtaaggttgtggtcaaatggagaaggaaagaaaacttgtgtatgaactatttaacctgagaagcaacaagctaatcagacccatggaaacattatgtcaacatcaagaaactgtcaggagtagatattatttaagcacatgctcattatatttagcatttgtattgtctgttttactttgtgggtaagcattacagatatatgagaaaaatgagaggaagttttcatttcctactgaagttttacttcgtctcaaaagattgttttcatcacagggcaccttaaaaatgggtaataaccattattaaatagaataaattttttgaaagaagaaaagagttcaactcagaaacattttctttggaaatatcattaaacattatatttttaaaatattcattctcctcctttcacgctgcttgttcatgcctgctttctgtcgatactaaacagttataataaatcatactctcctaacagaattattattattctgtcattttttctaagtattttagatcacaacactttgcccctgtgtgtgtgcgtgcatgtgcattagcataatgaccaactattttgaaattagatttaattcattgtctttgaaacctgaaagctctgcagctctggatgtttctatagaaaacctcctcccctccttacgagaagggcaaaatgaaatgtcagagagatgactattcatctttccatttatgggcttattgtctttgacattctttatactacttcatcaacctctgcttaggccaacctaacacaaaggacaaagagaccatattgctatctctactgtttctttattttagaagatctcaccattataacctcctctccattactattgtccagctgggaacatgcacatattttctattaactgtactacatgagatacattttaggtgactgtcactgagctaccaaagattgccccgttttctcttttttgatatggtgtctcactgtgttactcaggctggtgtcaaactcctgggctaaagtggtcctcccgcctccgccttctgagtagctgggattacaggcaggtaccaccgagtccagctcagaactcttttttttcactagtaaagatctagagcggggatcagcaaactttggcccacaggtgaaatccactgcctgtttttgtacggttttattggcacacaataaacatccatttgtttacatatttctatgaatgtttttgtgctgtgacagcagaattgaatagatgtcactacttggcttttgtgtttgctttcgtgctacgacagcagagttgagtagtcactacattggatagagagaacgtatgtctcccaaacactaaaatatttactatctggctctttacagaaaatgtttgcccacccctgctgtagagaacagatgtccagcataacgtacccaaaacatctcagaatgggtttgcaggtgttttagaggtgaaggtgaaagaccatcaggaagatatagcaagagcttccccctgggaggcagaaaagggattccagtcccttctctaccactatttgcatcgatctgggcagatcctgtttcctccctagcccaagtttgctcaaaaggtcaactgaaagaattgaatgagataatctacaggggcgcttccaacttggagattctgtgattccaatgtttagtctaatgagatttgttacaatcacagatgtatacctacagttgaaactacaagatcctcaaatttttttttattatactttaagttttagggtacatgtgcacaacgtgcaggtttgttacatatgtatacatgtgccatgttggtgagctgcacccattaactcatcatttaacattaggtatatctcctaatgctatccctcccctgtccccccaccccacaacagtccccagagcgtgatgttccccttcctgtgtccatgtgttctcattgttcaattcccacctatgagtgagaacatgtggtgtttggtttttttgtccttgccatagtttgctgaaaatgatggtttccagcttcatccatgtccctacaaaggacatgaactcatcctttttatggctgcatagtattccatggtgtatatgtgccacattttcttaatccagtctatcattgttggacatttgggttggttccaagtctttgctattgtgaatagtgccgcaataaacatacgtgtgcgtgtgtctttatagcagcatgatttataatccattgggtatatacccagtaatgggatggctgggccaaatggtatttctacttctagatccttgaggaatcgccacactgacttccacaatggttgaactagtttacagtcccaccaacagtgtaaaagtgttgctgtttctccacatcctctccagcacctgttgtttcctgactttttaatgatcgccattctaactggtgtgagatggtatctcattgtggttttggtttgcatttctctgatggccagtgatgatgagcattttttcatgtgtcttttggctgcataaatatcttcttttgagaagtgtctgttcatatcttttgcccacttgttgatggggttatttgtttttttcttgcaaatttgtttgagttcattgtagattctggatattagccctttgtcagatgagtaggttgcaaaaattttctcccattctgtaggttgcctgttcacttttgctgtgcagaagctctttagtttaattagatcccatttgtcaattttggctttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatagttgtagatatgtggcattatttctgagggctctgttctgttcaattggtctatatctctgttttggtaccagtaccatgctgttttggttactgtagccttgtagtatagtttgaagtcaggtagcatgatgcctccagctttgttattttggcttaggattgacttggcaatgtgggctctttttgggttccatatgaactttaaagtagttttttccaattctgtgaaggaagtcattggtagctttatggggatggcattgaatctataaattaccttggacactatggccattttcacgatattgattcttcctacccatgagcatggaatgttcttccttttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagatgatggagttttccaaatatacaatcatgccatctgcaaacagggacaatttgacttcctcttttcctaattgaataccctttatttccttctcctgcctgattgccctggccagaacttccaacactatgttgaataggagtggtgagagagggcaaccctgtctttgtgccagttttcaaagggaatgcttctagtttttgcccattcagtatgatattggctgtgggtttgtcatagatagctcttattattttgagatacgtcccatcaatacctaatttattgagagtttttagcatgaagggttgttgaattttatcgaaggccttttctgcatctattgagataatcatgtggtttttgtctttggttctgtttatatgctggattacatttattgatttgcatatgttgaaccagccttgcatcccagggatgaagcccacttgatcatggtggataagctttttgatgtgctgctggatttggtttgccagtattttattgaggatttttgcattgatgttcattagggatattggtctaaaattctcttttttggttgtgtctctgccaggctttggtatcaggatgatgctggcctcataaaatgagttagggaggattccctctttttctattgattggaatagtttcagaaggaatggtaccagcttctccttgtacctgtggtagaattcggctgtgaatccatctggtcctggactttttttggttggtaagctgttaattattgcctcaatttcagagcctgttattggtctattcagggattcaacttcttcctggtttagtcttgggagggtgtatgtgtcgaggaatttatccatttattctagattttctagtttattcacatagaggtgtttatagtattctctgatggtagtttgtatttctgtgggattggtggtgatatcccctttatcattttttattgtgtctatttgattcttctctcttttcttctttattagtcttgctagcggtctatcaattttgttgatcttttcaaaaaaccagctcctggattcattgatttcttgaagggttttttgtgtctctatttccttcagttctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttgaatgtgtcccagagattctggtatgttgtgcctttgttctctttggtttcaaagaacatctttatttctgccttcatttcgttatgtacctagtcgtcattcaggagcaggttgttcagtttccatgtagttgagcggttttgagtgaatttcttaatcctgagttctagtttgattgcaccgtggtctgagagacagtttgttataatttctgttcttttacatttgctgaggagtgctttacttccaactatgtggtcaattttggaataggtgtggtgtggtgctgaaaagaatgtatattctgttgatttggggtggagagttctgtagatgtctattaggtccgcttgctgcagaactgagttcaattcctgggtatccttgttaactttctgtctcattgatctgtctaatgttgacagtggggtgttaaagtctcccattattattgtgtgggagtctaagtctcgttgtaggtctctaaagacttgttttatgaatttgggtgctcctgtattgggtgcatatatatttaggatagttagctcttctttttgagttgatccctttaccattatgtaatggccttctttgtctcttttgatgtttgttggtttaaagtctgttttatccgagactaggattgcaacccctggcttttttttttcccatttgcttggtagatcttcctccatccctttattttgagcctatgtgtgtctctgcatgtgagatgggtttcctgaatacagcacactgatgggtcttgactctttatccaatttgccagtctgtgtcttttaattggagcatttagcccatttacatttaaggttaatattgttatgtgtgaatttgatcttgtcgttatgatgttagctggttattttgctcattagttgatgcagtttcttcctagcctcaatggtctttacaatttggcatatttttgcagtggctggtacctgttgttcctttccatgtttagtgctatcttcaggagctcttttaggtcaggcctggtggtgacagaatctctcagcatttgcttatctgtaaagtattttatttctccttcacttatgaagcttagtttggctggatatgaaattctgggttgaaaattcttttctttaagaatgttgaatattggcccccactctcttctggcttgtagagtttctgccaagagatcagctgttagtctgatgggcttccctttgtgggtaacccgacctttctctctggctgcccttaacgttttttccttcatttcaactttggtgaatctgacaattgtgtgtctcggagttgctcttctcgaggagtatctttgtggtgttctctttatttcctgaatctgaatgttggcctgccttgctagattagggaagttctcctggataatatcctgcagagtgttttccaacttggttccattctccccgtcactttcagatacaccaatcagacgtagatttcgtcttttcacagtcccatatttcttggaggctttgttcatttctttttattcttttttctctaaacttctcttctcgcttcatttcattcatttgatcttccatcactgataccctttcttccagttgatcaaatcagctactgcggcttgtgcatttgtcacgtagttctcgtgccgtggttttcagctccatcaggtcctttaaggacttctctgcattggttattctagttagctattcgtctaatcttttttcaaggtttttaacttctttgccatgggttcgaacttcctcctttagctcggagtagtttgatcatctgaagccttcttctctcaactcgtcaaagtcattctccgtccagctttgttccattgctggtgatgagctgcgttcctttggaggaggagaggcgctctgattttcagaattttcagtttttctgctctgttttttccccatctttgtggttttatctacctttggtctttgatgacggtgacctacagatggggttttggtgtggatgtcctttctgtttgttagttttccttccaacagtcaggaccctcagctgcaggtctgttggagtttgctggaggtccactccagaccctgtttgcctgggtatcagcagcagaggctgcagaacagcggatattggtgaacagcaaatgttgctgcctgatcgttgctctggaagttttgtctcagaggagtacccggccgtgtggggtgtcagtccacccctactggggggtgcctcccagttaggctactcaggggtcagggacccacttgaggaggcagtctgtccattctcagatctcaagctgcatgctgggagaatcactactcgatgctcaaatttttaaaacctttttattttgagataattttaggttttcgaaaaagttgcaaaaacactgcagagaactaactgcagcacacccataagccagcttacccgatgtcaacctctgcataaccatggtacagttctcaaaattaagaaattaaccttggtacaatactattaactaaactatagactttatttagattttaccagtttttccactgatgtcttttttccattttagatccaatccagcatatccctttgcatttagtcatcatatctccttaagtatcctccagtctatgatacttgatcaaaacagcacccatcagttattttgtagaatgtgcctcaaatttgatttggtctgatttttttctcgtgattagattgaagttatacattattgggaaggccaccacagaggtgatgtgcctttctcactctgttgtatcaggggatacatgatattcatatgtattactgggtatgttaaccttaatcacctggctaaagtgatttctaccaggattccctaccagcaacttataattccctcttccccaccttgttaattactaaatattttaggaaaaatactttgagaatacgcaaacatcctattctgcttaagcttttgctcactcattatcacatccattgatagattcctcctgtggcatttatcactgtggtgttctaatggtgatattgcttccttcatccctcctacatctatttaattggaatttttctctctcattcacttattcattcgattatttatatcagaatgaattcataaattttattttatgctttaacgtataatctaatactctcaatatttattgctcgttgctcaaattgctgcaattttgaccattgggaactttctcaggttggctcctgtgtcctttcaatatgcccctgttattttttttttaaggctgcctaacttttatttaaaagggggtgtgtttctgggttgctacaatattgaaagtttggttttcaaccaagggcaattttgcctgatctctcagggtaaatttagcaataagtggagatatttttggttgtcataactgccaagcatcctacagtgcatagtacagcctcccacagcaaagaattttcctgtccaaaatgtcagtagtgctgaggttgagaagctctggtctagagcattattttcttgatgctcagatgtatggtagcaaaaccaaatattgtgaggaataaaaatgctttttaaaagtatatttttaaagtattaaacattttgtgcttggaagaatatttaaaaagtaatataataggagactttctcttccatccatgatagaatatcagggactaattaccttccatcttaaacaactagaaaaccagagagaaaatatgaaataatggcttttagacattggacaacaggcagtacaaaagtacaagatggtgattcctgacagagagaatacaagtaaggtgagccctatgattttcgtagcttattgcctggagtaattttctaggctgcagcagagaaagagaggaccaaaaccaatcctagagctcttgatcagtaaggcagacaaagattagagtccagggagaccacgaaggctggaaattgcagggagcaagatttgtatagagaaagctccagagatgtgcagagggtcccctctagtctttggctgaattctgacctgcagctcatgtatgaggaaaaaaaaatctacccttgggcagtgatagaccatgagaaaacaatagactgaaaaattaacagggctcacacaggtctgggaatagacctgtaatacctggagtaggaactacaatgttccaaaggatattgtcttagtagtagggcttagttatttgtagactaaaggctgctatggacctgccttgaacaaagcttaaaagtaagccttgaaagaatcagataccatataagttgactgcatcccagaacaaaacccaccaatatttaaaggaatgcaacaaaatccaccacccaactgtgtaaaatccactttgtacagcacccaagaaaacattattggccatgcaaaaaaaaaaacctgtggaatatgattcttaaccaggatagatgacaatcaataaaaatagactttgaaatgacagagatgatggcattagcagacaagaaagttaaaacagcttttataaatatgctctatatgattatgaaggtggagaaaacatggatatggctaagagaaaaatggaagatataaaaaagccaaaatcaaactagtagagatgacagatacaatatatgaaatgaaaaatgtactggatgagattaacagtgtagaaactgcagcagattagtcaacttgaagtcatagcaataaaaattactcaaaatgatgaacagacagaaaagactgaaaaaaaagaacataacatgagtgacgtggggcaacataaagggatctagcatgcataattggagcagcaggagggggagagggcagaaaaatatttgaaaagtaaggctgggaaatgtttaaattttatgaaaactaaatattcttttatccaataatctcaccaaactccaacaaaataaatgtaaagaaaactacattatgacacatcatgatcaaattattgaaaaataattgtggataaagaaaaatgttaaaagcaaccagaggaaaagagacatggtgcaatgagtaataaagataagaattacatcagacttcttgccagaaaccatgcaagctagaagacaatgtagtgacatcataaatgtactgaaggaaaaaactgtcatcagaaatctaaacccaatgaaatcattttcaaaaatgaagaggaaataaatacttttccgacaaaaactgagagaatcatcatgaacagataatgcactacaatactaaaggaagttcttcagacaaaatgaaaagggtaataaatgaaaatttggatcaaacaaaagtttgagtcctgagactggtaaacatgtgagtatatttaaagatattttaaaattatttgtatattcccattaaatgaaaattgtctaaatgaaaaataataacactgtattgtgatgtaatatgtttctacattttataaatgtagaaataaaatgtatgacaacaataacataaaggacagaaggggaaatggaagtataatgttgtaaattcctatacatgaagtggtataatattgcttgaaggtagattgtgctaaggtaaacattttaatgcttgaaggtagattgtgctaaggtaaacattttaatgcttgaaggtagattgtgctaaggtaaacattttaatgtaaattgtggagcaagaaataaaaataaaaaagagagcctatgaagccaatactggatataaaagggaataataaaaacaattaaaacagaagtcctggaaagagagagcaaggaagaagaccagattgggtaaatagaaattagatagcaaggttgtagacttaggtccaataaaatgaataatttaattaaatgtaaaaacctgaacaattaaattaaagatctgaatccaattaaaagataaagattgtcagtttggtgaaaaggcaagacccaactatatgttgtctataataaacccattttagatataaatatacacatagcttaaaatggatgggaaaagatatagcaagcaaatactaatgaaaacaaagctggagtggctatattaatatcaggcaaagtagattttggtacaatgaatattactagggataaagagaaatagttcataatgataaaacaatcggttcatcaaaaggacataatagccctaaatgtgtctggacctaatagcagagcttcaaagatgtaaagcaaaaactgatagaactgtaaggaaaaatagtcaagtctaaaattatagttagggatttcgacattcctctctcatttattgatggaacaaatagaaagtaaatcagttcggataaagaataattaaattacagtatcaaccaaattgatctaattgacttttatcggacattatacccaatgagagcagaatatacattattttcaggtgcacacagaacattctctaagaaagaccatattctggactgtaaaaaagcctccataaatttaacagagttttaaataatgcaaaggatgttctctaatcaccaagcaaccaaacaagccatcaataacaaatagttaacactaaaagaaaaaagctaagtttactgtatgataatttaaataataaagttaaaaaatataacagggctgtaaaaaaaatagatatctgaaaaattctcagtacatgtttttaacagcttttaaaaaatataattcacaagccatacaattcactcatttaaaatgtacaatttgatggtttttagcacagtgtattcacagatatgtgcaaccatcacccctgtatcctttagttatcacgctttcatctctccaccccactcagagcaatcactaattcattttctgtttgtagatttccttattgtggacttccataagaatgaaaccatatggtatgtagtcttttgtgactggattcttttacttagtgtagtgttttcaaggctatttcatgttgcagcatatatctatacttcattttttgtgtctgaataacattccataatatagatacaccacattttgcttatccactcatctattgatggtaatttgggttgtttccactttttgactatgataaataatgctggtataaaaatttgtatacaggtttctgtgtgggcatatgttctcatttttcttgggaattaactggaccattttataactgtgtttatttttttaggaactgtcagaaggtgttccaaagtggttgcaccatcttccattcccactaacagtgtataggggttctgatttctctgcatattccccaacacgtgctgttatctgacttttttattctagccattttagtggatgtgaagtgatatctcattgtggttttgacttctatttctctgatgactagtgatgttgaacatcttttcatatacttattggccatttggatatcttatctggagaaatacttgtttagaccctgtgcccctttataatagggttatttatatttttattcttgagttgtaagagtgctttatatgttctagatacaagtcccttatcagatatatgatttgcaaatatctcgtcccattatgtgggctgtctttccactttcttgatggtgtcaatatataaatatccaaccacacattcctaaaaaacccatgggtcaaaaaacaaatttcaagagaagttagaaaatgttttaaattaaatgaaaataaaaacacagtatgacaaaatttgtggagtgcagctaaaacaagacttatgaagaaaatttttgaattcagtgctaatttagaaaagaagaaacatctgaaaggaactatctaaacttccactttaagcaactctaataggcattgtcagattggtctccaaaacagttatgctagtttatgcttccagcagcactgcttgttcacattataagcaacacacctgatactgttagactttaatattttgccaaatagatgggtgtgaaatatatcttcttgctttagtttttatttccctgattactagggagttgtttcatcttttctctcatgaaaagaatggttttttgagggatctcttaagcctcctgaaagtcgtctcatctccatggatctaacttaacaaaggtcatatataataatacttatgatgaagtaccttgaacttcatgcctatgtgtagaatttagactgttatgttccataattttcaattgtgcatttaagatcgacccagtggtgtttgtctactgtgttcttttgtatttttattgtcatatcaacttgtttgctccaggtcctaggcatgccaggacttgtcacaaaaacccacgctacagaagaataataagagcctaaagagttccatttctttgtatagattgaaagggaacatttataagggtcttgataaccatagaatgacaactatgttgtaagtttctcttttagtttgctttttccattttcatattgttctggagctgttgtttagatacatacagtagatcatggaagaccatgactacatgatgcctgtatgtgaatattcctaagtatttagatacatgaccaaattgttctgtgttcatttagatgtgtcagtgcggactttagccaagatttcatagtctactattccatttgtctctgttatggaacagaaacttttcagctctgtactgcttccctccatacctggacacctaggatggttctttgcaattaatcaattttatttcttagggtagttttaggtttacagaaaaatagagcagaaagaacagagggctctcatatactccctctgtttcccctattattaacatcttgcactggtgtagtatatttattacaattggtgacccattattggtacattatcactaactcaaatctatagtttgagattcaccttttgaattttgtcaaatacgtaatgtcacgtattcaccattacagaatcatacagaattgctttactgccctaagtatcccctctgctgcattcctccaaaacttcctcctcccctcaaactcctgccaaccactgattttttttcttacagagatagtttgacttcctctctttctgtttgaatgcctttttaaagaatcttactttaagttctggatacatgtgcagaacatgcaggtttgttacataggtatacacgtgccatggtggtttgctgcacccatcaacccgtcatctaggttttaagccctgcatgcattaggtatttgtcctaatgctctccctccctttggaccccacccctacaacaggccctggtgtgtgatgttccccttcctgtgtccatgtgttctcattgttcagctcccacttataaataagaacatgcagtgtttggttttctgttcctatgttagtttgctgaggatgacggtttccagcttcatccatgtccctgcaaaggagatgaactcatccttttttatggctgcatagtattccatggtgtatatgtgccacattttctttatccaggctatcattgatggacatttgggttggttccaagtctttgctattgtaaatagtgctgcagtaaacatacatgtgcatgtatctttatagcagaatgatttataatcctttgggaatatacccagtaatgggattgctggatcaaatggtatttctggttctagatccttgaggaatcaccacactgtctttcacaatggttgaactaatttacactcccaccaacagtgtaaaagcatacctatttctccacagcctctctagcatctgttgtttcctgactttataatgatcaccattctaagtggcgtgagatggtatctcattgaaccactgatattttttcatctccataatttgtcatttccataatgtcttataaatggaacaatacaatatgtagtctttttaggctggcttctttcacttagtgatatgcatttaaggtccctccatgttttttcatggcttgatggctcacttattttttatcattaaatagtattctattatatggatgtaccacttaggcctgttcttaacctgttgcgctttgatggatcatttaactgtgatgacagacaactcccaattctaaatcacaaaacccttcatgttcaaccatagtcaagtgcctatttgaacaaccacttcatttagactcatttactggctaatgtaaacaattgatcatttgggtaagaaaagaaattagccaaattaatggtcactaattcaaacatccaattccatcaaaatggtcaaactggttgaatgtatcggcctagtctgagagacagacagcatggtctagtggaaagagccctggcccaggagtcaagagctctacattatactcacagctcttccactgacctgtcctagctaccctcctctgtggaccctggtctttgaaggctttgcctgctctgctgagcacaaattccataagaactgtaagtcctcccttactggtcagctctcctatctgtaacattgggatgccatttatatgccagagcatatatgctgggatggtaggaccatgcattcatagacacaggacttagcttcttgccaggggatggaactcatgctgcatgtccctgagggctttgcagaacttcttcagagatgagctcgtgatacacactcatcctaagtcctgttggagataggcaaagagtgactctctgaaagcaggattttccttgacactgaaaaggggctttttctcttgtagtattattaagccaaaattgatccaaagccattggggattaatgctgctagatggagctgttctttttagatgaactctcctccccttcttcttgacaacgtaagtcccaatgagctactgcacttcctaagtttaaattcctctttgctatcgggaaccaacttccacgagtgcttctaaagttttagatttaaatattggctgcttttcacaacgaagtctccccacctttcattccgtttgtcttttgtgaggcagagggtctttctgcagtgttaaaacagaagcttgacattcgttccttcttttgcaaattaatatattttttcctgagagactcttcactacacgcagggccctgactctgggctaggcttggcagtaggttttgtggagagaagtagaagttcctctgactttggagagcacacagtctgagaaggagactgacaaatgtatacagcagacagagccagacagtttgggattttggctaggaggctcatcatatccccagctgcccagctaaaaacttcccattctccctcagctgccactcaccattggacctccgaggttcagaccactcatctcacatgggtgccagcaaaagctccaccccttgtttcccttgctccaggctgtctcctccactgcccatgatttaaaggctgttcttcccaccgcaaagtcatgcctcctgctcacaaggcctggatctgtactgactttggaatgaaatcccaacccctaggcctagtgttcacactctggcattctacctcctggttacctctccagatgactgggccaccaccttccacagctcctgatgcttcagctataccagacctccttctgttccctgaacatctcatttacctgtacattgctttactttgtttatatctggagttctcccttcctctactgtcttttccttttcattcttcaagctgcagttccaacatcaccactttgtgacaccttctctaattcctggagagttagtttcctttcaggtaatggcagagtgatgccagaccctggttctgagggcctttgccccatgctgtttggtgaagagaactggaactaagcatttcccagagtgacctaaagtctccaggaacacgtgctacctaggatctctgctggctccttgttcacaactatccctgcaggcagatgcagctgctcacatgctctggcaggagcacagccatcttctgtaaggaaggatgtcctctttgactggcagaaagcccagggagggaggggccagtaagcaggcctcctcagacctatccagagaggaatggggcagagatggcctcccagcctaatattctctccacatccaccctgggaaaggccgccacatacagcagctcttgactgattatccactgagctggtgctgggctacactccgcaaggcatttatggcccaatggggaacatagatctctgtatattggtgtattcatttgctcaggctgccataacaaagtagcacagtctgggcggcctgaacaacagaaatggattttctcccagttccagaggctagaagtctgagatcaaggtttcaccaaggttggttccttcagagtgctgtgagggaaggatgtgtttcagacctctctccttggcttctgatggttgtcttctccctgtgtctcttcacatcatcttccctctgtgtgtgtctctgtgtcttcatttcacccttttataagaacaccagtcatactggattaaggcccaccctagtggccctattttaacttaattgcctctttgcagaccctctgtccgaatacaggacttcaacatacaaacatagggggaccacagttcatcccataacaatgggtaatgaaagtttaggataataagggccataatgggggagggtctgcacagaatattgttgggacacagaacaggctgccctattctggcctagactctctcgaccacatcacacattgccagttaggactaccaagtcctgcctttaattgagcagagtacttgtaagaggcacagataggtttaagcccacagccatatggttccatgtaattatttgtcagttcagccatggagtgttctagttgagaagcccatgctccttgctttctctgatctggcccaggtcccctttgggaggagaagagatctccatgagcctcttctgacttctctctttccctgcctagcctggaaaaattgaaggaacataagctgagggtacagagagatatgaattcaaattttagttagcctacttactatttttatttatattatgaacagacaaatcatatccctgcatgagcctcaattccctcttccataaaatgggatgataattattttcaggcatgattatgaaaataaaatgaggatatttggtgaaagacaatgggtccagcctagcctggagtgtcttgatctctgtcctggcatagcctggtatggagtctgacatgggaccacacccaagccaatgagggtcaactgcatgaagcataagtgactgaatagatggatgagggagagcagtgctctcctgctgcaagtccttctgccagttgtgcccatgaattcaggttaagggtctgtgtgtcctttttacaccacggctaaagggaaaaatgatttcctccctttatggaggggatgggagaagaaaataggggattgggaaagatgggtaaaaggcccaggaaatatcattgatctgcttctcatgtacccatgtggaatgtcacaagcagggtcaggctgcggagctgagtgttaggccagggctgggggatgtgggagcagagggatgggactgggagcctaagttcagattgctgagggcaaggaagtgagggcaagcagcaagcacgggtttgtgggaagaaagggctgtgttcccccactctctccaccttatagcctagcatggagtagctagatggccaatgccaagaggctgaaggttgtgccaacagctacacttccctctgacttgctttctgaaagtcaagaagggtcttttaggcctgtgttatgctgtaatcaggtactctcatttcatggtcacaagcactacacctgataaataagtactccaggaagcagtagagcttggatttgaacccatgtatctctgatcctagagcctgcctcctatccactagggtatactgtctataatgaagaaagaatgggataggaagggagaatacctgggtttgaggcctaactctgtcatattctggctgtgtgaccataggaagttatttatgtgctctgagcctccacttcatcatcagttaaatggggataatactccccctcacacacactacatgtacatacacaggtcactgggaaagttaatcaagggagcatgagggaaatgctctgtaaagtatgccccaagttagcctatggcctggtgtcctatgtggcacacaggctaaccttcaggtgccacttcacttccttcgtgaaagtcccaccctagtttgaagtcactctgcaatgcaaattctgagaacccctggcctctcagagtcgcagctaggttctcctttcaaaactcccttttgggttatcagcaggtactgcccccttctctccccttcctccccccatgctctctcatgctctctctctctctctctctctcacacacacacacacacacacacacacacacacacacaccaaacaagatgataggcccagtcaatcagccacttgctcaaaaatcacattgcaagcatcatccattttctccattctctgggagattgctgcctggagttacatgtgggcccatcagacccacagaaagacctagttaagccaggccctggagtgaagtgctgagttgatgaaggttgaacagagcatctgggaaggaagggccagtccaatggacaagggcttggcaatagatggcccttctcttgtttctattgtaaataggtccaagatctgctcatggctcctctttgctggggacattgtcttcagtgccatctgtatcttcctcctaagtcatgggaaggggctttcctcaggtcaagccacaagtgataaggaaagtagcttgtccacctctagctctgtggcccaagtggtgggagatggcctggagtagggagaagcaacatggcctgcagagtctggcagcctgagccctggccccagctttgccctgccttgctcttggttttccataagtccctgcccctctgtgggccttggttcctctagcttcagattaagggagttggccttatcccatctctgacctcccttcctgcttgaatcctccttgtatccaggcctatacttcaagctctataatcagggagtggaaaggctttctggtcaaggtaggaattgttctgccagcctgactgagagtttcgtgtcggccctggtgcctgctgctgagctctaaccatttcataaccccagatcagagacactcattcattgtcctttgagacaaattccaggtgggaaaaatatcatgctttaaagcagccaagcagcaactaggctcaaatccatttatttacaaagattttccacctcttggcccatctgcctctgagtaacctgaagcacaacaaagatgatatgtgtcccagccctggattttgggctaagcgtgccttaaaaatctgcatcatacctagattccctcccaactatagctcaatcctgaacaacctcagctgtccacagatatttggcccaaggaaagccaaaatctcaacagttaactgtctcaccctaatccttctctatacatgtgaaatcccagtttagaaaggaaaaaatatttatcacattcttgcatggccattctacaccagattgagtgggtgacaggcaggaaaactggaaaggaaatgcctgcaatatttagttaatgtggtcatcatattttatttggctgcatctccccaaatgcaaatagaaatgtcccactttatttgcatgcaagtcttttcttccacagagggagagatgggagagccgcctcgagtcccgcagtgatcttggagcagagtgaggcatttgcttggacttagagcagttgtactgggttccaggtggctggagatgtggtttctaggacaaggccacatgtaaatactttatctcgatcaagagcagcttggaaaataccacaattccgtttttcagaaaatcattttgctggtacctttaacagaatggaaagagcagcaggcttggaatagaattactgcagtcaaatctgagttctagcacttgaccttaggtgaatggcttagcttcttggagcctcagtttcctccttggtaaaatggggttaaaagccctgctctactgacctcactgggatgttacgaagtgcccatgggaaaatgaatgtgaaagcttttgtcaactgttttaggaacatattttattgttgttgttattgttattaagtgaggaggctagagaatgcctatagagcaaaaccaggcaacagttctgtttttaggtggcttggactcagaacaacccatcttatagatgtgatttggagcatatagaatcattctttttttggtggggggagaggtaatcttttttattgtactttaagttctggaatacacgtgcagaaagtgcaggtttgttacataggtatacatgtgccatggtagtttgctgcacccatcaacctgtcatctacattaggtatttcttctaatgctatcccccccagcccccacctcagctagtttcccaacaaaaaaagagtcacccaatccaaaggatcaaggtgttaatatgaaaactggcatattttcaatgggcaagatttaaatatacaggaaattcatttttagtttttttaatcaaacttttattaattttgagatcattgtagattcacatgcagttgtaagaaacaatacaaagagatccagtgtatactttacccattttcccccagtggtaactatgaatcatatcttaagggcttatgtttttcctttgttaggctgctgggaatgcagcctgctaccagaccatggtagaaaccattagctctacagaaacttcactttgagacttcccttaccctttctctggcatttggctccctagaaggcatctatctctcacatccccctggtcctgataaaacctggcatccaagatgctgcccaaattgaaaacgttttggtagtgcaggtagcacagttgccactgccaaaatctgggcaccttcccattctcaaatttcattctctcacccaactgccctgttttccatcacttcctggggagctggacctcctacacttgacattaaaggcctttcctaactcatctcttcagtgcagagcagtggaaaagatggttggctgtagatataagcaaatctggttttgaatgccagctctatctcatactcatatatgaccttggacaattacttcacctttctttctgagcttctgtttactcatccatcaaaggaagataataatgcctcacagagctgttgcaaggattgaagagataacaataaatgcagagcatctggcccagtgcttaaccatcgtggctgcctagttgtcagtggctgtgagcactgcagtgcaagtctatcatgcacagtctggccccatccagatttggtctttgctattataccgtgactctctctgagcctttgctttgacttcatgcctttatttatgctcgtccctatacctgagacatcttttcctttatcatgtttgcgtatctaaaatcagatctataattcaaggcccagctcagaggaagcccttctggcccccagcctgctgtgatcacttcaccctcccttgtggtgcccatcaccctctcctttgtctcagcatggccacagctactctggttgctcaagagactgagctccttgaggataggctcagggtccgcttcacctcagagtacagggcttgatatagagcagcagctatggcaggatccatgggtgtggggtcacacttgaagctctgtagaagatagactttccagcatttgactagatcatactggccctgcttccctgagtgccagggcacccctgccccataaaggccaggtggcacctgggcccctgctagcagagtatctaagtttggatcgtaagaagctacctcatgttcatctacctagaaacagacccacaggtggttccatttggggaagccaatagctatgaggagaaccttctcccgatatttcaacaccttgaatcagcaagggctccatctttctgtgttgctttgaagtttagactcaaactgagacagcccaagaatagggagataagctatgtggcaatccaggactttggggtcagggagtcctgggaggaatcctgtctccccctccttactagctgtgtgatcttgggtgagtcacttcacccttctgtcaagtgtttctgaggagtaaatgggaagggtcaggcacagggtgggttacattgggaacactcaataaaggttcattattgggctagtgctatctgtcctatcaccatagagggcactgcagtgaaggtgagcatttcttgggccccatttaggggaatttatattctgaaatacaaaagcatttcatcacaatgcaaccttgcccatgagcctatcctgaaatatgaaccctgagaagagtagttcagagatgcccttggaaatagtggctattactgaggacgtgttgacatgaggtgagtttgcaactatcccatttagtactctggtgaaggctgtgcactgggatctcatcagtgtgtaaggaaagtgtgtttcttccaggaagagctgcttttgaccagtgtgattgagtagcgattggaggtgttgaggaggatttggtgacaagtgctccattaaatctgacttaggaacagtctccacagagcttccatttaatacttaatgctttgttctctgtagctttgggggatcagttttcactcccttggcagtaacatggatgagctcaattgtgggccgcactgcgtctttggcccctttatggggctacagagacaggtcctttcaaaagctgctgagaaggcctggacgttgccaaaagtggtgaggacaacgtgggtgtggcttgttcaggggctcatctggtgggtcagcatggcaataggtgctcgggacactggaagtctggtgcttggtgatacattgccagatgccaagtcattcacatcaaaaggctgtcagcagctggggagagaggggtttgtctgtctgatggaggccacactaaagcagagcagggaaacaggacctgatccaaacacattggggcttaaggcagggacccaggtccagcaagaagctggaatgctcagcacagaaaacaaggcacagcccacctatatggacttggccaacatggtggcagcagtaaagactatttctctataggcacagggtcacagggctcccccagctgcaccagctgctggctctagggcagcaagatagaggctactgggtgggccctgtcaggtatatcgtaaggccaagactgagactgtgggtagaggccttaagcctggcagtgagaggtgggcgctggcagggactgaggcagattggctgacccattcctgtcttagtcctttgtttattttcacttggacaccatattgaaggttacttggctactttattcctcattcactcaaccaatatttatttactgggcacctgctgctccagtcaggccctctgctctattctgagaagactagtgacactgataccatggttctctccttacaggcctcactcctactggggttggccaacaagcaaacagacaattagaatgcagtgtggtaagggcaatggtagagtatgcactgggcaacactggagcccagcggaggatgcccgacctacagaggcatcttcctggaggcaagagaaagctcgccactgggcgcacttctggccacaatgcagtagtgacatctgtctctgcctccttcaacaaggactgtcttctcaaatacataatttatttggttgggggtggcaggtggcactgcatgtcagagcaaagtgaaggaaattctaggctccttaccagggctggtctgagttaactcccacagcggggaccaggaagtaagcccaaacactcagacaagtaactgataatttaaaaactgtctgtcattaaggattagctctgacacaggccagaaactagcaggctggataagagccttggagggaaaagcagaaatagccaccttcacttggggcctgggaattttctccaagttggcagcaaatcctcttgggaaaattaaactcacagggaggcctaggcatcttttctctctgaggtgagggggatttttccttcagtgaaggatatgccaaggccctaagtcctcctgggagataagatttcttttctaaacatcaagggattgaggattttattccatagtgggatggagaatggcaagcatggcttgcttgggactgaggaccacagggcccaggaatttcagcccagaaaaggacagtgatgccctggagctcagaacctgtggagaaacagcatcactagggaagctcagcaccaaaggaaaggcattgccatctcctgccatagaggatggttacagcacaggaaaaaaaaatcaccaatggcaataatggaaaccactagtgggaatggttgtttttgcttttaaaaatggttccacaagcattaggaagaagattatactgcaccagaattcatggttgggaaaagaggaggcagctctcagtggctttctggcctctttccatcctgaaatgtcctatttttctgcatagagtaaggaactgtgcttgtccccctcccttttgcttccccccgtttcgctttgttccagtttcataaagccatcgtgaggagctgcgaccttgggtcggccctaggaatcgtgcacacctctgcagctgtctgctctctaggctcttctgctggttgatttggctggcaggactctgagtgttaaccccttcctaggccagtgctgttatttgtaggacagctcaaaggtgctcccactgaagaacttccagttgctaaccacaggaaagactgagattgacaaaatccctctgagcccaaccctgtctctcctgttatcactatgcaagttttacagatgaatataaggaagcccaggaccatgaagatgagggtaccccctaaaggccagtgggaccagtctgcactggcatctcttagtattttcacatatggttgttgattgcagagcaacatgctggcctcagcctacagtgtagagcagactaagaccccttattttccccaagctcatactaacttttccaaaggatatttcttagaaaataaggacaaagtagacaatcagaaaattatgttgaacatgtaagatttgcctctaaagtaatgggatgcatctgtgttcgtcctggagtggtggaaagagtgataaattaggaagcaaaaaaagtcttgagttcagccctcccgtttgctttggcctaggtatgtgaccttgaggaagctggttaccctcattggtcctcagttaccccattaataaaggggcaataaagcatctagccacaggtttgttgagaatgaaataagggatatggcattgctgggaaatagtggccggctcaccgttgttaaatattccaacctgagttttaagtgaatgtttgagagtgttccttcagagctggccagccattcctggaacagctttttatcatttgagggtggcttttattctcaatagcccaaaagctttctgagagaatgtggagaaggtggatggttaaaccagggaagtgtggatttggctccaatgggtggtggtatacataaattgtctctaagggccacttccacagccccatcgggtttgagcaacagcagctttaggaaagtgtgtaaagcctctcaaggggactactttcaagggagatatttccttggtggtatagattttgtttctttttgaaatatatatatatatatatatatatatatatatatatattatatactttaagttctagggtacatgtgcacaacgtgcaggtttgttacatatgtatacatgtgccatgttggtgtgttgcacccattaactcgtcatttacattaggtatatctcctaatgctatccctccccgctacccccacccaacaacaagtcccggtgtgtgatgttccccttcctgtgtcctagtattctcattgttcagttcccacctatgagtgagaacatgcggtgtttggttttttgtccttgcgatagtttgctgagaatgatggtttccagcttcattcatgtagggacatgaactcatccttttttatggctgcatagtattccatggtgtatatgtgccacattttcttatagattttgtttcttttgcttaaaaagtctcagtattgtgacagttcccctgtaaatgagcatctatataaatgcctagtaactgcctctagggttgcttctagttctgttctagtcatgcttagttccagttatgattctacttctgggaataggagtgtgatgatatgagcttgctcaatagcaatttgagcaaggtagtgggcagaatagcaaacaacaacaacaacaaaatgctttactcttcccctgtgggtaagtactgttatcatccctattttgcagatgaggggactgaagcacagaaatgtgaagtgattttcccagtgtcacacagcagctaagaagtgtcagagcctggatgcaaattcagggaacctagttccagagttcgttctgtgctctattggaaggggtcttaggagccaagtgttccagaatgctcttgttcaataaaatggatgagagcactgattgcccagaccagaatctctctctgcctgagtgctgccagttgaatctggaaaacacaacagctctgagggagatgtagtgcattgagtgggatccctccccaaaagatatgttcacccagaaactgtgaatgtgaccttatttggaaaaggggtctttgcagatgtaattaagtatttccagatgatatcgtcctggatgtagggtgggccctaaatccaatggcatgtatccttgtggaacacagaagagaaaaagacacgcagaggagaaggcaatgtaaaaatgaaggtagaaactgaagcactgtggctaggaacaccaaagattgctgacagtcaccagaagctaggagaaagccatggaacagattctattccagagccttcagagaataaatttctgctgtcataagccagcctgtttgtgacaatttgtatgacatccctggaaaactcatgcagagaatgaacccccataaggagtcttgatgtactattgcttttcagaagcaactgaggggtcggggtcagggtcagtatgggagtgaatatcaatgccaccaactctttggaagtggcagagagagggatagaggggaaaattggctccttccaggcccacagccctattcaatcagaggcttccagctcagtgctcggaggccatcataagtggcagaaacatctgtgtgctgagttgctcaagaggggccttggttcccagcggtatccaggaaaccccaagagtggccagtcataatggccctcaagagggctcctgcatttcgattaatttacctctcagctcacttgagctgtatttcatccattctgatgtattttgttttgtacctgataaaatgaagataaaatgggatggagagagactgaagatgggagagaagtatatttgtttgtttgctgagcattttaacattgttggcattagcattgctcttgccttgagacatatttagaacaagggtctttgattgatgctctcaagacatcagggcaacagaaagtacattggtcctctactaattttagccctctttcctaggcgctatgattctgactcaaaggctgagctaatgctagctgctgtgtggttggagatggcaaaaggatggccagaagtccaggaatttgaagcccagacatctgggacttggctctgactcctcacccttgaaatgcccatagaacttttggggtctaaaactcttgttcacacttgagaaaacaggccctgagggatgcagggacctgcccccaggctgtgcactttgctcactgccaacctgggactggatcacaggactctttccgacccatgttgccagtcagccttacatccctttcctggtcatcatgagaagccagaggatgggcaagcctactaagttctttttccagctacaagtcttctgtccttccttggaacctcctgcctagcgctttgctgttcctgggaaactgtgaccatattccacttggttatttaggctcctgtcttgtctcctctgctagaccacaaggctcaaggtcagggcctaagcctgatgtacctctatattctcccttcttctttcagggcccagccagggactggcatggagtaaaagttcagcacatgcttattgaataaatgaatgaatgaaagataacagatatataacagtaagaaatcttttgtgctcaattacatattaagagtgaattagaatggactcatttttatactaaattacactagaattacattagaatttcagattttaacagagaagaaattacaaatttatgcattttcatttgtctgtgatggctaaacccccagaattaaaggcaagacggtaacctaatgttgtcattctgttttccccctgttctcttgctgctggacatattggtgagactatcagtgttttgaaataacattttgaaatacatgtcatttgaaatacatgtcaaattttatgtgagtccataaagttatgtcccagctttttttctttcctttctgctctcacattgtgtggttaatgcaccctttgactgtattggaggagcaaagttcattaaatgacatgagcccccctacctagctagtttcatggatacatgtgcttggccagttctgctgagtgcacctggaacagatcccaggggcgatgccaccctgggtgtggcaggctagatgtgggacagccttcagtgtggccttggggcaggagaaggcagtgaccatggggggggaatacatcatgaaagggtttatgtcaggtagggtgagcagaggagaggcccccatccagaaaaccccactagggcagggtcaatgggggctatgccctggaactcatgtctagccttcctgcatccccacagtttttggtaaagcagtttaacaaccatgcctggcactggagaatcagtagttaggaagcagtacagcagagacagttaagaggggaggcccgggagccaggtggcagggctcccagtctccattgccacatttcctatccaagagatcttgggcaagttactcagtgtctctgagctcagtccctgttctgtaagctggagactaaatagtgtcctgccatataggcatttaatctctgtgcacacctggcacagaccctggcccatgagaggcaccctgtatgtatatcttgtgacacaggtggtggtgaatggcaggggtgctcagcatggtgggaatagcaacagcttcttatgaagtactttgtcggtggcaggcagtatgattgccctcctctaacccttgaggaaactgaggctcgggaaaattagatgacttgctaggggtcacatggccacatcctagggctgttggaaggatccagtaaagtaacaatggccataaaaaccaggcccccaacacttccttccttgttccttcctcttccaagccatccagaagagcagaactgcagacaggctgcacctccagcctgctacttagctgatcttgaatcttaccagggcttgaggaaagattttcctaagaagggacactctgcaggctgttggtgaactatgtggatcatcagtcagcaagatgtcattcctgggactataaattgtatttgtttgcagaagggaaaaattatacttagcaaatctttaatgtcacattgactgaaaccagccaagtatctggcttaacacattcttcccctcccactggccttcctggggaagggggtttggaagcatttactaggccacagaaaatctgaacagagtctggagaagagacaggggagtcatgaaggcctttggtgaggggatgggggttttgtggctgccaagtattgttaggttatgagtgtaccttccagaaccaagctgggatttgtctggtatttaaggtggggttcctttgaagagataaatcagggcaggttgaaagttgggggaggaaagcctagcaggagggaggccacattgtcagtccagtgagagagacttagcctcctcctatacaagcaaaggggacaggagggctactcccaggccccttcctctctgataagtcatgattttgtgcactagttagcaagccagggaagattagtctgtgcagtacccaccatcctcctcctgactctgacagcccctattgcctctctgctggtatgtcctctagcctccctgtctctgtttcctcatcttcaaagtagtctaagttaagtttgttaaaatcagcttctttttggaaactccctagaggtggaagaaaacaaggaggaactctgctgagctatgaagttaacttaggaggcaggaggtggtactggttgataacctaaacatgttgaaatgaaggggaggttgggccagggcaggcaactggcttgtcccgccaaggcatcaaccttgaagtttccttgtcctcctaccttgccacatcaaggcccctctgcccttggtgattgcctgcacacccagaatgcagcatgcagagaccactccatttgtcatgggaccatagccaatttaggcaaatctgttaacctttccttgtaattcccaggagcactgaggaattgttcggggatgatatccttggatgcacttcagacttcatggattttatgttctctctgatatttcttgtatcagggagctgagaggaattggtctctgaactgatattaatttctttgtttatttcaagtccagacaaagaagagcactgattggccctgtcctcacaaagctgcagaaggtatttggcacaacctcaaatctgggaggggcctaccagttccaaaatcctatgtccagttcaggaatcccctttcaagaattaattttgtgtttaaatatctctaggaacatgctgctcacttcttcctaaggcacctgtgccagtttcagacagtgccaatcatttggaaagttttccttcttctgagctgaaatttatctccccaaaatgtctaacccacatagtcctggatctgtcctctgtatgcactttccaaatacggctaccatggacccctcatcttcttgtctcagggcttatcattaattcgtcttatgtcgtgattccaagacccttcaccatcctgttctccctctgttttttaccagtttcttcccatatatctcattctgtaacccatctggaataaattagattgttcagggagaggtaaagatttaagtgaatctcccttcaggttaacatccatactcccccagagtacttgctaaataagctttcatttccctgtggttttcttttaccaggtttggttctatttctaaaatagatttcacacgtagctttacctttcctttttaaccccagattctgtatctttttttttttttgtggatgctgtaacaaagtaccacaaacttagtggcttaaagcaacacacatttatcatctttcaattctggaggtcagaagtctaaaatgggtctcacgaggctaaagtcaaagtgttggcagggatgcagtccttctggagtctctaagagagagcccatttctttgctttttctggcttctagaggctgcccccattccttggtttgtggccccttcctccatcttcaaggcaagtatcatagcatcttcagatttcaattacccccacgcttgctgactctctctgactctgcttccatcatgacatcacctactcttactctgaccctcccttatgcctcctgcttttacttataagaaccctgaatccagggttacattggacccacctggataatccagaatgatctcattccaacgtataaatccaaaatataaatctgccaagtccctttttccttgtaaggtcacatattcacaggttccaaggattaggacgtggacatctttgggagggactgttattctgcctacctcagattccttctgcctgcaaggccattagccaaacaaacttacctgactactgatagattcagctgggggttccactcccatgtgcccacctaggccctggcttccctgaaagaggggtattgcattttttcggagaaagtggtgaagcgaaagccactttggggcacagattcagtcctttatgtggaatttgaagcatctcattcctggaaactcttcattcaggtctaacatgagcctggcatgggtaagagttcagtgaatgaatgactggctgactagataaatgagtgaccttcttccgtgtctagccccaccatcatatttgtataatctttccacagttagttagtgtgtcttggttctctcttcagaaatggttgatggtgcccctgcatgtgcagatgtaatcccagactcttcagcccagcctagtcaagcactcccccatctgaccctagcttgctggtccagcttcacctcttactgcactcatccacgtgctctgccctctagcctcactggcctgagccggaatagtagcaacaagcatgtgcagagtgcttgcccagttccaggccatgttctgagggctttatgtacattaactcacttaacccttgccacaaccctataggcaggtactcatgactttcatgggagtctagaagaggttccatgacccactgaagtttaagaacctctgatctagagaatttcctctaggtggaaagtgggtggagcctggttgagtgtcagctcccctatctcctgtggggcctgcactgagccagcacagggcatggggctctgagacctaaagacccaacagttatggggctccttagcggggtaccagagacactgatctgggacgagcccacactgcagtgcaggatgacctattgctaccctgactatggagactaggggaaaggacagcaggggtgggggaagggtgtgtggtgagggcaggagatagtcaaggcatagttgatgaggtcagggcagtaagacaaaggcacagaggatataggacagagtaacagagaacattttgagaggtggtctattacaattgttaaaatcatagactccgaagccaaactgccaaagttggaatcctggctctgctcactgcttattagccatggacccaagtaggttactgtactgctccaatcctgttttcttatttgatttgtaaaatagagatagttatgcagtcatgcttcacttaaatacagggatacattctgagaaatgtgtcattgggcaattttgtccttgtgtgaacatcctatagtgatttacacaatcctctatgatgtagcctaccactcacctaggctatgtggtagagtccattgctcctaggctataaacctatagagcaggctattgtcctgaataccataggcaactgtaacacagcaataagtatttgtgtctctaaaaatataaaaggtacagtaaaaatatgatattataatcttatgggaccacggttgtatatgcggtctgtcattgcccgactcccgtgaaagccatgagatcctcttcctggataaaatgctcatgcacacatacctactgtagataatcgctgggagttcctggtgccctgaagtcctccccagggaaggaaagctgatatttacagaaccccttctgggcaccagtcattgcagagagcctttcagatgcattttttcattgaaccctctcagccccacaggaagcagacctttgacagcctgccctaagtctcgcacacaggcagtgagagaggtggtaggcacttgcagcccggacctccagtctataaattcttgcttgccccagtccttacctcagaagctggaaaactgtaggtatctgccctgtagatgagggactggctacaacagggcagcagtgaccctctggttatctccacagaaccctgggaaggaatctgggaagtaaccgtggctgttagccaggacactggggaccctaagcctgaaccagctgtggcccaagtgtagagtggctgggggatgggctggcagcaagcctgttggagcagaggggcccggatgctgggaggaagcagatagtggccagaatgggatttcctgagatgcttgcaaggtcagggaggagggcctgaagccagggcagaatgaggggccttgttgggggagggcattgactctgtttaccagggcccttgttagttttggggttcctggattacctttgctggattgagaaaggtcggaaaactggaaaggatgcatgatcacccaagatcaagaggtgtgaggtctgggtctgtccctgctcctagcgtgttgggtcactttaggtggtcccttcctctcattgagctgcaggtctctatctgtcctataattaggccatctccaagggcttctccctagttgtgacatcttcaattctaggatctttgtctcagcctcagtcactgacctgggacagtcttaacttacttgagtctaccaaggaatttatctgtgacagagcaaaagtttacatcattaacaattcaacagacatttaccaagggcatctgttttccaggcactgggctgggtgctatggctccagcaaggaggccaaccctgcttctgtctatggaaagctcccagctaggtgggaacaactggcatataaaacaagcatcaagacactgcacatataccttgggctctaatagtcatctccattgtgtgcccaggagcacatccctaaacatccctgatttgagtacagagctggcccacccatccatcgggagtgggtacagacaaacaccatgaggagaaagtgaggagggagctacgtgaatgccatctctgctggagactctcaggcaaagaggctggagtaagaagcagcactgaagtgacataccttgcaaggctgttattggactggaatgagaggatttcttttcctgatcagagcctggccaaggcagacactccatgaaagatggctattattatctccatttcactgacaacagaggcccagtaaggtttgtggttgcctgtctaagattccagaggagattaacagcagaactcagattttcacccagactggaccagtttccaagcccacacacatttttcctcatacgacttggctagttctaaaattatatatatctcattcgagtgaaagattcttcagcatcattaattttcaaaagtatgtgtgggtcctgagggcaatttgccaagagaaggttgtctttgccggcccttgcccctgaaagcccttggtccatgcccaccttaaagctggttccaggcctccggataacatggatttcccctttgtacacatgcgcatgcgtgagtacacacatacatgtacacatgcatacacacaccaccttgcttcctacgttttttcctcggcagacagtggaatgctcattagttgcagtgctctacccatgataaaggtagctggtttcagacaggtgtgccaattcccatctggcttcttcctttctgtcctcagtggtacctgaggttcaccaggctcccctcattccttagggagatcattaaccatcctaagcctagacacatcacttgtcaggcagccacagatgagagttgggagaagcctatgcgaggcatagtggggagggttaggggcccagtccccaactgtcaccaactcatggtctgaccttgggcagggccattctgtatcctgggccttgaaatgtgtatgtgtacattaaggtactaagactggagcagtgacagcaaaactcttttctggcattctagggtagtaccttgggggagcaagggtaaggccaaggatgtggcttcactaaagaaacagattgatctttagacgatgaaagccactgggctgggtaacctccaatggcctttccatccctgacatcccatgattgtatatgtgtgtgtgtatgtgtgtgtgtttaagagcaaaagattgatttattttggggtgtttgtacattgcatgtgtgcttaggatgcgtgagtgtattcatgctgtgtctccttccctgaacctcctgactaggagtgccaatctcctgccccccacagtcaccatcacgttaccctatattttgtcctcatgacacttattatcaaattattatttataacatttattgtaaagtcataatgtacttgttgatttctttattttctctcttctccaactagaatgccttttctcagagagcaggggctatgttggctttgcccatcactttgtccttagcaaccagcagagtggctggttcataggagatgttgatgagtaaatatttgtgggttcagaagatttatgggtcaggtatgcctctctgtgtttgggaggtatgggtgtactaggtggtcagggtgctactctgaacctggcaaacctagacttggcctttgtctgaatcttgaaccaatccctagttctgattgctgcttgttccttcagcagaaggctccattggccggagagagcagcagacagggatagcaatcaggaaagtagaggagggaggtaaaggggttaaagttttgcacccttactctcttgcctttacttagctgggagtcctccactggacttttcttctgtgctccatattagccattctcaaaaactcttctcgatttgaggcttcttgtagctacagcttgtgcggagtggggatgaggtttgtaagaaagaaaagagccttcttatatgctgctgtgttggttccttggcctcacactcagcacgtttgggcaccaactcccaggacattgtcctaggcaggtggccttcctcgtttcgggacagttttcattggactgactgactggtcagcctgaggcgagcactcctgagctgaaatcctgttaacaaatgcaatgtgggcttgtaacttgaaacctttctccactcaaactagagtgtcccccacaaataactagcaaactgctagacgtgtctagactgctagacatgctaggccatagggaaggaagtcaagacagtcatcctttccatgcatccttctggtggccctagtaaggacaggagaacactgtgcttccagagtttactgaaagatggggtcactgagtaacatttgggccctttgggtcacagactgtgagaccgagttcatcatgtttggccttccccagaatgtattcatataggctgcacagtgtaggagaagaggcattggttcacactcaggagagagaccatgatgggcatgcaatttcaagtcctggccccaacactgaccagctctgtgaccttgggcaatttccttcacctccccaggcctccatttcctcatttaatgagtgaagaaaacaagacctgtctctcagggctgtttttgaggattgattcctatgtattagatgcacttaacccagcacagttctgagcgaggccagacatgaagtgttggattagtccgattatggcaatatgttccacactcagagatggaaccaagacagctgtgccatccattgttactatcagaggttaacgagtgtcacaaacacagtgggctcttcctgtagtgtactccatcaactctggtcagagaacagagttccacaatttggggagctcatccctgaactggtggggtgatacagcttccttaaaatggtcgtgagctttgtgtgtataaattcatatgtatatgtgaacattaagccattctaggatcacccgtcaatagtaccatctgaggactttcagcttttttatcgttcactagctacaacatttcattctgtggatgcaacagtgcatcattacctggaggtagaaggagcaggtaacaattttttgttgatagtataattttcattgttaagaaagcagagtaagtgactttagctttaatcattacaagggcttctctacataggtgacattccagctaagcagccattgggagataaatctgaggatctgctctgagggcaatggtgctaaggagggtgtcagagtcctggggttgagtcccagtatatcatttgctgctcttgttactgagcatgacttacatgtaggtagcaccctccaggccagaaagagccttcaatgtggtcttcacaacagtttggggaggcaggcaggtcaaaaaatgattctattcctcattgttttccagatgaggagggaagaggagctgcagggagtttgagtgacttatccaaggtccctgcagctgattggtagtgagggcagggggtggtgtttgaatcactgctgtggagacctcagcagcatttaaattgtgctgagaatctatatctctgttttggtaccagtaccatgctgttttggttactgtagccttgtagtatagtttgaagtcaggtagcgtgatgcctccagctttgttattttggcttaggattgacttggcaatgcgggctctttttttggttccatatgaactttaaagtagttttttccaattctgtgaagaaagtcattggtagcttggtggggatgacattgaatctatgaattaccttgggcagtatggccattttcacgatactgattcttcctatccatgagcatggaatgttcttccatttgtttgtgtcctcttttatttcattgagcagtggtttgtagttctccttgaagaggtccttcacatcccttgtgagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacgatggagttttctaaatatacaatcatgtcatctgcaaacagggacaatttgacttcctcttttcctaattgaataccctttatttccttctcctgcctgattgccctggccagaacttccaacactatgttgaataggagtggtgagagagggcaaccctgtctttgtgccagttttcaaagggaatgcttctagtttttgcccattcagtatgatattggctgtgggtttgtcataaatagcccttattattttgagatacgtcccatcaatacctaatttatggagtttttagcatgaagggctgttgaattttgtcaaaggccttttctgcatctattgagataatcatgtggtttttgtctttggttctgtttatgtgctggattacgtttattgatttgcgtatgttgaaccagccttgcatcccagggatgaagcccacttgatcatggtggataagctttttgatgtgctggtggattcggtttgccagtattttattgaggatttttgcgtcgatactcatcaggaatattggtctaaaattctcttttttggttgtgtctctgccaggctttggtatcaggatgatgctggcctcataaaatgagttagggaggattccctctttttctattgattggaatagtttcagaaggaatggtaccagctcctccttgtacctctggtagaattcggctgtgaatccgtctggtcctggacttttttttggttggtaggctattaattattgcctcaatttcagagcctgttattggtctattctgggattcaacttcttcctggtttagtcttgggagggtgtatgtgtccaggaatgtatccatttcttctagattttctagtctattggtgtagaggtgtttatagtattctctgatggtagtttgtatttctgtgggatccgtggtaatatcccctttatcattttttattgcggctatttgattcttctctcttttcttctttattagtcttgctagtggaacttaaagtatattaagaaaaaagaaacacaataattatagttgatattaaaacataaatggcaaaataattataatttctgaagtttaaaaaaaattgtgctgagaatctcatactgaacttaaaaacaaggttgtctgccagcagcacccaagcagctgcaggaataactcttgaagaagtctgcccagtacacagcatccaccagagcatcttttcactggtcatttgaatattctcttttgtaatgtgtttgctaagccattttgctactttttctgttgggttgtttgcctttttcgtattgacctgtaagaccctttatatatcctggaatattagtctcttagtttcttttatgtgttacaaaatcttctgccaaactgtgggatgaacaccattaatgaatcaataccagtatgaataccattaatagttgtttatagttcttttttaattctgagatgaaatttgcatataatgaaatgcagaaatcataagtattcaatgtgacaagtttggaaaaatacatactcctgtataaccaagcctttactgagaattagaatcttaccatcgtcctggaaagtcctctcgtgttccttcccagtctatctgggctcccacttccatagacaaccaatgttccatttgttttctgttatagactagactgacctgttctataattttatataaatgaagtcatacagtatatgctattttataagtgttttttccattcaaagtgtttttgaaattcacccatgttgctacatatatcagtagtttgttttttatttcagagatgtcatccattgtatgaatttaccacagttagtttgtccattctcttattgatggacacctgggctgttaacagattttggcttttgtgaataaagatgctatgagtatcctttcataaaacttttcgtggacatttgttttcatttctccttggaaaatacctaaaaatggaattgcctggtcatagagtaggtatatgtttaagtttataagaaaatgcaagctagtccagttttggaagtggttgcaccatataacatacccaccagtaatgtgtaaggttccaattacttcatatccttgccaacatttagtgtatttattcttttaaattttagccattcaggtgggtgtaatgatatggctcattgtgttttttttaaaattatttttccataagttattggaggtacaggtggtatttgtacataagttctttttttttttttttttgagatggagtttcgcttttgttgcccaggctggagtgcaatggcgtgatctcagctcactgcaacttctgccttctgggttcaagtgattcttctgcctcagcttcccaagtagctgggattacaggtgcccaccaccacgcccagctaattttttttttttttgtatttttagtagagatggagtttcaccatgttggccaggctggtttgaactcctgacctcaggtgatccgcccacctcagcctcccaaagttttgggattacaggcgtgaaccaccacgcccagccatgagtaagttctttagtggagatttgtgagaacctggtgtacccatcacccgagcagtatacactgcaccatatttgttgtcttttatctcttgccattgtatcattcttatgcttttcatcctcatagcttagcttccacatatcagtgagaacatagagtgtttggttttccattcctgagttacttcaggttttgatttgtatttttctaatgactaatgatagtggtgagcatcttttcacatgcttattagccatttgtatatcttatttcataaagtgtccattaaatattttgtctctttttattgagttgtttttattgttgagttttagaaatttttttgtaatatcctagataccagtcctttgtcagatatatattttgcaaatactttctcccagtcagtgactcatctctacattttcttaatgatgtcttttcaaaaatagactttattgcttagaacagttttagatttatagaaaaatgaaaagatagtacagagagttcccatatacctcccacccagtgtcccctaaaattaatatcttacattgtacagtacatttgtgacaattaataaacccagatcaatacattattattaactaaaatccatactttattcatatttccttagtctttacccagtatctttttttctatttcaagatcccattcaggatactatattaatatcatttagttgccatgtctccttaggattctctttgctgtgacattttctctggcttttctcttttttttttgatgacattgatagttttaaagagtactggtcggctattttgtgggatgcccctcttgggatttatcagatgtttttcttgtgattagtctgaatttatgggtttatggaaggaatagcacagagatagagtgccatcttcattacatcatatcaacatgacttatcactgttgatgttgaccttgatcacttggctaaagtagtttgtcaggtttccccacaataaccttattctttttcccctcttccatactctactcatagaaaggaagttactatgagcagcccacgcttaaggaataggaaattatgctctccctgaagttgttgttgttgttgttgttgttgttgttgttgtttttgttttttgagacagggtctcactctgtcttccaggcgggaatgcagtggcaggatcatagctcactgtaacctcgaactcctgggctcaagcgatcttcccattttagcctctcaagtagctaggactatgggtatgcaccaccacacccagctaatttttttaatttttagtagagacaggatctcactgtgttgcctagactggtctcagactcctggcctcaagcaattctcccacctcagcctccaaaagcgctgggattataagcgtgagctaccacacctggcatgacaaggtcttatttataagtttttattttcttttatggttattgtgtcctttccgttcccaagaaagctttgcttacccaagtcatgaaaatattttcagcctatacctatgtcaaacacaaaaattaaagatgtttcacaaaaataaacataaaagttaaaaccatgaagcttttagaagaaaacataagaattaggattatgctggactcatcaaacaaattggaagagtcacctcgtctattttctgaaactgtttgggtaaaattggtgttatttcttccttaaatgtctgatgacaaacaccagtgaattctttagctctggagcttttttcctgggaaggaatgtttttgatgatatattctatttatttaattagatatgaaatgcagatttttctgtttcatcttgtctccaattcagtaagttattgttaagaaatgtgtttactttatccaagttgtcaaatttgttggaataaagctgtttataatattttattatatttttaatgttgtaggatctttaatgatctcaggcttttcttgtttttgatgatcatcttttattcctgttagtgctaatttgcattctcttttttcttgattagtcgaggtagaggagcatcaatttttgctggttttgttaattttctcagtttttttctgtttcattgacctttgctctttttattatttcttaacttctacttactttggatttactttcccatgattttctagtttcttagagtggaatcctaggtcattaattttaggccattcttcttttctaatataaacatttaaagttacaacttttttctctaagtgctgcatcacttgcttcccacaaattttaatatgtcgtgttcttattgtcatttagttcaaaatattttctaattctctttatgctttcttctttggcccatatgttatttaaaagtatattgtttaattttcaaaggttccatttttctggctatcttgttattgacttcttgttaattccattgtggtctgagaacacattctatattttatttctgtcaaatttacttacacatggtttatggcgtagcataaacctatcttggtgaaggtactatgtatatttggaaaaaaaatgtgtattcttctctcgatggatatagtgttctataaatattagttaagtcaagttggtcagtaatgttatttagatcatctaagtctttactaatttttgtctagctcctttatctgtagctgagaacaagttgttaaaatctccagctatgttttctctccttaattctcccaattttactttattttgaagttctgttattataccacatacacatttatgaatactgtctcttcctgatgaagtaattctttattcattatgaaatgcttctctttacctttaataacactcttacttgaagtctgctttacctgatttaatatcaaatagccacggaagccttcttgtacttactgtttacatactataagcccttctccatccatttgtttttagccaatctctatttttatattaaaatacatatctcctagaaagcacatgatagtgtcttgctctttttctccattctgacattctgccttttaattcaaatttagtccatgtttattaacatttaacataattattgatatttcagatttaaatctttattcactagttgttttctgctttccccctctgtttttcccatattcctctttttctgccttctcttggattatttgaatgtattgtagatttttattatatttatttgattttagctgtgcctctttgcatcatttttagtgttgttctagggattacaatgtatattaataacttgccacaatttacttagagataatattgtaccacttcatgtcaattgtggaaaccttgcaactatattcctcccaattttatgctatattgtttatgtattacaacttactgacattttacattccaccatatgatgctacagttttcactttgaacagtaatatgtattttacatagattaagaagaacagtagtgttttatatctacccatttccaatgctcttcatttcttcctgtagatccaaacttccacctggtatcacttcccttcagcctgaagaactttgttcaaaatttcttgtaatgcatatctgatggatattaattctctgggttatcttttatgtaaaatgccttcatttaacctttattcttggtttttgctagatatataattctggacagttttctttcagcactttaaagatgttggtccgtggtctttggaccctcattgtatgtcgtatgtcataagcagttacttgaattgtggttcctctgaatcttactttcctctagcttctttaagacattatctttgttttttagtagtttgtctgtgatgtgcctagctgtgatttgctttgtattcattttacttgggactcgctgaacgtctttaaatctgtgattttatgtctttcatcaaattgggggagtttactgctgtcatttttttcaaatacaatttttctggtttattttctctcttttccttctatgacactaactacatttgttttagatatttttataatattctataggttcctgagcctctgttattttttcttctttgttcttcagaatggataatttctattgatcttcatgttttctgactcttctgtcatttctagtttgttgttaagcctatccagtgaatttttaattcagatattatatgtttcagctctagaatttccacttagttctttattataatttttacatttcttttctgatattttctgacttttcattcattataagcatattttcctttatgcccttcagcatatctataatagctgcttttaaaatccttgtctgctaattccaacatttgaatcatcttagggctacttttagttgattgccttttctcttgagttttcctcatgcttttctggttcttcatatgtgttgggaccctggttttgctcttttccttggaagagtgttgatttttgttttgttatattgattttacttatgttttgttttgttttgtttgtgttagctggcaactagactggctggactcaaactgcaagttatttctcctctacaatggataacagctcaaataacatttcagtttttttagtcttagctgttctccttagagtctgtcacacacatgcatggtttggggtcagcagagagttggatgtagtttatacataggatttgatgctctttctttctggctttctcattttggaggatttcctccttacttcgcagtagttgtgtttgctatgaactctgtactctagttcttcaatacagaaagactacagcttttccactacagtttaagttgctctgcatggtacagtctgggtcctgtcctcaagctaaacaccagaaaagtaatgggaaactgacccagtgccattttcttcttccaagtgttgacccccctccactatctgcctgcttttgatccctccacactgccttcaagtagtgtatttatattttgttttgtttttctccagagttcatagttttaatctgtagtgagatagggtcaataggagcttacttgtctattgctggaagtagaatctgtagcttgtttttttccccttcttagtcatattattttattaataaaaattcttaatttaaatgtggtcaagtctatttttcatttgtgattcttttcttaaaatcttatgcagggaagtgtttcctacccccaaattattcatacattctcttatataatctttcttacaatttgccttatacatttagttttctttagtcctgttggaattgattttttacttgttttaaaataatttttttaaaagtattttagaataggtttagatttagggaaaagttgtaaagatagtacaaggagttataataaacgctgaatccagttttacctattattatcatcttacataagtatggtatatttctcacaatcaataaactaatatattaatacattgttattaactaaaatccatacttaaatatttcctttgtcatacatcaagtctcaatgtatgtatacatctgtttctggactttacattctgtttccttgttctatttgtctgtccctgagacaataccacactgtcttaattactatagctttataataaatcttgatatctagtagagcaagtttcccccctttttcttccttcaagaatactttagctatacttgacttttcacatatatattttagaagcagcttgttaagttgcacacatacacacacaactctcaggatatgtcattgaattaataaatcagtgtggaaactactgacatctttataatagtgactcttcctattcgtgaacattgtaaatctttccatttgaatagatctcttcggtagatttattcctaagtatttaatttttatgtcaatgtacatactatctttccccagtaatgttttaattaataattggctggatcaatgaatgaaaactgtatgctaggccctgtgaagaatattgaaggcaaaggagaggaaggaattatttttgagtgccaaaaacctgccaggtattattactgatgctttgcttttttctcagctaataattgcagcaactgtgccagcatcctattatattctgccatgtacagatgagaaaactgagtctctgagacagttaaggaacttgtctaaggtaatgaagccaggaagtggtagagctggtgttgatatctaggtttgcctgattgtagtgtgcatggtctgtccactcgaacatcctgtctccagataattcaatcataccccttactatggaccttaactatttttgtgtgggaaaagggcaggatataaaatgtgtatccaggcaataaggttgaggactgcagctgcagtaatacagacattctgaggaaacagtcactttgagctgaagggctctgcaagacaggcttcctgtaagaggaaacattgtcactaaatttttcagactggagagaatttggacatgcagtagtggaaggtcacagatgcctgggatattaaaaagaccatctccagggcaatgaatgctgagaatatctgacttgaaccccagcattcagaagccacaggaggaagtgaagtgaaaaacttacacctttgtatatgaactaatgaggcagggctgtggactcccttctcatagctttcctgagggtccatggtatctcaggctttagacctacctcttttcctcttggatacagaagcaatgaaatggaatgggcggttggctcccgcaaatgacagtgactttgcttatggtgacttttttggacactgcaggcagcatccagcaagagaaagcagggaggagctgacagagccctcatcactgcttccctgacaggaggtaggggaagcaaaaaagagcctctgaggggaagctcacctctgctcggacccaccacagttacagcacctgtccagctttctgtagcacttgaaggtaatcagatcctacagtttggtgttcaaggccacaacacctggtcccagtccatcttgccagtcttctatgtttcctctttctccatcactcatgtagtctatgcatgggccacactcaatcattctgcatttcctgtagttccctacttgtgggacattgctcatactatttctttggccagagacccttccccatcttcaccctcattcatgtgttcagcaaatctgtattgagtactacacgccaggtactctgcgggttccatggggacttctgagaatttaggactcctttctcttcaggagcaagtgcgctgcctactgaggggataagacatgtacacataactagactccaaggtgaaagggacaaacacacacatccatctgaggaaaactgcatcttcctacaagctttctcagcacctcttcagaatccagtgtgctaagtttgctcaaaatggcagtgctggaggaagaattcacgttgtcttcagtagtcctgagcgcggggcctgaaggactcctaggcatgaagcagagtgacaaaacagaccagtttctagtgacagacagtggcagaaccgtgatcctctataaggtttctgatcagaaacccttggggagctggtcagtgaaacagggtcaaattgtaacatgtccagctgtgtgcaactttcaaactggagagtatattgttgtacacaataataagattttaagaatctggaataatgaagatgtaaacctggataaagtatttaaagctacattgtcagttgaagtatataggaaactttcagtgcaagggtcagaacccttggtgctcttcaaggaaggtgttcgtggtttagaggcctcgcttgcaggcccccagcagaaaattgaagctgttatctctgatgaagtgattaaatggacaaagtttttcatagtattcagacatcctgttttaatttttattactgaaaaacatggaaatcactttgcttatgtgcaaatgtttaactcacgtatcttaaccaaatatacactcttagttggacaagacaaaaactattttatagagagttttactgcattggtagatcagaaattcatctctttgacgtcattaagctctgatggttgtatatatgaaaccttgatgccaatacgtccaactgacccagaaaaaaatcagagcttagttagatcactgttgctcaaggctgttgtgtctggtaacacttgaaatggagttgcactcactgcgctggatcaggatcacgtcacagtcctaggaagtccactagcagcttctaaggaatgcctctctgtatggaacataaaatttcaaacactacagacttcaaaagagttaccacaagggaccagtggtcaactctggtattatggggaaaatgtgtttatgctacgtggaaaatctctgtgattccatacaactgtgaagtgtcatcattagcaggtgctcatggaaaactcaagcatagtcaagatccaggaactcatgtcgtgccccattttgtaaactgggaaacacctcaaggatgtggacttgggtcccagaactcagagcagtcaagaagaattttaaggagacgaaaaattgaagtgagtttacagccagaggtatcaccatccaaacaacttttgtcaaccataatgaaagattcagagaaacatactgaagtagaagtatggaaatttttggctctgaagcagacccctgactttcatactgtcactggggacacagtaacaggacttctggaaaggtgtaaagcagaaccatcattttatccccggaactgtctgatgcaccttatccaaatgcatgtgctttcttacagtttgtgccctgacttaatggagattgccttaaaaaagaaagatgtacagttgttacaactctgtctacagcagttccctgacattcctgaatcggtcacctgtgcttgcttacaaattttcttgagaattggtgatgacagtattcaagaaacagatgtcagtatggagtcagtttttgactatagtaattctgtacatgatgagaaaatggaagagcaaactggaattcttcaaaatggcttcaatcctgaagaagataaatacagtaactgtgatcaagagttaaataaaaagccccaggacaagacaaaggagaccatttcatgctctgtgataccaaaaagagcagctctacttaatgcaattcttcattcagcatatagcgaaacatttcttctgcctcatttgaaaaacatcccagcacagcatatcacactgtttctcaagtgtttgtgtttcctttatctgaagtgtagcgaaaatgctactatgactcttcctggaatacacccacctaccttgaaccagattatggattggatatgtctacttctggatgcaaattttactgttgtagcaatgatgccagaagcaaagaggccactgataaatctttacaagcttgtaaaatctcagatatctgtttattccaagctcaacaagattgaagtaagtttttgggagctacagaaattaaatcaagaaaagaataacagaggattatattcaattgaagtgctggagctcttctgatattaccaattctccttcatagtcattttataaagctcttttatgtaactcttgcttcatccaggcaagagtggtgttttgtttgcgaccctctcggtgtcaagagaaacatgtcagtgagtacctggaccatcacttattgatgctccggggtagaactgcaggtttcacatgaacctattctaggttgtggacattggtgtgcagaggttctgcaattttttaaaaatatgtaactgggttgattttaagtaaaattatttgtgtattgataaaagtctaatttcttatcatgtattttgaattttaataaaaaacgaccattgaagcagtgaaaaaaaaagaatctggtgtgctaacagaagacatttaattatgccatcacatatgaattctctgtcctccaaattgacccaacacctcatatatctcttagggcagcattcctttcctggaggaggtgctttgaagggaactctggaggaagattaaggttttagatggcgagctctttggaggccagaactgagttctccaagtttctgagccttggtctattgcttctacttcctctacaggttctccctggactatttctctcattcttgtgctttaactttcatcaatatgcagttatctccctgatcttggtctcttaccaaaaccttccccccataaagccaaatgctacttggatatctacactgatcattccacagccactgaaatggaagtcttcaacctacttaaaaactccatccaaacagcttctccactgcatggcactggcatctacccagtcacccaggccagatttctcagcatcacccttaactccttccactcacccacctaatctgccatcaggttctgccagtttacctcctaattatttctggaatgtatctttacctcacctaccctcctgctactgcacaaatttaggtctttattatctgtcacctggattactcttcattgtcccctcactgtcatccctctagagtctcctctacacatcagctgaagcgatttacctaaaatgctaattcaattgcatcatccccactgctgaaaaccctctaatggcttcccaatgtgaaaaacagattagagacatcccttctgaatgtgctacagctgaattagtgtgaccctgcctcagacctcttgggtgagctcaggcaaatccctttccttctctgggcttcaatctccttatctaaaaaataaggggattggaagagttctgtatttcccaaaatgtgttgtctggactgctggccatatgaaatgctttttccacatgggtctggagtaaaatgtgtttggagaatgcattctctagctcctattggagagtgacagagcaccttgacatgtcacaggctctggcaagcctggcaatcaagaaggcttgctaactttcctccactcaagtttccttaaacttttgtcaccacagaatccttttggagctgagcatctattagaatcttgaggaaccaatgtttgtggaacatactttgggaaatgctggagtggatcattacccaggactgcattgctgtgaccagtggtgattctgcttaagttattatttgaggcaagaggatggtgtctgactcaggtttacatctaccacagtagatactcagacaatggttattgaacagggggtgtaataagaaatggataaattgaatggaaagtgcgcctattttagatgtggacagtagattcctagccatggtaagagagcagattgttcccagaaagaaatgagtacaaatcttgatgggcagagtgtgctaactacagtagtgatgggtacttctgtgacccatgtggctgtctgtactgctggacatgtccattcatggccattatcatttgacagttcctctgggaaagtttacccagggactctggggtgtgacaagaagagagctgccccactcttgtgcctttcgttgcatgaaagccatcgctggcacttgtaaatgttgactcttagtagctctgctagaaaatcagcattttctatctctggaccatgtcctggacaaggcagaagcttcgtggcactgggcatggagcctggtccgctgtattcctcagctgggtcttgcattagcactgattgctggcaaggccatcggcctaaggctgtgtttttctaatcaaggaagccagtttagcacttgggaaagaatagtcagctgagccacgttactttcccctcctggtagaaataatgtaggcagagacagtggaacttttgcgaatggttttgcaggcagccccaagtcactgaggtcctgtactctccagccacttcagggctgctcactgcggttcaccaataggccttcctgtcctgggactggtgagagagacccaatcctcatgccatttggagctttccagcacattctccctggggtgggggtgggggacagaaaatcatttcctgatcccccaggcaagaatactagggttctgtttactgtatcataacaactggagggaagctggtattaatattattccattattcctaatttgtagagaatgaaaccaagaccaaatatatatatatatataaatatatataaacttgctgaagtccatacagcaagaagatggcaaggctgaagtcccaatccaggtcagactagttacaatgcacttgctcgtgacaccacattgcatctcttagttctttatttgtttgtctttaccagagtttgtgggctctttgagggcaagagccatatctgatttgtagtagggcctgccacatagtgggtgttgaggggagctggtagtcagtataaggctgactgtgtcagagcattgtggttcacttgtcaagagtgtaggggaaagttctctgcagtgtgggcttggagaaacaaacgcatctgctccttacttcccaagcctggcatcccccaaagataattactgtggactctcagctgttggagctgagaggctattccacttcagctgagtgtgtttcccaaaacaggtttacattgttttgaaaccatggtgcagagcacgcagagagcaaatagaagttgatccccacacaacaggcagtaactaagacatcaagagtgagtgggacaggtttggggggctaaaggggaaagctggctagtgctgagggtatgcacattttagaaagggacccacacctgtggaaggcagcccagtcaactgaagcaagagccctagaactgttcctgacctttaactcaataattcttcttcctgagattttattcctcaggaagcagttcaacagaattgagaagatacatgcatgaagatgttcattatgaaattggctgtagtaatataacactgggaacaaatgaattgcccaacaataatgggtggctaattaaattatggcatatccattccatggcatattatcagaacatttaatatgctcattctgaaacctgcagcagtctgaggaatacatggaacaggttttgaaaaggaagaggctccattgtatttacactgtgatcttgcaacttacaaaaactcatagtaaatgcgtaaatgaaaaaagctgtgttagggtgatgggatttgggtgatttcctttataaaatatcttgatcattagtatcattgctatattgtttttgcatttctagaaggaactgtttgtgtgggtacatgcacctttgtgtgggcagaatcaacacagaatttctccccaaagctaaatctattttaaatggattcttacatctacttaataataaaagtgtatatatgaggaacacagacaggaaaacaggtgctggtgccatttgatgcatgatcagcaccatgacatattattgaaaagaagccagttggggagggattatcatggtggacgggaggcaggactagattgcagctccagacagagcagcgtgcagtggcttgtaaatttaagattcagattgactgcaagaacaaaccagcaatctcaagaggacccacagaccctctgaaggaagcagatgctcctgcaggacccaggaaacaccccaaatactgtgagtgtcccaactgcaaaagtgggaaagggagaccctcctctcccgaacacacacccccactggagaaactgaaggtctgtttgtgggagaagtttcctaccttacctggagctgagtccaagtttggagagccaagccaaatacaggggtagaggaagcagcagaaaggccctgggagctcgctgggtccccagacagcccattcctacctggcaccacagggattcattgggagggtggccagaggagcatggggtaaaactccacagacagaaggaaatctccagctgaacttcataacaatttgaatggggcaagaagcctcctggccagaactcaggggagggtgcaaatccagtgtgcagactccacaggcaggggaagaatcaatcccttttattttgcagctgggaggtgggtagcctggggcatgttttcaagcccatctcactcaccgcctggaaacagactcagggctgttggggggtgcacggtaggagtgagactggcccttcggtttgtgtgggagcttggtggggcctgtaactgccggctttcctccacttccctgacaacctgcatgactcggcagaggcagccataatcctcctaggtacacaactccagtgacctgggaatctcacccccatcccccacagcagccacagcaagacccacccaaggagagtctgggctcagatacgcctagccctgcccccacctgatggtccttccctacccacactggtagctgaagacaaaggggcatgtaatcttgggagttctagggccctgcccagcaccatttcctctccatactagcacagctgatgctctctggaaagtgccacctcccagcaggaggccaaccagcacaaaaatagaacattaaaccaccaaagctaagaaccttcatggagctattgcacccccacaccaccaccacctccacttgaacaggtgctggtatccatggctgagagacccataggcagttcacatcacaggactctgtgcagatgacccccagtaccagcctggagttgggtagattcactgggtggctagacccagaagagagacaacaatcacagcagtttggctcacaggaagccacacccataggaaacgggggagagtactacaacaagggaataccccatgggacaaaaagaatctgaacaacagccttcagccctagaccttcccttctgacagagcctacccaaatgagaaggaaccagaaaaccaaccctggtaatatgacaaaacaaggctctttaacaccccccaaaaatcatgctagttcaccagcaatggattcaaatcaagaagaaatccctgatttacctgaaaaagaattcaggaggttagttattaaggtaatcagggaggcaccagagaaaggcgaagcaggaaatccaaaaaatgatacaagaagtgaagggagaaatattcaaggaaataggtagcttaaagaaaaaaacaataaaaaattcaggaaactttgggcacacttttagaaatgtgaaatgctctggaaagtctcagcaatagaattgaacaagtggaagaaagaaattcagagcttgaagacaaggtcttcaaattaacccaatccaacaaagacaaagaaaacagaataagaaaatatgaacaaagcctccaagaagtctgggattatgttaaacgaccaaacctaagaataatcggtattcctgaggaagaagacaattctaaaagcttggaaaacatatttgggggaataattgaggaaaacttccccagccttgctagagacatagacatccaaatacaagaagcacaaagaacacccgtgaaattcatcacaaaaagatcatcacctaggcacattgtcatcaggttatccaaagttaagacaaaggaaagaatcttaggagctgtgagacagaagcaccaggtaacctatggaggaaaacctatcagattagcagcagatttctcagcagaaaccctgcaagctagaagggattggggccctatcttcagcctcctcaagcaaaacagttatcagcccagaattttgtatccagtgaaactaagcatcatatatgaaggaaagatacagtctttttcagacaaacaaatgagagaattcactgttaccaagccaccactgcaagaactgctaaaaggagctctaaatcttgaaacaaatcctggaaacacatcaaaacggaacctctttaaagcatgaatcacacaagacctataaaacaaaaatacaagttaaaaaagcaaaaaaaaaaaaattccactggcaacaaagagcacaatgtatgcaacggtacctcacatttcaatactaacattgaatgtaaataccctaaataacctaaatgctccacttaaaagatacagaactgcagaatggataagaactcaccaaccaactatctgctgccttcaggagactcacctaacacataaggacacacataaacttaaagtacagaggtggaaaaaggcacttcatgcaaatggacaccaaaagtgagcagaggtagctattcttatatcagacaaaacaaactttaaagcaacagcagttaaaaaacacaaagagggacattatataatggtaaaaggccttgtccaagaggaaaatatcacaatcctaaaagtatatgcacctaacactggagctcccaaatttacaaaacaattactaatagacctaagaaatgagatagacagcaacacaataacagtgggggacttcagtactccactgacagcactagacaggttatcaagatagaaggtcaacaaagaaaccatggaattaaactataccttggaacaaatggacttaacaggtatatacagaacatttaatccaacaaccacagaatacacattctattcaacagtgcatggaactttctctaagatagaccatgtgataggccataaaatgagcctcaataaatttaagaaaattgaaattatatcaggcactccctcagaccacagtggaataaaactaaaaatcaactcaaaaaggaaccttcaaaaccatgcaaatacatggaaattaaataacttgctcctgaatgaccattcagtcaaaaacaaaatccagatggaaattaaaaaattcttcaaactgaatgacagtaatgacacaacctaccaaaacctctgagatacagaaaagacagtactaagagaaaagttcatagccctaaacacctacatcaaaaagactgaaagagcacagactgacatcctaaggtcacacctcaaggaactagagaaacaagaacaaaccaaacctaaacccagcagaagaaaggaaataaccaagatcagagcagaactaaaggaaattgagacaaaaaaatacaaaagataaattaaacaaaaacctggttctttgaaaagataaaattgatagaccattagcaagattaaacaagaaaagaagagagaaaatccaaataatctcactaagaaatgaaacaggagatattacagctgacagcactgaaatacaaaagatcattcaaggctactatgaacgcctttacacacataaactagaaaacctagaagagatggataaattcctggaaaaatacaaccctcctggcttaaatcgggaagaattagataccctgaacagaccaatagcaagcagcgagattgaaatggtaatttaaaaattaccgacaaaaaaaaaaaaaaagtccaggaccagacatattcacagcagaattctatgagacattcaaagaagaattggtaccaatccttttgacactattccacaagaaagagaaagaaggaacccttcctaattcattctatgaagccagtgtcaccctaataccaaagccagggaaggacataaccaaaaatgaaaactacagaccaatatccttgatgaacatagatgctaaaatccttaacaaaatactagctaatcaaatccaacaacatatcaaaaagataacccaccatgattaagtgagtttcataccagggatgcagggattgtttaacatatgcaagtcaataaatatgatacatcacataaacagaattaaaaacaaaaatcacatgattatcacaatagatgcagaaaaagcatttgacaaaatccagcatcgctctatgattaaaactttcagcaaaattggcatacaagggacatacctgaatgtaataaaagccatctatgacaatccacagccaacataatactgaatggggaaaagttgaaagcatttcttctgagaactggaacaagacaaggatgcccactctcaccactcctctccaacatagtactggaagttttagccagagcaatcagacaagagaaagaaataaagggcattcgaatcagtaaaaggaagtcatactttcactgtttgctgatgatatgatcgtttaccttgaaaaccctaaagacccctccagaaagctcctagaactgataaaagaattcagcaaagtttctggatacaagattaatgtacacaaatcagtagctcttctatacaccaacagtgaccaagcagagaatcaaatcaagaactcaacctcttttacaatagctgcaaaaataaataaataaataaataaataaataaataaataaataaaatacttaggaatatacctaaccaaggagtcaaaagacctctacaaggaaaactacaaaacactgctgaaagaaatcatagatgacacaaacaaatggaaacacatcccatgctcatggatgggtagaatcaatattgtgaaaatgaccataccgccaaaaggaatctacaaattcaatgcaattcccatcaaaataccaccatcattcttcacagaattataaaaaaaattctaaaattcatatggaaccaaaaaatagcctgcatagccaaagcaagactaaacaaacaaacaaacaaaacaaatctggaggcatcacactacctgatttcaaactataaggccatagtcaccaaaacagcgtgatactggtataaaaataggcacatacacccatgaaacagaatagagaacccagaaataaacccaaatacttagagccaactgatctttcacaaaggaaacaaaaacatacagtggggaaaggacacccttttcaacaaatggtgctgggataactggctagccacaggtaggagaatgaaactggatcctcatctctcaccatatacaaaatcaactcaagatggtttaagcacttaaacctaagacctgaaactacaaaaatttttgaagacaacattggaaaaacccttctagacattggcttaggcaagaatttcatgaccaagaacccaaaagcaaatgcaataaaaacaaagataaatagctggtacctagttaaagagcttttgcacggcaaaaggaacagttggcagagtaaacagacaacccacagaatgggagaaaaacttcacagtctatacatcaaaggactaatatccagaatctacaacgaacccaaacaattcagtaagaaaaacaaacaaacaaacaaatgccatcaaaaagtgggctaaagacatgagtagacaattctcaaaagaagatatacaaatggccaaaaaaacgtatgaaaaaatgctcaacatcacgaatgattagggaaattgaagtcaaaaccacaatgcaataccaccttactcctacaagagtggccgtaatacaaaaatcaaaaaacagtagatgttggcgtggatgccaaggagattccatgggcatggttatcaggaagcacttctacactgctggtgggaatgtaaactagtacagccactatggaaaacagtgtggagattccttaaagaactaaaagtagaactaccatttgatccatcaatcccgctacttggtatctacccagaggaaaagaagtcactattcgaaaaagatacttccacacgcatgtttatagcagcacaattcacagttgtaaaattgtggaaccaacccaaatgcccatcaatcagcgagtggataaagaaactgtgagataaaaaggaatggattaacagcatttgcagtgacatggatgatattggagactattctaagtgaagtaactcaggaatggaaaaccaaacatcgtatgttctcactgatatgtgggagctaagctatgaggatccaaaggcatgagaatgatacaatggactttggggacttgggggaaagagtggagggggtcgagggttaagactacaaatacggtgcagtgtatactgctcaggtgatggccacaccaaaatctcacaaatcaccactaaagaacttactcatgtaaggaaataccacctgtacccaaataacttatggaaaataaataaataagaagccaggatccttccatggtacaactggctattcatgaagctcttgaaatggataaggttgtagcatctggtccattgttgtcattcctagattgccagccaggcctcatcttaaatctctaatttacaaatggttcttgcctatcagtgaccaggggtgtatccacaaactttttctcatataaatagaaaataggcaatcttccccaaatgggagaaggaagcttgtcctaaattccaagcttgaatgttcattggtcttttgaaggcactgtaggcagagctccccagtccccactactggacaaggttccctttgtcccagagatagcagggtatgtgacagagcagtttgtagagacagcagtgatgacactacctcactcatccaccattggtgctgatgctctgcttgtcctgtcgaatgtcagccttgagcaccctgacccctgcctgcaagcctgatgcacgagaaaatacaccttgggactgtgtgaagtaacgtcaaagtgtttggccttcatatattgtcccctccccattcctgctacccccttcataattgtaacctttttggatattcagcttggaatagtgggcatgcagcccctcacaccaccatgctaattcacaccattcacacccagaggcaattaaacctaaggatggccaagatatagaggggaccaaggtactgtcttaacttgaggcctttggtgtttcccttttaacactttactgcactagctgggctagcttgtatacttaaaagctgggcttggatacagaaggatatatctaagtatgtatacccatatatctataattatctatctccattctgtctctcattgctcttcatagccagggccagtaataaggaaactaatgctgagagttaacatggtctgttcaaggtcttgtatcttgaagtgatattgctactgcctaaactttggtctcctgtcttcaagtccagtgctttttggtaggtagccactagggaatattctctaatttgggcgtgccttaatggcataccctaataccactggtgtatccacaagcctaagttgggtgtaccgtaggcccatccctgtgctaggtatggaatggggcagcagttaagatgcactgtccagcctggcatgccctcactcccaccaatttaaaggattgccctgtaaatacttcacagttccagtccaccaagacttgctgcttgtctgcatggatcttaactttcccggcctcagcttgcctttctgttgccgtttttgcttttttaaaaaatgtttttagttgtgaaatataacatagaaacaaaaaggtatgtagccagattaacaaactgcataaagcaaatgctcgtgtaaccatcatccagatcaagaaacataacattgctagcaccccagataccacccacatgtcccttcctaatcactatacccctgctccccactccgggaagccactagcctgactttccagtaatcacttgcttatcttcagagttttaccacttaactagggatacctaaacacactatagctttgcctatatttttgaacttaatataagtgagatcatacagtatatattcttttgtgcatgacttcctttcattgtttgtgagattgagacatgttattgatatagaacctttccattacctgaaaaagctttctccttcccttttgcagtcaaacttctcctacccctgtcctaggcaagtactgatctgctttctgtcactataggtaagtcttgcctttcgtagaatttcatatgaatataataatacagtatgtactcctttgtccctggcttcttttgttcatcacaattttttgacctcattaatgttgttgtatgcatcagtagtttgtttctttcccatgttgtgcaatattccatgttgtgaagatactacaacttgtttacccatccattcacctattgatacgcatttgggttgtttcaagatttttactattacagatgaagctgctatgaacatttctatacaagtctctctgtgaatgtaaattttcttttctcttggctaatatttagtaatggaattgctaggctgtataattggtatatgttcaactttattataaattgccagaggatttttcaaagtgattataccattttgcagttccacaatgcaacgtctgagatctatttgccccacatcattaacaacactggatattgtacagctttttagtttttaccattcttgtgggtatgaagtggcatctcttcgtgttcagtttgaaattttgattcttgatatgatgagtgatttggcatggaaacctggatatttcaggtattatgttatgagactctgggtctcatttatactttaacatagtttattctaacaccaatgcagcagggaaagaggggaataaatttgtatatccctgataacaagtgacagtgaatatattgtcatgtgcttgttggccattcatatattttcttttgtgaagtgtctgttttaatcatttgcccatttttaaattgggttcctggtcttgttattaaattataattgtgatttctatattcttgatgtaagtcctttctcagatctatggtttgcaaatttaccatttcattttttttagtgattcaaagagcaaaatttaatgaaatccattgtatcattttttcttatatagtttatactttttgtgtcctatcaagatttttgcctcttccaaatttgcaattatttttcctatttttttcttctgaatttttatagttttaacttttatgtttagatttatgaaccatctcaagttaatatatgtatatggtatgtaataagggttgaggttcatcttccccaaatgaatattcagttgtaattgcacctttttttttttaagtctatgttatcacccattaaatcactttgacatctttgctgaaaatcaattggtcatacatgtgtgaggctatttctggactttctaattttttcccatgatacatttgtctatccttataccaatactctacttccccagttgtttaatctttataacaattatttaagccagtcaatgtaactcctacaactttgctcttcttttttaaaaacttttatttgtaaactgccgtttttatatagttctatgaattttagcataagggtagattggtgtaactaccaccaaaatcaggatacagaacaatccaatctaggggtagcctatcaagacagaagtattttaggcaatgactatactgttttagcccaatgccacaggggaaaacaaacaaacaaacaaacaaacaaacacttttggcctgaccacactcacaccagcaaaagctgagtgggaaagctagaattctatccttgccaggctgtaatgaggctccagtgtcagagaaggctgagtagggagctaggactttcattccctccattcggcagcaaggcatctcctcatcccgtgatgccagtggagatcatttggggagcctggatttatgtcctcacaaggcagtaatgaggcattccatagactccttgctgaaatggtgtcagaggaggcctactggagattcagggtcaccatcttatggtggcaatgaggccactgcacccatatgtggtgtcagtggaggcaacatgaggaacagtaaaaaggtaacaactacctcttccatccagggaagtatcattgaaagcctactagggatctggatctcccacctctatgcagcagtaacaaggagcatcatcctgcctcaggtgccaacagaagtaatctgaacttttgtccccatatggctataaagaggtgacacttcattccctcttcccttgctgcattggtgtcataataaattatattaaacagaagatataaatgaggcctaaagtctcgtaacataataccccaaatgtcaagatatccatacaaaatcactcatcaaagaatgaacatttcaaatggaataaaaaaaaaacaattagttgatgcccaacaccaggatgacagggatatgggaaggatttgacaaaaatctaatgtacccattgtaaaaataatgagaaatttcaatgatattcaaacgtatttggaacaaatgaaacacacttggaacaaatgaaaaaatataacattttagcaaataaatggaaatagaaaatatcaagaaaagccaagtggatattttagaggcaaaaaatacaataaccaaaataaagagctcaatagatggattgaacaggaaaatgaagggacagaggaatcagtaaacttgaagttgcaatagatattatccaatcttggccaatcaagatatataatcattacacttattgtagaaatacactttaagatgaagtatacttttttttatttttttattttttttattatactttaagttttagggtacatgtgcacaatgtgcaggttagttacatatgtatacatgtgccatgctggtgtgctgcacccactaactcgtcatctagcattaggtatatctcccagtgctatccctcccccctccccccacccctccacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttagttccaagtctttgctattgtgaatagtgccgcaataaacatacgtgtgcatgtgtctttatagcagcatgatttacagtcctttgggtatatacccagcaatgggatggctggatcaaatggtatttctagttctagatccctgaggaatcgccacactgacttccacaatggttgaactagtttacagtcccagcaacagtgtaaaagtgttcctatttctccacatcctctccagcacctgttgtttcctgactttttaatgatcgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagtcagttttcccagcaccatttattaaatagggaatcctttccccattgcttgtttttgtcaggtttgtcaaagatcagatagttgtagatatgcggcattatttctgagggctctgttctgttccattgatctatatctctgttttggtaccagtaccatgctattttggttactgtagccttgtagtatagtttgaagtcaggtagtgtgatgcctccagctttgttcttttgacttaggattgccttggcgatgcaggctcttttttggttccatatgaactttaaagtagttttttccaattctgtgaagaaagtcattggtagcttgatggggatggcattgaatctataaattaccttgggcagtatggccattttcacaatattgattcttcctacccatgagcatggaatgttcttccatttgtttgtatcctcttttatttccttgagcagtggtttgtacttggaagtaaagctctcctcagcaaatgtaaaagaacagagattataacaaactatctctcagaccacagtgcaatcaaactagaactcagcattaagaatctcactcaaaaccgctcaactacatggaaactgaacaacctgcttctgaatgactactggatacataacgaaatgaaggcagaaagaaagatgttctttgagaccagcaagaacaaagacacaacataccagaatctctgggacacattcaaagcagtgtgtagagggaaatttatagcactaaatgcccacaagagaaagcaagaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaaaccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccgtcagagaatactacaaacacctctacgcaaataaactagaaaatctagaataaatggataaattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctatcagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaacgaatccagcagcacatcaaaaagcttatacaccatgatcaagtgggcttcatccctgggatgcaaggctggtttaatatatgcaaatcaataaatgtaatccagcatataaacagagccaaagacaaaaatcacatgattatctcaatagatgcagaaaaagcctttgacaaaattcaacaacccttcatgctaaaagctctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatgaggcgggagaaggaaataaagggtattcaattaggaaaagaggaagtcaaattgtccctgtttgcagacgacatgattgtatatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaagtatacttttttctgagaaaagtgggttttttatactgacatctttaaaaattgtaaaatatttctcttgttcatctgctacccattccccctactaattctatagaattgattatacactaattctatagaatttattatacccttaagactaaaagtttataataaaaatataaaagaaaccaataatgtttattacttcaagttttaataaattaagaaaatgccaaataaaaagaaaaaaaaaagagagaaaacagactgaaaacaaatgagcagagtgtaaaagacctgtgggacaataataaaaaatgtagtatttgtgtcataggagttccagtaggagagaagaaagagggtaggctgaaaaggtacctgaagaaataatgacggaaaaccctccaaattttgcaaaagacgtaaacctacaagaagatgcacaaattccaagcagtataaacctaaagaaatccatgccaagacataaacttctgaaaactgtagacaaggaaagcatattgaaagcagaaagagagaaatgacaattagaatgacaacagatttctcataagaaatcatgtaagtcagaaggaagttgcatatttttcaagtgctgaaagaaccaacaacccagaataccctaatgagcaaaattcttcaagaatgaaaagaaaatcaaaacattcacagaagaaaaattttttaaaaattatatatatatatatatatatagcccagcaggcctaccctaaaagggtggctaaaggaagttctctaaacagaggggaaataataaaggaaggaatcttggacattagcaaggaagaagacacaatggaaagagcaaaaatatagatacatatagtagacattccttctcttgagttttccaaattgatggttgaagcaacagttataacactgtttgatgtgattctaaatatatgtggaagaaatactttagacaattacattataaataggggaggttacgtgatgtaaaggaaagtaagttttctatacttcactcaaactggtgaactgacaccagtaaactgtgataaaattatgtatatataatatcatacttaagacaaccactaaaatagctatacaaaaagacatattcagtgacactatttatgaagcagaatggacgttcaacattattagccatcaggagaatgcaaataaaaatcacattgagatattgctgcaaatctgccaggatggctaaaaaaaaattcataaaacagtgacaacaacaaggctggggaggatgtggtgaaactgaatcactcatacatttttagtgagaatgttaaatggcacagccattctgaaaaatagtttggtagtttcctaagaaagtaaacatacaactatcatacaacttacgtccacataaaacctgcacatgaatgtaactttatttgcaatagcctaaaattggaaatggtccaggtgtccttcgataggtgagtggttaaacaaactgcaatacatccatatcatgaaatactactcagcaataaaagggaaattgttgattcacacaataaactgaatgaatctccagataatctaattgaaaaatgtctatcccatttatgattggcttttgatatgtatgatttcatttatacaaagttctttaaatgacaaaattatagaaatgaacagactggtagttaccagggttaaagagggggttggggagaaggtaaatagatgtggctataaaagggcaaaatgtggtatgcttgtggtaatggaagtattctgtatcttgactgtatcaatgtcaatatcttggttgtgatattgtgctatggctttataagatggtaccattgaaggaaactggggaagagtgcactggatttctttgtataacttcttacaactgcatgtgaatctacagttacctttaaaagtttatcttaagatttgagttatttgttggatgagagttcttatatattatagatacaaatcttttatcagatatgtgatttgcaaatattttctcccaatctgtagctttctttttattctcttgatagtgtcttttgcaaagcaaattttcaaaatcttaatgttcagtttaccattcttttcttttatgctcatgcttttggtgtcatgtctaagaactatttgcttaacttagcggtgaggattttcttttttgttgtcctttaaacatttttatagttttacatttatgccaatgtctatacactttttcagataatctctgaaacttcagtatgaggtttgagggttaggttgaggcactttttaaattgtgttttgtttttgcttatggatatccaattgctccagcaccatttgttgagactattctttcttcattgaattgcctttgcaactttgttaaaagccaattgacaatatttgtatgggcctattgcataactctactctgttccattgatgtatgtatctatctgtcagtatttattgtaactttgtggtaagtcttgatttaggtttactttgctcttgtttttctagattttaaggtagatgcttagatcattgatttacaacccttttttttgagacggagtctcgctctgtcgccaggctggagtgcagtggcgtcatcttggctcactgcaacctctgcctcccaggttcaagcgattctcctgcctcagcctcccgagtagctgggactacaggcgcgtggcaccatgcccagctaatttttgtatttttagtagagacggagtttcaccgttttggccaggatggtctcaatctcttaaccttgtgattctaccgcctcggcctccaaaagtgctgggattacaggcatgagacaccacgcccggcccttttttctttgttttttttttctttttattttttattacactttaagttttagggtacatgtgcacaacgtgcaggttagttacatatgtatacatgtgccatgttggtgtgctgcacccagtaactcatcatttaacattaggtatatctccaaatgctatccctcccccctcaccccaccccacaacaggcccgggtgtgtgatgttccccttcctgtgtccatgtgttctcattgttcaattcccacctatgagtgagaacatacggtgtttggttttttgtccttgcgatagtttgctgagaatgatggtttccagcttcatccaagtccctacaaaggacatgaactcatccttttttatggctgcatggtattccatgatgtatatgtgccacattttcttaatccagtctatcattgttggacatttgggttggttcctagtctttgctattgtgaatagtgccgcaataaacatacatgtgcatgtgtctttatagcagcatgatttataatcctttgggtatatacccagtaatgggatagcagggtcaaatggtatttctagttctagatccctgaggaatcaccacactgacttccacaatggttgaattagtttacagtcccaccaacagtgtaaaagtgttcctatttctccacatcctctccagcacctgttgtttcctgactttttaatgatcgccattctaactggcatgagatggtatctcattgtggttttgatttgcatttctctgatggccagtgatgatgagcattttttcatgtgcctgttttctaatataagcatttaacatcataactttttctctaagcactaccttagttgcattccacaaatttcaattacattgacttttgaatgttaaaataaccttgaattcctggaaatagcccacagtcgtgatgtattatccttttcatgtattacaggattcactttgctcatgtattgtttaaggatttttcctggtatgtttatgagggatattagtctaatttttttcctttaggttggcttcttctggttttgctatcgggatattattagctttataaaataaagtgaaaatatgtaggaaaacatctctgccacgttccactgacaacttttcatgtgttcacataggtcatgtaggtaaggcttaactatagcctgacccgagtcttgttagcataacctatgattcttcctggaacaaagagataaaagaagcctagtgagaagcttccatgagacagtttctcattaacctccctattttatgggaaacttccaaaacatgatttctcacccatctttctagtttcacttgagcacaagactttccacctcacccctacttagtttacatctataggcttctgtgtaagtgcataagtttagagttggttccccagtagcagagcaattcattgcccatgctgtctgtcatctggccgctctggttcattgttgtcctgtcaggtgagggacaggaggatttgacaccatgttgatctcacttttgttgtctgtataagtaataaaccatttgaatctatttgggcttgttgtctccttatcagacaaatctatggaattttggcaagccaacctagcagctgccaatgtgctgctgcttagagattgcttgacagcttgagaaggaagtgttcccctctcttcttttttcctgaaggtattttccttagtatcagtgttatttcttccttaaaatgtaatggaattcaccaatgaagtcatctggccctggaatttcatttgtgggaaggttattatttacaaagtcaatttccttagtagctgtagctattcagattatctgctttttaaatcagatttggtcatttttatctttcaaagaatgtgtacattttacctaagctatcaaatgtattgccataaaactgttcatagtatgcccttattatccttttaatgtgtatgtgtaggatctgtagtggtgtcccctcttccattcctaatgtcataaatttgtggtctttgtttcttgatcactctagctagagaattaccagttttatggatcttttcaatgtactacttttgttttcattttttttctaaattatttgtctaccactaatgctttcattcatgttttgtttgtcgatatctggcttccatttctgctgtctattatttctttcctacagtttactttgagtttaacttattcttctttttctgattacttaaggttgatgctcagaccactgattttgactttccttattttctaatataagtagttaaagctataaatttccttctaaggacttcttgccacatccctcaaattgtgatatgttgtattttcattataattcagtgcaaaaatatttttaatttcctttgtgatttcttctttcacctcagattatttagaaacatattgtttaatttccaaatacttgggttatttctagatattttattgttattgatttctgattcattttcatcatggatagagaatatattctgtaagatttcttttgaaatccatagttttttctttgtctctgcatatgttccatttttgagactgttccatgtacacttgaaaaatgtttattctgccattgttggttgtagtattctacaaatgtcaactgggttaagttgtttgataatatcatttagaaactgtatatcattactaattttttagttgctctatcagttattgagaaaagagatgttaaaattttcaactatgagtctggatttgtctctttcctcattatttctgtaatcttttgcttcatgtatttcgaaaacctgtaattaggtacatatacctttataattgttgtgtattcctgatgtagtaatccttttgtctttatgaaatattcttatttatctttcaccatactcttttcttgaagtctattttatctgatgtaaatagccatgccagctttcttatgattactgttcatatggtatttctttttccttttatttccagtttgtgtctttatatttaaagtgtacattatagatagcatactgttgaatcttctcttttaatctgatctgacactttctgtcttttaattgaagtgtttatttatacttaatatgggcattgatattatatttaggtgtaccatctcaatatttgtttttgacttattttatctgttctttgttcccatctctatttgctctttacctgcttctttttggtgaataatttttttagtattttatttcttagatatatcactgtttatgacttttagtggtttgtttagggctaagaatatgcatcttcagcttattaatgtctatttagagtcagtattttaccacttcacacctgacactttgcactttctacttcacactttctaattctcactttatatgtgacatttctcactttattattacaccacatagcaataataaagtgagaagtgccacatataaagtgagaattataaaagattttttataaaattataaatcttacaaaagtacaattccatttaccagtcacactgtatgctttatgtgatttttgtcatattctttaagtctatatatgttacaaatcttattttataaaccatatattatttttctgtaatcagttattttataccataagttctagggtacatgtgcagaacatgcaggtttgttacataggtatacacctgccatggtggtttgctgcacctatcaacccatcatctacgttaggtatttctcctaatgctatccctcccctagcccccaaccccccgacaggccccaatgtgtgatgtccccctcactgtgtccatgtgttctcattgtttaactcccacttacgagtgagaacatgtggtgtttggttttctgttcctgtgttagtttgctgagaatgatggtttccagcttcatctatgtccctgcaaaggatatgaactcatccttttttatggctgcatggtattccatggtgtatatgtgccacattttctttatccagtctatcattgttggacatttgggttggttccaagtctttgccattgtgaatagtgctgcaataaacatatgtgtgcatgtgtctttatagtagcatgatttataatcctttgggtatatacccagtaatgggattgctgggtcaaaaggtatttctagttctagatccttgaggaattgccacactgtcttccacaatggttgaactaatttacactcccaccaacagtgtaaaagtgttcctatttctctacatcctctccagcatctgttgtttcctgactttttaatgatcaccattctcattagcctgagatggtatctcattgtggttttgatttgcatttctctaatgaccagtggtgattaactttttttcatatgtttcttggctgcataaatgtcttcttttgagaagtgtctgttcatatcctttgcattttaatcagttttaagggaattatgaaaagtaatatttagaaaaccaagttccttcattattacctacttatttaccatttacattcttttaacttcctcctgttctaagtttctaaatgtggtaccatttcccttttagtagtgtaaggctactggcaatgaattctcttatcatttgtttatctaaaaatgtctttatttcatccttgttcttgcaggctatttttatggatatagaattctgggttgacaggatgattatttgtttttgttttggcagcactttaaaaatgtctaattccactgtctgcctgcttgctttctgatgagaagccagccaccttttgtatcattattcctgtgtatgtaatgtgtatcttctggcttttttcaagattttctgttatttttggttttcagttatttgactattatgtggctaggtattgttttcattgcatttattctgcttggattcattgggcttcttggttttataagtcaaagttttcatcaaacttggaaaaaaaatcagagccattatttcacacaatattcttctgcctcatcttcactcttttctccttctgagactatataattgcatacataatgcactatttgatgtcccacagggccctggggttttgttcagtttttgaaggttttttttttttttctgttcttcacatttgataaattctattaacttatcttcaaggttactgagtctatcttctgccttctcaagttgctattaattccatccagtgaattactcatttcagttattgttcttttcagttctagagtttcacttggttttgaggggatactttttatttatctgcttagattcccaatctgttcactcatcaataacatatttgccctaattcctagaatgtatttttcatagttgctttgaagtctttgctaaaatcaacatctggaccatctcagtgttgatttcaatcgactatgtctcaattttgtgttttttttatttttagcaatattttattgtatacttgacattacagatgatatcttgctttgtctgattaaagccaagactcagatatagacttgcaggagactccacatggatgcttatatgttgaattgtattttcccaaaatttatgtgttgaatttttaaccctcagtacttcaaaatgttttcttatttgaagataggatctttacagaattaatcaaattaaactaaggtcattaggaggggccctggtccagtgtaactggaagagtttggggcacaaagatacacatcaagggaaggcaatgtgaaaagatacaaggaggagatggccaactataagccaagaagagaggcctggaacagatcctttcatcacagctctcagaaagaaccaaccctgtcagcatcctgattttgaatttttagtctccagatctgtgagagaataaatttcggttgttgaagccacccatgttttggtagtttgttatggaagccctagcaaactaagacatggacttttggtgcttcctcccatttgtagttctcccatctcgaggaccacatcccaaagatctaaccattttttgcttttccaaactctgatctctgcctcttaacctcagtagtaccactatgcactgcttggattccagctcatttctgcacttgggaaattttccccatgcagagaactggagcaattgtggttttcatccctcgctctcagggattccagacttgtgttatctgttgcctaaagcctagtgtctaatttctaatgcctgaaagcagttgtcttgttgtttactgtgggggtgggggggggattctctggcacctgttaatctattatttctggaagtggaagttcaccatatttttcatctgtaaccccataaatttcttccactactgttgcatcatttcaaagtaaatctcaaacattatgtaatttcattctaactgcttttgatattttctcttttatttcggcagttttactgtgatgtgcctctcagtgtggttttctctgaattcgtccttcttgaggtttgcaggcctcttgactctgtggtttgataccttttaccactataaaaagtccttaaccactggctctcaaagtatttcttctgctcctgttttctctctcacttaactcttctcctcctatgccaattacacattgattagatattatattctttatgccccttactctctcttccatgtttcttgttagtttatctttgcatattctggctgttttattcagacctattttccagtttactaattctttattttactatatattttatgttattatacctatctagtgagtttattattttggttattgtatttttctgttgtgaaatttccatttgattctaatttttattttctattacctttgaccaaggaggtcccagatgttgcactcacttttctgattatgtgttcttttctatcttgcccccataatccttatcttttcagatctttgacattctagagagaatatattttaatgttttgactggaatttgtgtctatttttagtgggaaagctaatcccccattatcaaaagtgaaagcctcaacttttcatcttgattttcccatcatggtcaggcagccatgagccagggattcatctagcctccagtatagccctcatcacatttctttttcattcttcatttatcactataatgggaaatatttaagtaaagaaacagagtccaatttatttctacatcctcagcatgcagcacagtacctggctcacaacagatactcaggaaatgcttttagaataaatggaatacttagtctgtgcttcttaggagagagaagacttatgttgaactcaaagtatggctgggctgtggagagaatcgggaaagatatattccagaatctcaacaaggatttatggtcctctcagagtcctagttgtaagcaacagaaactaactctgaattattaaagcagaaaaaaagggtttctaggaagggtactgggtaggtcatagaattgctgggaggcttgagaatcaggtttggttgccatatgaccagatttacagataaaatcatatcactgagttagtctgataagagcagctctgttacactactgagcagtagaccctgtagcttgttcgccaacattgctatcactggcctctgattcccctggtatagatgctgcaggacatgagattctgtgccatattctctactgaccctgcttctcttcatcattagcactgacccaaaactgaatggcctgagactcagccatgtactgtgccgtagcttaaaaaagaagctgggaaagtgagtaactggtgtttttttcagctttctcaaacctgggaagagtgaagatggtgggcagtcaaaaaaaggatagatatccaccataagcccaaagcaggattgtgtggcattggtgcaactggcccatatatgcctatatggctggcaggaaagagctggcagaggattagaggggtgcaaacactcacacccatgtcctccaaggccatgcactaagatccctcatcttgtggtgtgggaatcttgggaagaagttgtccattttaagttttttctccagttgcctctctcaccgcatctcctacccatctgaaggtttatatacctcttgggaccaataaaccaatttgccacagacttcatacagagctccttgcctaccacacaaatcccagcccatatccttgctgttgtgcctttgagcacatgcagtggcttcctagggcttttctccagtatcaatggctaaactcaggagcttctcttgtttatgagagtgtcaagtcccagccctacaagtggagcagttgtcttttgtgaagctttggaaggcttcagagcaggacacacagttagaagtcctgtgccccttctatagtaagtgatttcagccaacgctggggctttggtgtttactgtgatgtttatgttcttatttgatttcttggcattcagaatcctcattaatatacatttgtgcctccctgtggaaacaaaggatcgtattctgtctgtatgtgctcacatttctttatttagcctggcacctgccttcttccccagcatctgtgttgttcccttgcaaatctccagagcttacaattcttagaaaaaatgatttctctctaggaagatttctatctttctctggaactatccttaagggctaagctcttgtgtcacaggcaggtgagctgcatcacccactccagcaggtggggccgctgcacatcccccagtcactggttctataggcccctctgagcagaggtaggcatcccaggccagtgactgctgcttctgtggaccctcttatgtcaagccccaaaagtttccaaggatgactcacatgcaaaaatttgtcacctgcattgggcagtatggtggtttataccagttgggctccaggccagctctgagcaagagggaaggtgtcactggagtattcatgagtggctgctgctcaccaggctccaagagagctggcccttgggttttaggagttagggggaatgaatgagactgtctctaaatagccctcaggagctgggccctgagccaggggacttcctggatggattactggactacaatctagatgatgggcatttggggccatccctcataagcatccactggggtctgggagcatactgtcagcctggccacttgttcacatctttatctctggaggtgacacagaggagacagcattgggtgattatgtcaagccaagctagagtcagccagacctgtaattatatcctagcttcaccacttacgtactttctgactttgggcaggttgcctctcttatctcagtctcttatctcctcatatgggaaatggaagggttcgatgagaatgtacttcacacacctagggcagttcctggcttatagtaggtgcataataatcaagatccattgttataaaaataacactgaacttgactgaaatttgagtcccaacactgaccccaactacctcagtgctgacaggaaagtcactcccctttctttgcctcagtggtcaaattggataacattccatgccctgcttccctccttagtacttggcgagttgcaaatgggatagagaacatgaaagaactttgattcctgtcaactgctgcccgggggagagaggattgtctcagacttaagttgggaatacaattggagtcagtggaaagaaagatgcagtcataatgagccaaggtggcaaaaatggtcacaactcaagcaggcagaatgccatcatgctgtctgggaagacactaagggagaattgctaagaaatccacttgcttttttcttaagcaatagccctgtcctctccaagcaagtgcacacgacccctgcacccccacctgagcacaggaatattcacacactggcctggcagaaaggaaatgacacttccccttgccttctagtggtgtagcctcagacaaagcatttcaccttacagcatcatgcaaactcaggatggtaccactcaccactctatgttgatgggggcttatgcaatattgtgaatgtggaggtgatttttagtctatagtacactgtacagaggtagggggctgtttttattatgcatctctgtatcagcattaaatataaatgggaatttgatttagactcagctaatgttttatacacacgcaacccctcctgtgccctgtttctccaggaatgtatctcccctgtgttgcaggccttgaaaagggattttgcacctataggggtgcgtgtgtgtgtgtgtgtgtgtgtgtgtgtgtgtgtgtgtgtgtattagtatgctggggctgctgtaacaaatacaacgaactgagtggtgacttaaataacagaaatgtatgatctcacacttctggggctaggagtccaagatcaaggtgttggtaaggttgatttcttctgaaggctgtgaggaataacttggtccatgtatctcttctatcttttggtttcccaaccatccttggcattccttgtcgtttagaagcatcaccctgatctctgccctcatcttcacatgacatactctccagtgtgtctctatgtttaaatttctccttcttataagaacactggtcgtattggattagggaccaaaccactccaatatgacctcatcttaacttattacatcgtcaatgaacctatttccaaataaagccatattttgaggtattggagtttaggatgtcaacatatcaatttggtagaaggggggatgcaattcaacccataacagcttgtattgatggagcactatttttacaggacacccaagtttctgctttccaagccatcaggcttctccactctcccaactcttgaggatttttttatcccttgtgtcctagccctggcacagatgaatgaaactttggctccatccagggtctaggtagctgatgacagaggcatgtgaggggccagagaaatgctaagccttatagccttgcacacttatctgcctgcacgaggatggagctcctggcattctctggaactgattccattctgttctctgctgatgccaatagccacccccccgcccccgccaccaccactgtggtgctgtggcccaactgtctcctgaaggagcactttccagctccttggctatagccctgctggacctggcctgttacatgcttgccccaaacagtgttcctgctgggaaactggtgtgactcagctgcctgtgaagtctccagggcaggcctgggtctacatgactgtggcatctctgcagtggaccatttgggtgtacatgggcctccctttcctttggcaatgatgcagcaccgcccccatcctctgctgctgtccctggtcagttcttgatccagaaacttccctattaatgatggtagtcagaatctgggccccattgttcctgtgctctggcttccaagaagctcagagccaagtgtattttggtcccagcgatctcacccccaggtcttagtgaaatgacctcttacctttctctgagtgtttctgtctctgtcttattggtttagttccactgctccttttcatctatgtttttactatgagccacctcaaatctttagagaagtatttatgataattatgtttttcttactgcaattttggttgacagaaagaggtttccttgagcttatttataagtgaggtgggtgagcaagcaggaaggatcttcacaagatgtggtcagtgtggcagaaagggccccaggcgtagagtgtagaggtctgggactgattcctggctctaccactctctagttctataaaattaagacaatctccccaagcctcagttttctgatctgtcaaatgagctaataatcttgctcttcccactttaggaagcacttatgggtcctaataagatttttaaaaattatatccaatactttcatagaccatgctgtatgtcagtcatgacattaaacatgttctatgtattatttcactgaacttgcacaacaacccattttgcagaggtggaaactggtgctcagggaaattaagagacttggcccaactcacagaagtcagtttccagctccaggttcctgattacctgttcttacccactgtacatcctgcctcccacagtgcatgtgaaagttcaagtgctggtgaaatgttttgcaaatataaggtacaatacaaatgcataaatgatgttgcctgtattttcattttttctgggactcagcttccccatttccatccccagaatgtagagattggcccccagatcccttagctctgcttcctctctgacaagctctcagtctgtgtgtatcttatgaaatatgcaaaaccagatacaaaaatgtgttatttattatactttttaaatgatcatatttgttaccagggtaaagtgatactcatgttaaaagttggcatgctgtttgtaattttggctgcatgatttggtcacgagacaaagtcacaaaatagcttggcaccaactagaacattctagatttgtgtgaggcccattccccagcaacctatcaaaagtcttggctctcccagcccataaaagcatgtgttgctaccaaagaataggagcttatgccatctgggcattcatgtcaagcctcctgaggataccagctcctgcaggcttgttttatgaggccagtgctggcctccacagtccctacacccagacagaagtgtgcaggggaagaaaattccccagaagggcctgtctttagctatccaatgggagtccctgggaggagtgctcattgctaaaaaagttggcctttttttttggaaggaaatgaggttaaaggcctttgagttcatcctcagtatcctctagagccacaagcactgccaggcttcctggctcccagccctctccaccacataagctgagaccttttcagctccacctacgggctgcttcatgcacacttgccaaggctctcaaacccatcctaagtcacttgcttatgggacttagaccgttgtcagacggggtcctagtcatgaggcactagggcaggccatcagcctgccagtcaggaagtggaaacctagcagccagaggtttgggtgctcagcaataacagggagcctcagatgggacatggggcaggaagggaggcagagtccaggcctgggacccaattcttgaactttttccttgctcccctgagtacctgcctacctctgggttcttcctctagtgccagtcccggttgtctggaaccacctctgcctcttcctatgcctgtgcttctgaggaatgggtccctacagttgtctccccaaaaggtagagtctctgaaaagacaccacaggtaatagggctacagaaagcattcagttcgcccccagggtagcagcccaacatctgtacaggagccagatgtctgtggtcccctttgacactgggtgcttgcaaagactactcagtcatcaatttcaaacaagaaaccctgcagtagaagtgagaactacaggccagtttccttcggtgcttagtaggtgtgagcagtgagtggacaagcagctcactggtgcttcttttccaccaatgggttgcttggctgtgccagcgcccttctcagctgaccacactgccacaaaagcaagctccacttggcttctcttccttgggagttttgtagggctgtgaattcccagggcttcttcccaagcagcctggcagaataagccattcaaacctctttctgattttccactgtctgtattgttccagcacaactcagaccctgttactcccttgctcaaatcattccatggctccccacggaatagaggctatagtccaaagtcagatgcacctttccaggccctctgtgatctgtgtgcagcctatgtgcccagcctccgctctcaggatgtactctgctcccccttgcctacttgagactccttggtgacattctctacttctctctgccgtgccctggcccagactatccttttcttcccagccccatggctacctggggcagcgtacctttcttttacagtgaaactctagtttgtattaaggccctataatatatcaaaatatggactagatgctttttacataacttttcatttagccatttcctgatgtcagtcctataatatagggacagtattattccatttcacaggtgaggaaactgagacacagaaatgttaactgcacacctacagccaatacgtggcagatctgggtatctgtacttagatctgtctgactctcgatcccttctttcttctacttggtctcatttctgtttcttagggctcacctccaaacctccttttggaacaactgtcccttttccttctccccctaccacactgggctcaaattccctggacaccagcattcctggcctctctcttgttcccatactcacgctctagcacccagcccaggctttgcgtgattcaggccaaagttaggcaggtgggagtcgggtctacctcagctggcctgggctctgggaaggggtggaaacaggcaggccctatcttggtcacctgcctcctcttcctgagtgggagcagaggtatttgctagaccatgccagtggtctaggctgcagacactgggctccgtgggtagccacttcacacctcctgtgtgtcacaagcaggcactcagtacatcctgcaggagttgcttgaattttagagatctgggggccttccctgtgaccctatcatctgatctctccattcagctcttcccaagggaattagagttctttgcctcctccttgggacccagggctgggttacaagaggcctaaagcctgtcacccctcttctctttcctgcccttgattccacgcacatatcctcctcccaggcaatgagcaaggcttccccagccatactgggagaagccatagggattgcagctgaaggtcaccaaagactgaatctgagagcaatgccatgccttcaggtcctggggctgggccccaagtgcctgctgcaggctgccggtcagtcacaagtatgcaccccactcattgggctcccaagcacccaaaaagagatgcctggcaaggctaggctgtgccttttgctcagcctatgaaaatggaactgtgcttagggtttgaccaagtttttagcaagaaaaagcaacccagcaacatttcaaaaaggaagtttccattgcaggatctgagatgtcatggggtgcatggtagaggttggcaaattccaagaggtttgttctgggattgtatagacctgcaaactcccactatggtagctagtggctactagctacctctggctatttttacataaattaaaattaagtacaattaaaaatccaattcttcggttgcactaaccatcacatttcaagcgctccataggtacacacggctaatgcctactatattggccaacacagatctgaaacattttcatcatcagaaaaagtttcatcagagagcacttagactgttcaggccaggaggaatggatgtggcttgaactcctgctataaatatgcttctgcatccttcccacacctcctgatcctgcgcaggtcattcttctctctcaagtgccatatgtgtgtgaatgtggcaatacccacccccgtccccacccatgcatggtcttctcgagtggtccaattttcttgcctatcttgtcttactgtggagtttatcttcaactttcactgcagctgaaaagtaaaaagctttactagaggagcatttacacaaactaagagagtaattggagcctctttttggataccgcttctgacagtggttatacaaaagttaggtggagtgaactgcccatggctgagaaccaaatcgaaatacaattgatacttgagaggctataaaaggattccccatgtccagcccaaggaaaagaggactgaagctaattttttaagccagaaatgcttcttaagtgatgttgtctgtcaggatgaattctagccatttgctggtatttaagaatttgtgaagaaataaagatccagcttgaccatcgaggcctgccaattgagagctggtctttttgccttttttataaatcatgggcagtggaagggctgtcatctggtctatggagctttgagagaggaaaggagcatagaaggaaagtggtggttcctcggaaagccagcctgcctgctcagggactgctgagaggtttccaatgcagagcagataccaagccttccaacaccttccatttatggggcctcctattcttcaaatgaaaggaagtgggggcagggagtagggtaagtataggaaaagtcctaggagaaaccaaatggataaatgggcaaaatgcgccactcagaatccactttcttaatagccttgaatacagcaaaaaggtacagagagtctttctgcagtttcagcttgtgataaagcatatcagacctggctttgaatgagcaatagccatttctattaccctagttctctcctcacctatcctatcacacatacatactccatccccatcttggcctcattttcaaaaatagggtgtgtcccattggaggtaaagggtataaggcatctcactgtattatttcttacaactgcatgtgaatccattatctcaatgtaaaagtttaaacataaagagaggtgaaagaaagtagtttccaggctggtggcacctcagatcagccccttccttctctaggcctcagtttcctcctttataaaatgggactattggagaagatgatctctgaaggcccttccaggtctgccgtgctagaacactggccagtgaaaacctaggagaactctgaacaacagcttttctgggggcaaccatggggtgggctgagcagaggctgcatctctgcttgacagagacaaagaggtggcccagaaaaagcagcatggctgtccagggtacccagcctgtcagcactaggctgagtctggaaatcaggccacatggctctgagtctgtgctctttacccccttgtgagtcccatacagtctacagatgggcaggagtcttgctataggcattttctcctgaagctttgtccctgctttatccttggtgacacaaggctgcagctcaggagggcaggaattgagcatggaaaccatgctggaaagaaagtatgggatggtattgttcagcacgatattgtctagcatctgggacaaagctgtccctttgtcaccagaaagctgccacagtaggggcaggtcttcacctcagggacaagctccctggtccttctgtgcatcctgccatcagctccagtgaagcaagctcacttcctgtcctccccataaagattgtttagtctggtacctccctttcgccctgggagatggctgccttcgattgatttatctgggaaagtatgttcaaccttgccaggtctattggaagttgcagagcatgtgcattttaagccctttggtaagaggggaaaacagcagccttacatcctttatcacaatcaagtgtcttttaaagcagagatcccaccatgtgactattgattttgcactggagctagcatttggtgaggctgtctgagatagtcctcacttgcccatcttcccccttctccacctgcctcttctttgcagcagcatgcagggtagctaggagatacattatggaaaggcacctgagcaccaggctgctcagaggaaccccaaggagtgcctcttcccttctgccctaagagtagatggatggggctccctgtcttcaccgggatagccatggcatggctcctatgaatcagaggccatcctactgccctcagaggccccacccaggactggggaaaactggcagggtgcccagtgctctgtctgctagtggagcctgcagcctctgggatgagggcaggcaggaagaggcaggcagacagggctcaagctgatgagctgagacctttggagacataggttgctgcattcaccaaggaccctttcctctgcacggtcaaaacagctgataacagtgtgacttccccccaaaaagcaacagaggccagcatgatgtcatccatgtctggggttggcggtggggggcgggggctccacatgtttgggctatttttgtgatcaacagtaaaaagccctgcattagtcatgtcatgcacagaaatctgtctcatttcactcccgaatcctctcttattaatgcaataaatgaaagggggctctggaaagaactcctgaatttggcttctctggtggtcagggcccaacattccctcagcccccagcccctggctcacttacttgctccaccatccaccattggattgctccaccatttcaccaacatttcctgtgtccaaatctgagcccaaaactgggagaaggggctaaggattgggccttgtccttgaggagcccaccatctatgaggaggcaccctggagaggggctggtgggggcaggggaggtgagagtggtctctcccctcttctcagagtgtgctcactcagctagcagctgctgaatgaaagagggcaaggaatgccttaacactgagcttttcaaacactgcaagacctggtacccttttctatccagtgtctgtgctgacagaccccggatttaaaaaaaaaaaaaaaaaaaaaaaaaaaaaaaaaaaaaaaaaaaaaaaaactactgcttgggaggcttttactgctttttggtctatggagttatttctagattgggaggcacaagtctagactgagctggtctgttgctagtttaagagccctgaatccgcaattgagtttttaaaagtaaagcatcttggttacagagcgcatattccttcagttcctaagagctgcatgacagactgcttatattaagaaagaaaaggcaaacaagagtctgttgactataaatgttcaaagcaactggcaggatcatctcttgccaagatgcagcctgagagggaccagtggctgggagtgagggctgtgctgtcccaactggtgcaatggctaatcctacccatgacctggcacaccacctaactgcccgaacagggaaacagaccagacagctcgcacctcaggagatgccccgtgagcacctatctttcccttcacctaatctgataccattgtatcctttcctccctgctctgttcatttgggattttgttggggtcctcggtgaagaaggtacctctttgaggatttttctagaatgcttctgaaggcagcatcagcagcatgtactagccacaatggttactattcattcattgagcacctgcagtgtcccaagaactcaactattgtcctggtaatatctcttaagggttgtgagtctaaaaatcttaaatcatttaaaattaattgcaataagtaaatagatacaaatttgacataattttagacttagagaagttgcaaaaataggacaaatcgttcacatatacttttgtccagctcccttaatgttacagaaacttacataactttggtacaattatcaaaaacagataatcaacattgatacaatactataaactacaggccttaggattgtgattctattattgcccttttacacatgagaaaactgaggcttagagaagtgaagtgacttgaccaaaggttccactcccaggaagtgggggagctgagattgaaactcagggttgcctgcccattctgtcctctatagcacattgcttcagccagtgacagctggcgattgtgtctctggttcttgtttaaacaccattagcagctgtatcagtttcctactgctggaggtaaaaaattaccatgcactttagtggcttaaaacaacacagcatttattattttatacttctggaggtcagaagtccaaaatgaatttcaccgggctaaaatcaaggtgtcagcaagattgtgttccttctggaagctctcaaggagaagctgttccctttccttttccagcttctagaagccactgcatttgttagtttgtgccgcatcactctgacccctgcttccatcatcgcatctccttctctgactccctcttaaacctttgaaggattcttgtgattacactgagcccacccagaaaagccaggataatctccctattttaagatctttaaccaaatcacacctgcagattcacctttgctatataaggtaacattcacaggtttggagacttaggatggggacatctttgaaggccaattattcagcctgctagagtcatacataaactcaaggataagaaggtggatgtcagagaaacaaggcatctcatgcctggttcaggctgggtaccaaggcatgtccaatcccttggtagcataggatgacaagagaagaaaaaagaaggtaagttctggtgaacagagtactaaaaccaaaatgtactacttgaaaagaaagtaagacataaagtaagaaagtaggtttccaccatgacagtcaacatcctggggtgggtgatggggggagcaagggcagtcacagctggagaggtgggagcacaactgaggttcagcagaggagattgtccagaaagttcagaggacagagaagagtgcagtacgaaggatggcatccctatagtttaacaaacctgcccacaagaccatcagcttgcctatattgtcaccagcatgtccccagtgtggcacaggctccagatcaatctgatattctcaaggccatggtgtccaaagttcccactgtgactgcaaaccccaaagctgccttaagcttatggagtcctttagagcctgttctggttcttattacatgtcacaaagtaggcccagactacctcccctgagggcctggaatagaaacctccatccccatccttgtatggatccaggtagagccgccatcccacagggagccatggcaggccagtggacagacttggggaaagatggcttacagaggcgcatggaaaccccacctcatactggggggtacagtgccaagaaatggcagcgggtcacaaggctggctctggcctggggagctgagaaatcctagcgtcccagagtggacaggccccatagcaccctgcccttggcctcccacccttggcaggcaatccctgacagatggttgtccagcctttccttgacctcacccccatgatgagaaattctcttctctctgagatatgtgattagaaacaggcctctctggcttcagcttccatcagccagtgagggggccctaaatatcattcagataaaatctcctccctctttctgcacatgaaaggcctttggctgtttgaagccggtttctgtgctcctcctgtctcctgaccctcacctctccaaccccccaccaaacacagacgtcttctgagctgaagcagtgggacaagcagggtgggccaagctggcagctgatgctgccacaggggctccgggcaagtgaaggacagcaggtgtatgtgggcttctgcagcgggaccttgccatcagagcataagtgctgtcctggcttgcacctggggaaggatgagctgtttcctctctcccttacgtccccttccttttccacatgtatgcctatgattagaatccactaattgcaatagaactgacaagagaagaaattgcgaactccagctcaagagtcatcttctcttggagacaaactgatcatcagacccctcatggcttgaggtgcatctagggtaagggcaggcagagtcaccagtacttttctatccctgcaggatgctggcctgagggatacagtcaggcttctccctgtcaggtacagtctgcctaatttgctcagcatttggatgtgatactaccaaccttaattttaccaagtgcctgctttgcccaagtgcaagccaaggccctgggtagtgtttgaaatgagcacatggtctttgaaatgagcactctgacgcattaggtttataaatgcggttaccaggaagtacagaccaaagagagcatcttgaccctgggaatgagtcccatgtgtttggagtgcttatcccaggtatgcttgcaatcagagagaacacaaagctccaagttgggagtgttgcttgactcatcaggaaagcatacagggactggtatagtgatagccttaatgtttctgtaggagaaagaacactcggttgtggctgtcagtgtcaagatggtcagaaaatatatgttgcccttacatgaatctctcaacctcaattggtctatttataaaatgggggtgggtggatggttgaaatttatggtttctaaaatctttaatgctctattactagagtcgtgtttccacagggcatgcccctacctgggagtatcttttgattggtcacgtaattaacagcccagttgccaggccatcaactcaagcccaggccttggaatcacagttggagaaggagccaggcctcctgccccctgctcttcctcctccctcgcatcctttttccatgaccatgtatctaacactctgttagagtgacttccccaatttagaaggagagtgagaactctgcattcaaatgtctgagcagtctatttttatgtcagcaaagatttctgtggaaagtcacagggaactctgccctgtgggctacattacccccacagaaggcacaataatatttggaaagatccagagttctatgcagggctatgcattctgcttcaaaacatgtatttatgtctccttgccccatcagggcccaggatcactgcaccttcaggatgaagacattaaagatatgcagtttgggtacagaattgtgttgagattgggtttttatgtaggaattagacactggcttagagaagagccctctttcaaaccctcaaggaagggtccatgcccttattcaatatgggagaggcagtgagtgttgtagtgtgccatgatgctggacaaggtgtctctgttttcacagcctcagtttcccttgctgtaaaatgatgacaagtcatgtctaagggccccacagccaggccaacctgggagcctgtatttagggcttgttcattagttgtgtctccctgctgcctggctgcatgacccctggggaagtggccaaatgaggccacatacaactccatttgcagaaataccttgccaggccccaggtgttttctgggagagtctcagttcaggtctcagctttgaggtatggcttttgactactgctcacttcagcccaggacagagtattcaaaacaggagcccttgtagcctggccagggagaggctctgcatcccatctcagtgaaggccacatgtcctgcccccacccttctccaggaaagaatgcctattgtgtgtcctgtccaatgacccccaaagggaagggcagtccccctgaagagctggccttgggaatagctgaattttcactaaacaaggcagaagtgatgctctctatgctcactgcctacatcattaaccgacagaaaaaaaaaaaaaaaaactatctctgctatcagaagattcagctagacctttagtgctgatgactcactttctcaaaagcagagtttctctatttctttccaagtaaaatttttaccccttcttaatgactgaatgaccgccaggcactgggagaaagcagtccttcagcagccaccatgtgggcacacccagggcccagcaggcagcacactgtcagcaggcacccacttcccctttcaactccccaggatcaagagtaacaaaggccaagcctccctactgggagggcttgcccatcagccaagctggcattgcccagggaacactggggtcttggcaaggcaactctggaaatgaagttgtaagtgacctcacttggccacttttccaggagggcatttgctccttctctgaactccggcggacaagtctatagtgtcttggaatgacctccaagatcctgccataacattccccatccacttgcctcctctgtgagctgggaccagtaacttctgcccctaaggaagctgacctggtagttttcgcccctctccctccattgcttcttttaatcctcccagcacagtaaagggtggaaaataattatccccatcctacagatgaggaaactgaggcatctttttagctgcagacttaggatttgaatcccaatctgtggggtccctcatgtagggagactgctcccactgcttcctggctggccttgggctctctcctagaagccatgataacctcctcatctttttttgttctggttttccctagcttgataaggtcttggtcttcccagagagctgggctcttgcactgggggtagggtggaggttgggcagcacctgaataacaaaaccttgctgctctgccaatcctccagtgttgagggacagaggcatggtggtaaagggatgggaggaggcagagtcaagttcacatagtgtggagtaggaatccacgcctgaggaatggcaatagggaaggagaagatggggccaagtcgagataagtcaaggaggcagaatctgcagagcttgaaaataattggctgtggaagcaaagtaaatgggaagcacctgagatgactcacaggtttctgactcaccggccattgggtggccggtggtgtcattttgtaagacagggaatccagaaggagcagtataggaatgtaggggtggagacaatgagtttgattttggaaagatagagttttaggtgctaatagggcactcaggtggaagggtgcccactagacagttgggtatccaggactggggctcagggcagagggagggtctagggtggagatgctaatttgaaggttattgactactaaacttgtgttgttcaatatggtgacttctagccacgttgctatttaaatgtaaattaattttaattttaaaaagcacagtataaaatttctgcttggggtgatgaaaagttttggaaatagtggtggtcgttgcacaacaccctgagtgtaattaatgccactgaattgtacacttagaaatagttaaaatggcaaattttatgttctatatattttgtaattaaacacagaaaagacagaagtttaaattaattacaattacctgggggcagtggcacgtgcctttagtcccagctacttgggagactgaggtgggaggactgattgcctgagcccaagagttcaaggccagcctgggcaacagagagagaccctgtttctaaataaataaatacttaaatgtttaaaaaggaaagagattttaaaacataaattaattacaatttaaaattcagctcctcagtcacactaattatatatgcagtagctcaatggatatcacatggctcctggctgctgtactgggcatggagatatgaagtatttccatcattgcagatgattcactgtagatggtacctacctgaaaccctgggtcttgctgggattgctggggggtatgtaatgagagggctggggcaaccctgtgcagagatctgacctttgagagcagagcaacagaagaggagctagcaacggaaaccagggagacaaatgctgatgaagcgacatacaacatgctgagggagcccaggagacagcaaccaaccacatttcagaaaatatgcatgccttgctgtttccctcaaatagtccatgttgtcctgtccctgggccttgcttcatggagtgccttatcctgggaaccctgccatcatcatccttcccatccctgttcagacgctgcccaggatttgaggccccacacagtcagctcctccccatatggctatgaatccagaatctcccaaccagacggaaacagaaccaggcactggcggtttttcagatttattaggaagactttttacagattaagacctgcagatgggtttgcacaggggaatcagctctataccctggtgtatatgtgggactctgtccaaatctagaaatgccaggcttctgaaacccagcagacaggacctgcatggtgccttggggacagtcaggtgccttggagacagccctatgggcaatggtggagagaaggagggcacggcaaactcgcacttaccgggcaaggctgcacacactggcagtgctcttctagctacctgtggctgggggtgcaagggagcagggctcaagagtggcccagctgcattgcatgtaggtgcattctgtgcctgtgcttggagctctgctctagtgaggcactgacagcagccccacagggaagtttgttgggttgtttcttagcagcactatggtgggcatggaggcagattggtcctgcacatagacctctgctccattaagacacagcctgtgccctggtagaggcccactgagcccagattcagctccttgctgagatgggctcaaagtagacatgggctgagcctccagctagtgctgtgcctcaggtgaaatcagccagcaaactcttgcgtcatctacttctgctccgccaacccaggctgtttccttgagttgctgtactcagtcaatgtgtaggttcagcctgcatctggtccttggatcaggtggaagcagccagcaaccccttgcagcaactctttctgtttcactcaccagactgcagttccatgaggagcttcacttggtgtggacacatgatgactctctgcaaagatccccagttaggtgcaaccagttttctcctgcagtggctagttctccacttctctgggtgctggctgtagaggcaggcaacactggcaggtagagccccagttcttcaataaacagtttgaatctacttgcaaagcattactccatgctggtccagtgaggcgctccactccatgtagacacaggctgcgtatccactagcagtcctggctcatccctgtactggctgtaattaggcacagagggcatttctgagctgatccaggtggtggtgcctgctggagccatgcacactgtagatgtgggctgcatctccacaggatagcctgatgcatttccacagacaggggcttgtcctgtgtggatacaggtggaagttccttgagaagcctcattttgtgtgcaagctatgtggttctgtgtagacgctgcctggttatctgcagatgcaaactcaatctcagtaaacatagcctccttctgtgcttacacagccttcttggtgacagataaaacctcatcttgggtagacacagcgtcattttgggcaggtgcagcttcatcttgggaatgtcccaccttgtcctgggcagccatagtttggttctgtgcagacacagcctgtgatgacacacagagtttttgctcatgtagacacagtttatggcctgttgcagggcagctgttgacacagccaacatcctcttgtggagtctgtgctgtgtagatgaggcttgagcttgcttactgaactgtgttctttgtagagacagtttgtatctgggtataaagtcacctcctgtgtggccatggcctgcagaagcctgccgaggctcatcttgtttagatgttgtctgcacctttccactgagcctccttgcacagatatgcctgcattgccttatgaaatttcacttggtcctgacctagccagcaccaccatgcagagctgtgcaccacatggatccatggggggtcttgaagagccacattcatgactaatgcaacctctgcctccagggaactgccatcatttttctgcagagctgtgatccacacagtggcagtgtgcatcactgggaagacccacagtcctcatgttggtgctgcccgcatctcctggctgggtgctatcctccacttttaccgtctgcctcttgtggcagatcggggctctgtatgtgcagttggcttctgcctgcagggctggacttgacagacacagcaagcatctctttgcagttttgtcctatggaaacacagccctgttttccttgggaagttttgtcttgcatggatgttgtctgtatctctttagggagccagattccacgtagatgcagcccacatccactagaagagcctcatatcatgtagatgcagccttcatccccacatagaggcatccccacacattcttgtggagtggagctacctgtggatccagattgcctctgaccacctgccttgtgtgctgccccaggttactcgggtggcccagtccctacagctatggctcccccacaccgtgctgctttctttgctgtgatatctgctcaggcagcagtgatttcagctccgccctaggacccaagttcctgcttggggccccggcccccttggaaccccagctggtgccagcacagcctgcctccatctcctgatggagcaggaggaacccaggtaggtggcggggtgggggtgggatggaacaaccaagaggagacagactggaggagagcaagcaagctgacaggaggggccagccaacctcagaagccaaacatgcaggctttggctgaagtgggtgtatttatacaaagagaaaggaggtggaaaaaatccactgccactccctgcttggctcaagccctggtctgggtaaagcctggagagtttaatatgactgactctgagtcccagccagtctacttccaggacacagtgaagacagccctggagagttgctcctgaggagatgactccccctatgcagtggccctgtccaggtcagctggaggccattgctccaaaggaaggcctccccatggggcagagcaggcacacatgagtcctcagggtttccaatgggaagagaccttagaggcagtgcagactgctgtggttggcctggaggccgggacagaacccagagcccaggtcccactcagccactaattccctgaataaccttgggtaggtctctcacctctctgagcctaagtttcatcatcttttaatgacaagtaccatgactgctaagattttttgctgctctcactttccaggattgttggggctcttttgttcccccaaccccctttgctttacagatgggtggctgaggccctgggaagtggcaggctctggctcacccaatgtccacagtggcacctgagctagaacccaaacgctcttgctctaacactaggcccttttctcctggtccttttctagagaagtcagcagtgtggtgctagaagatggagcccagcttgcaggaggcccagagagctggcactggggagaccacaccttcatggatctgtgatcccttcactgccaaatcctcagcctgtcacaccaagaagatactggccttctggcagataaagtggaaggtgaactcagagcagccctatcacagtggccagcttcatcccaggctcagaatccaagagcatccttcactggctccctggtcctagccgccagctctgggaggagtcagggcccaagtcactgggcccaggtcaaggcagaggagctgaagcccagagagggaaagaaagtgaagggtgcaggttggcagcaaccttgtgtgttgaaacagaattcctggggagggaagcaaaacaacattttcctacctccgtggctccctgaggaacagtggcagcccaaagatgggactcctccctctgttcacattagccagccctcagcataccatgatgcatctgtgcaattgccatacttataaagcatctttctcatcaatgaacatgtgccagaagggatttattgcccccctttttctctatcagtcagatatttactatctctgtccttgtgtgaaaatattctcagaagtgccatgagaacatttcctattgtgagattgccaaagaaccaaggcaaacatcatacatctttcttgggaaaatgtctcacgaccttcaccaaatcctgggggaaactcactgcagtctgacagtcctcagatccctcccagtcctagacctggctcctggctctcaaataggcttaggctaatggagacctggattccagtctgagctttgtcatacatttgatatgtcacgtaatgcaggttctttggactctctgggccccagattctacagaggtggcatgaagagggttttacctagatgggggtgactagcctatgctctgaggatgaagcaatttttggtgacctagaaagttataaaatatgccaacatcccaaacaaatcccaatatagagcaactgctaaatagtgagcagagaagtatcatctggtagataatgtcagtttcagcaacctaacattttagattgatgattcactaacaattacattattttatagtgaattattaatcaaagctaacattctgtgccagtgccagacaatattctctatgtcttgtgaatattgactcatttcatccttatagcacccaccgaggtgggtactgttgttatcccttttcagatatgagacaactgacacacagagagaggcatattgccccaggtcacacagatagtgtgctggagcttggattcagttaggccaggcgcttaaccactgctgtcttctgcctcctgttgaaacacttggcaatttctgtccttccattaagttacatcatctaagctctttgagtctcaatttctttattcgtataaagggaaactaacaggacctacctcatagggttgttgcaaggatgaaactagagaatgtgccagaagagcctgctctacagtgcatgtgcaatacattcttactgttgtaaatggtgcccatgtcagtattcacatcctactctggcatgtgccatctgtgtagggacattaatggtttataccgatttaaacttgctatttagggatgttacaataatgattctaccagaagtttcagatacaaatgcaaccaacaagcattgtcaagcactttcacatacatctcctggggcaatctgtagacaactttgcaaatgtgctattcctattttgcagatgagaaaactgaggcttgtaaatttcccaaggttacccaactcacaggtggcagagctgggactctaacccaagtccaccactcactctctgctacacagtttggccacccctgtcctgaaatgaaaaacctcttaggtttttcaagagacttgtgtgctttgattcagagatggataagctgagtaaatgcaacagagaaacatggctctaaggtccctcccactccaccagccaagagccaaagctgctttcacctggacacacttctttttttttttttttttatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatgagtgagaatatgcagtgtttggttttttgttcttgcgatagtttactgagaatgatgatttccaatttcatccacgtccctacaaaggacatgaactcatcattttttatggctgcatagtattccatggtgtatatatgccacattttcttaatccagtctatcgttgttggacatttgggttagttccaagtctttgctattgtgaatagtgccgcaataaacatacgtgtgcatgtgtctttatagcagcatgatttataatcctttgggtatatacccagtaatgggatggctgggtcagatggtatttctagttctagatccctgaggaatcgccacactgacttccacaatggttgaactagtttacagtcccagcaacagtgtaaaagtgttcctatttctccacatcctctccagcacctgttgtttcctgactttttaatgatcgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgttttcttcttgtaaatttgtttgagttcattgtagattctggatattagccctttgtcagatgagtaggttgtgaaaattttctcccattttgtaggttgcctgttcactctgatggtagtttcttttgctgtgtggaagctctttagtttaattagatcccatttgtcaattttgtcttttgttgccattgcttttggtgttttagacatgaagtctttgccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagtcagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgccttggcgatgcaggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtcctttacatcccttgtgagttggattcctaggtattttattctctttgaagccattgtgaatgggagttcactcatgatttggctctctgtttgtctgttattggtgtataagaatgcttgtgatttttgcacattgattttgtatcctgagattttgctgaagttgcttatcagcttaaggagattttgggctgagacaatggggttttctagatatacaatcatgtcatctgcaaacagggacaatttgacttcctcttttcctaattgaataccctttatttccttctactgcctcattgccctggccagaacttccaacgctatgttgaataggagtggtgagagaggacatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggttgttgaattttgtcaaaggccttttctgcatctattgagataatcatgtggtttttgtctttggttctgtttatatgctggattacatttattgatttgcatatattgaaccagccttgcatcccagggatgaagcccatttgatcatggtggataagctttttgatgtgctgctggattcgttttgccagtattttattgaggatttttgcatcaatgttcatcaaggatattggtctaaaattctcttttttggttgtgtctctgcccggctttggtatcaggatgatgctggcctcataaaatgagttagggaggattccctctttttctgttgattggaatagtttcagaaggaatggtaccagttcctccttgtacctctggtagaatccggctgtgaatccatctggtcctggactctttttggttggtaagctattgattattgcctcaatttcagagcccgttattggtctattcaaagattcaacttcttcctggtttagtcttgggaggatgtatgtgtcgaggaatttatccatttattctagattttctagtttatttgcatagaggtgtttgtagtattctctgttggtagtttgtatttctgtgggattggtggtgatatcccctttatcattttttattgtgtctatttgattcttctctcttttcttctttattagtcttgctagcggtctatcaattttgttgatcctttcaaaaaaccagctcctggtttcaataattttttgaagggttttttgtgtctctatttccttcagttctgctctgattttagttatttcttgccttctgctagcttttgaatgtgtttgctcttgcttttctagttcttttaattgtgatgttaaggtgtcaattttggatctttcctgctttctcttgtgggcatttagtgctataaatttccctctacacactgctttgaaagtgctggacgtacatcttacactgtccagccagtttgagtttagcagaagctgaagccttgagttgtcaatgcatttgcatttccgacagctgaatccactctgatgagctgtacctcaggctccttgttttaataaaaggtctcttttacagataaaaataaataaataaaacaccacatgtccactccacagggtcactccttacaatgaaactgagattttactctccctccctcttacttcccatttccattgtctaaagattctatgaaaaaccaagaaaggtccaaagagctaatcaaaaatagaacagtcattttttctattttaaataacagctttagtgaggtatacttcgcataccataaaattcaccctttaaaaattctctattctttaaaagtgtacatacaactcagtgattttagtgtattcacagaattgtgcaaccatcaccactatctaattccacaacattttcatcacttcaaatggaaaccctgtatccattaaatagtcactctccatctcatctcccctagcccctgacaaccactaatctactttctgtctctattgatttgcctattctggacatttcacattcatggaatcataccatatgtggcctattacaaatggcttctttcacttagcataaagttttcagagttcatccatgttgtagtatggatcagtacttcattctttttatgaatgaataatattccatcgtatggatatatcccattttgtttaccccttcatcattcaatggacattggacttgtttccaccttttgactattattaataatgcagctatttctgtgcaagtttttgtgtagacatatgttttcatttctctttagtatgtacctaggagtggaattggtatttcatatagtaatatttaaccttttgaggagctactagactgcttttcaaagtgtctgtaccattttacatttcaaccagcaacatatgaggattctgatttttccacatccttgctaacatttgctattgcccatcattttgattgtggccattgtagtgggtgtaaactggtatctcagtggggttttgatttccatttcctgaatagacagtttttgtctattcgaatagacattttttgatgatcatgtccatcatgattttgcccatcatcttaaatttgtgttgtctttttactgccaaactacaacttcttcttcataaattctagttacaagtctcttataggatatattatttgcacaaattttctcttggtctatgtgggttgtcttttcatgctcttaactgtatctttggaaaagtagatattttatattttgatgaagtccaatttaccaactttttcttttatggattgcactttggtgtctaaagaatctttaccaaacacaaggttgcaaaagattttctccaatgttttattctagaagttttatagttttaagctttacatttaggtctatgatacgttttgagtcaatttttgtatacgttgtatggtagggattaaaatttattttttgcacaagggtgtccaattgttccagtgccactgattgaaaagactgtcacttctccatgtaactgcctttgcacctttgtcaaaaatcaggttttgtttttgtttttgttttagagacaggatctcactctgtcacccaggctagagtgtagtggcatggtaatcttgaacccttgggctcaagcaattctcctgactcagcctcccgagtagctaggactacaggtatgcaccaccatgcctggctaattttctaaaatttttgtagagatggcgtttctttatgtttcccaggctggtcttgaacccctgtcctcaagtgatcctcctgccttggcctcccaaagcactgaaattacagacatgagccattgtgcccagcaaaaataaataaataaaaaatcagttttctatatatgtacaggtctatttctagactctctgttctgttccattgatctatttatcttgataccaacatcactgtgtcttgattactatgttgtataataaatcttgaaatcaggtagtgtaagtcttccaaatttattcttcttttgtcaaagttagtttagcaatactagatcttttgcattttcatatgaattttagaatcaactcgttaatttctactcaaaagcgtcctggaatcttgactggtattgtactgaatctacaaaacaatttggggaaaattcacaccttaacaatgttaaatccttgccctgtgaacatagtatatctctgtttatttagatctttttattttctctcagcagtgttttatagtttttacggtagaggtcctttacatcttttctcaagtttatccctaagtattttgtatcattgatgctattttaagtggtaatttttatttcaatttctgattattcataggtagtatataagaatgaaactgatttttgtatattgatcttatatcccataatcttactaaactcacttactgcccctttttgtagattccatcagatttttctacatagatattcatattggttgtgaatagacaaatcatactggctgtagataaagtcagttttacttcttctatttcaatcttaattgcctttttttcttttttttttcttttttcttttttttttttcttttttcttttttttgagatggagtctcgctctgtcgcccaggctggagtgcagtggtgcgatctcggctcactgcaagctccgcctcccgggttcacgccattctcctgcctcagcctcccgagtagctgggactacaggcgcccgccaccacgcccggctaaattttttgtattttcagtagagacggggtttcaccatgttagccaggatggtctcaatctcctgacctcatgatccgcccgcttcggcctcccaaagtgctgggattgcaggcgtgagccactgcgcccggcctttttctttcttttctaattgctctagctaaatcagtgttggatagaagaggtgagagtggacatccttgcagtgttccatatcttaaggggaaagctttccattttttcaccattaagttttcgttagttatagactttttgtagctgctctttgttaggttgaggaagttctactcaaagtttgttgagaattattataaataggtgttcgattttgtcagatgcttttttgatatccattaagatgataatatggttttccttttttagtttgttagtatggtaaattaaattgatttattttcaaatgttagaccaaccttccttactgagataaatttcacttggttatgttgtattatccattttatgtattgttggatttgatttgctaaaattttgttcagaatcttttcatttacttctatgagggaggaatattagtctatagttttcttttcttataatattttttttctggcattgttatcagtataatgctagtctcatagaattagctctttcattttctgggagagttttctgtagagttagttttattttatccttaaatatttcatgaagccatctggtcctggagttttctgtatggataagtttttaactacaaattcaatttttaaaatagatgtagaactattcaagttatttatttcttcaggagtcagctttggtaatatatgtcattcaaggaatgggtccattttgtcgaattcactaaatgtattgtcataaagtcataaaggtttttatgatagtatcttattctttttatatgtgtagaatctatggtgaattcacctcccaattcctggcattagtaatttgtatcttatctctttgggagctaaatgatgagaacaacactcatggatggagcttcatcaattttgttgatctcagagcaccagtttttgttgcaataatttttctttgttttcctgtttttaacttcattgatttctgctctgatctttattattttctctttaccatttactttgggtttaatttgctttctttctttcttttttttttttgagatggagtcttgctctgttgcccaggctggagtgcagtggccgatctcagctcactgcaagctccgcctcccgagttcacgccattctcccgcctcagcctcccgagtagctgggactacaggcgcccaccaccatgcccggctaattttgtttttgtgtttttagtagagacagggtttcaccgtgttagccaggatggtctcgatctcttgacctcatgatctgcctgcctcggcctcccaaagtgctgggattacaggcgtgagccaccacacccggccgctttccttttctttttttttttttcttttttattatactttatgttttagggtacatgtttgttacatatgtatacatgtgccatgttggtgtgctgcacccattaactcatcatttagcattaggtatatctcctaaagctatccctcccccctccccccaccccacaacaggttccagtgtgtgatgttccccttcctgtgtccatgtgttctcattgttcaattcgcacgtatgagtgagaacatgcgatgtttgtttttttgtccttgcgatagtttgctgagaatgatggtttccagctccatccatatccctacaaaggacatgaactcatcattttttatggctgcacagtattccatggtgtatatgtgccacattttcttagtccagtctatcattgttggacatttgggttggttccaagtctttgctattgtgaataatgctgcaataaacatacgtgtgcatgtgtctttatagcagcatgatttatagtcctttgggtatatacccagtaatgggatggctgggtcagatggtatttctagttctagatccctgaggaatcgccacactgacttccacaatgattgatagcgtggacacttaggtcattaatttaaaactttttttttctggtataggaatttaatgccataaagtgtcccctaaatactgctttaatataatagcatacaccaaatttagatatgttatgtgtccattttcattcggttcaaaatactttctaattttccttgttttcttcttccgaatatttggtaactaaataacagttattagaacctgttttcttgttttcttcttccaaatatttggaagttttccagagttatttgtctttgatttccattttaattctattgtggtcagaaaacatattgtgtatggcttgaatcctattaatgttattgaaacttgttttatggcaccaaatattgtctatattggtaaatgttccatgtacatttaaaatgaatgtattctactgtcattggatgaactattctataaatgtcaaatagatcaagtttgtcagtagtgtttttcacatcttctatatccttaatgattttctgtctacttattctattaattattgagagaataatattgaaatctccaactttaattatgtatgtgtctatttatccttgcattatattagcttttgcttcgtgtaatgtgaaactctcttattaggttcataaactcttatgttcctcttagtaaattgatccctttatcattatggaatgacctttatcccttgtgggatgaccttatcccttataatattctttattctgaaatctgctttatctgatattaagatagccacttcagatttcttttgattagtattagcatcatagttttcatcattttacttttaaagtatttgtatctttatttatgaaatgcatttattgtaggaagcatacagtcaggttttgctttttaaactcagtgtgacagtctctgcctttttattgtgctgttcagaccattttatatttagtgtgagtgttgatattatcagatttaaatctatcattttgctgtttgctttttatttgtcccgtatattctgtgctcccccttttttctctttattttttaaactccttttggattaattgaatatttcttcaatttcattttgtcttttagctattactctttgttttgttattttagtagttcattacagatttacagaatatactattaatttatcacaatctgccttaagtaatattatgtcacttcatatatagtataaaaatgtcataacagtatcttccatttctctccttctgtcttttgtgctattatagtaatttcacttatgttataacctccactctcaattgttattatttttgtttaaatagtcaattatcttttaaagaaatttaaataataaggaaactcccaggaacagaaaaccaaataccacatgttctcacttacaagtgggaggtaaatgatgagaacacatggacacatagaggggaagaacccacactggggccttttagagaggggagggtgggacaagggagaggatcaagaaaaacaactaatgggtactaggcttaacacctgggtgatgaaataatctgcacaacaaacccctatgacacaagtttacctatgtaacaaaccagcacttgtacccctgaacttaaaataaaagttaaaaaaaattctatatatatatccatgtcattaccatttcagtgttctccatttcgttgtgtagctacatattttcatctggtgtcatttttcctctgcctgaaggactttctttagcatctcttgcagtgcaggtctgttgctaaaagtctttatttcactctgtcacccaggctggagtgcagtggcacaacacaaacaacaaacacagcttactgcagcctcagtttcccaggtttaagtaatccttccaccccagcacccgagtagctgagactacaggcaggcacacaccactatacccagctcattttttttttttttggcagagatgaggtctccctatgttgcccaggctggtctcaaactcctgggtatttcaccttcatttttgaaagacagtttcactgggtataaaatacgaggttgacaagttttttttcattcagtaccttacagatgttgattatcttcttctttgcattgtttctgaccccccaaaattactattatccttatatttgttcctctgttcataacatgtctttttcctttggttgcttttatgatgtttatcactagttttgagcaatttttttataatacgtattcgtatggtttgttcatatttctcatacctggggtttattgaaattattagaactatgggtttatagttttcacgaaatctggaaaatttgtggtcattatttcttctaatatttttctgcctcttcccttccttcacatgactccagttacacatgtattaagtctttgaagttctctcacagttcaattatgttctttttttatatcttttctctctgtgtttcatttggataatttttattagtggttgttcaagttcactaatcttttatctacaatgtctaatcttccattattcccatccagtgtatttttgtgtcatacattatagttttcatttttagaagttcaatttgggtctgttttgtatctcacatgtctctacttaactttttgaacatttggaatacagttataattaccattttaatgtcctcatctactaattctaacatctgtttcaattctgtgttggtttcaatctcctcattgtgggtcatattttcctgcttttgtgtttgtttgcctggtaactttctattggatgacaaacactgtgaattttgccctatttggtgctggatatttttgtattcctatgaatattcttgagccttgttctggagcatagttaagttacttggaaatagcttgaacctctcaggttttccttttatgatttgttaggaggattgaagcagttatcagtctagagctaattattccctaatactgagataagattcatttgtgtgctgtactcaatacgttgtgaatctgagatttttccagactggctgggagaagcaggcattatcctgagttgtgtaagttacaggtactgttactcataattctttcaagtagttcttttctaggccttaggtagttccttcacatggattcactgatcattactacactgaatactcaagggagaccctcagtgggtcgccaaaatgtcccctctgtgcagttttacaatacctatcttgtaaagttagcctccttggccttcctggattcccagccatatcttcaactcagggagagcatcaaactctgcctggattttccctccctgttccacagccttaaatctctctctaggcaataagctggggcaattgtagcacttgcctcatttgtttcccatgtattaaggatcactgtcttgcattacctaatgcccagaatcttgcaaagtattgtttcttttttgtttgtttgtttgtttgttgattgtttcaagctgtaggataaattcagcccctgtgactctgtcttggacagaaaggaaggctacaaatatctttaaacatcatgaacttcatgtttaggtggactcaaatgctaaacatgcaaaaataacctttattttttaaaatatcccctttatccttgataaaatattttttaaattccccaaaggagcccagatgaatggggaaaagtagggtcgtaggaacattcaggaagaaaagagaagggacaggatataagcttaggtgaaggtttttcttcaggacacaatatcaagtttgtatatgttcatggtggccctcaaggtgagaacagcagtggtgacttgttttggtgggaagataatttctctactagtatatggactgctaactcccttgcttcaaaatgaatatacaaacaaaaagcctgcctacctgctgcccctgcaatgccaactccatgtacacataggattgctagataaattacaagatgcccagttaaatttgaattttagataaactgaataatttttgtatgtcacaaatattgcacagtacatacttatactaaaatattgttaatcattcacctgaaattcaaatgtcagtggagtcctttatttttgtttgcaaaatatgacagtcttatgcacatagcagtatgacttccagctcattttttaggcctctggaattggtcagaaaaggctctcatatcagttctgtcactgggctatttggggatgattcatgcacaatacttagctcaccatctgtcccctagtagccaccctatgaattagaatgagtagccaagtcagatactgattctcctttatagatcactcactcatccctaatggcctctgagccttctaacagccaccataaggcagttgacaatgatgttatacccactttacagatggggaagatgacgatcttaaaggccaccacagcaggtcagaatgtataagtgccctgtgaatgacccagagaggaagggttctcatcctacctctgcccttgacacccccctgacttcctctccaggcccactctccacacatagccaatgagctgagcccaggaaatatactatcaattgttctagagtttgagtgacaaaactagaatgaggacattgccccccaccccagcatcctggcctgtcctttggagtgaagtcctggcttgtccttggagtgaagtcttgtgttcttggggtctccaaggaagctcaggctggctacttaagggatagtggacaggcttgttgtcttcttctggttctttgattcctaactgatagggcccacatggtatagaaagggctcagtgaagcaagaaaccagggctttgaccccacctcagctgctaatttattcaggggtcctcctccctctctgcctcagtcactgccttcatttctccatcgctaaaatgggggtcatatttaaaaaaataggaaaggactttgaaaacattaaaagtgctgctcaaatggctgcagattctgaatagcagtgtggccccaaaattagaatcctcatgttagcccttctgcagcagtaactgcttatccatctatttgctgagaccctgactgagatgtggggaatgtaggggaaggaacctcccttcttctgaaggtcattaggaagttcttcaaagggtagagaatacagagctgtgcccagttcttcccagtaattgcaagatgttgagcttggaggtttttttccccctgggcccactggagaggggtgagcttccaatctgggcctgttgcctacagcctccagagacttagagtttggagaaagagagccagaggcagagtgaggaaggacaggccacatctgcctactgtcctaaagcctccagttatattactgactcattccacatcctaggaagctgaggactagtgcttattagcaatctctcagcaggacataaagtgcatgtgtgtttctggtactgctgtgtattttctgatgctgaataaatggatgagcagaagactaacatccaacaatgaaaatgctgggctaccattgggtgcctacaatacattgaacatttttaccactttgttttaattgatacacaaaaagcatccccacaaggtagatgttattattatcctcattttataggtatttaagtcaagaccagagttaaataatttcacctaagtcatacagctactaagtgaagagtggctattgaaacttaggtctggctgactctaagatcttctctcttccacgccatactctctctggtgtcccccggaactttcctgccctgctgtctggaccccagtgcctggagctctggctctgccctaggaatcttggaggaaaccactgaatgaggcaggaggaaggaagatggagcagcagaaagagcctgagttgtgagctggcctcagcctcatcactctgacccttccaggtctccagtggcacaaatgggtgctcaggccaaataaagtctgtgaaacctacagatttcaaaaagtagtttctatacagttcagtaatacctcaattattccaaaatcatgtaattggtgacctaactgaatcagaaagtcatcaacctcagaacagcgtctgaagagctgaaatagcctgaagtctcctgcccttccttcaccagggagctcggcaggttcatatgcagtttgtggcttcacgcccacatgtctagcaagctctgctgccagttctctcagcctgtagcacatagaagcagcaaattagaaagagagggccagagctactggaagtgaggctggcagacatcacaaatggccactgacagtgacagaggaagcagcaatattatacaaagtaggttcgaatgcaagaggttcagccatgtgggatcatttattataacgacaaagagcctgacaatgctagataaatgagatgttactggacttcctctgccaactttgaattctcaagttacctactgaaagaactaaacatgtccttctggacctgagcacttgcctaagactcaggaatattatttagggtacaagaacagacatcatttgccatcccatgtacatagagattatgctactgattcactattaggatactccaaaattctgacaaaaagcaagtcacattccataatccagtagcacttttgaaaatagcatttaatggggagctaagtggccccagctagagctgggaatcaggagatgaggtgaatatcccattgcctcagtcaggagcagggcgtgcctctagggtcatagcctagtgtactcatgaatagtgtccccctaaaatttgtgcctgccctaaacctatgaatatgatctatttgggaatagagtctttacaaatgtcattagttaagatgaggtcacactgaattagggtgagccctaatccaatgattggtatctttctaagaagagaaaatggacacggacacagggagaaggccatgtgaagatggaggcagagattggaatggcatgtctacaagtctaggaatgacaaggattgccagcaaccaccaggagcaaagaagaagcaaagaagcatcttcccctagagccttcagagaaaatgtggctctgccaagaccttgatttcaaatttctagcctctagaattgtgagaataagtttctgttattttaagccacatggtttgtgacactttgttgtggcagtcctagaaactaatataatctaaatttttataaatcagttcatggtccaaacaacactagtaaagaactgagaactaagccaatctggactgctggctaagatggctttttcaaagtttacactttaagacacctccaccaaatacatggcaagaatgtactataaagagaaaaatgcatacagccctaaaaataaataaataagtatctcagtggaccaaaattggaacataaatatatctgctaagcagggatgaaggcacagggcaactaagctctggatctagaaggagatggagatgaccaggtgttctgctcctatggggtaatgagaaggcactggatttactgcttgaaaccaagtcctagtgtggggctttcccattcatgaaaaggatgtataaacattgcagttaccccctgattagaactgcggtttacacagagctgcaaacttagggatgtaagatgaagcagacacatcctggcaaccaggacttggctcaagttacctgtaaatctggtgatatccccagaatcgcagcaggatggaagcctgagtcaccaagcaaatacatgatttttaaccgagagctctagggtgctaggtggaggcaataacaagaacactaaacaggaaagggtgagggcagagaaaataaacaaacatactactacatgagctaagccaaaatcccaaaacacatgagaaaaatgaatatgaagagtgacagctaaaaaaaaaatcaacactaaggagatggattccctcttgacaaagtgaaagtattattgcagcctaaaaatgatttgataaaagatacatttagtatcctcaaagaggtgaaaaataacatctagtttttaaaactaagaaattacgtaccaaaacagacataaatgaaataagaacaagtaaacatataaatgaaccaattagaaattatggaaatgtctgcttatatttgctcctccctgcattaacagacatctaggacactagatctagctcacctaattcagcagccttgtatgccactttcctactagcattgatatttttctagcatagcctgtcttctcctctgcagactccttgatctgtgactaaagctggattaagaagtaggtaaccaagcagctaatctagaaatggtggccacatatcagtggattcgttggctataagataccagtttattcacatacaaacagacacccagtgtctttatattgtccctgagcctgcccttccttctctgtgtatcctatgcccctatcaccccccatcccatgtgcatttctcagatcccgtttctactgcctgagctctctgctaccttcagcatccacgtgcattccttgccaactagtaggcattccacaggcctcgtggtacagtgccttttctttcacaagttctctttaatttgcttattcacactcattctgaaaaccagcagttctcaaagtgtgttccctggaccaacagcatctccatcactcagaaacttgttagaaatgcaaattcttggcccccactgaagacctactgatttagaacctcttggagtggcactcagaaatttgatttttaacaagtccttggatgattctggtgcatgaagaattactaccgtagaaatttgtgttataagcacttacaacatgccgggcgctatgataggtatctcttggcatgcctgctgtcactttgtgtcatagctgttttatctggaagcctctctggggctatgtgggaaaatcggagactcccagagtggtgaatgaatgatcagtatggtatggacttagaaaagagaaggaaagcaacatttctgtggctgacagatctgaagctgagaattcgagaaagagagggactattaaaagcccttgtgtggagctgggtaacagatgtaatgattgtagcccaactaaaatcaataaacagtgtcatacaggggctgggcatccacacagataaagttgccagcccctgaagcctggtgctggagaggtgatgggagagacagggaggatgacagtttgctggtgccaagcaaagttgcattgtgtcaggatgccatccatgctaagtaattccacttgacaaacactagttcagcaattggccaattcaaagagcacatgcaagtacctgctctgaggatgcaggaatgaatcagccagagtcccttcctgccggtagctcatggtcacatgagggtgacagacacataatcagccacctgtggtacaatctggacacatgctccaggagcaagccatggagttccctagtttctgctaggagttgggggaggccttttcgtgggagatgaagtttgaaggatggctgagaatggccaagtggagggaacagactgtgtgatgatatggaatggtgaaagggaagagggagaggttcaggatagctggtaatgttaaagcagatagcagtgcatagcaagagagaaggctgaagaagtaagtggggttggaatggattgtggtgctgggtttcatcctgtaggtgatagggagccactggatgtttctgagcagaggaatgatatggcagacttggtatgttagagagctcatgctggggactgcatagatgatggagctgagatggagacagcttgtctaggaggcctatgaggattctgtttgaagagtcctagagaaagctaatatggatctgagatgggtcaatggcaccagcattgaatgaaaataatgattggagagatcttgtcagggacaggtcctgcagaactctgggggatataaagatataccacaaggtaaccaccttacctcgcaagcttagcattccttagaaggaagcctaagacaagtatacaatggaaggaaaaacccttctttcaccttatatgatgtattagtttcctagggctgccgtaacaaagttccacaaactgagtggtttaaaccaacacaaatttattattttacagttcttgagatcagaagactggagtgagttggcagggctgcattccttctagaggctctagggggaagatcttttttcttttttttccttttctagtttccggaggatacctacattccttggctcatgaccccacatcactccaacctctgcttctgtcattacatctccttctttgactctaaccctcctccatcccacttagaagaatcattgttgattacgtttagggcaaatcctgaaaatccaaaatgacctccccatcccaagatccttaagtcaatcacatttgcaaagtcctttttgtcatgtcaggtaacatattcacagcttctggggattatgatgtgagcatcatgggggccaattattcagccctactacatatgaaaagagttcttatgttttcacgaataaagaaagatgataatggccatcttcttttgagtgcttaccatccatcatatattttctcatttaacttttgtggactctaagagggtatgttccattcctatccttcaagttgccaaaaacaacccagctaggaagtggcagggctaggtagcactcctattcccagggctgtgcatttgtgtcaaatctccttctgcctcccccttataaagacacatgatgttgcatttagagcctacccaaatggatgaagatgtgaggataacatcctcatctcaaaattattaatttattcacatctgcagagatgctatttccatataaggtaacatttagaagttccagatttggggccattatccagcctacaatagttttcatcatcacctaggtcttacagcagggtattcacatggctgtaactcttctttaaacacctactaaagttaatgccatatctggattcatcttaaaaatcttaccccttgactcctgaattcactaacccagaggtctcatctttttgccgtaattttgagagataattttcggttttatttatttttttttttagacaaggtctcactctgtcacccaggttggagggctgtggtgcagtggcatgatcatggctcattgcagcctcaaactcctgggctcaggcagtccttccacctcagcctcccaagtggctaggactacaggcacgtgccactgcaccccactatttttttttttattttttgaagagatgtgatttcaacatgttgcccaggctgatctcaaactcccggcttcaagtgatcctcccccattggcttcccaaagtgctgagattataggcatgagccactgcacccaggcaagagccaattttcaattatctatggaagtgatatattaactgatatttgccaaacgtaaattcatgtttgcattcacagagtgaatggggaagaactgtggagacagataccccaacttgtgtcctcactctgagatgacctcttcaaagagtgttcatggccagttcaggaggcagcatgcagaatggcaaggtaactgagcttggagtcagagaagctgagttttgacacagctctattactgccagctgagtatgaccaatcacttaacctttctgggcctcaatttctttgtctgtgaaacaggactattgatatctgtgttgcttacctcacagggcagaggtcaagtatgcatgtatgctctttttccatctgcaagagcatggctcaagctgggtgaacagtgagggccatgtagtcatgtactcccaggcagcaagtggtagtgaggcctgaagcctgggcaggccctataggaggactcaggccactgggagacatcaagaaaggccttgacaaggtgtgtgtgctcacataccacctgtttccctcaacagcccaggcctggggcctgccagctaagatttgctgctcgcattgagcctcataaatgaataaagtaggtaatttaatatcattgtgacaactacaagagagattttgcatgtctgctttgcagcataaagtttccttagagccaactttcagacttggacaatttctatattctttcctacctctacctccccagagaggcagggatgtcagacagaaattaagaaaattctgaattcctcaggaagattactgtgtttggatttttttgaaagaattgaatgaacattttgtcaacatggtatcaggggaaagaggagtggcatattcagcactatcttgcatccttgagaagataaaggcagactttgagcacggaggattcttgtctgttgacctctactctaaggcacccctgtggacctctcctccactcaatctaaagtggatgtaaaagtctatcctcatctggacaggccaagtgggccctccatgctgtctttctctagcgtcatgccccgaggctccaatgactatataaaggggctgcttctccagcccaagcccagcagccctaacctctcccactttacactggctcctgttttcatccttcgtccctcccagccacttccatgcctttgatagcacatggactcagcatcctcagagtacatcagtgcagatcgtcagatagagtgccaggggggtaaacatttcagtcattcagaacccattccacttggagcacatggtatgtcagggacccagtctatattatccccaggcgaagtctggaacacagaaatccagagattcctaaacccacccaataaacttccccagccctgactgaggtgtattcctatttgcccaccctgtgctcacctactgccatcccccatcaacagatatgccaatcttttttttggccactgtctccataagtgccccctctgtgcacatcatggattcccttcatgcttgctctatttctccccactgctgctaacctcctgacagggaagtggcacccttgggccaccaaagtcctttagatgagctggatcccctcctccaaacggctgctagtgggacactaggaggactcaagtccagctgtatgagtttgtaaaagggcagaggcaagaaggcttttaagccagtgttgccaagatgagttttggtaagtgggggtgtttggatgggagaagaagcttaagacagatcctttcccattgggatgaagctttgagccagccagctttctttgtgatatgtgatgagttatatcacccacccaggatagaagttcctgttcatccaggtcctcaggaccagaacaagcttctccagggcaaaataaatcacaaagaatctcctcaagggcccaggaaagtgaatattcagtggcagttgctccctgactaatgctaactaaagttagccctgagctagtacaaccttccattcttcaagtggggaaattgaggcccaggcagctcatgtctccagctctccccagggttgaatgtaagtctcttgattcccagtcttgtcttttctccaccctaccacctgacctgcccttggacacatggctgcgagggccagccttcctcagcttaccactctcaatatcactttgacaagaattcagatttcacagccgtatcagcaggatgttaaatgttgcagtgaagcgtggctaaatggtgacatctctagcttcatggtggtcagcctacaactgagaggctcaaggtcaatagctgcaggcctgacaggtcctggatccacatgccaatggcagtggagacagatttaccacagggagccctgcaccatcagaatggatgccagcggcagaccttgtttctttcctttgatatgccaaaagattaagtttgagcccctaaggactctctagggtatcttgggaacttccaccagccagtagtcaaagtgccctttaatccagctgagtgcataactagggaactagagtgttgtcttgggctacagctgagatggggctctagcaaaaagcctggtgtaaacttactcactcttctaaagcccaagcagcctctgcacagagagcagctaagtaaagatgaagcctcttaggccactgaactgactgtgatgtgatgatcttgccatctcctggaaagagggggttgtgggcccatcacaagaaacagcccaaaggaagggccaacctgtggtggtagcccctgagctgcccacagggtgccaagagacacagtgtcagcattttcatctatgtcgttatcattgttgcaacccctcccagacaactacctgacattgagtgcctcctgcatgccaagaatattgtaagcattcactcctgtgttgattctcacaaataccctgtgggattagtattataattaggcccattttatagataaagaaaacaaaactcagagaggtaaagttactcaccaaagccttatggctggtaagcatgtgacaatgaggtgaagaagctgcctcttgttcttaaggtgttgccagtcatgtctacagagtgtatggaaatggaatcagtgtttctttgtggggactggattcagtcttggtgataagaactcccatttattatctactatctgccaggagctttacatgattattccatttaatcctcacaatagccctctgaatatgctattattattatcttcattttagggaggaaaatgagactcctagaagttaagcaacttgagcaaggaatcacagctaataaaaacagagctgggatttgaaccactaagccagtggctctcaaacttttttcctcagatcctttatactcttgaaacttattgagagtaaatctacagaaacagaaatgagattagtggtttccagggactggggaaagagcagaaaggggagtgactccttaatggtacggggcttccttttggggtgaaggaaatgtggaactacagaggcgatggttgcacaatattgagaatatacttactgccactgattatacactttaaagtagttaattttatgtcatgtgaattttacttcagaaaaaaaaatgatataatgaggtaaatcaacaacaatgacaaaaacttattgaggcctccaaagaccttttgtttatgtgggtcatatctatttatgttaccatattagaaaaaatattaaaatatttatttattttgaaattaaaataatgaactaattacatgtaaatataaatagtatttttatgaaaatagctatatttttctaaacaaaaacttgtattgaaaagagtggcattatgttacatttttgcaaatttcttttatgtctggctcgctagaagacagctggattctcacatctacttctttattcagttgtgagatgttgtttggttgaagtacatgaagaaaatctggcctcacactaatatgaagttgagaaagggaggaatattttaatagacttttcagatcattgtggacatttgtctttgataggacacaaaaactccaccaatggttgttttttacaggttaagtgtaatgtgggatgcaaaactttatcagtgagccttctctacttggttccgttggactctcttgtcttttgaatggattttttacctatttattgtttggtaacattgtgtattggtcgctttaaaaaatggtggtgccctgacttatggagagcctccatatgttgacatatttcattccacaacatcacaagatcacatttgttaatattatgacccatctcgttggaaaaagcctttaactgttgagaagctgtcaagcttacagtggtggatacaagcttttcaaaattcaaatttttgcctgaaggctcaaattttatcattggcaaaaactatagtcagttgttttccttgaagtgacaggctcacttcgttcatctacaagaaaatgtctgccaaatacccaagtctgagtaacattagttagtcattctttcaagtaaatatgatgttctatgaaaaatcggccagtttagctcacaactcaaaacacgcagtagtgctttgccttgagtcaacgactacactttgattccagcagaactgctttgagcatagttctcattgtgtctcaccaaattttaaaaataaggggactcaagggctagtatttaataaagttaattttcactgcttcgctaagaacattcgtaagtgaagctggcattttttaaactgcaggtgtgtggtggtgaagaatccaattgacaactagtacagttggtgccatggtcccaattcatgctcaggaacctgctcttttcacctacctctgcttttgcaccagcagtgcaaatggaaagcatgacagtggaatatcaaagaacatttcagtattattgggaaaatagttttcaccttgaggatcctctaaaagggtcttggagacctccacgggtccacagatcctactctgagaaccattgcacatggctatgcatggtgccacctcccttacttaagagctttgatggcttactatcatctgcagaatcggacctgccctcacccatgatgtcagcccaggacacagggacccagccaaatgggctccttgccattttccaaatgtgtcctctcatgcccttgtcactgctctcccctctaccaggaatgccttcatcaccaactctggccattgaaatattacatatcctccaaggcccaggtcaaccactgccttttccagaaagctttctcagggtttttttgttttttggtttttttttgagatggagtctcgctctgtcgcccaggctggagtgcagtggcacgatctcggctcactgcaagctctgccttctgggttcacgccattctactgcctcagcctcccaagtagctgggactccaggtgcccgccaccgcacccagctaattttttgtatttttagtagagacggggtttcactgtggtctcgatctcctgacctcgtgatccgcccgcctcggcctcccaaagtgctgggattacaggcgtgagccactgcgcccggcctgctttctcaggtttttaagtggaaaatggtcatgctttactctgagcttcctgagcccactcttggagcatcttctctagcacttatcaggctgggtgtcattagatggaagtatttcctcatctgtgagatcatcaagaacaggcaccaagcctatcctctccatttccccacagggcacccttgttcatcattacattggggaacatatttgtctaattgcactgaattgcccagaatgtaaaacttaaaaatgctatgtggctgtggctggtaatgctcaaagcccatggagcatattctgacttttttgagtccccaaggaatgtcaccattggaaccattggtactaatatttgtgcatgcttcttaaaaatggtcttatttcaggtgtaggggaagagtgttacacatctgaattactccaaccccaggaacctcagctcccaggtctagaagaacccttgagagggagaagccccctgccaccaagctttattgaaagtacaatgtctcttgccactcccctgcctcccattttgcggatgacatggttcatagccctgcaggaaggatgggtgcagtacctgagagcccacagccaggaagtggtgccacaggttggacctgaggcccagatccttccctcccagtttctgtcatatgacttgcaattcaaacatgatcatgctaatggctcccatagatcgccccacattctgtccctacatgcccagcccaacctggactggaggctttatctcatttagggctcatcttggaactctgcagaatcacagctgatgcctgaagagacgcacttgtttattttgaaggccaatttaattaggatgcctttggcctcaacagttgtatcctgatttccaggaattgctctcaatttagagttgccagctcacagcattgtgtgccagccctttgcccacctgctgtgctccaacttctctctcctcagtgatcacattggctggcaggggtgtggagcaggaaaaaggagggaagggtgcttctccaaggaacctacacaggcttgagcatggtttagttggaggagaggacccagaccatggagaccaagggaccgtgaaccagggcccagagaacatataggacaagacacagagatgggtgagaatagtcaacctctctgtgtgagttggtgccgggatgggtggccagataaacaatcagggccttaggctgtatctacaggggccaagtattcagaacaagggggtgagtgtgctgctttcttctgcagttcaacgtgtaaggtgtggctgtggagccaattgtgagttagacttttgacgctaccacttattacctgtacgactttggacccctctgagactcagattgtctttgtcatattttcagagtacagtagtagaaactatttcaaagtgctgttaggaacagtcaatgagatactaggtgtcaaaggtttggcacagtgtctagtgggcacagctcccctattctctgctctgttctgctctggtcagctctgggcctcacatgttgaaaggccctgataaactgaaacatatctgaagaagggaaggctgggggtggaggagcaaaagaatttctatttgcctggtagaagagagggcacctcctgatgtgggtggccaggttcctcaatgtggggctcagttaggatgggggtggggtggcagaagtgactgaggtgcaggcgccagtgcacaagaggaaagaagacttctcaagaagtcagaaacatgctactatctgttgcttcaggaagaagggagatggagactgaggttcctttagatggtggcataccaggagagactggatggccacagagcaggaatgtcacaggagcaggaaacttcaagtggcaaccacgtccagacccaagcctctggggtgtctagagtgcaactttgttctgcgcctaacccagacaataaactataaagtctttctgctctggcttggattcctgtaagggttatgggccattcctggggacccatgagtcccaggccacccaaggtgcccctgttgaaattgcagaagggatattgccagtgtgttcactctaagagcagggagctgcagtggcctctcaggcagccatgggtatccaaactgggagaacctcctaagatcctcactgagcctaaaaacccctaagatcttctccttttccagctgaggggcctgaggcctgtagcgggacaaggcctcccagtgccatctgggagtagagtcacaccccatccaatgctcagccctgccttgtgtccagggaccccaagggctcattcccttgacaaatgcctgtgtcatgtaaatgtgttaggcctggctcagagctcagcaggcttatccagacaataggagcctaggggctgagagacaagtccctgccctcctccattacgtgcctcacttgccaggggaacttgaggccaggcagcctcctcccctcaggctctcagccactttagctctgaaaggagaaagtgtcagtcgatcctgccaaaggccacactgccctgatagccagacttcttggaagtcagtgatccatcagtgggagtgtatgtactggggtgaagggtggaccccaaaaagatatgtccaagctttaaccctcagaacctctgaacgtgaccttatttggaaaaaaaagagggtggggggtctttacagatgtgataaaggtaaggacattgagatgtgataagcctggattattcaggtaggccctaaatccaatggcaattgtccttagaagaaaggagaaagatgcagaacaaagctgggcacagtggctcatacctgtaatcccagcactttgggaggccaaggcgggcagatcacctgaggttgggagttcgagaccaacctgaccaacatggagaaacctcgtctctactaaaaatacaaaattagccaggcgtgctggtgggtgcctgtaatcccagctactcgggagcctgaggcaggagaatcgcttgaacccgggagtcagaggttgcagtgagccgagatcacgctattgcactccagcctggacaacaagagcgaaactccgtctcaaaaaacaaaaacaaaaacaaaaacaaaacaaaacaaaacaaaaacagagaatgccatgtgaagacaaaggcagagactggagtgatgcagccatagccaaggatgctggcaacatccagaagctggaagaggcaaggaaacagtctcccctagagccttctaagagagtacggccctgccaacacctggatctcagtcttctggcttccacaactgtgagacaatacatttctgttgttttaagtcatttagtttgtggtaacttgttacagcagcctcaggaaacatacagtggaccacactgctcccaagaccctgaccctgtgagccatccaagggcctaaaccctgccaggtggcacccagggaacttctagtgactcactcaaggtcaaggcggcatgattggctccattccttgtcagacctgctcagggcccatgagcttcaggctttggacttaaccgcattagaaggtgaggctgtcaagtgaagcctatgaattgatagcaatttgattaattaaaacaaacctgcccagagtcagagcagacagcaatatggacatcaagtgtgcagcactaggatacacctgcctgagctgctccttccctttatgtttgactagggctgggggctgcggtaatttgtatttaagaaaaggaaatacatcagggttatgagtagtaatttcccttcacctccactctgcctggcccagtggtttccggaagatggccaatcgaatcagaaaaggaagaattgcagtcattgtgtagacatccagggtccccagaagcagaaagcaacctggcctgaaactagcttctgctggggatgcttaacctgaaatcctctgccaggtctgggctggtggggtaggggtagttgatgaggctattgcctatggttccttctgaccttgggttcttgaaatgtcccttctcctctctaggccttagcttcctcttctttagatgggaagattatccttctccagagcagttgtggggatcagtgttccatcatgcacactgggtaagcattctgtaagccaggacagtttggacaggatagtgctttccgcctggaggaaggagtgctgaggaggaggaggcagaagaaaggtaggtgccttcctgggtctttttctaggagcaaggtgactctgtcctgagagaggacattccagcagtccagggaggtttcatttggctgcagagcccctgatcccagacaacctcccagaaagccactaatggcaatggctggtcccagcaagacaagggatatctcaggtgccgcaccagctcattgatgatggctgacagcagctcatgctcatatctcttgccctgtgcctatgcttcttgaattctgctgtgctgggccatagtccctgcccaatgcatagtagtagcagacgcatgctctccagggacccttgcctagccccactggtgtcctctttgcctgagatcaggtgcctcctgtgtagcaggaagtatgcagcaagtgggaccagaccctgaccatgagagccacactcatggccatgatatcctccataggccactgatgacttagatgtccccttcgatgggagaagaaaatctggggtggaggggcaagccaccagcaaaaggtagtaagtcagagctgccaaagagccagtagcccctgggctgtcttcatacaggctcagttctgaaaacaatagccctgaaccctcttggtctagtcactccagtgactatgattcaaaaacaactggcagttggtggtgtactccgggcagtaaaagcagtcaaaaccacagaagttgccctggagcttcagagtgacctcttagcaccacttctcatatgcttttaaaattctgattatattattcacagctcctcaatggctctttactcctaagcattcagaggctcctatagaggtagagatggcagaaggggccatgaagggttctgacaggaggtgacttggtccacacttagtttggagggatttactgggagccattcaggcggcctgcaggcaagggcctggagccgctggagaccctgggcgtggtgtggtttacaaatccaatacagagatgagcagattgtgcttctgggtggtggcctgcctgtgaggggagggaaggtggccttggccagagtctggacagcctgaggccttcttgcagctgctcccccacctccccatctcccaaagctgccgttggcctaatatcctgttctctgcccagagactagccccctgtgaggagagctatgtgaggacagcgtctctgttggagtctgggcctgggggcccaaggtttggcccaactctgccttcttccctggagatacccattcttgcagccccctctcccctgagtccacagtggccacatatttggattctagcccacaattcaaccttccatcaagaggagggagcagtgtctagcagctgcaaagctcccaagggcaggccaaggctaggaggcctcaggttgctgggcctggggaacccaggtttgtgaaaatgcccccaccctacctgttgtcagccttgtcactccctctgggggtccctcaagctacaaagctctctttggatgtttctggtcttctgtgtgcctgctcggcactagatcagaatggctctctacaaagcagcttctctcctgtagctgcctctgccagcctccccctgaccctgggaatttgtgttctctccagctttttctcacagttttttgccctaagactggctcatctttgtggagttgccttcccgggggcatggttggagcttggcagagcagccatggcttgaagccagcaggtctagtggagtttctcctctgccataaagaacaggaagactgttgcaaagatccctttctgtacagcctctcacttaagcatcattgaaatcctaagtcagatactaatgggattctcatttcatggaggagcagaccacgcctgagagagggtggctggactgcccaagatggtgcggaggtagaaatggatggggaacccagagccttcaaactcccaaccacatcaaggtgctgcttagctcccctctgggaacacagccctcaacaaagagtgggcctcctccctgctctaaacaaaaacccagcagatggtggagcaggtttgctggaagcctcagcttaggcctcagtccattaggaccaccctaaatggggaggtgatgtctttgggtgcatattgcagaatgtgtggcaactccagtagaagaaactctgagctcagtagcacaggtggccctatcctcaggccctctacagtgctgcagccacaagcgcccagcgctccactcccagtagaccctgcccctgggcctgccaccattctccatggctgacaggctgaaggctgagcttctaagccaccctgccccacagtatgtcccactactcccactgggtgggtacccaggataggtgttcagggaacagaaagtgagcttattcctccttcaaggaacttcttggaacttgcccagtgaaaactgttcagaattctgaagaattctagaattctagtaccaaagtctgggagatggacagggccctcagagcagcttgtgcagattctccaaggcggggtgagcatcagcggcactggggctgctgaatacactgcagatttcctgggctccatgccagagccactaaatcagaatctcagggtcggagcaggggtgggagtgtagccagctgcatttttgaaagggatccacaggtggttcagatagactctacaggctggggaagtgaaggccccagatcacacattgagtcatcacagactgggaccggaactgtggtccctgcctcccactgtggggctctctctcctatgtcatcagacctagctggctgtcaaggctgccaaggctgaggagctatgtccatgagtcacttgctgacaacactcatcctgccttgagggcatgagtcatagcagaccacagctgaggatgggcagctccaaagatgtcaatgggagacggtggggatgcctcatctatcctgctgtcctaatactgggtgctcggtgccctggagcaggaagagtcccaagatggaaccgccagtgcctcttgggcaagagagcccagtctttcagaaggaaacctgcacaacttcagttcagtcttccatctggtgctgtggatccaaacatactgtttttccagccctcagccaggaaccggagtcactccagtgaacgggccagatgcagcacctgccctcaggaaactgcaagaagcaagaagcccatcactgggatgaggcgcaccaaggggcagtgcaagatgatgctctgggcatgccagtaggggctcagccaaaagatggaggggagcacggaggccactcgcaggcagaaggaactgtgtgtgcacatgaggaaggggaggcccaggtggctggtgccagagtggaagtggagggccagggaccattcagtgcggccgggagtggggcagggccttggaggcccagtaaggatgctttgttttttttttcagaaacatggaaaaagggccgataggtatgtgaaaagatgcacaacatcactagtcattaggtaaatgcaaatgatagccacaatgagataccacctcacacccactagggtaaaaaaaaaaaaaaaaaaaaaaaaaagaacaacacatgcacagaaaataacaagtgttggcaaggatgtacagaaattggaacgcttgtacattgctagtgggaatgcaaaatggtacagccactgggaaaacagtttggcagttcctcagaaaaacataggatgactatatgacccaggaattccactcctgggtacatacatagccaagagaattggaaacagttttccccacaatgaatgtctatcacagattcacgatagccaaaaggtagggacaacctaaaatgtccattgatgacgaatggataaacaaaatgcactatgtccacataatggaatatcaattcagcaataaagaagaataaagtactgatccatgctacaacactgatgaacctcagaaacatgatgctaagtgaaagaagccagtcacaaaagaccacatgttgtataactccatttatatgaaatatccagaataggcaaatccacagaggcagaaagcagattaatggttgtcaggagcttggagaaggaaaaatgggagagtgactgcttaatgggtataggctttcttttgggggtgataaaagtgttctgcaattacatggtgattgttgcataatgttgtcaatgtaattaatgcctaagtatactgaattgtacactaaaaatatgaactgacaaattttatcacacacagagacacacacatataccacaataaaaagtgaggggaccgatgggaagaccagttgagagttcaaagcagtggacggaaggctgaacagaagggcatgcaggttcctgccagttctgagactttggtgcctccctctcccttttgcgcactgagcactctagccagcttcgttatctgtacagcaggcctgagcatgactttcctcccctactcactgttgggctcccataagacaatacgtggaagccctggcacataatagatgagcagccaatgccagctctgttccctgtgaggggcgacgtgctgtggtgttccttagagtcacactgcgtggctcttatcctgatttggtcactacttagctatatggccatgagtagatcacttcctccctcagagttgccacatccttgtacgtagaatacagccggtcacattcctgtcttccttttagtccctcttgtgaaattgtgccagactgaggcctctctaccctggagccaggaagcacagttttctctcagagcacaaagctctgccttggctcggtcccttggggaagttgggaaggacctgatgcctaagacttcccagaggtctccagatgggtcctcttcattcaatatgacaatgccctctgttgttggcctgggaaatcactgagaagaaaatcagaagcaagtacagcctcctttcttgaaaagtgttaatgaaactgttaacttttacatctggttctgtgctgttgtcctaagcctatttattagtatatcatgtaatgtggttctagaagggcaaatatgagaacacggggaatccctgagtgtctgttcctgaatcctttctccccacttcctcttcctactgaccaattggtctctattcttttatggtcttcatttctgactttccgctgcctcatcagcctgcagcctcaacattttggtctctaaaatgggtttcatgtgaaggtgaaaggagtgaggcttagcccagtatgtggcttgtaataagtgcttaacaaaggttagctataattacaattatttaaaataattttaaaaagtgctgattttttctcatggacattgttttttcccacataattgatcatctaaattgtaagactgtgatttttccacaacactcaatagacttatttttaatcccaaagacaaaaagcagccaatccacccatttctttgtgctgcctcatctagtccatgggcaaaccttgctccttccaagcccaaacactgatccctgagaaccagcatgggcaagcaagctccaggccctttcagggtcaacctctccattaggtacagtaggctatgagacttttaaggacacacaagataattaaacttattttaaaatcagaaggaaagaaatgaacttttagattaaagacaatattttcttatataataatgtattcatctttataccaacacaatcataaaatataattatcattatttattggtaattgaagaagggccccatgaaggcaaaaatgttcagggttcctggaagtcacagagcagctgccccatgtcaacaagaggagacaaaagatagagacactggcttcacttccatcttccaaataacacctgaatttcatgtggctcctgctgaatgagaactgtttaggggaagggaattccagccatcaaagcttcagcttcactcaactggcatggaacaaggctgccgccaccatttttagcactctgaataaatatagtgtctagtaacaaaccttcacatttccctgaacttaaaataaaagttaaaaaaagtaaaaggttttccattcaactaaaaggtgtgtttggtaatgcacacattgttattgttgctgttattattttgctgctacatgttggaaactttgtttccttattaagaatataaataaaatgagttactttgtgtttctttcaatataagaataaataaatgtagtgtctaagtggaggagcagcaggggctggaaatctagaaaacccccgcaccctgaaactggccacgggttctgctttacagggctcgtggggtgtgcggcagctttgcacctcaacactccagcacttcctcctcacagatttcccattaccctgtaatctataagttcaggacctcaccagcctgcagagatagggtcccagaacattaacaagctagtcgcctgcttctcgccctatctattcacccaggctccctccccaccccctgaatatttcaggctccctccccaccccctgaatatttcagggagtccccaaaggagcttatataagtgttcacaaatgtttctgtcatctcatcaccatctggggtctaccccattctttctctccagaatccattcccatttgttaacatgggctgcccaggaatccccttacagaaaccatggcaccatgtggcttagagtgcccctggtgggcaggccaaaggctgtgccaagcgtctggccctgacaccacacaaactgcccaggcctcctcaggacacagtagaattcagttctggcaagaaaagagagagcagccccagccctacctcttgggtacattttgttctctaggctctgtgaagcaatatgtactgggcctagaggtcatcagtcaatcaacagagttgtaactcaagctgctttgggtgaagtggctgctcctgggattcacagtcctagccactcagttcctccatgcttcttcctgccacctgggggccccaccaggcctcaggctggggaatgccttgacgctctgtccctgcatgtctgggagaactcttttttttttttttttaatgattatactgtaagttctagggtacatgtgcacaatgtgcaggtttgttacatatgtatacatgcgccatgttggtgtgctgcacccattaattcgtcatttacattaggtatatctcctaatgctatccctcccccctccccccaccccacgacaggccccggtgtgtgattttccccttcctgtgtccaagtgtgggagaactcttttgactgtctgcaaatccccaagctgagccctcagcacttgacttggaggttgagagttaacatacatacccacgtagcccttttccttatctcaacccccagaaggtgcaatgctcctgccccagcatccttctctcagttgagatgaaggctcagcccacgctctcaggagggacaccccctcccaaccctcttcatccatcaccagattagagaacatagaaatctcagccaggtcttcatgttccaatcagggatctggctgttcttgtaaccttctggaaactttcacaataatgctaactatgttgagcactgtccacaatttggccaaatttgagcattccatagattgtgatacagaagataggggttgtcatagcaagatgagtgtcttacagctcagtgtggggtcctgctaccagggtctcacaagagatcagcagcacgggagtagaacaattcaaaaaatagcaactctttttggaacagcgtttccttggagcttgggaaatgatgatgccttactcttcacaacaaacacaggttactgagacaaatactaatcaaggcagctcatctcttgtgccctctgcatcccattcttcattgacattggctgtcatagtcattccaattcaacttgacctcagttcacgtgggagaagagatgtaccagaacagaacatctcgtggtgtgcaggctagcagcactcactgtacacaaaagacagggatctgagttcaagtccctaccttttgcctttggcggtgatatgcgatcgtgggggatgctgtgcaagtaagtcaggtttccaggttgcaattggacagatatacggtgtgagaaatttggctgctgagagcttgattgtaatgaagtccttccagggactcaaggagcctgtcccctttggaggctgccccttcctcagctggctcttgctctatgaaggatatatgctagtagcagggggtacctctcagggctgtgggcttcccagcgacccctcttcttgaagaacaccaacctcaggtaggatcttgcatgtgcttagaagaggtaagggattttagggaatcaatgcctgaatgggttctgactgcacagctaagggagttcctgccatctggtttctgttatgcaaatctgtataaccaaatcagggtcacctttccatggggtctcagggtggtagtgagaagggtgctttctcaggatgaggagctggactcactcattgccttccccacattactgtggtcagttgtcccctgctaaagctctagtcattagctgtcagaaacatctagaaatttccttggacttccaaaggtgaattgacaaaggacagcagctcatagcattgcccagcagaatggcttgatggtcaggggcattccctgagattgaaatgcagcttctaccaagggcctccttcctgcctcccttgtctagaccaggaattcatttcagagctatttccctcgtgttgacattgcccccactcccttgtcaaaacaagtaaaaaatcaaaaggtagataaacataattttaaattgtaaaataagttagaagataacatcctgaaaggaaaatggattgactggcaaaaaacaaacagaaccaataacaaagacaatgaccagaagacaacactcccacatggggcccaaagaggtgagtggccacagttctgggcagcaattgccctgtggccagctagggctaagctgaaatttctgcaaggtcctctgcaagaggtattttccaaggtttgggggctacagattcaggactagaggtaggggtcccacttcaggacagagatatggggaccctggtggttcactcagctgttctttctgcccacaatggcaatgcccactaagccatgagcttggccttcctcttcccatggctagcccctaagccttttattgcatttcaggtccccatcagaaatttcagcagggctcccgcctcttctcagatgctctctcaggcacctctgacccaacaggccaatgtctggaagtggttagtaactgtggtccttttactagcagcccaagtggcttacatgaatgcttacattttgtatttcacagcagctttcagcccttgattccatagtggcctgcccagagggacaagttcttctgctcaacacggcagtcctttctgccttctttaatgtttagtggagaagactcctagggcacaagtgggtagtccacagataaagtgagagtaggctgtggccatggcctgaagtcatagcttactctttcctggaaggcacagtggtggaatgacaccaccagcatatgggtaatctcccctaggggcactgcacctcacaactctagaaggcaacaccacattgtcttctaggcataattttgggcaattgttgctctgtggccaatcagggccaagctagattcccagcagggtccccagaggtattttcaaggtttgggggccacagactctaccccaagctgcaaatagcagcccttgaaacacaacacttggggttggacaacaccatgactgtggaaccacagtcctggttttcaatattgtgtcccatttgttggcagtctgtatagcaggccatgtgccttgcctgctttcccctctttccagatgcctcctcaaaagcagatggaaggcagcacttcttgaaacagtccttctaattttatcaactagacctgcttcattgtgcctgctttgggtcggccctgtgttagggtctggagtgccacttggcctcactgcctgtgggactcagtctgatggaggatacttgtatctgtccgaaatgatccctaaggtgctttagggatctttaatgacattagggatctttaatgacttagggatctttaaagacattaaatgtctttaatgaagccttttttattgttaaatattaatattgcacacaaagaaaagtgcttaagacatatatatgcagctaaacaaattgttgtaaacactagtgtaagcatcacccagctcaagaaatgcagcattgacagcttccccagaagcccccacatgccctacaagtcacagtcgagcccctccttcatccctgacttctatgagaatcacttccttccaatcttttgtattttaccatatcaaggtgcatcccagatcaccatggattacctttgcttgctttcaagtttatagaaatggaataatgcatgttccttttaaattcaaattttagtcttttaattttgaaatacttatagattcacaggaagttgcaaaaatagtacaagaaggtcccatgcaccatttacctggttttccccaatggtaccattttgttcaactgtaacataacattaaaaccagaaaatcgacattgagatgtccactgaccttactcagatttcaccactcatttgtgtgtgtgtatgtgtgtgtgcatgatacatacacattcatttggtcagtcctctttcactcaatattttgcttttaagattcatccatatttgttttcactgccaaatagtatacttttcatatgaatgcaccacagttcatgtggccattctactacaacagacagttaggtagctccagggagattggatactgtgagcatcattgcccatgtctcctaatacgcacaagtactcatttcctgaggatatctatttctcttctgtctatatctatatacagatatataaaagtggaattgttgggtcattggggacagctatcttcaactctgttagataatagaaatgtttcctaaatgcccatccccttatatactcccaccagcaggcagcctgtgagttccaggggctccatatcctcatgaacacttactgtcattactcttgttaattttagccattcttatgggtgagtagtgaagctcattgtggttttcatttgcagttccctggttactaggaaatgtagcaccatttcacggttattagctatttggatttcctggcttgtgaattactggttaagccttttgacagtttttctgttgagttctctctctttttcaaaataatttgtagcattttaaaaatatattctagatataagccctttgtcagttttacatgttgcagataacttctctcagtctgtggcttgctttttcactcttttcatgctacctttcaaaaactaggaattcttcatttttatatagtacagcttgcccatcttttccttatgcttagtgtttttcatgtcatgtttaagaaatttttccctacctttaggtcatgaagatattctcctatatgatcttctgaaagctttatagttttacctttaacatataagtccttaatccatctggacttgatttttgtgttgatgcgaaataagagtcctatttcattttctatcctgtggatacctcagtatccctgcacaattgattgagaagactatcccttctccactcctgtgcagtgtctcctctgttataaattaaactttacgtatgcatggctgtatctctgggctcactcttctactccatcattctatttgtcttgccttataccaataccatggcaggcagaagtctctcaacagctattgacccaggctgtgctcattagggattagaaggataaaagttagctatagtcagattagaaggatcttaaaaatcaattggaaaagcctggacctgacctgaggagcaaaggagtgcgccagcatgttacagagaagagagattatgaatgagcaccttaggaagataaatttgggagtcaaggtaagtctcagtatggggctaagaaaagaatatagaggtcattgtagtggtccaaggctgagatcacagggagcgtggatgaaggaggtggcagtggaaccaaaaaggaagggatgcatccaagagacatttagaagagaaagctgaaatgatggcactttgttacgagtccatgtaagagggaggggattagaaagggcaaaatggcctggaaactgaggggtgattctggtttgatgaaagagacccataaagtagttggtggagtatgttttccaccattcaatcctaaaagttcaatttgtgttcccaagagtcaatcagagaagtcctgactgtataaagatcatcttgacaaggctgttgagcagggatacaccgcccatggcttggacttttgagatttgaagtgagactttgggccatattcaggcccccttaggcattgttgattggatctgctttgcattctgaacacaatttgatcataaggacatcctgaagcatatgatttaatcactaagcaactgtgtttacaaggcaaagttcattcatattaaaacagcagcagccagaaaaatagccaccaaaactaatggaaaaaacaaaacttaaaaacaaaaacaaaaaacagctagctctgggttaagtcatggaactctatgaacttaaacatccaaaaggtactttgaatattcgtaaatacatgtaaacactcgttttattctgttgacctaatatatttaaatgcatgtagcattcttccttgcactctcctacccctgctgatatacaccaaagcattcaggtctaatattattactgaaaagccaaaagcatatttccagatactgaatgtgtataaaaagcagatgaagcaagtcccttgagaaaataaagtcccatagattatgttgtgaaaagacaaaaatagtgtttgcaactcaattacatcaccaattgggtttttaaaaagagaccatacacattttaggtcatgaaatcattcccttaatcctttaaacaacaaatcaaattaaaatttaagataagattcacttggttaaaaatgatatggaaagcattggcaaataattaaaagggatttggtaacgtaataactagctaatttaagcacacatttaataaagaatgggttatgggaggagttagtgtttgtgtttttttcccataggaagaaaaaaagcctgtcattctttgtaagtactactgatgtttgcagaagaaatctaaggtgctatgagagcatgtgagcgcatcctgggcggcaggtgtggagtaagccaatctagaccctggagatgtcccctgaaagactgccagagtccacagtcaaaggaggcgaaaatgcagcatttccaggaagttgtcatcttgaagtttctggagccacctctcatttgttctgtagtgtgagagccaatgctgacttttcttctgggtctcagcaatcctatgctcaagcggttcaacttacacaggtagaaaaaccagaactcacaagtgttctgaacctagatacttacccctctcattcattcattcactcgctcatacacttactcatccatacattcgctcattcattctcacacacacactcctacacattcactcattcgttcattctccactcacacactcactcattcattcattcattctccattcactcacacaaacatactcacaccctcagccattcactcgctcacacattcattcatcccttgactcatacacacagtcattcactcatccattcacacacatgctcactcgctcattcactcactcactcatttcacaaacattccttgagtgaatgcctcatgctgtgggggctgtagaaaagaccagcccttggctccatactctcaggcagtttattcccttgtgagagacacgaatacaaatgaagtagccataccacgaggcagaggaaaataaggataatttggggtaagaaaatgcagggcaagcagaaggagaatttaaatccacctctaaaattctacataatgcacttctcttgtttacctctcttcccatctagaatgtcagctccttgaaggcaggggtttttatctgccttgttcgctgctatattccctatgccaaaaacagtgcttggcacatggcgggtactcattaaaagatctgttgaataaataagtgaattaggggaggaagcaggagagctccctttggaaatgcttcacacaggaaagaatcctggagttggaccttgccaaaagagaagggtcttggtggacagctggagttaaatggcgttttggtctgagggaacagctgaagtgatggcccggggaggggaaattgcatggtgtgttcagggaacagagttgtccagcatagaggaatgtaggacacaaggtgacagtggtgtcagataaagttaggacaagatcactgagagctttcaaagccaggtggcagtgctgtgtgttttcctgcaggtgttgggctctggcgaaagaaatttgacatccacttactgagaaggctgactgcatgcagagcctcacatactgggagacggcagaagagctctgattccatttaccaagtacttattgagcatccactatgtccacagataaaactattagcagaaggtgtagcaggaagggctctggcagggatggaggcagggggtgggccccaagctgggcctcctagcctggctgtcagtcccatgatggagacaggccagctgatcttaagggcccctgcagccctgacattctgggactctaattatagaagacaaagcttcattccagatagctggggaaatccttgggttcaatttcacctcctggggcttgtagttcagctggcactgaggcagttgaaaaggaatggaatggaaatccagagcctgcctcagcccgattgtctctcagctgactgtttgcttctagatgtcagcagctcttttaggaatgcggaacagcagccttttcacaggcaagggtccaggtttggttcctgatcttttcctttgcattgtgaagagggaaggtcatgtgggccaagaggaaatcaaagaccagattccttccagacttcctttccaaaaaagctcaaaggaaaggtagagctgtagtcatatggacaggaccactcttctcataaacaagtctcagctttcatggaagccagtcaaacgggcagctgatagggaagcccccattccaacaggccccagctggttggcctgtcctgggtctgaccaagtggggcccatgggaggccagtggcgttgggtgtcatttctgacacacaagccatacctacacaaagaaaccagcttagagaaaagggctatgaacagtcaaacaattggttaccggaaaatcaccaagacaactcatgaaaaacaaaataaatacatgcctctaacaagctagtaatcagttgcttttatggattgactgaatcccactgtttccttgcaaagtgtgagtgtattagggcccagagcaggaggccaatcccagggaggcccagcaaagtcattcagtgtgtttgagattgatgaagtcaaacacttcccatcagtggagggatgtgaggatgggagggaggaggccaagacccaggaagggtagagccttggcacctgatgctggcagtgcctttgctgagatgggaagccgaggtgaagtctggggtaaaaggtgaaagatccagctggagagcctatgggattgacaagcccatgggtcgtcctggaagagggtcagggaaggagatgggaagacagatctgggctccagatgtatattggggatcacccttcaggcatctcctcactggtctccaggtgggcctcagtgggaggtaggagggcaaagactgaagtccaggtatgaccacagttggtttgaatatggtgcacatatccagcaggctgttgtatatataagttgtatatatgttatatacatatatatagttgtttatataagtctagagctgagggagaggcagtgcttggagccccagggagtggcagtcccctcccccaaccccactccctcctctggcaccagggtcaccagggccacatggtagtttctggtttcaccaaactcttctcaatccctggagctctatgctgggggcttctgggcttccctggggggcttttctgaggacctctagccacttgcccttagtggggactggggggaccctgacaggtcagactctgctgatgtgtcctcattctctggctccattctagtcttgtggaggtgtcactctccaaggcccaccctcagccccagcagacctctgcctccccagtggctcccgctcctcttggccctctatggcagtgatgacaatgatggccctccatggcacctgacggcaatggcgagctcggcggcggggaggggacagcctggactgcatgctgtgtctctgcagtgcatccccactgtgctggggacacagaaccacccacatctgtgctgtggcagggcagggttctgcccccagagcccagggtcatatcagtcccttgtatgtcttagccaggccagggacgtgcctatgggtctgtgactgatctctcacctgttctctttagagagtggccccgcaagaggagcagctgagaaaggcaccagcctgcaaatggcagagccctccagcttgtgggcaggaggccactccttcgaagggctatgggagacagatagacattcaggcaggagtcccaaaggaactcagagcccaggccccatccctgcatctccctgacagcctgggaaggagggagggagggagaaacagagggaaggagggagggagagaaggagggagagagggatggaaagaaaggggaagagagggaggggggatggagggagggggagagagggggaaggagggaaggaggtccatggttcccctgagcatccactgggaaagccccatcagccaccactggggccgaggccgctgtttctgagatgtgtcttgtgctcccggggacagtgtgcacccatggggcagatgccaccttcaccaggtgaatttgcagaaggactcagagtcacccaaaccaggtgggacattttcccactctgaccccagcattatactggttccttctgaggatcttggacggggctgctgggtcctccagagcccagggcacctggggaggccctgctgagagccccagctgaggactcagggaccgcccccgccccggggccttgacttgcaagggacctcgggcacagccctgcctcctgtgggcctggatctccccacctgtcagcactttgtgctgggggcctgcctgacccgagaggccctgcctgtctttcccacaggctcccagagactgaccggcttaaggctcgaggcgtgccagggcccccggagtcaccctgcatcagctcttgccgcctgctgcctgggcacgggagaccacactggtggaggggatgagacagggcaggcccagccttgggacacccctgtccccacagctccagtgactgggtgcttcccccagccctgcagagcagcctgccccactgcagacagtgctggtccagggaggtcctcacaggacaaccagagttgtgatgcgggtgatgatcagaagctgtgagtgtggaggaggcaggttctctctgtctagccattgtacagatgaggaaacggtggcccaacgccacacagtgcccagcaggggtggccccaggagccagtattccagttcaggcttgactgacctcataacccccaaactggctcatgctgcctcccggctatgctctaagatccccaaaggggaggccctcactagacccccatcctgtccaatgcccagcactgtgccaggcagaaaagtgacaaacagttggcatctcttaaagggtggtccagccgaaggagctgcccacccagctagagagggagcagcaccctgtccaggtctgtcctgatgaatggggcctgtatgagggaggcctgtttctgcaaagaggctgtcctttgccagccctgcacaccctcccactcaaacctgttgctctctgcagcagtggctgacttgagactcagtgttctctgttctttcagggcaaataaagctgacgtgttggcctccagctctgtgagggagggaagaggtaccttgggctcccagctcctgcccacacacagtagacctgggggctgggtttcctccccagaggaacactggtccccactgaaccacatgtgaaaccttggcattgttgactaaattatggcagagggatagggcagtttgggtcgggtgggagaggagctggggagatagggaggagtgttcatgggggtggggtgaggagaggcggagaggggtgccttccatgtcttctaagggatgtcttcaatgtctgctgtgtggacacgggagaccacactcgtggagaggatgagacggggcaggcccagccttttgggacatccctgtttccccacctccagtcccagctccagtgacagagtgctccccagcaagggggacgataaagggtactaacccagcttgtccttccccaggacaacagcagtctatgcacacctcagagagcccaggagaccacagccccttgcagacaacccactgtgggctcctgagagtttgtccctgggcagacatcatcctttgcttaggtgatggtagcttgttttttgcctcttgttcattttatttttagacccacttggccagcctgtctcccagcctttgcagaatgtgagcgtgcccagagaaagtggtgggcacattagtgaggcgggcaggaagacgggtacactgaggggctgtgaggacagctgataaaatgtttgcttagcttcatctatttattagcatggttagaaactgctatttatattttaacccttcagagacagtcgtgaatctctggataaaaagagttggttgatttccagcctggaaagtgagaaataatcaatagtcacagatctggtcaggactgccaagggcgggagcctgctggggtgtggcccccacccgttggtctgagatgcccaagagtggctgccaggaatggtgggcatcaccatgctcacgccacaccaccccctcagcttacatggtctcactcagctactcacgtggccattggtgctgtttatgtgaggatcaatataagcaaagtgcagaaaatgctcatggaaactgtggctggcaaatcgtgatagggtttcacacctgggaaaatggagactcctcccccgaccctccacaactgtgggaagtgctgggagccatgcggggagtggccaagctgcaataagaaccagggccaaggttccttcccctatgtagaagataaagttgaagggaaaggagggggtggggggagggtgggaggggtgcagaagctccctctcctgttttcccaccaccaggaagtatccatggggaatgatgcaccctgcctcttctcagggtggtgtcccacttctgagcaggtacagaccaccctgtcacagctttttctttgcagctgctcatgccaaggtcgggttggttagaggcccctgtggagttatggggggtggtgatcagatgagcctctctttgagggagagccactccagctcaaatccactctgatcctgccactgcctccccagagggctggcaggtgtgactgaagtcaccaaggggtcaggctgtggtgcccatgctcagggagggacttggggcctggcatgtgtatgaacctggcaagtgtttttgggagcgaactgagaaatttcctaatattaatatgtttccactacaagctgtttgcatctcagatgcccttgtatttagtctgctgtaatggtgatgttttggaacacttatcaacaagcattttgacaatttgctgtggttttaggagcactggctcctgtctttgcagcttattaatgggagacagtttaagcatatgtgtagacataactgagttcttcctggagcaaaaccgaagtgcaagcatctcagaatttaactggaaataaagcaacccaaatctgtctcctgtcccatgagatcacttaaccttgcaaaagggaccaagcaatgtgcatttcagttcctgatggggttttcctgtggggtctgaagactctagtggtctcctttcctatgaatttatggcatcaagcctccatctactaagtctaatcctcagtgtaggtgagagggaaatgaaagggcaccagcctggcagacgtgaaggccaacgcacccctggcctgctctgcacagccccagcccagccttccctggcacctgattggagctcaggtttagtgcaattaacagctcaagcccatagctcatgtctaaatttacattcatcataatccaaaagcaaacatgtgcctttgatagctctgatttattcataggatcagtttgctgttcacgtcttaattgtttttttaatagcttcgcggtagaaaatcaaagcctgatgagttttgtattatacaaacttattttcttgcttttttttgtttttcagtttttaaaacttaaaatatctaattaatccgtgtaatctggatacattctgtttaaacctttcatgctcatataaaataatgatgcaaatgtagctaattggtatagcaggttttttcctttttttttttttttttttttgtttgtttttttgtcttgccagatacatcagcaaatatatgttcaggacaagaaggttgtgaagcaagaaaacgaatgaaatcccaacgatcagggggatgttaaaggagctttactacccattggcaaatgttaacaaagattcctggaaagaagttcagttagcacagcgctgaggggcactcttcttcctttggcctccgtttcacagagtacttgcctgagaggggccccttcgggccccgtggccaggcagtgccctgatagcgcccgccttctccaagcctcacttgtgcattggcaaagctttctgcagccttaatcccatcacctcctgccagccgtgttgtgagcctgcctttcctcttagcatctccctcttggcagactggcgagcgagtgagcaagggcaatgcttgtctgcagccactcagctagtccatgcagaagccaggaagtgatcttagagctgtctgactacagatccttggcctctccctctgtggtctgaggaaaattcccctgacctcagccttgagtcacctctgaggtcgagaggtctgcggaggcagaggaaggctgggacacaccagtgcacaccagctcagccatctcctggctcaggagcatctctagagcttgccgacacatctcagttggcaaccctggccgccctcccctgcctccagagcccctatccctgtcattccccagccttgcctgcttaggctcagaactgaaatcccaagaaacaaagaggcgattcaggtgcaaatatccctaatgaataaagaaaggagattcacttgccagattatttaaggcaagttgtcaaagccatttctctttagcaagcacgttacttctgggggcggggagtgcggggatgggggtgagggcctgtaaagggcaccagccactctccaaagcctgtcttcagattccctcctggaaccagtacctgcaaggaagaatggatgagcaatttgcaaaacattaccactggcggagtgaggaaagctcctaggaacaggtttatttgactagactctgggcagacagattataaacttgccttgtcaccaggagactaaagatgaggatacgagactccttggacgtttcccagcaggctgggtccctcccaggactctgctgatgtgtctgcaggagggctactggcaactccctgtggccaccactaccaccaccacctgcccagggagctgccttaggggtagtgccgctcagggtcccaagtaattagaagctgcattggactcaaagaccttgtcctggtgcttctccactttggcttagaaacaggctgtgatggaaaggaagactcacaaggctgggcctcatttcctttttggccattctcacctccattccaacatcaagacattgtgcagaccccacataacagcagctagcaatatttttatcatctgttgactgaggaacacacaaggataaacagctgatttgagtttagcatcggtcttcgatgcaactttcattgatcatactagctcccagagacatagagctatgaaagttacatccatctacagacagtgcttggtatacacacggatccaggcactcctggcagtaagaaaatcaccatcactgggctaaactcatggtgtcggcaggaccaggctccttaaagctcaggggagaaaacttccttctccctccagcttctggtggctctgggtgctgcttggcttgtcactgcatcattcgctccagtctctgcctccatcttcacatgaccctctcccctgtgtgcctcttctgtctgtgtcttctcttctaaggacacttgtcattgcatttagggcccactgagatcattcgggatcatctcatcttaagattcttaccttaattgcatccgtaaagacacttttttcaaataagttcacacacccttgctcataagcctttaaaggctctctgctgcctctgagatgctgcctgagctgctccatctggcactcaacactccccagtcagaccccagccctcctctgcagccctcctctctctgcaccgcatcctcctcacacacatctctatcctaacctggccgctttgctcctccagcataccctgacttctcctgcccctatgcctctattctttcttcctcgcatagaatactcttccacacctaccagcctccttttcactcttccaggctcagctcaaaccctactacctctgagaagccttcccagtctggccgtgctgagaatgactccctccctctgcatggttctttccagaggattcatatccagatcacggccaaccctgcggcaaactcacctaattaggacttcctttctcccttgaggggatggggttttactttccctgggatctctgacaccttgtacacgatagggtatacaatggatttttgttgaatggaagtggaggcgatttgtgcatctcttgttgcccccattgcttagtggagaagaaaattaactatgtccaagaggggagaaaaggtacaaaaacgagctgagagagaagggattcagagtcacccagtatgacagatggcattcagagatcctgactcctgccctggcctctcccacttccctctactacagtttagaatccctagggcacccctttgcctcctgcagcactttgaaggcctgaagttgcccttggcatagacacttggggttcagactgttgacatgtaacatgagtgcagatcttgttcagattgccacagcctttgcagatgtccctgaagtccccttcccacttcttccttgctttttgccaagggtagacctcttccttttggctcctctggctgttgggaaagtaaggctggtcctttctgtctggacctcatgcccacagctagaggccgcacccaaccccaactaagcaacacctctggagtctgtccccagaacctccctgacttgcccccaccaccccaggatgcatggcccccaggcagccattcactctgctcactcagggacttgctctctttgtccacagtttctttttgacttcctaggctcttcacacctgcctccattggagtaccagctcaagggctccatcctgcagccactatggagggggggaggggtgggcagagcatgaactgtaacatcagccctgggttcacatcccagccctctgctttttgctagcttgtgacctgctttgagcctcatttcccgatggacacattcattcacttattcagaaaaaggagaaggaaggaaggaagagagagagagagagagagagagagagagaaagaagggaaagaagaaagagagagagaaggaaagaagaaagaaagaaaaaggaagaaagaaagaaaaagaaaaagaaagaaagaaagaaaaagaaaaagaaagaaaggaaaagaaaagagaaaagaaaagaaaaaagatctttatggagcacctaccaggtaccacacctacggtgtgctagacatcagcagcagcagcagtgtaacagtgcaaaggacaaaatccctgccctcaaggggctccccttctggtgaggtgctagccatgtgaataagcagactagaatgggacagagggtacagggttgtgccatgccctgtgctctgatgtgactactgggctcctcaacaactcccactgtcaagcattatattccaagagcacagtgaagggttagggactagagaattcttacttgcaataaaaagtcattttccctgcaaggatttcaataagagagatttttgggaaaaaataatagctatgggtgtatttggccattgcaaaagataatcagctgctccaaatgcatagaacagccttaagtaccacaggacctgccttcaacagcaaatacagccacagtcaagtttgtgtgccctcgagtttaatatggtgtgattgataaactgcacataatttaatagtttttcaggaagaaagagagaatcagcaacatggcattgaaggtacccgttgacagtgacgtgcatcacagcattaacaggtgaggaaagcatgcggctctgaaaaccctctccttgcagcccagctcacgacccacaaaggcctgcggtgaggccagtcactctgctagcacagccagtttgtctgtcagtcacaggcaacagtcttcctcctgccccctccctgcccccatagccccagttcccaactctgatcatgttataaccaagagcaaaatgtgatgcttctctgttctggcaggagaaatgcttgtgtgtgcaaatgggagacaaaggaaagggaccaccacatccatggagtgcaccgcgtgagagaaatgctcaggaagggaattgaccagattggctgtggagagaaaagagaaggaacatgggaggcagaggtatacccaggcttctggcaggttacggagacctgtacccaggaaagaaacaacagtcggcaggggagctccaggtctggatccgccttgagcagggatcattgtgtgtgcctgaagctccgttttccatggccagctctattatgagggctcaggggagctgggttaggctagccatgtcccattcctgaaaggccagctctgggtcagaaatgtgacctctctctcctaaagccccagagactgagtgctccttgtgcatctccctaaatcctgttgtttgtccaggctctagctgggtcccccttagcagcccgctcagcaaggcaggcctggagtcccaccactggggcttctctctcagttggttccacctctcctagctgagcaaccaggctttcactgctgaatgtctgagccagctccatcgtacaacaggagtgagggaagtacctgcttcacaaggttgtcatagccatcaaatgggatcacactctaaaggcaggtagggcagtgcctgcatggcacttggtggatggtcaataagactttatccttcttccttcatcttcctcttcctccttcctgtttcccctcctctccttggtattgttgctattttgtattggtttctgtgcctactgtaacaaattaccataaacttcgtggcttaaaacagtgacaacttattcactgatgcagaaatgtatttattcatttattctccaacagttctggaggccagaaatcagaaatcaaggtgtcagcagttccaagctccctgcgaaggctctaggggataatccttccttgcttcttccagcttctggtggatccaggtgttcctttggcttgtggccgtatcactccaacctctggctccatcttcacccttacctacttccctgtgtatcttgaatctcctgccactctcttataatgacacgtcattggatttagtgcctatttgga

SEQ ID NO: 3935 - DNA, 108678 bp, human
cgtagcccacgaagggatcttgctgggttctcggaggtggccccagcgctttccgagggccgagagcgtgggcgtggagggaaggaggggcctagtgggcggcgggcccacccctttattcgtggcctgcggctccgctgagcgtgaccagatgtgttggtgacaggttgctactcagaggtgcggacaggagctgagcgctgctgctgtcggagcagacgcggcgttcccgggttgtgctcagcccctgcagctgccatcggctggagaagtccaggttaggaaacgcatccggggaggggatcctagagaaggggcgcagccaaatacccgggaggtgggataggtgggaggggagtcgctggactcggcgccagggcagatggtggacagggcgcgctggcccgcccggcagttcccaaggaacctatgttcctgcagaagccgcaggtgtccgtcttgggataactgcggagggagccaatccagcccagcttgggcgggagcatcgcgtgccctggtccagtggaacgggagactggccagcgagcctggactctgagctaagcgtactggcgggcgacgccgacagcgtccgcgctaagggtgggggactgggaagtggggagtggggcactcggccgggatggagagaatgcagttcactaactgccacctgagagccctggtccccgctgccgccacagcgggtctgtttggcagtcagggcgcgagctggtgagcggatgcgtgggcggagggactggcgctacccacccagcagccacccactgcaggtgagtgcccctcccagggcgaggggaggagaagggcctggccgctagccctagggtcaggctctggtgaaaatgggaagggggatgggggctgaataggctactttgtgatgagactcccgtccctgtgacacttcagggtcctctggggatctgtcattcctcttgcaagctctcttgttctctggtccctctcctcctctccttatttcctcctctcctctcctctcctctcatctcctctcctctcctctcccttcatcgtgtctctacctctatctccgccggtgcctctctcggtatctgtctctcagtctctgccttctctgtgtctcgtacggtctcctgtctttcttggtctctcggtcctgagcgctctctcgccctgtcactgatgaccgctggcttttggctctccgtgctcgctcttcgtgtgtcccggccacgcacggctcaccagctcgttttccccagacgcggaaagtctaccttcggcgtgcgggtttcccaagcgcgccgggccccgcctgcggccctccggcgggctctgtctgctggaggcgctccgctaaccctgctgtcgcctctttccaccagcgcaccgcctaggcaagccagctgacgccgggggcacagaccaccctccactgagtgcggagcagccaaggtgagtgcaccgatgccccttccgcccctccgatccctccccagctgccctggttcgagccgactggagaaatgaggctgcaacagcgaagccagcctgcggccgctttctcctctaaagactggtgggagggcccgggaggcccctcgggcggccgcagctctttggctgcccgctgccccatcccggagtggaaaccctgagtttccaggcttcgggctggcggggtcgcgggcagggcagcgcggcttcccctttaaggccggagccgctcgtcgccgtgagtgtgagggtgtgtgagtgtgcggcgtgcgtgtctcctcctccccgagtgacacagcagtgagaaatgcctatcagtaacttaaacccccgaaactccaccttccgggcgcgcggcgcggagccgggcggtgggaatggagcgagcagattgaggccgccactgcagcgccgccagcatgaacttggccgcgagctgaagcggccggcggcgggcgggcgcgggggcaccggccgctagccagggggtgatctgcaacagggctgggttccttggcggccgcctgagtccaggctgcccgcgccggcggccgcccgcccctcggacactgcccccgccgccgccggagctctgcagcacggtaaggctgagggcgggtgcaggaagtctgactgttctgggggttccggggtacacttgtagcccccagttatggtccccatcgctgaggatcggggtcccaggggtgcttcgagtcggtagaccctaaagtttgctctgagcacacggcccacctggcgctgcgggcggccacccccttctcgaaccagcccggctgggctgggcgcagctcgaaacgccggagaccacggcctttggctcggcgcccgtcgggcgtctgaaatccggcggggacagccacgtaccggggaggaaaggtagaagggcgcaagctcctcgggctacgctgggctactgggaggctcccactctgtcccagcacccccgggtcgcttgcagcctgggtgtcaccggcgacggtgccttcacatgccagctgcctgagcccaggccagtaggcagtgggcgctggatgaaggatttccccaccccaacgctgtttgccgcctctgagcgagagtgtggagtgtgcgcgccgaatccgctgccctgcactccctcccctgccaactcctgggaagcgcagcccggagctgagctggtgttcagggcagcccggactgggttcctgcggagcagccccggcgcccctgcgtcagagtccgcgcttcaggttccccagcatccgcgcgacgacagagctgggcgcccggcgccggctagcgcgggcgggaagccccccggagcgccgccaaatacttttctcggccagttggcttggccaggctccgtcccaatgcagtgtgtccgaagcctcctggaaagctggagatgtcgtctgattctgatccgtgattaaattcggactgagcagacactaataggattagcctgccagaaagctcggccctgaagccatcggaacctgtgcaaacacgcgcctcgggctggagcattcactcccgccccgccgcgcttctgcagctgggtgcggctgacctgggcacccggagtgtgggtgtgtgtgagcgggcgggagcacagcgtggctgggggacgtggggagaaggggctgcttttgctggggtggcttgtcgttgttgtttggcaccacggtgccccccgggggcgcggtccccacggtgaacgtgctgctcacgggtaggcaaacccaggccggctccgggacattgtctgcaagggcgagcgagccgagcttactagaggcggctgcgctggaacaaaggcgcaaagtctccctgagaccaagcaattttgaaagagttggctagggagagggcctgggtctcccggggtagacccccgcgggaattgcgccgcccccagcggccccggcccgcgcctggggaattgtgttccctggttgcggtgagccggcgagcgacatcgcagcggcgcggcccagctcttggcaggcgtgggttgccgcccgagtgcccaccggccgggcggggtcgaccgtgcacccgccggggcttcccggccgccaccgcagctctgggcccctggaggccgcgcagcttctttccttccctccctcccacctcttcttgtctttatagatcccccctccctcccacccccgccgccgccgccgccaacaatccgctttataaaaagcccctttgtttcccaggaggctggagagagggaaggggaaaagggacgcagaggcagagggcgggggcggctgtctccaagtggtttcgagccgctcgggacaggagggcaagtgtaggcgatgggggagggggctgtgtttcgaggaccctctgtgggaacccacgaaggcgcacggagcctcagccccggccctcgctgcacgcccggcctgccagccctggacaccctaaatcctggcggccgggacggccgagtggactgcactgcgagctggcgggcgcgcgcagaggccctaggctgcaagcgctccgcggggtgggcagacgcgactcgccgatgcgctcgccgggctcgggcatagggggcgccctttccttggtttcgctttgcagcgggcgcccctcgccgccggagctcagggcagctgtcgcgcccgccggtggctaagacggaggcggcagctcggaggcttaggccacccgcgtctggctacacgcctcatttcttcccgcgccctcctgccacaccctccgccccaccacacacaagggctcaaactctccgagcgccctttgtttggaggcgcggaggcagtgggagccgccacctccggggttcgtgtagcctaggcgggcagtgaggatgagcgtgctactctggactgcgcgctggcctgctgcctctgcacctaacccagcgcctgacactaaagctgccagctttagttagattgaccatttagcgggtccttgtcccttataactgcccccctaaaactttcgagaaccagggcttgcactgaggaatgtcaaatataatgttagaagtaacctttcgccattctgttggcctgctccgcccctgtgccccaaagtggtcggtgtctctcatagagtttgttcgggaagggaatactgaaaagaaaaaagtgacaaataaggaaagtgggcggggcccaggctcaggctggtgggtctcccaagcgaagtcagattccacccgctctctggccgcctccgcccctcctacttccatttaatctgatgtcgacgttttatttgtgcctttttgcatatctttctcctactcccctcccctcccatctctggaggttattgataagtgctgctcaaacatttgttttctgcgtctttggagtagaagatgaagcgttaacacccccaacgcgcatacacacatcccaaatgcgcgcatacacacatcccaactgcatctaaaaccacaagaaagtaatcaaagggtaaactactggttctgccttctcctccctcctttgtgcttctcttctggagcaagatcattggaaaataaagctgctgatgtgcgagatggaacatatggtgcctccataagagagaagctgaaatggccttgaacctgccggacagaccagctgtttgctgccagccagagcagctaatcagcttcttccccttaaagtaacagccctcttttcacttcatgaccagtttgcatattaaataggatattctccagaggggaaaagtgatgggctcctatactgctttgtgcttggtggttctccaatgcctgctccctgctctgggggccgccctgccctctcccggtgcctgcctgcgatgtgcgagtgtttctttcagtactgaagtaagaatgttgctcaaagtggaacttgggacagacgaggcaggaaaaaagaaagaaagaggtggggctgagagatttccagatgcctgggaggaaatctctctgttttgttcagcttcggaaaaaactagcattctttcccccctttccccctttaaaaatatcacaaagagctgaagcttttccttacaagatctccttaaaaatcatcctcttccggctgtgaccattttcagtttttcttcagtacaatgtgttggggtggggggtggggaagagtttggcgttggaagaagaaagcctttaggagatacaaggaaattccatgttaggaaatcattagcaaagggtgacttcgtctgttttcctgccactgacgctgacagtgacacagatgtgtgggttgaaataggaacgtcattgaatttttacactccaccaggaaataccctgtttctggggtgggggtggggtctacagattcactgcaacttaaggtaggagattcactactgtcaatcctttttactaaggaaagggatttttttagcttagccagcatgtttaatgtattttcttcccttttaaattgatcacctaaaggcataaaatgcacctgttaatggatggtccctaggaaactcaattactatttggggttatgaaagggaataaactggtcttagacaagtggctcttctgaaaatagctggactatgcctcttctttaaaggagcctcaatatacagtaaaacctttttttattattgcactttaagttctagggtacatgtgcacaacgtgcaggtttgttacatatgtatacatgtgccatgttggtgtgctgcacccattaactcgtcatttaacattaggtatatctcctaatgctgtccctccctcctccccccaccccacgacaggccccggtgtgtgatgttccccttcctgtgtccatgtgttctcattgttcaattcccacctatgagtgagaacatgcggtgtttggttttttgtccttgcgatagtttgctgagaatgatggtttctagcttcatccatgtccctacaaaggacatgaactcatccttttttatggctgcgtagtattccatggtgtatatgtgccacattttcttaagccagtctatcattgatggacatttgggttggttccaagtctttgctattgtgaatagtgccacaataaacatacgtgtgcatgtgtctttatagcagcatgatttataatcctttgggtatatacccagtaatgggatggctgggtcaaatggtatttctacttctagatccttgaggaattgccacactgtcttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgctggctgcgtaaatgtcttcttttgagaagtgtctgttcatatccttcgcccaatttttgatggggttgttttttttttttcttgtaaatttgtttgagttctttgtagattctgtatattagccctttgtcagatgagtagattgcaaaaattttctcccgttctgtaggttgcccgttcactctgatggtagtttcttttgctgtgcagaagctctttagtttaattagatcccatttgtcaattttggcttttgttgccattgcttttggtgttttagacatgaagtccttgcccatgcctatgtcctgaatggcattgcctaggttttcttctagggtttttatggttttaggtctcacatttaagtctttaatccatcttgaattaatttttgtataaggtataaggaagggatccagtttcagctttctacatatggctagccagttttcccagcatcttttattaaatagggaatcctttccccatttcttgtttttgtcaggtttgtcaaagatcagatggttgtagatgtgtggtattatttctgagggctctgttctgttccattggtctatatctctgctttggtaccagtaccatgctgttttggttactgtagccttgtagtatagtttgaagtcaggtagcatgatgcctccagctttgttcttttggcttaggattgtcttggcaatgcaggctcttttttggttccatatgaactttaaagtagttttttccaattctgtgaagaaagtcattggtagcttgatggggatggcattgaataaaccctttttttttaagattctgattttttttttttctgcaacagtgcattgcacagatcattagcctaggagctgggaaacttgtgttctagaaagttctgcccactaattaacagagtgatcttggacaagtccatcctttctctcccccaatcccatgacctctgagtctgagtcccttccagttctaaaacactatggtttgtgaatgaaatagtcattttctgggaaagtgaaacatcaagttcaaccttgtcattgggaaacagctagacagataataaaaaggggctgatattttgaagggcaaggataaaaaggaggagtaaaaaaatggcagaaggccaatcaaaacaatacaaaagtgtgaagtgttcacctttttgtgtcttttgcaagtgtgaacttctaacccagaatcagagacagcagacatcagaaatcaacccaaagtttctcttgtccagtactcctattgatggcaggcctcctaatcattgggttggtatacagataacgggatctaaactctttagagtagactggcatatttccaaaggactcatctaatgtagagcagatttgctgctttgcagttatttagtgaaggtttcaaagacaaaaaggccttccatccacacacacgtgcaccactggggtgtgggttctgaacccattgttgaaccttttcttttcttcctaatccagctgtttttttttttaatcacatttccaactttggggatacagcagccatgtaagaacctgctgctgtcctacttgatgttaatattgattttttaaaggggcaggggtgaacattatgaagaaggactctttatcctctgagttctttggcaattatcttgctgccataaatgttgatacacatataatggatgtaactaaaaaactccttatccaagcagaaaaggctgagtgtttgttggagcagatagaatgctgagagtgtgaatagaccaacccagatgtcactggggagggagataaatgatggaggaacaggagccggttactatggatcagcacaataaaccaattcccatcatacacctctcacaacgccaccgaggggtaacctaggcagcaccagtcaactgtatggcaggaaaaaagcattgcaaagctcaattggaactggcctggttttgtaggcattgggtccttaaacatcttcagtacttcgaggaggaaaatttcataaatccgaatgaacctgaagagactgtgttgcaaatacttattacttcttatttttgttgtgtcattgttgttctttagtctgtaaaggtgtcaaaggaagaagaaaaggccccatggagctgtcaggacagttagtcagggggttctccatggaggtaagaaacagtagcttgtgttataggatatttacatgccaagattggaggtgcatagtcctgtggggtcctgctcccaaattaccagcccagggctgctgaagccccaagagcattttcttccagaggtggagacagaagcaaaagagttgggttaccttatttccctgcctccacccccccagctctggttgctttctttctccccttcacagagcctccctggtttccttcaaacctcgagttttctcctaaaatctgacatctttataacatccaaagcaatcagatatgaaacagttcaaaaatattccccccgggggagggaatagcaaggggcctccctggctgtaggcactgagctcccagagtaaaggcttccagagacagggcctaaggagggtttgggagcaagaagcaaaaagctctttgcaaagtttaggagagctttccttgcccagattggctatcttgagcctccctgaggccccagcttcagactactccctcccttcctcggcctgcaagagggtgggctcttcatacccctggaggaggaccccccacccacccaccaaggcaactcagtcctgcccggctgccctctgacctggacacagccagtgcccctttctgcacagcccagttggagcctcccagacccccatttccttggtgggcaggtggggtaagctaccttaccctcccatgtgccctgctgcttgttctgccaagtaaataaccagtaagtggattttgggaaaggccattttcttaaggctgagaattgttccctgaggttcagagaaggatggagtggaccaggtgatatcatcttgttggaagagggcctagcaggccagccgttgattttttcccctttcttccacctgtgcgagtacctagacactagaccacagggacagttttctgctgattttggaagagatcattggaggccacagcacctgagctagttaatggcatccaggtcaaaaaggcctggtggccccagcttgtgttcacctgtgagaggaaagtgtgggtctttggagcataaagacaggaaaaaaacaaagtcaagtaattctgaacacattgaggaattccaagttcttggtccaattgtcccagctccaccctcaccccacaagtaatgcatttctattttttcctgcatttgaatccgaaattccactctcagcttcggcagcgtgctgtgacagagtggggaggaggaagacaggacccagctctgccttcctttctgtggctatgccagtcagttgaccattgcacctgtacatagttagcacaggtgcaccacctcacctgcaaactcagatgttgaaagatggagaatcttacagctggaagagtaaaaccccatgattttacagaagaggaaactgaggcccagagaagcgtctgactttcctatggggacatagtaaagggagcccaaagttgacagaaccctggtctctagttctcagtcaagtgtagaacatccattttgcacccatgtgtgagcagacaggctttccttttgaggcagagcaaatgtggtaaaaagaaatgcagccaatggagggggagcgcttgtaactgtggcgtaatataatctaccctgtatcaacgtgtgctttgctcagcattgttaggacagcaaaggggcatattagaatctgaactcgaagtctggaagtagctggagaatggagattgtaaattaagaattagaaggtagtgtgtgtctcgttttcgagttgctgtcagagagtcaggcagccagccctgtggagggcttggctgggtgggctcctctggcaatggtgggaggttgtttgggtttggctcttaatgagatctcagtgttaatatctgcctctggaagttccagcaccagcctcggaattttaagtgggacagtagttttggtgcagttgccaacgtcacatggtttgcgtgtctaattctgaaagactggcatgctttatgctaggcttcgggaggagggcacagcgtttctaagctgcttgtctgtcaaggattaatttaacctctaattactacattttcttcgcagtttgctgcacgaacatgttgtaacaaagctcaaagaagtatgccattttatttccctgccactctaaaattaatttccggaatacggagtcaaacctgacacacttggtgttaaaataattgtgctgacattcgagctaaagtgaacaatctggttgtttctagtgatcccccagccatggggtaaagagcattatcatgttagttgccatgacagttctcgaaatgagccctgaaaatatcaaggagtgtcactgcactaatcccaccaggggagcaccagacacaaaggtaacacccgagcacatggctggggtgttagttttggagtatgactgatgccctgtgcaatagggcagccagggagtcctttctcacccactaatagggctcgtggtgaggtcttgtcccacagcacgaggtgagcacattatcaaatcggaggctcccaagagcctgcccctggggccaaacctgttctgagtggctgtgacaatgaaatcacaagatgaagttaatggggattctccaggcaggcttttctccctcctcctgcctgctcttcctgggcgtcccgcaccagcaatccccaagagtaacagccctttggcagtcccacatatctcttttatccccaccttcccaaacagcagcagtggatcccagagtgggaggcccgttccccattctgggtgcttgagaagactgcattctcaggccctggttggggagacttagcagcattgttggttgcctagtttgggtccaccgaagctgatttgtgggatttgagagttggccaggttagccatttgagttctcatctccttgctcaggtggttgtgaagagctctctctctctctctcacacacacacacacacacaggtacacacacacagacacactcacacactcaccctctctcaggagtagaactttgccaagatagcaaaggctaggtctgaagccctattctgcatatggctggggacaggctcactggcattttcagccatgcctttggctgccaaatcccgagcaaatcgagtttaggttcagtacccctacattttccttaccggtttctagacttgcctcctgcttctcacaccccctctccaccttacctagaaagatgccatcctcagcccgctgtaccttagtgggattcccttcctctggagaatctggagcctctaacttgaattaaaagatgcaagagttaccatgccttggagagaatctgctgtttagggcacaggtaaggaggtattcagggcttagggaagccctctaatccacaccccaccctccaccccaccaaatggtaccatgcctggcataaagctggtcctatttatgagttagagaactgcctggttgccaaggtttttctgagcttgccctcagggaagctaaccccagttggtctcttgaacctcaaatcataacaaaaatgactccctatcctctgaagcaggagtggctgtttgcctcttagggatcacagacttctttgtgaatctgatgaaaactctgggtcttctccttagacaattgaaaaataacacgcaatgttgcatctaatttagggtactactaggccttaagcccactcatggttctctcgaggatcttttgtcacaggttaagaaagcctcaatatgagctttcggcaggagacattgaccaactgtgggattttaggcaagtctgtgaacctgccaagtctcagtgccctcagttgtcagatggaaatatcagaatgtcagttccaccaagtttggagcattgtgggagattcaaaagagacggtgttggtgagatggtcctgtaaatatcaggctcagggcacactcatgggttgctctctttagtgtcagtgtttactatttattttgcatttccatttgatgtgagaaatttaacaagagaaaatcaggcttcttttgacttgaaaagtcattttgtccctttctttgatactgcataagttacgcccaggcaaactggcattaaagagactctggcttgggagggacctcaaagagcatgcagtgtgtccaggatctagacagttttagagatcccaattacccagccctcggcagttccagaatgggtcaaggatgtgtgtagccagtccagtgccttgaggaggttccacatttgcctgctgcagaagtgagaaaatgggatctgaggaggcagatagttgtttggtttttcacatttcagtacggtcacaccgggcatgagaaggtaaagtggatcctgggtgtctctctcatagtcactgaaagggcctagccagaccctcatgaaaactgggaagtagtctcaccccaggatctgtccagggccccatcctgaggaagtggggtcgtgtccttttggagaggagcctcaggttgggcctgctggtgtgtggggggtctgcttaggagggaagaggatggctggactccattcaaataagacttccacaaccttccccgtctaaccctggaagtgtggaaagtcttctcatggcaaggccacgagggctcatatatcaaagatggggaaactgaggcccagagaggagcaggtgctggccctgggtctcatgacaagtcatgaagacatttccttggcccttgttgatcctgtgcaccttccaagttctctgtctggctcctcacaatagtgtattttcaattctcctagaaacacaagcccatcatcatattaacctggccctgatgaatgctcaggtcctcaaagtcagccctagaaagtaaatagcaggtttggaaagccctttgaaccctcagagggagatcctggccttgctcagcctgttgctatgcagttccaaagtggaggctgccacgcatttgcagagcttttaagtcccttcccccaccccatgtgcattttaggaaccttttggaaagaaatgtgttgctaggagcttgggctttccctctcctttagaaagagagaactgtttttgctttgaattgccttgcaaacagattgaggtgtctccctacccattctttcttttgttaaaccaacccgatttgccacgggtagttaagtggagatcatgttgaaaaagagtgcttagcacagggtcactacgcagagtggctcccattcccatccttggcagagcatctcacccttaatttcattattaatctggagggagaggaatcgtgcaagtcagttgaaagcagatgccacctaggaattttaggtccatcacgtcatcaaacaaaatgagagtagtttgtaaattggaaagtttggcagtgggtggttgccctttggaagattcactgtttcagaccagctttctgagtctgggaggagtccctggtgctacagtgggaagaatacccacctgagggccaccgacatgtggtctggcttcagctttgataccaactagccatggcacttggggcaagctatttcctcagactgggcatcattttctccatctgtacaatgaaggaatggtgtaggggcatccaaagggctcctccagctctggcatttctgaattctccagtagcaagttaaactctaagttacttaaaatatttgaaaaggataagtaataatttgttctttttgaaattaccagagacttgaaagcatggggttgtatttttgtttgggtaggtggggactgtgactgttacataagtgataacagttttagaagttttagctaaagacaaagttgacatgtatttatgtaggaccaaataatagaaaaaaattcctttagagaccccttgttttatgcttgaggatgctgcagctgaagaaaaatatcatgcttgcccaggcttccctggcaagctgctaggagctgaggtggtccaggacccaggaggcccagcttgcaacccactgcttgccccacaccgcacttcctaggatcttacagaagaagcctccaggccctcaactccaaatgggacctgcagtcagcagaatatagggctgagtgattctgatttctagctatcagatactagcttatcagaatggaatttttattctccacccctgcccccaacatccaagggttctctgttaacagtaaatatttaattttcttggttttgtaccaatgcctaatttaaaataaaacagattttttgaatattggggggtggtccttaggggcttgttatttggatttattttatttcaaacagatgggctgttttaggtttgacttcatatttgctaattttcattatggaaaaaaaaaaaaaacaatcccaagccaccccacccttatttttgtactgagtaacagtttgtcttgtctaaaagaagcttttattttctcaactgtttgcacccagcgtattcagccttattttgtatttttaatcacataaatgtgttggccacctatagcttatgggatgttcacaaaatgcgccccactcattcccgaacagccaccaactttgggactgtatctctcagctccagcccagctacctcttgtctagttcccagccatccactcctctggcctgaagccagactgtatggaggtgcagagtcagagaggccttggccttggagggaggcaccctggtgcctggcccagctctactgccttgctgtgtgaccttgggcaagtcccttcccctctctgggcctcacggttcccactgttacaaagaggaggctgacctaaaggggctttgtggaattttcctcttattatgttagattgttatatttggaagatgtgacttgaccagtacagtacatgacctttaaatcctttctagaagcaatatttagtgatgtttctgaaagagttaggaggtctatatctctgagatgaactagtactttctgaaatttatgaaaacaacagttaccactctttgaatacccactgtgcctggagactcttgtcctgctgtttcttagaaactcacccatcagctgtgagcattttctaatggtttcccctcaggcctttaatctttgatctcaataccttctccctaggagattaattgatcacttctaactctttttttaatttaatttttcacttgacataaattcagactctcagaatatttgcaagaataatacaaataatgtttaaatacctttcacttgattccccaaatgttaacattttaccacattctatgttatatctaccaccccctcacacacacacacacacacacacacacacacacacacacaattttattctgaactttatgagaacaaattgtaggtatgatgctcttttatctccaaatactgcattatatatttcctaacatttcctaaaacgttctcctgcataagcacatattgatcaaaatcaggaagctaatagtggtactaatctatctaaagactttaatctaaaggctttattcagattttgccaattgtcctaataatgtcctttatagcaaaagaaaatccaggatcatgcagtgcattcagtcgttttgtctctttagtgtcctttaatgttgaatggttcctcaatctgtcttagtgttttgtagcattgacatttctgaagagtacacgccagttattttgcataaagtccctcagtttgagtttgttgcctgatgtttcctcatagttagatcagggttatgtactattggcagaaataccacagaagtgatgttgtccatcagtgtatcatatcaggaggtccacgatgttagttccattcatcctattcctggtgattgtcactttgatcacttggttaaggtgatgtctgccagatatctccactgtccagttcctatttcttcccgttgcaattaatgagtatcttggggaaataaatatattttgaggctgttagtatcctagtacacctcaaactttcactcactagtttagcatttattgatggtctgtgcctggggcaagatggtcagtgcattatgctggttgccaaataatgaatttctgattccatcatccattctacatttattagttgactttctactataagaaagaacttttctttcactcccatttatttacttatgcttttatttatattaggttgacttgtgcatttttactttgagttataatcctttcctatcattatttattttgatgctcaaattgcctgaggtttgtcccgtgggaactccttcaaactagttcctatgtctttctgacatgcccctaatcatcctctgagcgcgcccttaatttctggcacatctgctccaggctcatcttgtgctttccctgccttagccttaatatcagccattttcccatggaatcttaacttcttttagtgaagaatggtatttaaaaactaagatctgggtactaaaagcatgcgcatttctacagatgtggcattgttactaaaccctctcagtccacaaagctaggaaaataattaactcacatctatatctattcctttttatttattattttggtaatatctatttctctatctatctatctacctgcctacctacttacccataaaccatgagttcacactgataacctccaaattccaatacaacagcaaagttcattctatcttcccccttcccatatttgtagtttccttgcaaaacagtgagaaatctctctgccattaccataatatatttactcacttaatcctagaatatatagaagctagtttcagagttgctaacccatgactctatgaagaagccaattgacaagagtacaatatttgttcagaattatttttgtcttttcgtaagagtgaatccttcaagcactgttaaaaagttacctgggctagttcatctcccgggccccactgaggtcatttgaatatggtttagttcacttgtttctgtttagattcctttttgtctgccccccacccctgaaccatctttctttgttaattttaattatttttctgtgagcatgtgaaataataacatagtttcaaaagttagaactgtacaaaaagaaatcctcagaaaagtgacatctcccattacttctgtcctttccacctcattccactcatttcctgtaagtaaccaacttcattagcttttctgtgtttccttttgcacaaatgaacagatatctgtgtattttcccataccccttccttacataagggtggcttaatagacatactcttttgagctttgcttgttcactcaaacgcatgtcccagaaatcactccatatagagatcttcttcattctttcattacagctgcatagtactgcattgtgtagatgtaccatagattattcaaccaacctcctatgtgtagccatttagattgtttccaatattttgcaattaaaaataaaacaaacaacccagtacatatgtattttcatattgttagaggtatatcttaaagagtacatttctataagtgggattaatgtgtcaaaatgtaaaaacaaatgtagttttgttaggtattgccaaattcccctccagaaagattgtaccaatttgcattcccattagcaatgtatgagagtgtttttttccccaaagcctcaccaacaaagtatttgctttactttttaatttttacaaatctgataggtgagaaatggtatctcagtgtagtttaattagcatttttctaattaggagtggcttggaacatcttttcatatgcttaagagcccttttgatatttttatgtgtgtgaattatctgttcatgtcttttctccctttttctattgggtttttagtcttttaccctcaattttaagagtatttttctgtgttaggtatattagctttttttatttgtgatatatgttgcaagtaatttcacttaattggtttgtggtttttttcaatgtttgttttgttttgccatgcaaaaaatttttttatgtcgtcaagtatcagtcttttcttttatcatatccggatttgaatcacagttagaaagcctttcctcacatccagtttaaagagaaattcaccaaattttcttccagtatttgtatggtttcatgttttacatttagattcctaatccatttggagtttattcttatgaatggtatatgggagggatcttactttacctctttccttttttctttttgtttctcttttttattcttttttagagacagggtgtcactctttcacccagtccggagtgcagtggcatagtcatagtcagtggtggggtggtgtgccacaaccacacttggctaaatttttttttttttaatgttttgtagagagtggatattgctatgttgctcaggctggtctcaaactcctgggcttaggcgttcctcctgtctcagccttccaaaatgctgggattataggcatgagccacagcacccatccccttcccttttttcaagagactacccagctatcgcagccccattttacaaatgttcatcttgctccagtgatttgaaaagtcaccattattatatattcagtctccacatatacttgggtctatttctacatgcatattttattccactggtcaatttgcctattcttcttccagtaccacactgttttaattatagaggctttattgtgatttttaacagccttttattttgagataattgtagagtcacatacagttttaggaaacaatactagaaagatcctatttacccttcacccagttcacagccaggacagtcacattgatacactccatccaccttattcagagtttaccagttatacatgcacttatttgtgtacatgtgtgagtatttaattcaaagcagttttatcaaatgtgtagagtcatgtgaccacagtcaagaaaaagaaatagtgccatcaccacaaggatatgcaatcctttgtgttgctgttttataccaaacccacttccctcctgatctgctctaccccaacttctgaacccatggcaactaaccagtaatctgttctccattcctatagttttgttatttcaagaatgttatgtaaattcaatcatatagcatgtgatctcttgagattggcttttttccctcagcataattctgatagtggtgtagtgcaatacaggagtagtccattctcacaggtgtgtagagatatctcattgtcatattaatttgcatttccctaacgcctaatgagattgaacatattttctggagtttatttttcatccatataacttcacggaatgtctgttcatgactttggcccattttctagttggattatttgcattttttctcttttttttcactgttgagttttgcaagttctttatatattctagatacttgtattttgtccaatatgtaatttgaaaatactttctctcagtctgtatcttatctttccctccttttaataggttctttcacaaaaagactattttgggggtcagatttttgtggttgagtctaagaactctaccccaagtcttaggtcctgaaaattttctctaatattttttaagtttgatggttacacatttaaggccataatcgattttgagttgatttttgtataaggtgtgaggtttaggttgatgtttattatttttttgcctatggatgctcaatggctctagtagcatttgttgaaaaggctatccccacctcactgaactgcttttacacctttgtcaaaaattcgtgggaaatatttttatgggtctatttctgggctccttattctgctccactgatctatgtgtctatccctctgccaataccacacagtcttgactaatgtagccatataaaaatgttaatactgggtaaaagtactcctcccattgtataattgtttctcaaaattgttttaacctaggacttgtgcctttccatatattttagaataaccttgtctacgtctacaaaaaactttgctgagattttgatgagaactgcattaaacctacaggtcaattcaagaattgacatctttactatgttgagtcttctaggcagtaaacatagtatgtctcctcttttatttaggtctttattcttttatgagcacaaaaaaggtgtttattattatttctatttgatgttcaactctttttttctgaattctttttattaaaattcaaaaatgtcaatattttcaagggaaatacaataagtgaaaatattttaaatatattcttataaatgtattcatacttgttgatgtagtataagactgcagcaatagagtacaaaatttgaaacacttcagattacaaatattttgtcccattttatttttttttttttttttttttttttttattttttttttttttgagacggagtctcgctctgtcgcccaggctggactgcagtggcgcgatctcggctcactgcaagctccgcctcccgggttcacgccattctcctgcctcagcctcccgagtagctgggactacaggcgcccgccaccacgcccggctaatttcttgtatttttagtagagacggggtttcaccgtgttagccaggatggtctcgatctcctgacctcgtgatccgcccgcctcggcctcccaaagtgctgggattacaggcgtgagccaccgcgcccggccctgtcccattttagagtagagttttaaaaaatcactattttcataaagaaaatatagagtttttttaaagagagaaaagaaattgcttataaatgtcagttgcaagtataatttattgtgattggaactactatcaagatttacttcgtatgtaaatttctttgataaattttatggattttaataggtcacaggaaatctcattgtgctcctctttgattttttatattttattttattttaagttccaggatacatgcacaggagtctttatttcttacaaaagcattttgtaactttctggatgcagatcctatacacattatattatattaaatatctaagtattgcattttctatgcagcagttgtaaatggtatgtgttctcttaacacagttttattgataccattcacataccaccgaattcacccatttaaaatattcagttcagtggcttttagtatattcatagttgtaccatcatcaccagtatctaatttcagaatattttagttaccctgaaaaggaaccacatatccattagcaaacatcctcaattaccccctgcccaagcccttagtaactattaatatgctttcggtctatatggatttacttattctaggtatttcctataaataaaaccataagataaatagccttttgtgactgacttctttcccttagcataatgttttcaagcttcatccatgttgtagcttgtattagtacttcattccttttctttgccaaataatattccacatattatttgtgatacaccatatgttgtttctccattcatcagttgatagaaatttgagctgttatcactttttgattcttatgaataatgctgttgttaacattcatgtacaagtttttgtgtggacatatgctttcatttctcttgggcatatacctaggaatggaatttttgcatcatatggtaactctatgtttagcattttgaggaactgccaaactgttccaaagtagttgtgccatttaacaatctcaccaacaatatataagagttccagtttctccacatccttgccaacacttgtaaatttctgtcttttttattatggctgttctagtgagcataaagtggtatttcattatgattgtgatttgcatttccctgttggctatgattttgagcatcttttcacgtgctttattggccatttgtatatcttctttggagaagtgtttatgcagagcctttgcccatttttatattggattatttgtctttctattgttgaactgtaagcattgtttatatattctgaattctagaccttcatcagatataagagttgcaaatatttgctcccattctgtgggtcatatttacacttccttgatggtattattcgcagcacaaaaattttaattttgatgaaagctaatttatttagtttttcttttctcacttgtgctttttgtatcatatctaagaaactatttcttaacccaaagtcaaagatatatttctatgtttcttccaagagttttatagttttagttcttacatttagatttatcttccattttgagtttttaaattttaaaatgtttagttaataaaaattgtgtatattcaaggtgtacatgattcgatatatgtatatattgtgtaatgattaccacaatcaaattaattaacacatccattacctctcataattaccatttttttgtgtatatatgtgtgtggtgaggacacttaaaatctgccctcttagcaagtttcaagggaacaatgcagtactactaactatagtcaccatgctgtacattagattcccagaacttattcatcttataactgaaggtttgcacactttcaccaagatcttcccatttcccccacctctaagacattaacaaccactattctactctctgcttctaggagttcagcattttaaatttctacatataagtgagaccatatattatttgtcttctttgtctggcttatttccacttcaggtcatgcaggttcatccatgttgttgaaaatggcaggatttcttctttatgcctgaacaatactacacacacacacacacacacacacacacacacacacagagtttatgcttgaacaacatagtggtttggggtaccaaccccctgcacaggcacaaatccacttataacttttgacttcccaaaaacttaactaccaatagcctactgttgcctggaagcctcaccaataacataaacaacacatatttcatatgttatatgtattatatactgtgttcttacaattaagtaagttagagaaaagaagaggttattaagtaaatcatatggaagagtaaacatatttactattcactaaatgaaatggaatcatcataaaggtcttcatccttattatcttcatattgagtagactgaggagaaggaggaagaggaagggttgctcttgctgtcttggggatgacagaggcagaagtgaaggaggtggaagaggaggcaggagaggcaggcccacccagtgcaaatttatggaaatacatcataatttctctctaactttttgcttttttatttctctaaaaaatgtttctatataataccaatccttcttccaccatttgctttagcttcaggtcctgtatcatagaagggttcatgctgtaaaggaagtcagaagctgtcttgagtaatcagaacccttctgttcaattgtctaatgtcaatttgtttcccagcactgcttcttttatgtctttgtcctcatggtccagcactagttaggaagcactcatctccataaagttgtcttctgttatttcctctggcatggtgtctattagctctataatttctccaagatccatatcttgaaatccttcaacacccatcttttttttttttgccatatccacaacctctttcatgatttccctgtttattgtcataaattctgtaaagtcatgcacaacatctggacacagttgctttttccagcagtaatttactgtttcaggcttgatggctttcacaggtttttctaaacaattatggcatattcaatagtgtaatccttccagactttcatgatgttctttctattgaggttctcttccaaaacattgacaatctttctatacagtaacctgtgtggtgagtcttagaagtccttatgaccccctgatctaaggctgaattagaattgtgtttgggggcaagtagaccacttcaacaccttcagtgttgaacccatggagttctgggtggccaggagcattgtccaatatcaaaagaactttaaaaggcagtctcttactgacaaggtacttcctgtcttcagggacaaaggatcgatggaaccaatccagaaaaaaatttttttattgtccaggccttcttgctgtgcaacaaaaagatcggcagctggtgtttatcttttcccttcaaggctcaggggttagcacctttatagataagggcagccctgatcatgaacctggactgcctttgcccgaaattgcaaagttagactatcccttcctgccttaaatcctggtgctcgcttctcttccttactactaaatgtcctttatgacatttttttttttccagtataaggcactttcatctgcattaaatcctgttcaggcagatatcctttcttatcaatgattttcttttttctttctttctttctgttttttggataacaaaggatctccaaattatattgaaaaataaatcataattaatattactcaaaaattttcagcatacttttcaaaaatgatttatgtaaaagagaagaaaatacacataattttaaaatatcttaaactcttttattccttactatagacattaattttgtcttttgttttctttcaattttctacaattttcaacttgtacctgtgtttaataggtaagacattaactgattgcttttctcaatctaaggattatatagttttagtataaatatatatcacatattttggtaaaattttgacaaaactgaataatcatgccttgttttaagtccatactccttccactgtttatcaaatctgatttaatggtcaaaaaattcttggttgtcattcttcttttacaagtcttcctgctaaactgccaaccagtttttacgtagtaataaaaagcagtaagaaagccaaagaaatggtgtctgggaacatctctgctacctcttagtcaacagaagctgcttctcctgttattttgatattttttaagccaaactgctttctaaaatttgtgaaaatacagtatttgtgggatgcgtatacagagggctgactttgctcacacataggttctgaagggctgactgtaggactgtagtatgtgtggattttgatatatgagtggggtcctggaaccaacccttcatgtataccaagggaggattgtaaaatattatctgtaaagtttctgtagatgcttgttatcaagttcaggatgttctcgtttgttcctagctttctgagattttttttattattataaatggatgttaaatttgctaaatgctttttctgcatcaactgttatgatcctgtgatttttcttttttaaactgttaatattgtggataacatggagtgtttccaaatggtgaaccagccttgcaatcccgagataaactccacttggtcatggtgtattattctttttatatattcctgaattttatttgtaaatcttttgctgatttttaaaatttaagttcataaaagatatttatttataattgtctttttctgtactgtctttgtcttgttttggtatcagagttataaaatgagttgggaattcttcctttctcttctactttctagaagacattatgtaaaagtggcactaattcttctttaaacatctgggaaaattctccagtgaaaccatctaggtatggatatttccttttcaagagtgtttaactacaaattcatttccttaaggtatatagggcaatttagattatatatttcatgttgtttaagttgtgacagttagctaataatttcttataaatttttgcatctatattcatgaggggttttggtctgtagttttcttttttgtactctttttgattttcatatcagggtaatactaacttcataaaatggattgggaagtaagtattccctgctcttctgtttttcagaagagaatgtgcagaattggtttggttttactttttcaatgtttaataaaattctccaatgaagccatctaggtctggagatttttggagggagttttacaattatgaattcaacttccttaacagtgatagtgctattcaaattgtttattttggtagtttgtgctgtgcaaggaattggtccattttatctaagttgtcaaatttctgtgtagagtttttggtaatattcccctatttttcttttgatttctgtcagatctgtgatattctctgcttcatttctgatagtagtgatttgtatcttctctcttttcaatcttgctagaggtcaattgtattgaccttttaaaaaaactagctttttgcttcattgattttctcttgcttttctattttcaaatccattgatttttatcttatctttattatttcttaccttctgctgctttgagtatattttgcacttcttagattcttgaagtataagcttacatgattgatttagcttacatattaatttgatacctttcgtttttcctaatgtacatatgcttttagtgctatacatttccctcccaactctgcgttagccatgtcccacatgtctttataactgctgttttcattttcattcatttcaatgcattttttttttgagacagaatctcactctgtcgcccaggctgaagtgcaatggcatgatctcggctcactgcaacctctgcctccagggttcaagtgattctcatgcttcagcctcctgagtagctgggattacaggcacacactgccacgcctgactaattttttgtacttttagtaaagatgggtttcgccatgttgcccaggctggtctcgaactcctgagctcaggcaatccgcccaccctggcctcccgaagtgctaggattacaggcgtgaaccactgtacccggcccatttcaatgcatttttaaattttcttggagacttcctctttgactgatggtttattacgaagtgtgttgtttaatttccaagtatttggcgattttcttgatttctttctgttattgatttctagtttgattccattgatcacattagagaatgctgtgatttcaattattttaaatttgttgaggtgtgttttagggcccaggatgtggcctatctcagtatatgttctatgaacacttgaaacaaatgcgtaatatgctgttgctggatggagtgttccataaatgtcatctagaacctttcagttgacgatgtattgttgagttcttcatctttgcagattctgtctagcagttgtatctgttgttgagagtggagtgctgaagtacccagctataattgtagatttgtccatttctccttttagctctctcagtttctacttcatgtgttttgagactccattgtttggtacatacacatctaggaccattatgttttcctagtgcattattattttatcattatgtaatgtctgcctgtctccaataattttctttgctctgaagtcttttttgatgataatgtagccactaatgcttttgtaaaattaatatttgcatggtatgttttctccattgttttactgtcaacttacctatgatgttgtatttagagtaatagaatagagtttggccatgttttcgtttgtttgtctgtttttgtttttgtttttttgagacaaatttgctgtgttaccaggctggagtgcagtggtgcaatcgttgctcactgtgtcctcaaactcctgggctcaagtgatcctcccacctcagtctcccaagtgtctgggactacagacatgcgccaccatgcctggttaattttcgtatgctttgtactctgccaacctctgtctttaattagtgttttagaccatataaataagaggtattgttcacatgttctggcttaagtctgctactttattatttgtttaccctttgcttcctctggttcttgtcctccatttgtttcttctttgtattctcatgctttacttaaatctattttaggattccatcttggtttatgttttatggtttttagcatattacattgtataattttcttagcatttactctagatattacagaatatgtattaatttatcatagtttacagtctacattttataagttcgagtgaagtgtggaaattttacttccatttaggtccttctacccttcctacttttaaaatgtaattatcttaaatatttcctctatacacattcagtatcaaataagatggcattataacttttgcttcattcatccaagatgatttaataaactcgtgagaaaaatagtttattatacttatcactatgtttgcctattctgaatttcttcttttctttatgtagtttcaagcctttttctgttatcatttcctgtctgtttgagaacttcctttaggcattcattaagggtgggattcttagcaacaacatcttttagtttttcttcatctgaaaatacctttatttccccttcattattgaaggatatttttgccagatacataatttggggttgacagttcttttctttcagcacttgaaaaatgtaccacttccttctgtactccatggttcctgaagaaaaatccactgtcatttgaattagtgttcctctttaagtaatgtgccattattctctgattgctcataagggtttttttctgcttcttttagttttcagaatgttaaatgcaatgtgccttggcatggatttctttgggtttattatgtttagatccctcagattctttaatctgtaggtttatgtttttcataaattttgaaaattttcagccattatttctttgactaatttttcttactctctccgctcttcctctctttctgggtttccaatgatagaaacgtttggatcttttgttattgcccacagatccctgagccccctcttcttcttcttcttttttttgttttgtattgttttgttttgttttctttagattactttctctttgttgttcaggttgggtgaattatactgatgtgtcctcaagctcattaactctatcttctttcatctttacactactaattaacccatccagtgagttattttatttttgttattgtatttttcagttctttaatatccatttgtttcttttttataatctcaatttctttgctgagattttctatttcattaatttgtttgaagtgtatttgtgattgctggttgagcatttttatgatgatttatttaacattcttgttaaataattctaatatctgaatcaccttggtgttgacatctgttgatcatctttactcattcattgttgtgattttcttggttctgggtatgattaatgattttattatcataccctagacaatttgcatattatattttgagactttggatggtattcaattttactttttagcgggcagtctttgtgttaaagtgtaatgtaagggccaggtggacatattgttcattttcttgctaggccccactaacaccactctggcaaaatagagcgctgactgacaaagccttattgctgataggtggagtggaagttcagcttaccctgggccctgctggggaaagtggggtactaaattgccctgccttgttgccactgagtaggatgtaagcccagcttcccaccagcccatgctagggaagagggaaatagagactgatccatattgcctttttgctgcaaggtgaaagagaaatctcaaatccctgctgggtccatctgataccaagttgaaagggaggaacaaaagtgcagtctagagctgcctattcttccttattcagtcttgttgctgctaggcaagggtatggaggttcagctccccactagtctttgctgataccagtgattgggtggaaaatggactgctggccatccctgacttgcaggactgagtaggggtggaagtaaaggtttccaatccacctcactaatacctgaggtgggggttacttggtaaagtctagtgctgatttagccccatctcgtaccacctcattaagtctgccaggtgggagtggagactcaactcccctcctgaccttccttacactaccctgatggggaagtggtagcatgcttgggcccctgacacctctgggcaggggaatcagaggaccgacatctgcttacatgagaattggggatggggtggagtggaatatcaacttcccactttgctaggctgaaaccacaggagagggatggtttttctgttggtgttgactaaagtagggtgggtaatttcagaaaggttttctgttatttaggccaccttttccacagtccttttactaggggaaaaggcttttcctggaggagttttttaattaaaaaaaaaatactttttttaacagcagctttaatattacagcaaaattaaaagaaagacagagttccaatatacctcttgccccttcatgtgcatagcctcccccctcccccattacctgcatcctgtatcagaataacacatttgctacaattgatgaacctacatggacacatcattgtcacccaaagtccatagtctacgttagggttcacttttgatgctgtacattctataagtttgaacaaatatatgatgacatgtatccatcattacaatacacagatcactttcattgccttaaaaatcctctgtgctctgcctatttatccctcccttccaatccctggcaaccactgatcttttactaccttcatagttttccttttccagaatgtcatatagtcagaatcatacggtatgtagccttttcagattggcatctttcacttagcaatatacatgtgaaattcctctgtgtcttttcatggctcaataactcatttatttttagtgctgaataatattccattgcctggatgtgtcacagtttatccattcacctactgaagaacatctgggttgcttccaagttttggcaattataaataaagctactataaatatccatgtgcaggcttttgtgctgacataggttttcaactcctttggataaatgtcaaggagcatgattgtcagatcatatggtaagagtatgtttcgttttgtaagaatgccaaactgttttccaagtgtctgtaccacttcgcattcccaccagcaatgaatgagagctcctactgctccacatcttcaccagtatttgttgttgccagttttccagattctaataggtgtgtagccgttatctcattgttgttttaatttgcatttccttaaagaaataagatgtggagcatcttctcacattcttatttgccatttgtgtatcttctttgatgagatgtctgttcaagcctttggcccattgtttaatcaggttgtttgttttcttatattgttgagttttaagagttctttgtctattttggacagcagtcccttatctgatgtgtcttttgtaaatgttttctcccactctatggcttgtcttttcattctctttgcagagctgaagttttccattttaatgaagtccaggttattaattctttctttcatggtttgtgccgttagtgttgtatctaaaagtcattgccacatccggggtgatttaagttttttcttatgttatgctccaggagttttataattttttcttttgcatttatgtctatgattcattttgagttaatttttgtgaggggtgtaaggtctatatctacatccttttttttttttttttttttttttttgcttatcaatgtccagttgttctagcactatttgttgaacagactatctttgctccattttactgcctttgctcctttgtcaaagaacagttgagtatattcctgtgggtctatttctgggttctccattctgctgcattgatctatttgtatattcttttaccagtagcacactgtcttgattattctatctttatagtaagtcttgaggtcaggtagtgtcagtcctttgactttgttcttctctgtcaatattttactaactattctggatcttttgcctctccacataaactttaaaataagtttgttggtgtccacaaaagaatgtgctggagtattgattgggattgcactgaatctatagatcaaattgggaaaaactggcatcttaacaatattgagtcttcctattcatgaacatggaatctctttccatttatttagttctttgattttttcatcagattttttgttttccttatatagatcttgtgcgtattttcttagatttatatgtaagtatttcattttgggggtgctgatataaacagtaatatggttttttttaattttaaattccacttgttattgctggtatgtaagaatgtgattgaccttgtgtcctgtaaccttgctataatgacttattggttccaatggttttgttgctgttgttgttgattctttcagattttctacatagaggatcatgtcatctgcaaacaaaggcagttttatttctgcgttcccaatgggtgtaccttttgtttcctttttttgtcttattgctttagctaagacttccagaacaatgttgaaaaggaatgatgagagtggacatacttgccttgttcccaatcttagtaggaaagcttctagtctcttaccattaagtatgatagtagcagtttttttttgtaaatattctttttcaagttgaggaagttctcaattctgagtttaatgagagtttttatcatgaatgggtgttggattttgttaaatggcttttctgcatctattgatatgatcatgtgatttttcctctatagcctgctgatgtgatggatgacgttaattggtttttaaatgtataatcagtcttgcatacctaggataaattccatttggtcatagtatataattgtttttatacattattggatttgactcatcagtatttcattgaacatttttccatctatgttcatgacagataggaatctgtagttttctttccttgtaatgtctttgtctggtttttgtattagggtgttgctggcctcattaaattgagttataacatattctctctgcttctattctctgcaagataatgtagagaatttgtgtcatttcttccttaagtgttatgtagaactcaccagtgaacccatccaggcctggcgccttctgtttggaaaggttattaactattgattcaatttctttaatagatacaggtttgttttgattgtatatttctgcttgtgtgaggtttggcagattgtgtctttcaagaaattggctcattttatctaggttatcaaactggtgagcctagggttgttcacagtattattttattatgctttgaatgtccatggggtctgtaatgatgtccccactttcatttataatattaataggtcatgttctctttttttccttagctttgtccagaggcttatcaactttattgatctttttaataaactagcttttggtttcaatgatttttctctattgatttcctgtttttaatttctgctctaatttgtattatatattttattctgcttacttagggtttaatgtgcttttttttttcttttttcttttttgagactgggtctcagtttttgcccaggctggagtgcaatggtgcgatcatagctcactgtaatctcaaacttgtgcactcaagcaatcctcccacctcagcctcctgagtagttgggactacaggcatgcaccaccatacctggctaattttttttttttttttttttttttttttgtggaggcttgtcttgctatgctgcccacactggtcttgaactcctgacctcaagtgatcttcccagctcaacctcccaaagtgatgggattacaggtgtgagccaccatgcctacctagcctcttcttttctaatatttacattcaaagctataaatttcttctttatcactgattttgctgcagtacacaaagtttgataagttgtgttttcattttcttcaaaatatattttcaacttctcctgagatttttgacccatgtgttatttagaaatgtgttgtttaatctccatgagttttggcgttttcccattatctttctattcttgatctctagtttaattccatcgtggtctgagagcagacattgtatgaattctgttcttctaaatttggaaaagtttattttatggcccagaatgagatccatcttggtgaatgttccatatgagcttaagaagtatgtgtatctactgttgtttggtaaatgtcagttatatccagtcgatggtgttggtgttgagctcagctacgtcctacctgtgtggggtttttatttctttgttttgttttttgttgtttttcttttgcctgtgcctgttgacagttccatgttggaagcttctgtagtgtcctgtccagaatatatgggagtcaatatggaaacctatggaactcattgctatgttatttcccaagtctaggactctaggttggtcaccttttctttctactttctagaggctttttatgcttttttattatgttatgcccagatttttgtttgtttctgtagtttgctttttaaaacactttaaattgtggtaaaatgcatatgacataaaatttactatcttaatcatttgcaagtgtatagttcagtattgttaagtatattcacattgtcgtgcaatgtctccaggtttgtttagttgtaaggagagagacatgggagaagtaaggctacttcatattggtcagaaccagaagtgacctatagtatgttttcctggctcttcttttatgttttatttttttccatatggaatttagtatcaaattgtctagcaaaattaaaaaacttgttggtattttaaaaattgagatttcatcttatatgtataaattgttaaacagaactgacatctttatgatgttgagtcctcctattcaagagcaaggtgtgtctttccattcattcatgtctacttttgcatctttcaggagtgttttagaatgtcctttgtagaggttttgtacactgcatgtcacgtttatttctaaggatgattttttttgtagataaggttttatttcctattgtgtattcccctttcatggttgtttgggaatatggaataaactagtgactttcaaatctggatcttagccctatcacctgagcccagacccagatttgtgacagttcatcccacctacccatttagctagtcctctcataccttcaactcaatgtgtgcaaaggtcaacttgtgttcttccctgatcactccaaccctcacttggacactcaccagacactgaatttatttctgactcatccctctacacccccttaccagctaattggtcattcagtcctaataattctctagcattctggaagctatggtcatgaaatctatgtgttagatggaaccatcaagtcatctatcataacctcatttctgatgcctaaattcactattcaacatccccattaagaagtttcatggcatatgcttggacatatatttccagggacaggtaacttactaccttatgaggcagcccattttatttctggccattttgatcatcacatacttttccatgtatatgtcagtcaaatccatccccttctttctaaaattatcaccccgtgcttgctcagcacccactccacccacagtgacccttctgcaacagttctgccaggttccagcacacacagactgaagggtaaaatttttcacctaatatccatcgcattttgtgatgctggccccagcctacatctaccacttcatggcttaccacagagagaggagaagaaggagaaggaggagaaggagaagaagaagaagaagaagaagaagaagaagaagaagaagaagaagaagaagaagaagaagaagaagaagaagaagaagaagaagaagaggaagaggaagaggaagaggaagaggaagaggaagaagaagaggaagaagaagaagaagaagacagggaacgaaggagcaaaaatacactagctttccaaaggtccatacgaacattagttgtggatattccttctttcctgctgtatcagtgggggttgcagggaactgggagcactggtattttcagtaggaaggctgtcagtgatagtaattaccctggggtactctcagtgtggactcaataatggatgctactaagcacttgacacaattgggatatagagatatacacactgctatcagaccaataactcaatataacaccaatgactataaatacaaagcagactatagattactacctcctccgtgaactctcataggacatttctatgtcctatgacatagaaggtacagagtgcttgcagccttatggtgtaattatttatagaaggttagttcctgtagggcagttcttttttatccatgtctgcatctcccactctgtcttcttcccttatcagaatctcatgcactctttagggtcccactcagatgtcacttctgctggaaatctttctctggtctctttagccagaagtcagtctacaaacacttccctaagcaccctctctgtgctaggtactgtgctaagcactgagtatgacatgctggtaaacctttggaactttccctggagaaagtgggaagccaccatattttcaagcaaggaagatggtcagagcagtgttgtggaaaggtttctctaccacagtatggaggacaaatgggaaagccaagactggaggcaggggaagccccctgggaggtggctgtggcaggagtccagggaagagatgatgaggataaaccggggcagtggaaggacacagacctggcagacggttgagaggcagaattaacagatggctattactccaaagacagatttgaatgatgtgtcactcatacagagatgcgggctggaatctgtgatagaaatattatcatcggcaactgtggatggtattcaacacaaggacttgaattgggctgtgagttgaattgtgtcccccaaaacaatacattgaaatcttaacccttagaacccgtgaatgtgagtttactgggaaataggatctttgcagatgtaatcaagttaagaagaggccattagggtaaaccttaatccaatatgactagtgtagttataaaaagagggaaatttggagacagagaaggacacagagacatacagggaagagaaagccatatgaagacagagggagagataggagtgatgcatctttaaggaacaccaagaactcttggaagccaccagaagctaggagagggcaatggggcatggaggcctcagagcctccagaaggaatcagccctgctaacatctggatttcagacttctggcttccagaactgtgaaagaatgaattgctgttgttttaagccccacagtttatggtcatttgttatggcagccccagcaaatgcatacaaatggtgcgaaagaacaattgagcaggctttcagaggctattgaggggctgatgaggagacattcattttgtaaaactctggcattggtggtactcaatcatcttatatttaggacccagcctgccctgttttcttgcagggaggttcgctcattagaataaaaagttgtcacatgctgttgtcagagaaacaagacggtggcctaagagatctacaaattcactctgctctagggctgaagtagctccctcttggtcacagactggaagggttcagcactcttttgtgcagaatggaagttccctggggaggtcagaactcagaacttccagaggaatgtacttcttgctctatctcagcatcccttatctcatctcttattgtgacagctacagagacttcaactaatttgagttatagtgagaggattttgatctagaaagtggagaaaaggcaaagatgttaaaagtcattgtggtttaaggagattttgggctgagacaatggggttttctagatatacaatcatatcgtctgcaaacagggacaatttgacttcctcttttcctaattgaataccctttatttccttctcctgcctcattgccctggccagaacttccaacactatgttgaataggagtggtgagagaaggcatccctgtcttgtgccagttttcaaagggaatgcttccagtatttgcccattcagtacgatattggctgtgggtttgtcatagatagctcttattattttgaaatacgtcccatcaatacctaatttattgagagtttttagcatgaagcgttgttgaattttgtcaaaggccttttctgcatctattgagataatcatgtggtttttgtctttggttctgtttatatgctggattacgtttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattatcttttttggttgtgtctctgcctggctttggtatcaggatgatgctggcctcataaaacgagttagggaggattccctctttttctattgattggaatagtttcagaaggaatggaaccagttcctccttgtacctctggtagaattcagctgtgaatccatctggtcctggactctttttggttggtaagctattgattattgccacaatttcagctcctgttattggtctattcagagattcaacttcttcctggtttagtcttgggagggtgtatgtgtcgaggagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacacattcaatgccatccccatcaagctaccaatgactttcttcacagaattggaaaaaactactttaaagttcatatggaaccaaaaaagagcctgcatcgccaagtcaatcctaagccaaaagaacaaagctggagacatcacagtacctgacttcaaactatactacaaggctacagtaaccaaaacagcatggtactggtaccaaaacggagatatagatcaatggaacagaacagagccctcagaaataatgctgcatatctacaactatctgatctttgacaaatctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacattagacctaaaaccataaaaaccctagaagaaaacctaggcattaccattcaggacaaaggcatggacaaggacttcatgtctaaaacaccaaaagtaatggcaacaaaagccaaaattgacaaatgggatctaattaaactaaagagcttctgcacagcaaaagaaactaccatcagagtgaacaggcaacctacaaaatgggagaaaagtttcacaacctactcatctgacaaagggctaatatccagaatctacaatgaactcaaacaaatttacaagaagaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacacttttacactgttgctgggactgtaaactcgttcaaccattgtggaagtcagtgtggcgattcctcagggatctagaactagaaataccgtttgacccagctatcccattactgggtatatacccaaaggactataaatcatgctgctataaagacacatgcacacatatgtttattgcggcattattcaaaatagcaaagacttggaaccaacccaaatgtccaacagtgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacactgcatattctcactcataggtgggaattgaacaatgagatcacatggacacaggaaggggaatatcacactctggggactgttgtggggtggggtaggggggagggatagcattgggagatatacctcatgctagatgacgagttagtgggtgcagcacaccagcatggcacatgtatacatatgtaactaacctgcacaatgtgaacatgtaccctaaaacttaaagtataataaaaaaaaagaaagaaagaaagaaaaaagactatgtgaggcaagaaaagatttgtgaagagttcacatttaagttgtcttccttaatacattccactctttagatggatttagaataataggaaaaaaaccgtagtgttgcgcttagagacttcatgtgaaatcccatctcatgtgaagaaaatgtgctttcattacttataatgatgaaataaattatctccattcttggaaccacttctttgcaaatattttagatattatttcacaaatgaaagaaaacagagaaggctgctaccaccagctttggagggaacaatttaattttcaagatatgtatctattgtgagttggcaacaatggctctggtttccaaagacagtgggaaaattgctgcgcatttcggaaatggttcccagacacttcccttcgaaaacgtaagcaaccaaacgcatacaagcaggcattaaagacaaatgcaattttataggcagccattctgttgcatggcatgataaatagacaagacgagtgttttgcagccagccagcttttggcttctaagagagctggaagggaaaactgacatgaacactttcaacaggctaccctggttgaaattaggaagagtttatttccacagttaaaacaatatgattctatttctattgcctgtgttacgtcgagttcccctatttatcaaacacaaagttccattgttgtgatctatggtgagcaaaggagaacctgccgagtcccaagcagatcttagatgtaaatcatttgatccgttgctcaaaactattctatcccataagcccaagagctcatatcagggtgaacaagacatttgaaaaaaaccaaaactctcctcctggagtcaacaggaaaacatgcccctggacaaagcttataactgttgaggccacatgtgcaatgtgctagttaactaggaggaggaagttccaggaaaacgaccaacatctggtttcaggcttattccattcttctcaggggcccccagtcaactgtgctcacctgaagagacatcttgagccagccagagagtaagcagctctagtttctcctgagcttgactttgtccattgtatttatttcttctgaactgatttctccaaaatcgaaatctgtagcacctccacaactttgatagccttttttgctccaattccttcaaggataaatatttaactccattttgggtcaaatacaaacttatatttctggggtttaaggattcacacagctagagcttgaaaggcatgttactttaacatgtttcagacccacagagctgtccagtggaatgtcatccactaccattcctcgactgtaagcatagttgattatcaattcagaaacactccgaataagcagttgtgtgccaagactttgcagttcattcatccaattagccatttgtttattcatctaatcaagctgcctatgtcatactgattccagtactcatccttcctctttttgcttatgcaaagcaagtatgagagaattgtagaaaaggtatagaaaagagacaaacttttcattctgtattgtattctgtattcaaagttaaggtacagtaaagtcctgttaacgatgtaaccttaatgcatctgaaaggtattgttttaatgacgcttaccttttaaatgatgaagatgcctctggcggtttatggaattcattttatattcgtttaagaaattgctttttatgagagagtatttctgctgagtttctcttgggcattggaagttagagggggtagcccacacatctgcgaaggtcaatagggtctttgctttccattaaaatgttttccaattctcacagcatttgtcaatatacccagaagaatcagaataaaatgaatccatggcttggtatccagtatgcagcagacatgctgcctgctgagtcttgcacaggtgttctctaaaaagcgctgaagttggaactgggagccctgggttcaagtctcagcccagggagatcattcactggctgcatgcatgcatgcagttataagcctcctcatcaccctggtgtctcaagagcctggatacctctacttgtctatatgactgatatgaactgagctccatgcttaagggttgtcaaaaagcagcaccttcaccctgatgcctacaggtcatagtttgtagagcagcctgagatgatggtactggattgctggcaggcccagctcactgctgaattataccaagatgactgcaattaacagtccctagtttttttctcaagccacatttcctccacactatacttcagcagataacccaaatgtagaacttgccatttatccctgttaaatttcccatgaccatcttgagctcgtcaagatctttttggatctcaatttcatgctacagagaactcatcaccttctggcactatctcaggggcaaatgtggtaagagtgaattctcaatcctcctccagatcattgagaaaaagtgaaggaagccgggaggcagccctgggacttgcctccaggtccctctctgtaagggagggtgttaatccattatccatggcctttagattcagtcttttaattggttacgcaatcacataactgggctgtaaatgaagattttacaacagatgctgcctagtgctttgctgaggttcaaaaacacttgcctgcttttctgtgatccacctgcctggtgagctcttccaacaaaaaaggtaagctattctaacacagcaagctactcctaatgagctcttttttgcttttgtcttaaacacactttgcgctggcttccttttctaagcactcactcactattcttttaatagtatgttcctgaatttttccaggggggccacatcaagcaaaccatagctacataagatattcagttaaaggaattttccttcggaaatttggaagtacatgcccatctagtagtttatggctcttttttttttttttttttttttttttttgcagttttctgtggttccttaatgctccatgataaaagctcacagtcttgttagcaagtgctctctctctctctccctcagcaccctagcatgtcgtttgccctggccatcgatgaccaggcagttctctcacaatcacttcctccatcacagacttcaaggccaactgaggagttctatcctttgtacattaaagatcattctcctattctatgaagaagcctgaaacttttctccaaagactctggtttctccttctgtggggtatgacagtctctttgctattcagggactccaggggtgtggtgtctctttatctcttttctctttcaggggtacattcttgtagctcctcccaccccttccccctttccccctgactctggttgtgattcatatagataggttgcattcatcaggtgctgctgcctctcctgaagaagctgctacctctcccctttcctcttcttggtgtgatgagccttcaactgtttgtttctttttagtggaacagggtttcttctcttctcccctgcctcgtgcttctctttgcattcctgattcagtcttttgttctcaaacagtgttcctgggtagcgtggaaagggagaagctgcacctccgtagcaaactcatcaatgtccaggcttatgaattgccctgggcccacagatttccagtgatggctgagcttccatcattgcatttccaaaacagcgaccatatgacacttacacagaagggaaggattcaagaaatactgtggaagagaagtcaagtaagggcaactgagtggtctgtaagcaaaaagacatctcagatgatctctcaagatccatgaataagtaggagcggtgatctgatcacccacagtaacaagaaatacagataccagcaagtgaacaccccaaaaatgtccaagtcaggtttgcaatgcctcaggtagctaaaggagagttgtgataggagtaaaattaatagtacttaccttaacttaaaagcaggccagacacagtggtctaggcatgtaatcccagccctttaggaggctgaggcaggcagatcacttgagcccaagggttccaagaccagcctgggcaacatagggaaatcccacctctacaaaaaatacacaaaaaacatattagctgggcatggtggtgggcgcctctagtcccagctatgtgggaggctgaggtgggaggatgacctgagcccaggaggtcgagtttgcactgagctgtgagtgtgccactgcactccagcctaaataacagcagaatgagaccctgtttcattaaaaaaaacaaacaaacaaaaaaacaaacaaaaactcgtaaggctgtttatggatggggcggggaagagagggcgaggaaataaagggtagccgtgaaatcaagttagtgggggaagttgtaacaactctgtaagggcttaaggcaaactccatcagtccacatggagtctatggggttgagcttgagatgccagtgagaagtatggctggaccagtggaagaactggcaagaagcacctaaaaggtttcagctggtggagagccagctaagatgtagagtccatcttgagggatgcaagaagggaaagagcctgatgatggagctgaagaggtagatttgcagggagtgcaggtggtttctccgtctgtgtcagtgcttgaagcttaggggaagcctggaggggtgggggtacaatgcaaggaagactggggagagcttcacatgttgttcccagttagttaggtatgagatttcagggagaactgaaatctttccctctcacactcctaattgttttgatgtgtttggatgtcaagtcacgagtctcagagccttcacattgttgtttgtagccaaaagtacaaaatagaatcccagtattgtcaacatgctgacacatggacttctctcttcttaataagtgtttgattatgtttccttctatgaaaatctgtatccccacacaaacaccattttagttttagaacattttgtgggggcactttaaatcattaacttttaaaaatatggttctcgatcatatggttttaattattaaatttttattccctaaatttgactaaaaatcatgtgatttgcacagcaaacaggccagttaaatgaagtgaattccattcactggcagcctgcctgctgttcctgtcaataagtaagtttagtttctgcttctggggctcacaactcctgacaggtggcttgctgggaccggggaagcaaggaaatcagccagagaaagtgtccttggcagcaaagggtctcactgggcaggtttttagggaaatcttgagattggggcaatgtgggatgtggtggcagcatcctagacatgacagacagcctctgagcaacctctggtcctacttgtacatatcccctctgttcattaaagcggcctcagctagagcttttccaggtggttggaggccaagaggcattgtgcataccaaaggctgaactggacttgctgctggcaagactgctccaaagcacagggagcagtggcaaagaactcatcaagcaaggcaacaatctatcatcctctgctaaacctgatgtcccagcttggaatccagagttggggtggggggccatcagtgctggcaaacttgtgggggacaggggctggtgtaattggagccagctccctggagcctcacaaccatcctgtgaagcaaatggggctgtggttcctatcccagaggaaagcactttggctgaggaaggggaacggagcactggtcaggcctggcgatacctagccagtacatggctgcctctgacttccttccagagtgaaggtgcttacccttagtagggaggaccctggcctggctggtatgcctccttggacttagcggggtctgggaatgcaggagaggctttagactctaagccaggggtgtccaattttttacttccctgggccacagtggaagaagaattgtcctgggccgtacataaaatacactaaaactaacaataactgatgagctaaaaaaatcaaaaaaaacttcataatgttttaacaaagtttacaaatttgtgttgggccgcatccaaagccatcctgggctccacacagcccaccggccatgggttggacaagcttgttctaagccatcctgacaggcagtgtagtcaggtggttcaagctgaactctggcacccagtggtctgtgtttgaatcttagctctgccactgatgagctgtgtggccttgcaggaagatattcaacctctctgtgtttatctatttcctcatctgtaaaagagagatgataataatagcatctgccttgtaaggatgtggtgaggatcaaaggcacatctgtaatatgcttagaacagttgttgacatgtggtaagccctaccgatgttagctagtggcactgtcttcctccaagcctccattccagtcctagcagagggaaacctggccactgtgatgatagctgctggatggagtgaaacattgtcatggtgcagaaaacaatgctgattgtttttctgtctgtctctcccctccaaaataggagactcatgctgaatgtccagtccgtagaagccagcctggcatgtggcaggtgcacaatgataaattaatgagtgagtgcaagaattcccccttgtggcaaatggctctggaaagaatgccaaccttaaaaaattactaacttcaatgcaaatgcagttgggtagcagagaacaaagggacctataaaggtgccagacattctactggggtagacttaagagctggcctaggagtcaagaggctggcttttgagaggctttactgcttcgttgctgtggggccttgagccagctcctgacttcttctgagcttcagtgtcctctctgaatgacaaacaatgtaaggtgggaccaaggtctgcgacctccagggagttcctttcctatcagggcccagaacaaacaagagatcaaggaacacacccagttcctaggcctgggctcactactatcaggttcaaggtcctgctcaatttctgacagcaatatccacataccatttctatgtcaattataggagccagtttctccagcttactttataaaatgttaattacttcccccacctccccacaaatgtgaaacttggatttaaaaagacattttggaaaacaggtacattttgacaggaacaatctgaaattgccacaggcataaacacatacaagtggatactgtttggtttgcttctgagagccccgtttagtggagagccggccgagccagtgactatctgaatgaagtataccagccatgccattatcagaggaaaggatgagtgtggactagtcaagtggctggatgctaattttatcacctttgctttcagaaaccagatcccattctggcagcaatggttcacatccctggctccttactgtctttaggtaatcataatattaatgtcccagtgcacccttaagccctttgcatctctcttcaaagcctttttcagacatgcaatacttatctggggtgaggggttgaacttcccactgagagaccagaactgatcagatgggcgggcctccaatcgcgagcttggctttaggcttgtagtcctcacttttctcaagtccagccacggcagcctgccaggcctgcctgccacaggcagccttattcaattgaatggggtcttaacaaggggaaaagccagagacatgaactggcgcatggagcacaatgatgctgactacccagcaaaggtaagcttgagacactctgaagcaccacactgactgtaaccacattgcataaaacccaacacaatccaagagaaatggaatcctcgtggggatagcattgggccaatagctcaacagccacccaaagtctccatggaacaactcaaggccagagcaaatttagtgacatgccttccctgttggagcacctgtatagcagccccgcagaagaggttgtctagtcccttccaggactcatgggagcccacgactctatagccattcttctccgccagattccacatcttcatagctttaagttttttcctttgccactccctatcttatttcctttctccattgtgtgttagcatacttaacagatggagaacagcatatacaagtggcttacaggactgtcaaggtagcagaggcacatttgaaaacagctcatgcaaccaaatgccaatgattgagcaaaccaccactcaggactgactcccccgcgttggccctgaaaatctagctactcagtgcttccatttgcagacataaacatccacttaggagttctgaaaacaccatctaagccaacatttggactcaagtaacaccaacagggctgcataatcagtaaactcacttttctgctctgtgcctttgcaacactctctgggaaagatgcagtagactcttacagataaaagttgacatggaggcaagttactaatatatagaaatgttggattttaagtaaagtatatttcactctgcagataaagggaacagagattctttttttcttatctcaaaacagactctttttgtagaattgatgaaatggaagtaattgtcaagaactgagagcattaatcaagaaaaagatgaaaaaaaaatggagagcaaattaaattaacttggaccacaaagaatatttaatgtttttgcccctgaaatccatttgatgtttcattttccccagatatagtacaggtggcctcaccatcattttgataagagcggcgccccagtcaccctctcccagtgatgcactgtgaagtgtttaacaaggggctctctaggaggaaaaaaaaaaagctctgattaaagtgatagcactgactgccgtgttgtaaatactcttgttgtggccgatttctagctaccaacatgatgtcacccaccttgcaaaattcctgaaaacataacagttggcttttgggagcccgtttgagataactctagcccaccactgtcccctcctctgcctgtatgtttcctatgctctccactctgggatcatagagccagcaaagagagaaatcacataagaataagacagattgttataatgatcaacacacacatgctaccttttggtttataaactctttccccaacattaattattgtggctaaactaacctctatgtgctaacagagtgccagaatgttttacaagcatttcatttaatcaataccaagaagtaggtactattagtatccccatttcacagaggagaaaactgatgttcaaacagattcagcaactcattcaaagtcacacagcttgtaagtgggtgagctaggactagaacctaagctccttggttgtgctttggcagtaagaagaaaacacagtatcagaaaaagtggtaaggacaacagtttggcttagctgaggaatcaggaaaaaaaaagcctaagtaatcaaataggtttcagtgtttctttagcaggtgatcttatcctaggattcaaggatagaattcagggagtctgtaaacttgaatgaggaaaaaattatatttctgttttcactaacctctaattgaaattcagcctttcttcaattatgcatgttggcaacaaaccacagtagtatttacataatctgtgactttgtcgccaagagaaatcatagatattttaatttcacattacagtcatagcaggaatcttcaaatatcactaccttgaaattacagtaattatgagacctactgctaggtcttatttaatgagttaagaagcacataaattaatatatcgcaaatttgttttgttaatatgttaataactattttgatcccattgttttattttatgcttttaaaaacatttatttattattattatttttttcctgagatggggtcattaagtttcaccagaaaatcgagggcatccatgaatctatagcctctctgcttcctcttcaggtataatgaaactttttatggccagttagagaggttctcctgagagctttatgtttgagttccggaatggctgggcccatatggacagaggacacagccgtcgcctgtaatagtcgatgggcactccaccatttttccccactgagagagtttgggagccatgagtcagtccttcctgggaaatggctgagaagaagctttcagagatgaaaatgaagtggagagcgcaaatgaaggaggggcaggggagaagctgagtcagaccctcgaccactcttctaggggtactgtctcatcctcttggggctgaatcataccagggtggctctgctcttctgcctctgcctgaatttcccttggtagggctccaggccttcatttgaggccaaaatgaagggccccaaacccagccaatgtgtgccaaagagaaattctagaacatgtgtgttactatcttgatggaaaaatatcaatggtgggggtcttccaaggactatgggacccacgtctgcttgacttgaccatcagggatcatgagcccagggacacctgtatttcaacagactaacaagctgaagctgcagcttgggatgtggggttacttggttttggtcatttctacctcacaatgaaggctctttgaggtgatggggtctggagcagtgtgcctttcctttctgacttgtacttttagattgcatctgtctgggaaagatttcctttcttttttttttcccagctcttccattacctgctatgtgatgggggtgaggcttttaccctttctgtgccttagtgtcctcctttgtaaaatggaggcaataatagcatctacccatcagatgctgcgagggttaaaaagagacactataaggtcctaagcaccatgttcaatccagagggagaactcagtaaagatcaactgttgtcatagttcttagcatgatgcgaaagacacacagcacatatgcctggccaagagggtaggctgaataaacgttcaagacctttctcttcctcctcatcccaccctctcaccccatcactttaaatccaaggatggtcagagtctgctctcaggagcagaggagctgaaaatggccacgctggggagggttggtgaccttagagtggaagtctcctgactccaggtctggcattctttttgctcccccactttgacagtcctcaggcaccttctgacacacctccagagcctcagaatgcccagcacaaaggcctctgtccagcagggggcctctgtaaggtgaggaattcgctgatattaagcctcgtctactccccactttgcctctctccaactgacctctaaagagatgataagaaaagagaagaagggctgtaaaaaacagtaagtgctcaaagcgtggaaaacatataacatcacaaccaccctctctttctagcttattccaagttataggccaagtatatcctgtcccattgcgatgggttcccagatccaggcaataacatggctgcacaggtgggctccaggatctggaagtgagtgcccagaaaaactgcccattcattcttcagggagttccaattccttaggcaggcaatcaggggctctgaacacttggctgtcccctcccttccttcatccacctgcagctgtcagccttcccctcaaaggacctagtttgactccttttgatggccccctattcccaatgcagccctattccccacatccagttttcccttcaccacttgaccctcctcccaatcatgtgtaataatatagcctccagaatcaggtcacaggttatttctggatccagcccaatgtctaatttgctgcagaacatgtgtgaaaaatcatgaacctctgccaactccatagagagccatggatttttaaacaattacaccagtgctggaatgtaatattgtacaactactttgaaagaaacaatttgggaatttctttaaaagttaaacgtacaccatataacccaagcattctactgctgggtatttgccaaagactaatgaaagtgtatgtccatacaaacacctgtatagctacgttgatagcagctgtatttgtagtcaccccaaaccagaaaacaatccaaatgcccatcaacaggtaaatagataaataaattgtggtataattcatataatagaatactattcagtaatttgtagaaaggaatgaatgatgaatatgcatgcaacaacctgaatgggtctcagtcattatgctgaatgaaagaaaccaggcataaaggattccctattctatggttgcatttatacaaaactctagaaaatgcaaactacagatcagtggttgcctgcagatgatggagaggggccagagggagggactacaaagggccacaaggaaactttggggactgatgaatatattcatcatcttgactggggtgatggtgtacacatatgcaaaactgatcaaattgtactttagatattttcagtttactgtacatcaattacacctcaacaaagctgtagaataatcaccccagcagctcatcttgcagttgttggtgacatccctgagcctcagaaaatgggaatgtgtgcaatgttttcatatataatgtactaacatgctttgttcattgctctgatggccctgtgctttcttagctttctgggtgagaatctccaatatattttcacttgtactttctgaagggctctcaggaagccacagcctagagagaagctgtttatgaaggaaattgttctttaaaataacaatcatttgtgatacctttagtagagatccaatgaatacagtggaccttgcctccttacccttcagtttttacctttttccattacagggtgcagttgatccattcagaagtaagatgtcctgtgaaatgttttgccatgtgggctgcctgtggtggctctcagaagggctgatctgccttgcccttcctaccttttcctccctccctcctttccttccttcctttccttccttcctttcctcccttccttcctcccttcttctttcttccttcctttcttctttctttcttcctttctttctttctttctttctttctttctttctttcttttctttctttctctgtctttctttctttttctttcttctttctttttctttcttctttctttcctttctttcttctttctttctttccttctctttctctctctctctctctctttctttctttcttcctttcttcctttctttctctcagtctgtcaccccaggctggagtgcagtggcactatcacaactcactgcaacctcagactcctcggttcaagcgatcctcctgcctctgcctcccaaagtgctgagactacaggcatgagccacagtgactggccttgctcatctttccatgttggcaaatgggagttaatgttggctcacttgggctgtctgtgctgcccactgcttagctgaaagtgagaagactgccctgccctccttagggccacaaatttgaccttcaatttccataaactgagtacaaaaatatgatttcaagcctgcaatgacttttttgttgaggtaaaatctacataacataaaattggccattttaatgtttacaattcagtgccatttagtacattcacactgctgtgcaactatactttctagctagttccaaaacatttatgtcaccccaaaagaaaactctctagtcactaccagtcactcatcatcccccacaccccacctcagtccctggcaactactaacttgttttttgttcttatgatttactgatttgccacattccatgtaaatggaatcatacagtatgtgacttcttgtgtctgggttcttaaactcagtatcatgttttggggattcctccatgatgtagcatggatcagtactttatttcctttgggggctgaatcatatttcagtgtatggaccacaatgacttttttttttattactatactttaagttttagggtacatgtgcacaatgtgcaggttagttacatatgtatacatgtgccgtgctggtgtgctgcaccagtaactcgtcatctagcattaggtatatctcccaatgccatccctccttcctccccccaccccacaacagtccccagagtgtgatgttccccttcctgtgtccatgtgttctcattgttcaattcccacctatgagtgagaacatacggtgtttggttttttgttcttgcgatagtttactgagaatgatgatttccagtttcatccatgtccctacaaaggacatgaactcatcattgtttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttattgtcctttgggcatatacccagtaatgggatggctgggtcaaatggtatttccagttctagatccctgaggaatctccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgctttttggctgcataaatgtcttcttttgagaagtgtctgttcatgtccttcgcccactttttgatggggttgtttgtttttttcttgtaaatttgtttgagttcattgtagattctggatattagcactttgtcagatgagtagtatctgaatgatgctggcctcataaaatgagttagggaggattccctctttttctattgattggaatagtttcagaaggaatggtaccagttcctccttgtacctctggtagaattcggctgtgaatccatctggtcctggactctttttggttggtaggctattgattattgccacaatttcagctcctgttattggtctattcagagattcaacttcttcctggtttactcttgggagagtgtatgtgtccaggaatttatccatttcttctagattttctagtttatttgcatagaggtgtttgtagtattctctgatggtagtttgtatttctgtgggatcggtggtgatatcccttttatcattttttattgcgtctatttgattcttctctcttttcttctttattagtcttgctagcggtctatcaattttgttgatcctttcagaaaaccagctcctggattcattaattttttgaagggtttttgtgtctctatttccttcagttctgctctgattttagttatttcttgccttctgctagcttttgaatgtgtttgctcttgcttttctagttcttttaattgtgatgttagggtgtcaattttggatctttcctgctttctgttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagacagtttgttataatttctgttcttttacatttgctgaggagagctttacttccaactatgtggtcaattttggaataggtgtggtgtggtgctgaaaagaatgtatattctgttgatttggggtggagagttctgtagatgtctattaggtccgcttggtgcagagctgagttcaattcctgggtatccttgttgactttctgtcttgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttcttgaattgatccctttaccattatgtaaccgccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtctttttattggagcatttagtccatttacatttaaagttaatattgttatgtttgaatttgatcctgtcattatgatgttagctggttattttgcttgttagttgatgcagtttcttcctagtctcgatggtctttacattttggcatgattttgcagcggctggtaccagttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttccaacttggttccattctccccatcactttcaggtacatcaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagctcagagtaatttgatcgtctaaagccttcttctctcagctcgtcaaagtcattctccatccagctttgttccgttgctggtgaggaactgcgttcctttggaggaggagaggtgctctgctttttagagtttccagtttttctgttctgttttttccacatctttgttgttttatctacttttggtctttgatgatggtgatgtacagatgggtttttggtgtggatgtactttctgtttgttagttttccttctaacagagaggaccctcagctacaggtctgttggagtaccctgccatgtgaggtgtcagtgtgcccctgctgggggtgcctcccagttaggctgctcgggggtcaggggtcagggacccacttgaggaggcagtctgcccgttctcagatctccagctgtgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagattcccggctgctttgtttacctaatcaagcctgggcaatggcgggcgcccctcccccagcctcgctgctgccttgcagtttgatctgactgctgtgctagcaatcagcgagactccgtgggcgtaggaccctctgagccaggtgcgggatataatctcgtggtgcgccgtgttttaagcccgtgggaaaagcacagtattcaggtgggagtgacccgattttccaggtgccgtcagtcacccctttctttgactcagaaagggaactccctgaccccttgcgcttcccaggtgaggcaatgcctcgccctgcttcgctcgcgcacggtgcacgcacccactgacctgcacccactgtctggcactccctagtgagatgaacccggtacctcagatggaaatggagaaatcacccgtcttctgcgtcgctcacgctgggagctgtagaccggagctgttcctattcagccatcttgccatttttcttctttctttctttaatggctattctggttcttctcttaactcactgctacttttggccacttgttaaacactctttctctccctacccaccttcttaggtagttttctctgttggacttaccaccagtataattggagacagaggctagacatgtatgcaaacctatagggacatcccctcaaaatgccgagtgacaactgcccacatctctttcttagctgtgagtttgttttctgacactttctttttagaacgtgttgggctctaagtttgctgaataatcttgagcattgtcccaattaatgattcagggcttcaattccccagattgctttgcttgaaatctgggggaagagggatgtctcactagtctttggtttaatgtggaaagaagggaccccaagctccacccaaccccactgggaatctggaggcggtctaagatctttccagcagccactgaagggaagtctgttcgtaccctcctctggctggggaattgtaatcggtggatgaccatagaggaaagctagtcaccaacacagggatgatgccagctggcaagcctcgtagagtcctcctggccaagctctttagtacattgaaagaaagtgcaactcagagaggtgaagctactcgtctgtcagcttgccagggagaggttgaaacctcagtgatgtcggcacttctttaaggagaggcggtcactggacagcctgggaggctgccttgcagatttatgaggcttctatccaggatctttcagaatgtggacccaaggaaatattacatagagcgtctgtctttaagtccggtctgctgggctcatgccctggcttgggattcagggaatctgacttctagagtcatctctcaccatcttttgctagcatatgttcctgggtgagtctcttcctcagtttccctatctgtacaagaaggggattggacctttttggtgtgtgtgacagagactcgctgtgtctcccaagctggagtgcaataatgtgatctgtgctcactgcaacctccacctcccggggttcaagcaattctcctgcctcagcctcccaaatagctgggattagaggtgagcaccaccatgcccagttaattttgtgtgtgtgtatttttagtagaaataggatttcaccatgttggccaggctggtctcgaactcctgacctcaagtgatccacccacctcggcctcacaaagtgctgggattacagacgtgagccactgggcctagcctggactttataatctctagttttccctcctgatattaacattctaggattctaaccaagctttgctataaaaaaggaggagaacaaaaagggattgctgtccttcagctcagttgctgtctccattgcctgcattgaaaaaaaagggctgcccttcccttgtgcctttagtgcacacagcaccaccctgtccaaggggctttctggttcaaggtctcatttgatccttatgtgcaccatgggaggggaggagagtaaagaggatcagccccattttgtagatcaggaacctgagactcaaagaggtcaaatgacctatggatggaagtggaactcaggtctcctggtcctcaaccccatgttcgtttcattatttctcctagaccgccagctaaaaatgctttgcaagcctttgttgggccagctggtatgactggcacctgggcccaagtgtaacatgtttgcaaactgtttctacactctgaggcaactgcctgctgaaattactacaaaaccaaacaatttccaacattttcctcctgcctagtgcaacatttccagttgttcctgtagggtaagtctagggacacattgtttttaaaatcatttccaggggggaaaaacattatactctgtgtgtgtgtgtgtgtgtgtgtgtgtgtgtgtgtgtgtgcacctttggggctacggttgagcagtccataagggcagaaaaggaaaagaccagctgctgcccctgtttcctttgctagtcagctgtagaacaaccggagtagcaatttgagaggaagatagaggaatctatgcctaccagtactgatggggataaccccaagcttaaagagggggcccttttcctccagggcttctagtgccatagtgctttccagaagagagagaaagagagagagagagagagagagagagtataccaactaatgagtggtatgttgtgtccctgcaatggacactggaacagcaccctccaacacacaccaactttggtggtcgactatggaaaagcttaagggaattaagcctgtaggcatttagctcatgagaaaactagcacggagatcacttgaattttcagtttggactgccactttaaatccaaggtatctttgaattctcaaagtgtatgatgtttatagcataggaaaagatgatgcttatagcataggaaaagatgatgctaaacaagttcaacttttctttttcaagaaataaggacttgaaaaaacttggactcacattactttgaaggctagttctgcagtcaatcatgtgacaagatgagcattgctattgttggtgtaagatagtcttgctctgccttcgtttcttgatgtccccaagttccagaaaactctgttctctgccataatgggaggtcactgtgtgctgtttgattttagagtcaaataagttttcagcacatggtcagcttgagagacagtttgccctcaattggcttattggtttgtacaattcttggctccttcaagcagggtcctgccatctgagcccactctgtgggattatgggatacctgtacttgccaggaagtcctggcctcaagctgattcatcactgggtagcacatgacgcccagatgagaggggggcatttttaacctcaatggcatgaaaatttcctgaaatcaaaaggacagagattgggagttcctggggagcagcagcagcagcaatgtcaaaagtaggatcaaccagagcttagaatattcctacaccaactttgcaagttgttcattgatatgtgggttgctggaagaaagtttccagcactgctgggtcagcatataaacaaggaaaaaagggtgtgttgatggcccatttcaaagggaaccagtcttgctaatggtagagggtataaacatttttctccttcaaaacttaaaagattttgttgtatcttttctctaaaagaaacatctttctaaaatgtcaaattagagcaaagagtgataacaatttggactagaaaaagcagcctcattaagatataattcatataccattcaattaatccattgaaagtttacaattcaatgtgttttagtgttttcacagagatgtgcaaccatcaccacaattaattcaagaacattttcatcaccctcaaaagaaaccctgtacccattagtagtcagtccacattctcccttccttcccctagccctaggcaaccactaagctactttcagcctctatggacttgcctattctggatatttcgcataaattgaatcatacaatatgtagttttctgtatctggcttctttcacttagcacgatgtttaaacggttcatccatgttataacatggatcagtacttcattcttttttatggatgataatattatactgtacagctagaccacattttacttatccacttacctgatgatagacatttgggttgtttctactttgggctactactatgagtagtgtttctatgaacattcctgttcaagattttgtacgaatctctgttttcaatcctcttgcgcatatatctaggagtggaattgtaggatcatatagctactctatgttagtttttcataacaacttcactgttttacattcccaccaacaatgtatgagggccccaatttctccacatcactttgagctttttaaagtcaacttttcaaagctaaaagtgatgttttagaatattgatatatctattagcacaaggctataattatatgcctcacagctcttgtatagtgtcaaaacagtcctttaaaattcacagaaatattaagcaatgtgttatgcattgctaagctcacttgtgctccagcacaccaagtcatccaggctctaggttgggtgatgccttcagagagttctagtccagccctccacccaagcttgaatccaccctgcagatccattcgggagatcattcccgagaccctactattctctgaacactctggggctacagccacataaaagacatgtttccttctctcacaagaatttacagtctagaggaggaatcaaatgctagacaaatacttcctgccaaggacctggggaacacagagggagcacctgtacagaaggctcttcctatgtaccttgtggggttgttggagcgagccagtgaaatgctctgtgtaaattgtcaagcccagtgtctggatcatagcaggcacccaaagatagctgttatattcctgtatagaactttgcattttacctatgaggaaactgagtcctaaagtttaaacagctttcccagagccctgtaactcatgactgagaagccaacctttctgtttcaggtcctgcttgttgggctccaaagccttggctatactgacatctaggaggccagccttattaaccttgccctgcctgtctccagactgggctcttctgcttctcccaggtctggtttcctggatcaaggcatcctactttattcatgtcctagcataacactaagattgttagtggtatacagtaactagtaacagttagctagtccctagtacagcagggtgatctgctctaattgcagccagaagtggtcatgactgatgacagtggcttgaggagtctattgctggtgcagcattctctgcctatcagcagccccacatttcttcccaacatccaggccggaagtctggaaagtaggaatggccttagcctcctggtctgtattcagctggccatcaagccatgcaaaatttccatgaagatgctgccttccgattgcttcttctccattcccatatggcccctgtaccacagttttgtctacagaagtttataagcatttgccatgagcaaagtattttgttgggttttctggttgagagccacctgagataaatgatccctggtttcaggctcatagggatagcagaataataagaatccagagctaggtgtcctctaaatgccaagagccaaggactgctctgggctcaggatctcaggatgttccagctcttattcatcataatgagagatgatcagtccctcaccacagaagactaagcaggcccagaagctcaaagtaaccagcaagtatggtctgctgtggaaatgggccagtctccactggcatcttcaccttgcctgcagaaacatttttatccccaatgtattagtttgctagggctgtcataacaaaatattaaaactagatgacttaagcatcagaattgattgtctcacagttctggaggcagaagtccaagatcaaggtgtgtcagcagggccacacttcctctgacagctctagggaaagacctgttctaggcctctttccttggcttgaggcagcagagctccaatctttacatagtgttctctctgtgtgcatgtttctgtgtccaaatttcccctttttatacagacaccaatcatattggattaagggcccaccctactccagtaagacttcatcttacctcattatatctgcaatggccctatttccaaataagatcacattatgaagtactgggagttagaatgacaacatattaatttggaggacataattcaatccataacatcaacatgcatgtttgaagatagacttgaattactctgccatcaacattatcttcacccaagtagatgtgttccattcttctgcaagctcatttgaaagcaggagttcttttggcttttcttttctttgagggccaaatttcacccttgaaaaatgatggctctaatattcaatgtcttctgccttaaccccaaatctgcccaatagtctggagactccaggtaggacatgatggcctcacctcagaacttttcttgggaatgcctgaaccacacctcaccctatccaggcaacagaggaagaagctattaggatgagggacagactcaggcatgtccagcaacttacctggagtcactaagagtacagctcagaaacaggcacagagcttgacttcacaatgcagctcacctttggacgttccaggctgaagcccaaagttgtttctgccccttagttcatttttcctctgatttggtgagggttgtgggactcagacacctttgagcttctaaagatttcagccttttggggttgctcaatcaatatccacatactcctcttcctttcttgccaggtgcctttgatttggttcctcatttacttcctgtcatgcctagagtcaggtggcagcaaggtagatctagctccaactggcactttgagatgggcattagggatccagcagggtccatggtctgggagctaaaggtcccagataagcaagaggtcgtagataatgtaaggaggggtaaaccagtgataactctggggttactggggtgccttcagagcccagcacagagggtctttgctctctttcatatcttcttctgggtatgggtggctaagggctcccaggtgtgtacttagagcctgatgtgggaaaagagactgcccacaggcctctgtttctgtgactaaggtgtgagtacagtactcactccactccacttcctgggtccacaagtaacaaagccatagagcaacacatgtccctggaacaaccatttacttgaggacgcaggcattttttcctatattaaagcaaacatggatgtaatataaaatcgaaagttgaagacccacagatttatttgactaaactccaaattgcatgtggcagatggctttggagttcctctttatccctggattgttcatgagtgagaaacattgctgaggatttggtttctttctatcagaggcataggcttcctgggcaggtgctcatgaacattgccatgggaagatggtacacagccaggcatttggatgcaaaaggtggcttactcctgctttggacagaaaggtctgcttaagggctatttcataggcttggattcatgtagagggaaagaagaaacaaagctgtgtccacaggctaatgtgctgaggttgtgagatacctttcaacttggaccaaagtcaatgtacaggcagtgatccctctccagtgtcccttccattggccctgcttcctgggtccagccagtacctgatgaagattgtggtggtgagggagtaggcagctactgcacaccagagaattgagcctttgtgtaggaagttttggccactacctcaccagtcccctttacattggctctgggtgtcacaaagggggaaggcataaaatcaatagagtggagtctttgaaagccaaagcagcattttaaaccttttttctttagggctgaatgggcagcttgcttgaagttgataggttttgtgttgccagtcctataatgagatctgagcttccatcctccagagaagctggagatgctgggcctatctggatgagggagttagtgatggcctcagcagtatcagaggcctcttttttttcttcttcatttgggtgcattgtatatcatgccattttatctttactgggatgtctctagaccctcacatttgtatgaggtcactcctgaggcctcaggcttggcccctgaagcacccaagaaatatttgggtgggaattggtttttttttaaataagaaagtctgtacaaacatcaaaagttgattgaaaaaaatagtgctatgtaggaaaggtcccaaaagcagtaagaagaattgatgtccccctgcatctggaccctgaagtccttttggaatagcagttagtttcttacttgggaaaaattagattcacaggaagttgcaaacacagtaaagaggcccccctgtaccttacatctagttttccccagtggttacaactcatataacaatagtgcaatatcaaaacttggaaattgatattgctacaggtttccgtataaaaattttaaaaatttataagaaccattttctattctaaaatataaatttttatatataaatttttgatataaactttcatgtctctgggataaatgcccaggagtacagttgctgagtcatatggaagttgcatgttgagttgtgtaagacactgtcaaactgatttccaccagcagtaaatgagtgatccagtttctccacttcctcaccagcatttgatgttgtcattgttttttagcttagccactctgttaagtaggtagtggtatctcattgtggttttaaattgcatttccctaatagctaatgatgttgaacgtctttgcatgtgtttacttgccatctgtatatcctcttcagtgaaattcagtgaaatgcctcttcatatcttttgcccattttcttttctttctttcttttctttttttttttttttttttttttttgacagtctcactcctttgcccaggctggagtgcagtggtgtgatcttggctcactgcaacctccacctcatgggttcaagcgattctcctgcctcatgagtagctggaattacaggtgcacaccaccacacccggctaatttttgtatttttaatagaaatggggtttcgccatgttggccaggctggtcttgaactcctgacctcaggtgatccactcaccttggcccccaaaatggcttctgcccgttttctaattggatggtttgtcttcttactgttaagttttgatattctttatacactctagatacaagtcctttgttaaacataaggtttgcaaatattttctcccagtctacagcttgacttttcattctattcacagggtctttcacagggtctttcacagagcgaaagattttatttttgatgaagtctagtttatgaatttttccttttatgggttatgcttttggtgtcacgtctaagaaagaactctttgcctagctctaaatccagaagattttctcctatttttcctaaaacttttatagttttatattttaaatttagctcagtgatcactttgagtgaatttttgtgtaaggtataaggtatagattgaagttcatgttttgcctatagatattccagaaccatgtgttgaaaaggctattattcctccactgaattgcttttgcacttttgtcaaaaatcagtttggcgtatctacgtgagtctatttctaggttctctgtccagttccaattatctgtctgtccctctgccattactgcacagtcttgattaatgtagccctataataagtctttaaatcaggtacactggttattcttctttttcacaattgtttcagcccctctacttcctttccataaaattttggaaaaatcttttttatatctacaaaaaatcttacttgaattttgataagaattggttaaacctggatgtctatttgggagaagtcaatgtctttactatgttgagttttccaatctatgaacatggtatattactccatttctttaattctttgatttctttcatcagtgttgtgtaattttcagtttatacgtcctgtacatgttttccttgatttacacgtaagtgttttttgagcaatagtatatggtattgtgttttcattccgatgtctgtgtgttcattgctagtatacaggaatgcaattaatttttatatgttgatcttgtatcctgagaatttgctgaactcatgtatgagttctagcagtttctctgtagatactttgagatttttcagatagacaatcatgtcaactgcaatcgttttacttcttcttcttccttgttttttttttctactttttaaaaaaaaattaggtcaaggggtacatgtgcgggtttgatatataggtaaattgcatgtcacaggggtctggtgtacaggttattttgccacccacgtaataagcatagtacctgataggtagttttttgattctcaccctcttccctccgtccaccctcaagtaggcctcagtgtctgtcgttcccctctttatgtccatatgtactcgatgtttacctctgacttgtaagtgagaacatgcagtttgtggacttttgttcttttcacttaggataatgtccaccagctccatccacatttatgcaaagggccaaaggacatgatctccttttttttttttacagctgcatggtatttcacagtgtatatatacaacattttctttatccagtctacttttgatgggcatttaggttgattccatgtatatgctattgtgaatagtgctgtgatgaacacatgcgtgtgtgtgtctttatggtagaatgatttatattcccttgggtatatacatgataatgggatggctgggtcaagtgttaattctgctttgagttctttgagaaatcactaaactgtttttgttctgtagatgtctattagttcagttagttatatattcccactagtagtgtataactatcccctttctccacaacctctgttttttttttatgttttagtaatagccattaaatgtctggggtgagatggtatctcattgtgatattgatttgcatttctctaatgattagtgatgttgagcattttctcatatgcttgtttgccacatgtatgacttcttttaaaaagtatctattcgtgtgctctgccactttttaatggggttatttttgcttgttgatttaagttccttatagattctagatattagacctttgttggatgcatagtttgagaatattttgtcccatttcgtaggttatctgttcacactgttgatagtttcttttgctgtgcagaagttccttagtttaaataggtcttatttgtcaatttttgggtttttttgcaattgcttttggcatctttgtcataaaatctttgccagagcctatatgcagaatgatatttcctaagttatcttccaggatttttatagtttgaagtattacatttaagtctttaaacctcctggagttgatttttctatatggtgtaaggaaggggtcaagtttcaatcttctgcatatggctagccacttatcccagcaccatgtactgaatatggagttctttcttcattacttgttgtcaactttgttgaagatcagatggttgtaagtgtgcaacattatttccgggctctctattatgtttcactggtctatgtgcctgttattgtaccagcatcatgctgttttgggtactgtagcattgtagtacagtttgaagtttggtaacatgatgcctccagctttgctctttttccttaggattgccttgactatttcagtttcttttaggttccatatgaattttatttttttttctaattctctgaagaatgtcattgttagtttgataggaataatattgaatctgtagattgtttcaggcagtatggccattttaacaatattgattctttctatccatcagcatggaatgtttttccatttgtttgtgtcatttctgatttatttgagcagttttttttagctcttgttctagagatctttcacctccttggttagccatattcccaggaatttttctctttttgtagctattgtgaatgggattacatccttaattggctctcagcttggatgttgttggtgtataggaatgctactgatttttgaacattgattttatattccgaaactttgctgaagttgtttatcagatcaggtaacttttaggcaagaatatggcattttctaggaatagaataatatcgtctgcaaatggataatttggtttcctctttccctatttggatgccctttatgtatttctcttgcctgattgctcctgataggacttccaatactatgttgaatagaagtggtgagagagagcatctttgtcttgtcccagttttcaaggggaatacttccagcttctgcccatttagtatgatgttggctgtaggcttatcatagatggctcttattattttgaagtatgtcccttcaatgcctagtttgttgagattttttaacatgaaaggatattgaattttattgaaagcctttttatatctattgagatgatcatgtgggttttgtttttagttctgtttatgggatgaatcacatttattgatttgcatatgttgaaccgaccttgcatcacaaggataaagcctacttgatcatgatgaattagctttttgatgtgctgccggattcagtttgctagtattttgttgaagatttttgtatctatattcatcaagaatattggccgtaagttttcttttttgttgtgtctctgccaggttttggtatcaggatgatgttggcctcacagaatgagttatagaggattctttcctccgcagttttttgaaatgatttcagaaggagtggtaccaggaattacacatctggtggaatttgactgtgaatccatctggtcctgggcttttttctggttggtaggatttttattactgattgtatttcagaactcattattggtctgttcagggattcaatttcttcctggttcaatcttgggaggttgtatgttatcagcaatttatccatttcttctaggtttactagcttttgtgcatagaggtgttggtgtagtctcaggggattttttgtatttctgttgggtcagtgataacatgccttttgtcattttttattatatttatttggatcctctctctttttttctttattaatctatctagtggtctatctgtcttattaattctctgaaataaccaacttctggatttttcaatcttttgtatgtttttcacatcttttccctcaattcagctttgattttggctatttcttgtcttctgctagttttggggctcatttgctcttgtttctctagttactctacatctcctgtagtggcgatgttaggttgttaatttaagatctttctaactttttgatgtggacacttagtgctatgaaattccctcttaacactggtttagctgtgtcccagggattctggtatgttgtatctttgttctccttagtttcaaataatttgttgatttctcccttaatttcattatttactcagaagtcattcaggaggacgttgtttaatttccatgtaatcatatgattttgagaaatttttagcattgatttctttttttattgcactgtgatccaggaatatggttggcatgatttcagtttttttgaatgtgctgaggattgttttatgtctgattgtgtggtggattttagagtatgtgccatttgcagatgagaggaatgtatattatgttgttttggggtggagagttctgtggatatctgttaggtccatttggtcaagttctgagttcaggtcctaaatatctttgttagttttctgcctcgatgatctgtctaatactgcctgtggagagttgaagtctcccactattattgtgtggttatctaagtctctttggaggtccctaagaacttgctttatgaatctgatgctcctgtgttgggtgcatatgtatttaggatagttaggtcttcttgttgaattgaggcctttaccattatataatgctcttcttgtcttttcttatctttgttggtttaaagtctgttttgtctgaaataagaatagcaacccctggccaggcacggtggctcacatctgtaatcccagcactttgggaggccaaggcgggtggatcatgaggtcaggagttcaagaccagcctagccaagatggtgaaaccccatctctactaaaaatacaaaaaattagctgggcatggtggcaggcacctgtaatcccagctactcgggaggctgaggcaaagaattgcttgaacctgggaggtggaggttgcaatgagttgaggttgtgccacttcactccagcctgggcaacagagcgagactctgtctcaaaaaaaataaaagaatagcaacccctgcttttttgtgttttttgtttgcttggtagatttttctctatcactttactttgagcctatgggtgtcgttgcatgtgatatgggtctcatgaagacagcataccattgggtctcacttctttactcaacttggcactctgtgcctttcaattggggcatgtagcctatttacattcaaggctagtattgatatgtgtgcatttgatcctgtcatcatgttgtttactggttattatacaggattttttgtgtggttgctttatagtgtcactggtctatgtacttaagagtgcttttgtaatgggtggtaacaacctttcctttccatatttagcactcccttcaggatctcttgtaaggcaagtctgctgttaatgaattcccttcacatttgctagtctgaaaaggatcttatttctccttcacttatgaagcttagtttggctataaataaaattattggttgtaaattattttctttaagaatgccgaatataggcccccaatcttttctagcatgtagggtttctgccgaatggtctgctgttagcctgatggggtttcctttgtaggtgacctgccccttttctttatctgcctttaacatgatttttttttttttcatttcgatcttggagaatgtgatgactgtgcatcttggggatggtcttcttgtgtagtattttcaggggttctctgtatttcctgaatttgaatgctggcctgtctaggtaggttggggaaattcttgtggacaatatcctgaaatatgttttccaaattgtttgctttctctccttctctttcagggatgccaatgagtcatagatgtgatctttttgtataatcctatatttctcagaggtattggtcattcttctttattgcttcctctttatttttgtctgagttatttcaaagagccagtcttcaagctctgagattctttcctgagcttggtcagtcctgctgttaatacattcagttgtatcctgaaattcattaagtgagtttttcaactctctcagatcagtttggctcttgcttaagatggccatttcgtctctcatttcctgtattgttttattgtattcctcagaatccttggattgagttttgactttttcctgaatcttgatgatcatcatttctatccatattctgaattctatttctgtcatttcagccatttcagccatttcagcctggtaaagaaccattatggggaagtagtgtggtcacttggaggtaacaagacactctggctttttgagttgccagagttcttggcctggttctttctcatctttgtgggctgaaattctttcagtctttgaagttgcattcctttgcatgttttttttttcttttttgatgtccttgggggtttgattgtgatataaggtgagttcagttggctggttttgtttctgggagattttagtggggcaaagctcagctcaggacttctgggctgtgtgttctaactctgaggggctggtatcaagtcctcagttttgttctctggcccttcaaggttagaaacctgctgtgctgaaggggctgaggtgttcctggactgctggtcacaacactgcaatggatggtgccagccaaagcactccatcggacagtagcagcaggatccatgctcattcacatgtgccagcagcagtagcagaacggcagggtgcactttctttggttggggtgggtgccggtaggtgcaggggttgccagcctccatgcagatgttcacagtgtcagcgatggcaatgtggcatggaggcagctacttcttcttttttaaaatgtgtgcattttatttcattttcttgccttattggactagctagagcttccggtattatgttgaatatcagtgtcaagagcagatagccttgccttgttgccactcttagaaggaaagcagtcagtctttaaccatgaagtgtgatgttaactgtagatttactgtaaatattctttatcaagttaaggacattcccctctgtgcctggtttttatcatgaatgagtgttgaattttgttgaaggctttttctgcatcacataataggatactatgattttaattatttttttgagatgatgtagattcaaatgaagttgtaagaactaatacagatagatgctatgtactcttcagccatattcccctaatgataacatctggtgaaatgatcatacaatatcacaaatgggatattgacattgacacagtcaaaatacagaacatttcaatcaccatgggtagctctcattttgctcacatatagacatatctacttcccttccatacccactctctccttaatctctggaaaccactaatcagttctccatttctatagttttgttattttaagaatgttacataaatagaataatatagtatggaacctttggggatggtcttttttttttcacttacaatcattctctacagattcatccaggccgttgcttgtatcaactgtgtatttctttgtatcgctgagtagtcttccatagtatacatgtaccatcattgaagcattactgagttgtttccagttttttactattatgaatagtgctaccacaaacacttatgtgcaagttttgtgtcaacacaagtctttattcctctgggataaatgcccaggagtgcaattactgggtcatatagttgctggatatttagtttttaaggaaactgccaaactgttttccaatgtggcaataccattttacattcccaccagcaatgttatgagtgattcagtttctccacattcttaccagcatttggtgttgtcactatatttttacaaagatgaaattcacataacaatctgtgatatttagtacattcacaatgttatgcaaccatcacctctatctaatttctaaacatttgcatcaccataaaataaaacctcatactcattcggcagttagtcctcattcttcccctcccctcagttcgtggcaaccaccaatctgctttctgtctctatggatttacctattccagacattttatgaagatggaatcatacagtatgtaacctattatgattggcttctttcagttagcttaatgttttcaaggttcattcatgtttcagcatgttatcagtacttcgttccctttatggctgaataatattccactgtgtggatataccaaaattttgtttatctgtttattaattgatgtacattcggtatgtttccacttttggtgctgctaagaacatttgtgcaaaagtatttgtttgagtccttattttcaattcctttgggtatataccgaggagtggaattgtggggtcaaatggtaattctatgtttaactttttgagagaccgccaaactgtttttgatagcaggtgcaacattttaaattcccaccagcaatgtatgagggttccaatttcttcaccttctcaccaacacttgttattttcttcttttttaattatagccattctagtgggtgggaagtggtatgctgtggtttcggttgtcatttttctgatgactaataatgttgaacatcattacatatgcttgttggccatttatatatcttctttgggaataaatctatttaagtcctttgcctgttttttattgtgttgtcttttttattgttgcattttaggtgttatgtgtatattctagagactaggttttaattagccatatgatttgcaaatgttttctcccattccgtaggtcttttcattttcttgataacgtcctttgatgcccaaaagtttttatgaagtccaatttatctattttgttgttgttgttcatgttcttagggtcataaagttccattgcgaaattcaaggtcatgaagatttacttctatgttttcttttaagagttttacagttttaactcctatgtttaggttgttgatcagttttgagctgaattttgtatatgatataaggtaggagtccaacttcattcttttctctgtggatatccagttgtcacactaccatttgttgaagactaatctttgcctcattgagtggtgttggcaccctggttgaaaatcaattggccatagattaatgggtttaggggccaggcatggtggctcacgcctgtaatcccagcactttgggaggctgaggctagcgaatcacttgaggtcaggagttccagaccaacctggccaatgtggcaaaacaccgtctctaccaaaaatacaaaaattagccgggcatggtgtagtctcagctacctgggtgcctgtaatcccagctccccaggaagctgaggcaggagaatcgcttgacctgggaggtggaggttgcagtgagcctagatcgaaccactgctctccagcctgggagacagagcaagactctgtcttaaaaaaaaaaaatggatttatttctgaattctcaagcctatttcattggtctatatgtctatacttataccagtgctacattgttttgattactattgctttgtggtaagtcttaaaatcaggacgtgagtcttcttgtttttcaataatgttttgaggtgatcacatgatttttagtctttgcctgttaacatagcatattatggtaatatggtggtatgtatgattaacatggattgacttttgcatattgaactacccttgcacaccaagaataaactcaacttgatcatggtatataaaacttttttataaattgctgaaactttcttaaggatttttgtgtctatattcatgggaaatattggtctgcagggttttttttttttcttgcttgtacagtgtttgtctttgctgtcaaggtaatacaatgagttgggaggtgtttcctcttctcttttctgtaggatattatgtagaattggtgctaattcttctttaaacaactaatataattctttagtgaggtcatctgggcttaaagttttcatttcagatttttaaattatgaatttgatttctttcataattatatagccattcagattatttcatattgggtaaattttggcagtttgtgcttttataatgattggtccattttatctaagtttccaaatttatatgtgtattcatagtagtagtcccttattatccttttcatgtctgcagtctatagtaacatctcccttttcaatcagagtattggtaatttgcatcttccctttttcctttgtcagtcttgctagagattggtacattttattaattttatgaaagaactagatttgtattgggtttctctattgtttttctctctttaatattattattaatattaaattattatttatttaataattaataatatttaatatttaatataatatttattaaatttaaaatattatttattaaatataatattattatttattattaaaataatttaataaaaattattaaatataaaataatataatataatatttaatataaatattaatatttaataatttaataattaataataataaaaatattattaatattacgtttattgatacaaatatttgtacatcttcatgcggtacatatgatattttgttaaatgcatagactgtgaaagtatcaagttagggtacttggggtgtccattatcgctaatatttatcatttctatgtgttgggaacattgcaagtcctctctcctagctatttagaaatatacaatacattgttgttagctatggtcaccatatactctgctatcaaactgtcttcagtattattgatttttattattattttcttccttctgcttgctttgggtttattttattcttattcttgtaggttccttaagtggaagcttatattattaattttagattttccctcatttctaacacaaaaatttagttttatacattatcatctcagcacagctttacctgtgtcccacaaattttgatacattgtattttcactttaattcagttcaatgtaatttttatttcttttaagacctcgttaacccatgaatttgtttcaaagtatgctttttaatttctaagtgtttgtagattttcaagttgtctctctgttattgttttccaatttgattccatcatagagaaaacatcatttattatttgaattcttttaatattttgtggattgttttatcaccaaaaatatgtctatattggtatatatttcttgggtgtttgaagtaatgtaaattatattcttttcaggtggagcaatctatacattttatttaggccttattgaaacctgttgttgggctcttatacatcttgctgattttctgtgtagttgttctatcagttgttgagagagggtgttgaagtccccatctataaaggtgaatttttctatttctccgttcagttctaaaaacgtttgcttcctatatttgcaggtcttctgtttaaagcatacacatttaaaagtactatgtcttgttggtggattgacactttcagcattatgtaatgtccctatctgtcgctggtatttttttttttttttgctctgaagtctactttatctaatatcactagagccacctctgttactttttaaaattaatatttgcatggtgtatctttttccattattttactttcagcctttctaaatcattatatctgaggtgagcatcttgcaacagcatatcattggatcatgttatcttctttgccaatctctgtcttttaattggtatgtttagaccattttcatttattgtatttattgataaattagtgcttagttctgccaatttatttttgttttctgtttgttctctggttttttgtttttctattttcttttttctgacttcctgtgggttactcaaacaatgtttagaattccatttggttcatgtatagcatttttgaatctatctttttgtatagcatttttagggatcactctaggtattacattatatatatgcataacataataatctactggtgtcaacattttgccagtttcagtgaagtatagaaaccctacctctcctttcacccctttactttcctctatttataatgtaattgtgttaaatattccttccacatacatttacagacacatcagacaatgttataatcgatgatttaaccttcaaacataatttggaaaactcaagaggagaaggaaagtccattatatttacccataattttttctctttccattggtctttattcccttctaatgttcaatatcctttcttttatcatttcctttctgcttagagaattttctttagatattctctttgtagaggcatattgttgactaattttgttagtgtctcttgatctgagaatgtcttgatctccctttcatatctgaagcatattttcactgagtatagggttctgggttgacagttctctttattcagcatttgaaaaatattatgctacttccttctggaatccatggtttatgaacaaaaattcactctcattcaagttatttttcttctataggtatcatttctctttcactgtattcaaggcttttctcttcatgtttcagaagttttgttgttacaggtcttggagtggatttctttatatttatactgtttgaggttcactcagcttcttaaatttccagatgtatgtcttttgtcaaatttggggagttttcagcaattatgtctttgaatacttttttttttttttttttggtctcattctctttctcatctccttctggaattccagtgacatgaaagttagatcttttgtttgtaattctgtatgtccctgagtctatgtttacttttttttccaggatatcttctctctgttgttcagattgatcatttctttttattttattttattttattttattttattattattatactttaagttttagggtacatgtgcacaatgtgcaggttagttacatatgtatacatgtgccatgctggtgtgctgcacccattaactcgtcatttagcattaggtatatctcctaatgctatccctcctccctcccccctccccccaccccacaacagtccccagagtgtgatgtttctattgttctatcttaattctttcctctgttcttaccattatcctcttgatttgattcactgaatttatttccattattgtatttttcatttctaaaatttccatttggttcttttttatatgttctgtttctctgctgagaattctgattactttgctgagactttctatatttttttcatttgcttccaagcatggttgtaattgttggttgaagcactttaatgattacttctttaaaatccttgtcaggcagttctgacatctgtgtcatcttgctgttggcatctgccgataatattttccattccatttgatatcttactggttcttggtctgacaagtgctttgctactgaaacttgggcattttggatattgcattataagactggatcttatttaaattttctgttttagctgacttcctctgacactgctctggcagggaaggcgggcaccatcttattcttcattgacatcagggaggatggagctcctcattactgctggacaggggtgaggattccaactccctactaggcttttactgatactactctagtgcggatagggaagggcacctcattactgctatgtgggggtggagtctaggctcctcatttggcttttgttgatggaatataatgggactgcattttcttctatggtgtttggctggagtagagcagttattgtctaaaagttttctgtcttgctaggttacctctttcctggtcttttggctagaaagagcaggcttttgttggggcttctttgttagtgcccattggcattctgggtttctggcttcttcagctccaagtctggtatatatgaggcagaaacaaaatccagagaactcgccactgcatcattgctcaggtcccaaggtccctaaccagtatacttttttctttccaccttttaatgtcttattatgtttgttttatatataatgcccagaggttttagtgatactcagtgagagaatggggaaaagtacttctccatatttccagaggcagaggtttagacttgagattttagaggctgatgctgtactgccaaggaggtttatgggaagtagagctgtccttatatattaatgtcttagtggagctcttatttcatgtctacatcatgaaaaacaaaaagaaatgaaactttacctgggtttgcatatgtctgcttatctgtcactggaggagtagccatgatcataacctgctcagtcagtttcctttacatcagtgcaccagggtttcatgagccccctttcaatatctgttgctcccttcctgtgtctgtcaggctttgaactgttagctcacttggctgtatcctaacagtgccacagtgggtgtctgcttcttctatgaaccataaagcttactctagtagagctgagaaggccctaagccatcacctaattgagccaccatgtttgcatataaggaaattgcatctcagagaacagaggaagttttcctgaatctcactgcatatcacacaaaagcaaatccagacgtaggacccagatatcatacttgtaggcccagtgttattttagtcacatgaagctgctcctccatccacccctctaccttccagtgaactttgtcctttcctctggtcaaggactgtcattttatcccagccaactgtctcacaaaaatgcccctcattcttgggggtgggggtgctcaatgagggtggtgggtgggaggaagggaaaaggaatgtggttgactccacacaaacctgtcttcagagtgaaagtctgtgattcacggggtcagtggtctcatcttcatatctgaaagacagtgtactttttgtctccctaagccctgtgtctaggtcgtttgggaaacgccttggagagtcaagaataaatttgcaggtcaaacaatggatgactggaaaagtcggcttgtaatcaagagcatgcttccccatttcgccatggtgggaaatcgtcaggagcccagaaagctccaggaatcggtcagacaatgggccatggggggaggggggtatttaatgcttctaatcttaaacttgaacgtaagatgtgttattgaaattttctgtgcaaacttggtggcagggatccaactcaaaatataaggaattcaaatgtgatctagaagagatctaggagatgagctgatcccaccccttgtgggtttctagaagagctggaaatatagtctaaggttccatatagcctcccagtctagtagtgatcactgcattgcacccattcaataagaaaaatgaggaaggatgagagagggaagacgagtttactttttctcttaatagaagccagtcagaatggcaagcactagatatattgcatgagcttcctagtatgactgagaacaaaaagctagtgagtaggcacagagaggtcttcccattcaactttctggccctgttgtccttttagaaactcatctgacacacttctactttcctccctgggaactcagacatcatccaagtgttctgaacctcaggattagggattccagtggtagttctaggagcaggatgatgatagaagggactatgagagccattgactagtttaatttgacaataaaagcctgcaacaccaccaatctaccaagattagctctgttagcaggaattgcagcaaacacaatagctgttatctcagggtattagggccacagaggagtggcttgcttaatctctggaattaatagagcagagaggaaatggctcttatagagccgtgggtcggcttccttccttttcatagaactggaagccctgggctctgaggtaatgccatttcacataactagagggcctgtcttctccaattcccagggcaatccactttcagcaagtcagctttcaatttattttaaaattctgatatgtgcacagatgtggatggaggtgattgaaatcttgttttctctttgtttcctcattgtcaaccaccaacaatgtattgagaatgtgctatcaagttgagcatgtagacatttacaaaactgtttactgcactccccagctctcacagagattgcagtcaggtgggatggcagagatggagacattacttggccagcagcctgtccaaattgccaggccttaggcctcttctagaaagaaatctctaacctccatcctaattaccctttatatttcatgcttctcttttatgatcaacaattgagtcagtaaagaaaaacctgataatgctcccagagtccgtgatcagttttagcatgactttaaatttctcttttatttcccacttgtttccattcacttgggccaaattgtagaagaaagtgttgatggattgtggatgcaggggtcctcttccccttctccccaactccatcaacactcttaaaaagtgtggccagtaagtaactgctttggttttgatcagtgtacagttgaatgcacagattccagtgggggttgtccttagaataggtccttggagtggccatctgtgcatttactctggaaaagttgtcattgcttacgtcatttccaggcttggcttctctttgcagatggcctttagagccctttgtaagctttgccaaaaattcacattcattgctttagagtcacactttggatttgatcaagatcagccctctgcctcctctatgccacaccttgttctctgaaagagttctctgttggttctgagtggcttgactctttctaaaacttcaagctgtcctagaagaccaagaattcaccccagttgaggagaacaaagaattttaaaaatttgcctcagcctccaaaagcaactctctcagatggtcttcttcacagttgaaacagcattggatgacattgagagagcccactcctttggctggacgtgacaggtgctgctgtacggtatccctgtagcctcagaaaggtacccagtgctaatatgaaactctgctgcacatgctgaggatctcagcatctgggtgcttgtgaactgaggttgaccaaataaaagcagaatggcctgtgagtccaccaagaaacctgcagtccaaacaagttattgtaaggcctggaaggtgagtggccaaaggaggtcctttgcaagagctgggcttgcatttccagggtgtagccttagctggatctcagatgtttcccttgtttgctctccttctgacacttaataacacccagggatgacaccctgaaccctagtcccaggaaaccatgtgcatctggaagcacgtttcttgcaccactctccctcatcctgaaaacatcgctaacagagatttgcttcaggcattcagcttgactggttctcttgttctttcctagaaaacaaacaaacaaacaaaaaacatgtttcaaatcaatcttgaaataaaatgatatcagtcccagaggagagttctcttttagcagtccttgaatttacatggaaataattgtgagctcccttgaaggaaaacgtgcatctcacgtaacagttgttcttggcctaagactagggctcagaacacctgggttctagtcttgcagctactcctcactagctatggggctttgtctatcctttgccctccctgagaacaaagttcaaatgaacgaaaagtaagaataaccacctttaattcagcattgactaggtgctaggcactttactaagcatttttggggcattatctcctgtaatcctcatgataaccctgggaagaagaagctattattatctccaggaaaccgagactcagagagattaagcaatttgaccaaagtcacagatataagaagtggcaaactcagaggccaatgtcatcaccactatactctaatgcacattgaaaactacaaaatgctgaatacatatcaggcaggggccatcaccataagaaatctcagtaatgcaagtaccttttcagcatctgttcattcatttaatagtgtgactggttaatgactctggcgatctggggaacagaagagtttgaccttttgaacatttgggcatctacccaaggttaataaggcatccagtctctgcacttagtgtatggagttttaacaggaggcagaacattttgtccttccctttgaagttaagatcacgattctttccctagatccctagatcagtaggtcaaaggattgctagtgtgagaatttaaaaggcattagtactccaatttgagagtgctccagagcctgcatggagttgagactcagtgcgcatgtcacatgccatctctgtctcagtccataccccaccataagtggcaaagattcctccagctcggagcaggtacctattcccttcataaggcagctcctagacaaaatgagggtgcaaagggcatgaaatgttcagttggaggaggaaggggacacagtactttttgcacatcttctgtgttcagccatttaatattaagaagcgactcactctatagattacaatgggatgccgtgcccagtatttcttctgagcttcccaaccagtcagtggttgggcagggtggggggattattattattctccttctttatggataaagagaataaagtctgagaaattcagtgactttcagaaggatggccatccagaaggtggggtgctacatcaaggtccacatttggatggccccaagggcagtgtgctttccatctacaatacgatgaaaaacaacccctcagcccatatctttctcacctctaaatgcaagtagggctgaagacgggggagagaggagccctcagtgtaacagcgtatgtggacatttggatggctgcaaaaatactggcctcattctatccatcccttttctttagactggtgaccttagacatatccagtaggaggagctctagtcacctcctccctttgtgtttatgtgacggggttcaagatttgcgcccatcagctttggaggcatatacttcttgcagaaaaagtgctggactcaggaaggagtcctcagactcgattcagggttggaacaagctctttgtgagattttgagcaggtttctttcttcttgaggtcagagggcatgggtatgagctctaagggcctgtctatctctggcctcctgccacatttccagggtcccttctgtgtgcctggccctgtgctcgatcttgagccccaggaattcatagtctaggggcaaattattcccaggcttcctccactgggaacaaatctatcttactctgtagttctcggtgaaacctggaggcaagtgtttgagcgtctctcttgtgcaaggtactttgtgcacattcgctcatttgcttctgtgtcacagagattgatatttccacttccccagggtggagactgaggctcagaaaggatggagactttcccaatgtcacacaggcaggaagttgtagatctcaaactcaggtgccctgcctccaaagctcttcctactcctattcccagattaggagctcaggtatttccagggccttctgcaggccaggcactgttctcagtgcctttcattccagtggcagagacagcccataaacaggtaaagagtagaagcaaacttacttcattctggtagctctctgggatgttctgaccagcgttgtccactgccaagcctggcagaaagctaggctgctttaaaaccctatgcaggggcagccagctgggaacagagtgagttgtcgaaacagctcccttagaagcctcaagagaaaacccagatttacagctttgagtctttgccagcagcccctgcttcatgcaggctgaaggcgcggcacaggtgcaaatctggccccaagagaggggagctcatgtttatgggtccccttccaagacccaggtgatcctaggggctagttaatctagaggcaactgtccctgccacttattgataacttgcatgagcctctgggcctcagtatccacatcagtaaagtagggttaataactctgctctttgcctgcgtcagggtttctgggatggtgatgaacaaggtgtggttgtgcacgtgttccaaaccacacagggcatgatcctaaaccacacactgctgtgagcacttttttttaatgatcagaggttggcattggctcagaggttttttgccatcagaagagtgatggaaaatgtgtgtcctgacccctgaggatgccacagtctcatcagcagccccactacactgaggagacctgaatctgtaatgtagctgtgagcattctgggtcaagggctgcagtgtgtatgcgcctttctactttggggatcctccccatggagcacgcagctgttcgctccctttgctccctcctcctttttctgcagtaagggctccttcctgttccagacacccaactggggtgagaagccaggcagaggccttgccttcacacagacctttttttgcaagaactgagcactgctcagcttgcaggacaccactgggcttggcatctgggtcctgcctgggtagcctggcttggtaaaccagtgacctgcaaatcacagtctgtttgaagggagagtgctggtgaggggagctccatttttcagctggtttatgcaggcacctgggagcatgacactgcctatttctaaacttttaggagcccatgctggcctcatctgcattcctgcctagctctttcccacagtttccttgacataaggcccaaggtaacaggtttctggaggtggaactgccccaggaaggagagggatgctgttagactccaggacagagttgaggctcagaagtgtgcacatttctagggagtatgcagacccaggggccagccctgtgggtgtgggcctggggttcctcaaactctgggctggcctgtgtaggctgaggcctcttgcttttactgagaatccacagctcgaaagcccaatgtttctctttttacagatagatatttgggttataagctacccctggagtgctgcattccagacttctggggaggagggacatgagcttctaagatttgggcaacaaattttgatttccgcagttgatatagaataatttgttggaaaccttcctcctccccttttgcttttcctttccctccccttccttcctgcctttcccttctcctcctcatctccctcctaccttctcaccagatctccaacccctaaattccaaagttagaaaggcaagcatcagccacagggaagtggatttgaccactgggcactcaaacccaaggcgcaggcatgtctctgctgtcattgcctccctctctcttgctccgggccccctcagcacaggcctgtctttgtctgcctccctccagtgctgcaggcttccatcaccctctcaagtccccatccagaggcagggctggcataggtgctcgcttgctcactcactgccctgaccctgagagctcctgcttctatgcccctagagctgtggctgagtatatggcacatagtaaatgctcagtaagatgcagctgctgttcatcttggccagaagtcccttagaaatcatctaggccacccacattgctggacacaagagaaggccagtgtcatacagaggggaaggggtgcaattaaaaagtcattgtctctaggccttacacaggaaatgggaaaataacagagttatttgcagagtaccattttctccaatggttcattcacatccgcagatgccagctgagccctgtcacgaggctttggggttaccaagatgaataggaaactacctggccttcagagagttatgtggtggaggtgggaaatgcatagacctaacatggcagcctcaaggttggccatagcacctaggatggtgatggaaagggtagaaggtgagactgtattatcatagagacccttgagggcctgagggtggagggtgtgctttaatccactagcccatgcaaattgttcaacaatgtacaagactataagaacaaggcccaagggtatcctggaggggatgatgtttctctcctctcttttttttttcttttattattatactttaagttttagggtacatgtgcacattgtgcaggttagttacatatgtatacatgtgccacactggtgcgctgcacccactaacttgtcatctagcattaggtatatctcccaatgctatccctcccccctccccccaccccacaacagtccccagaatgtgatgttccccttcccgtgtccatgtgatctcattgttcaattcccacctatgagtgagaatatgcggtgtttggttttttgttcttgcgatagtttactgagaatgatgatttccaatttcatccatgtccctacaaaggactggaagcttcggagcacctgagaacgggcgcacaatgagaagtgaaacaacttttgggactgctggatcacttgcacggtttagaaatggtcaccttacttgcactacggaagaaatctttacgtttttctgctccagaaaggttgcccacccactcttctgtgaataatgggcctacatggccccctgcaatgtgaggagggcaacttggaaagaacttatttccctccaagaagatgctcagttcatgctctaggtcagaggttggcaaactacagcctgtgagctaaatccagcccacgggctgtttttgtaaataaacttttattagcacacagtcacgcccagtcattaacatattgtctactacacagagcttcaacagagaccacatggcctgcgaagcctgagacatttactacctgggccatcacagaagaagtttgccaacacttggtctgtatcactgggcatttggttcatttgtttaccctaacaaatggtacccatttcaggtagaattacaggccctcatgcggccacgtgtttagcttcccctcctgtgccaaagctggccccaactccacactcccaattccacccttctcaaaagttcttgcccctaaaagtgtttcttttccttccatttctcctcccatcagcatccagagagaactttttcaaagagatgaagccaatccttcctctgcttaagtcccccgatggcttccctacaaacaaaatacaatccaatccctttcccatagcctgcaagaccctctgcaaattcacgactacttccctggtgcattgtgtgacaggcacactggctgcctgcccgtcactggaacagtccaaaagccccaccccagggccttcccacttgctgccctcctgcctgggatgctctgcccccagtccttctcctggcctgctcagagccacctgccattctatcacatcactattttttcagtctttgaaagaatactgcacacactcttaacttgttcttgttgttcacttaccgtttgtcctactagaattccagctccttctctctggttccccacttctctccctggcctgtgctcattctaatggaagtgtcagttctgggccccctaggcagccctgcctgccctttactgtcatatgacttcatctctatagtggaggggagcccagtgccactctgtaggtgcttctttcctagaataagcttcaggccctaaagttgtctagccttagggctgcccatgtgatgctgtcagcaaaactaaacatgttcttgcctcttttcctccctcaagtcaagcccttagagtttagaacaatgaacttggcctatataaaatacctccaggaaatcagtcctcaaacaccaactcccaacatctgctttctgaatatatggcttcaaacagctaagtgtacagtatctaactgctgtccatccttttgttttttttagccacatgacatctaaggaacttagaaaatgccttgccctttcctgtagttaaatttgacataaaattactttattggcagcatattaacaaacaaaaatctcctgtgtttttcccggtaattcagtttcagttttccaggtaagaaaaagataattttgaatgactacaaggagacagactgttttgaggtttctgttaataacacattcagagtgtgccttcttcctctgtcccagtcagtggtgctgttgacagagtggtacaacaagaatgaaatatactgtgggaactcaccctgatcccaacaccctcatcaacaccatcaccaccatcactattgctaccagcaccaccacctccaccaccactaccctcaccttcactaccaccaccctttaaatcaacaccattaccaccatcaccatggctaccaccatcccaccatcccaattgccaccaccacatccaccaccattaccaccaccaccatcatcactaccacccttacctccgtcattaccacctccatcacctctaccattaccatgattactatcgccatcccctctaccaccaccaccctaccacttctctctctatctctctctcatgtacacgtacatggttatatgacacttcatgatgcaatcatagacactgtccacatacacacatacagtgaaataagtacatgtttttaaattgtcattattttcaatatagaacctactcttgttgctatgtgctttggggtggggaacatcaacgtgtgtttatggccaaaattgaattaggattcataagaaagggctatatctccaaatgcgcacttttaaaaaagttaagtttggatgagggatctttcatttcataaaaggatatactgaggatttcctttcagtgacaaatttttgctgcattttattttgatttggtttacaaaagttagcctttcacacagctgttcaggagcgcagccaatgactaaaggcagatctgccttgaatagcaaatgctgctgagtaaaccatgttacaggctattttaggaccaccaagaatgtgtttgcattttcaagagtagaaggagagatcatatttatttggtatctacactatgccacacactatgctaattacatttctaagctcatgtaatccttacaacaaatttacgaaggctttactttccccattttgtaggtaagaaaacaggctcacagagggaaaaatgacttgcccaaggtgaccaccaattagagacaaggtttaaacagaccatgagggctcagggcctacctcaagccctctaatcaccctacactgctaagttcttctattagaatttgttgtgcagaaggttttcttcttcttcttcttcttttttttttttttgtataatcagattatccatttgcctacaaagcctatagtgtgcaaggagtgtgtagtggtccagtcagtgtaccctggcacttgagagctcattaagggcccaggagaatcagcaaattctcagcagccaagctaccctaacgtatatcatagaaactacaataggagatttcttctctgaggtcactgctatctggcactatcctgtgatgtatggtttggaaaaccgtgggtcaaatacaaccgtccctacaggcaagtcaaaatatcgtggctgaaactaaaagtgattttttatcctcagtctaagtgtgaagagctgaagtgatctgcctttcctttagcaccccagaattacctctgggttcattcggggaaggctggcttactgctgaggtgtccacacatctaccactatacatgcctggggttcttgggggttctgttacctgggctgaactctggagtcctgagtgccaagctcttctctgccactatctatatgacttttagtaagccacctgcaactccttcacctcagtttacccatgtgtaaatcagggaccccaagcaaagccctgcctacctcctaggattcttgttagaatcaaaggctgatgaatgagaaagtacactgtccactgaaagggcctgggattttataaaggcctgtagttggtaacaccaagacttggatctgaaggtctagaaaagcacaacatcctgagactctgtgtggatccctttagcctactgtgagtgcttatgtcatgtcatgaacatgatataccccccatacagccctaaaaagtctttgctactagaagccgcatcctgtatgtgtataaaaatacagaaccaacctcccaggtacacacccgttgcacaggcagtctctgctgagtcattgtgcagacacgtctcttgctgcttctggccatgttgttcccagaaatggctctagagggatttcccgcatggctgaatagatggggagcatacgaggagctcaccttttcagggttccagatatacagctgggccggaggggctgggaggcagaagagtgggtgcagcagagtaggcttgtggaagacaaagccttcagaaaagtttcttgcccgaggcaaatgcagtccatgctagatggtacattcccagccaggaagagagtgcaatgtcctctccaactcaaatggcagtgaccagtgggtctccccaaactctgccataggacattagggctttaccaagcactgtccaggttgcagttttagatgggaaagggcacttggccttgagaaggtacagaagccaactccctggtcaccgcatttgttcatgctttttcccttggccctcagcctctggatgccatcatttggcctggagataggaaaagtgttgcctacatctgcctctggtactagcaaagggcatggtacagtgtggtgcagaccagcagcaggaacagaaaggtgcttctctaaggaagctgcagagatttctctgccagtctggagatcagctttgggtcccagctctccctgctactcttccatatacctccaatgatgcaagtttccaagaagaccaaggctgtgaaaaacagtgtggtggttcctcaagaagttagttcaacataaaattacaccatgacctagcaattccactccttggtatacacccaaaagaactgaaaacaagtgttcaacaaaaacttgtatgcaaatgttcacagcaacactattcacaatagccaaaagacagaaacaacccaaatgtccatcagatgaatggactgaccaagtgtggcacgtccacacaatggaatattatttggccacaaaaggaacggagtactgaggcatgccacaacatggatgagcccagaaaacatgatgccgggtgaaagaagccaggcacaaaacgccacatattgtatgatcccatttatatgaagtattcagaataagcaaattcatagagacagagggtagataaatgtgttgccaggagctgggggtttccatttgggatgatgaaaaagttctggaactagatagtggtgatagttgcacaacattgtgaatgtcctaaatgctaccgaattgtacacttttaaaaagttaatttcatgctatgtctattttacctcaatttaaaaagagaggacctagaccatgggaagagtctttggactgactccttatcccatgttccctccaagtttcagctgctctgatgccaagactctcatggcatcagagctcaccagcctggctctaaatctactaagtggggtcgatatctctgcaggctaaaagttggcactcaggagctaaaatgtgcttattcaataagcatgtgacccctctgctaagctacagaggcatgttctggacataaattgttttaaatgtggccattgatagcagcatctctctttggtgtgtcctagcaggaagaggtcatagacaggatgcccctctagaaggttctgaactaatcaggtgtctctggaatcttctcccacctacatagcagttgaatttctcaagcagggaaatattctgcatggtctgaagcttgttgccattttatttagcctactgttggggcacagagagaggtaaggtcacctctggcctaagcttcaaagttcatccctcaagccttctaagacccggtacctaattttgttttaattttatattctgtttcataaagagggccccagattataaaagcttcagtcccaaaactagagacccaaacacctcactataggaaagaaggctctgattaaccagcagctgttttttttctttctctttattctttccagctctattgaggtataagtgacaaattaaaaatgtatatttaaggtatacagtgtgatgatttgatatacatatatattgtgaaatgattaccacaatcaagttagtcaatgcatccatccataacttcatctagttatatttgtttctgaactcatagaactgttttaaaatcatagaaacagtagaaggctggttaccaagagttgcagggggtggagtgtgaaatggggagatgtcagtcaatgggtacaaattctcagttataggatgcataaatttgggcaatctaatgtacagcactgtggctatatttaataatgctgtattgcatatttgaaatttactgtgagagcagatcttaaatgttcttatagcaactatttttctatttgccccatttaaactactctagttggtgtcctggcaatgaggaggactgtcaccttgtttcctgaccttgccactgcaatccaaatggggtctgtttttatcatgccaggaaaggagggggaggctgcgtgggttcagcaggggtgtctcctgactgtgccttccaggcagtctgtcactgtgtgttcccccaggaggccctggaccaaaggccttttcatctcagtaccccaatttctaacctcataaggttacactgaagatgaaaggaattgatgtagttaacagggctgaagcagaggcttggtaactagttgctcttgttatttcctctgcttgtagaggaagttggtatagtctctctctctctctctctttctctagctctggctctccttcaaccattgccctatcatctgaatggcaccttggcccatttcctccaagccccacttctgcttgaggacagggctctggaggctgacaaacccaagttcactccctggttccaccactttttagccagccaaatgcccttaagcaagtgacactccctgtcttcaactgggcaccctcatctgtacaatgagggtgggggtgatcacattagtactgactttcttgagtcactgggaacattaaggtaaagcctaaaatgcatttggaactgtacctgtcacttagtaagtattccaaagtcactcttgaagtctacttataaatcaggtctcccttactaaaacaaaaggaaatggagaaagagaagaaaggagaaagatgggaataagaaaggaagagagggagggatggagggagggagggagggaggaaggaaggaagacaggcaggcaagactctttaatctttgctccttgttctctctagccactcacactcaagttccagcccccaccaatttggagatgattccctgataaacctctaaactgcaggcatctctgttcttcatttctaagatgaggatgataatgggaatatctttctcatagagttgtgaagataactatgtgaatgcatacaaagtgcttagtaccacaatagtcatttgtgtcttgtgattccaggagttttgggcagaggattgtgtgccctggtcagggtgcccacaggcaaggttgccactgatctgatggggccaatccaacaggcatggagcccagaaacaggcttccatgtccaatcccatgtcctgctcttgggaaggctttcccactccgaaccacaaaaccactgggtttatctgggccactctgatgaaagtcacattcccctgaacaaatatcctcaccacaagggcacctgggtcatcctgctctgtgaagcactgaaagagtgaggcagaaaatggagtgactacttccagaaatggaatcacctcaagtcatatcaattctcttgggaagagccccttgggtttgtatagttctttaaagtctgagggacagtggagaggcaggtcccaaggagtgctaatgcagaagtaacatactatggcagcctggcatgggtcagatcataaggggggccagccagggcgtggaggcaggactggcagggcctggcagtaagaagagatattgctactgcattcacacggtcccaatcagaagtcttagagattatctgtagagagagctgtggctaccccatatagtacgtgacttccacacagcccaaactaccctaattaataatgacccagaagctgattgtttctagctctcagattagcagtggctccttattgccccagcttagctctaccagatgtcctgtccctgaaatgtaccagtagcccctctaaaaacccacttggctcatcagggcccagtccagggccctccccacctatcccattcctaatcccatcagcattagcgagaagcctgccactgcctcagggacctcgcatctggagactcagccaagatggtggcacctgtgagaggatccacaggtagccaagtccaggtagccagaggccaggtggcaatggggaagagcataagtgacccctgtccaatatgccctcatcagccaaatctggggcctcagtttgggctttgtggtgtgaaggtaccacccgccaaatgggcctggagccaccagcatagctgccctccttctccctgggtggccctggaggtgccacacttgcagcattcctgggtggtccttctgtgcatgggctgtaggtggaggtgtggaaagctgaagacagggtcaggcacagcccagggcagcctagagatatttacatcatgatgatgggattagacagcccactcgcttgtgcggtatctggacgccactggcttgcagagcatttgggggttactgcttgagagtgttttccactggtcttgtcactccctaggtgaaggaaagtctggcttttgtaggaactgcctgggtctctggtggagtatttccttcctcacctctggattattctgcctctttagagcattctagaaaaggggtgttttctcggttcattggccacacggcatggctgcatcctggtgacattttcccagcatcagatggttggagactgcaatgaggaggctccacacaattcatagccttcagccaggccccttgctaaagtgctgcatgggacggagaagaccaaaccaattggagagggactcgatggaagccacacatggagttttgtgttgttgtccagtacttactgtggttgccctgctcccattgacctggacgatccatgttaccatctgcccctcctcccaaaaaagggaagcttcctgttcttggagttggcactaggagccaccctcagtggcttaaacagatttcttttaactatgaggtagtgcactagatgaaccagactacaggagatgccagctctgtagccatcatttcacaatgcagccatacctaagagcctaggacaggccatacccggtgggcggagcagggatgggccacagctggaggactgaaagtgggatctcagcctcagttacagaggcactccctgatggccaggcagcaatcctgtggagggctttgtcatcagaaaataggagcccatcatctctggaaggttggaagcaccatggtgagatgggatgtgtgtccaagagttaaactggtctggagttctcttttaacaccatcatcacaccccttcatttaatctatgctggactttgaccataaaaaaccaaacttgaaattgggatccctgcaccgactggtgaggcacataggagagggttggtttgggttccatatgactgacataaagcagagcaaatattggcttgggacccaaaccaaccctctcttaggcttgttaaggccccattcaggatagttccctggaggtggttggagagctggcagcctttctggtgactggtgacctggtagtactctctaatagaatatgtcaataagcacagctcatttgaccagaattgtaggccgcctttctcgatccaacaggtgcagacctgctactctcaggattcactttgctagtctcctgcactccacaccggatcccaaagtctatgttcaagtaatcccctatttaaatgtcatagatatatttggggaggctcataatttgattcaagtaacagtctgatctgtgcctctcactgagctggtgcaggtaatactttctttaagagtgtgtgcaagtggctctcctcagcctactctcacccccagggaaagaagccctcgtggatggaggaagaagatttatcttttctctacaagagcagcccaggaagaaagcatcaggtaagcataagcttaccaaagctgggacccattcactttacagtggggaaactgaggccccgagtgtgaaagggacctacaagaggtcacaccacaaggtcctttaagagaggcagagcccagggagaagtgagaaggttgggcttaaatgatctctgcccggtggccctggtggcctccaacctcggttctgcctccacttctccctttgcctgtgtgattttgggcttgttagccaaatttaggtgaaatgtagattaagcttgtgaacctgggtccagcagaagtggagtcatctggattgggacagggccctctcctttgacctttagcttctattacagctacctcaggcagcacctacttcctctatagatcaacctcaccaaatccatccagatgtttctcttctccccacagtaatcatctctatcccactaatgacagaacctgggaatgtgtttggggaagactgggtgaggatttcttcctgtgaaaacagagtacaggcctcaccaggcttaacatgagtgggtgtgagcagcccgtcttgaagggcccagcagttctgacggtctaggagttagaggctagctctcaacaaatgcttgttcaatggcagaataccttgattcttctcaggagatggtacaatacaaattctgagctcattaaattcatatacatctataggttgaggatcatccttagagctgtcagttcttccaactggcatgtctacactacagaaaaggagaaagtagttctagaacactgcccacccaggtttgctcatctctgcctttgtcagtgcacttccagccactccaggctgctgctcagatagttctggcagaagcctgttgaagccccagccctcaggtcagggtggctaaaggctgatgactgtggcagccttcagagtggcaggtggtggcaagcagcaggaggcaggagtttccaggctcagccaccaagacagcatccctggctgtcaggtcagtgctgtcaggtcagtgctgtcaggactaagctgcttgcctccccctacttccactccatccccctatcctagtgaatgcatccttatttgtaagaaagcaacagaggcccaacacgaagacacagggccttgagaatgatatcagtagtgattactgctccccaagtgctctcctcagtgagtacagtggaacctttcactaatgctgtgaagcacacatggtgggccaagtacccattttacagaagaagaaattgagcttcagggaggggagtggcttgcccacagccacacaacaaacggaggagctaggacttaactgcaggtcttctcatgtgcattccagggccccttcctccaccgcagcctgcatctgcctgcatcgagtgctggttcagggcgaatcagggacaccaataaatccccgatttgtaggtcgaggttcttgctccaaaccacccattatcagagatttgctcctgagacataactgactcctcttgaagccaatcagcattagcattcagggttccctgccattcccaaccaccctggtattctccagagcctcatgtcttgcaattctggaaatgctcaaaatcctgtttgttctacagaaagatcagtttcagtttgctgggacattctgctgaaaataaacatgtaaataacacatccccaaatacaggcattgatactatacacacggatattcctttgatcccatgtgcaaatgcaaacatattcattctgtctttctctcctcctcgctctcactctctctctttctctccatcccccatctctttgtctcttcaaacccattcctgatacattattttcttatctattctacagctacctccatcatgccccacgacatcttcattactttcttctgagatagtctactgggggccatccttgtcctcagagggcttgaagtctaatttagttggccaacatcaggtgcctcaaaattcatagggggaaaatgtaacaatattgaataaagttgttcatggagtatggatgtaagggaagagactaggagaactggctagcaaattggcctgaactgaactggtgaggcactagtgaagaaagagcagactaaataaaccacaggcgattttcacctttttgacaattttgcccagggcctacaagcccagtgccctctggagggaaaataagtctccctgagtttatctttcctggttacctttgacctcctatcttcttgcccaataggaacagtgcataccctttgctgacctttttattggtgtccatgttaaacctccaactacagtgtccaaaatcaagcatttataacagcctgccagacttctttggataagttatattctttattctccttatgctcatttcatggactgtattcgtataatctctaccttctctaagaaatttttccccttttttgtcattctggactagaactatagaaagggaagagttgccatatgtcattgttcagacagaaccagaaataatgttgacttcagagctgaacttgtctctatcagaagagaaacctttgttttctcattatctagggggtggggaggccatcacatgccttgaaatgcattttaatgaatgtttataaggtcatggggatcacattggtggctttgtctgccggattctgaaatgggactctgcaggcatttatgtatggagagaaaggaattcgtttctaaaagatgccagggcactgtcactcactccctcccccttcctcaccaccaaaggccgggcctgtgagggctctggctgggagttgggacgtctggggtccagtgtccttttaactaattgtctgaaagcaaatcgagatatgctctgaggaaatcctgccagtggctactgattgtcacagggagaggcctgaaagaagtaggagctgtgggacagctaggactaataccctgctgtcatcaagaccgcagagactggagaaaagcacatgggtgaagcagggagattcatttagaaagggctgggagcttggttggggaccttccgcccctaccaggattctgggaggggaggtcattccggagcagtgagctatctcctgcccttgatctaaaatggtggctgtgggatttagtcagaaacacccagtctgggcaggcaaaacctcagcggcatcagccacaggcacaggtgacccagtgaaggcacgagtgtggcactgggcacaggggaaagcccagccaacttctcgcagttgagatgagtaacagatcatgggactgtgaaagagaagacacgaaagcaagtctttatctaggggcaaaattaactggataatagatttccacgcctcactgatgtctggtgaaggcagacgctattacagcaaggctgagccttccgtgtaaacacagccgcctctcctcggccttgtttagggttggctggtgttcttgctgttcagccagggcacttcaggctcactgttgaaagctcattccatgaaatccaaaacatggagctgcatggcctctgacaaagtgagttctcactgaagtccattgaaaaatgaaagctcagaagaggcttgcagcttgccactctgccaaaacagcagcctctatcggcaccccaaaccccacccctgagaaaagccaggtgagcctgccccctttattaggcatccttatgaaagtcagtgagtgtacatgccagcagctgtccagccacagacttggcatagcaaaagtggcatccgctccagcagtggcggcctgctgggatctactttgttattgagtagtcagttggtttctagaattggaattgatcagggaccatttgcttgggatgcagttgatgagtgctggaaaaggtgtgtgtatacgggctctcatgtaggagaggtgcagcctccttccctttgccagtggccccagctggtacctttagtgtctggtggtcatgccctgcctcctccatccctgcaccttactcccagcaggttagtggcagaccaacaattaagtgaaagctctgggagcccatagaagctgccagcaaatttcagaggctcacgtggcagggatgccagaccattgcccctcacagccccttccctcccttcctttccccaacccccaccccctccttggcctgcctggttctgcattgcttcgccattgttaaaactgtcttgcagttcgagacatcatggacagcactttgggcctgactgttgccagctcagactccctgcaggggatccttatgtcaaatccacatgcaatcatccctgattgatctatttcatacatttctatttttaacctattggattctttgggagaatgtagaagagacacaatttcagtttgggacccagtggcttgtttgtaggttactccataatggattgagtaaatggctgagctccctgtgtgttgggtaatttatgttcctttgtccattgattcgttcaactgccatttactgagcacctgctgtgggccaaacagttagtgagctgctccatggaccagctcagggacactatgggtgctgtgcccagtcagactcctgggaaagtgggcactgatgactgcatgggcctcagccctcttattgtgcctgctctacacctctccaacccattcctgcctgacccatggtattcaggcctcagatgagtttggtgacagagctgtcccttgaagtgcccttgttcagattgtgggcatctcaaaagaaaagtcaaagaagtgtgcaagtcctctcactcaagttggcaagccccttctgtgggggcgatgcagtgtcctaccaacaacatggcgaaggcagtgggtctggaggcagctgagtggtggtggaggggccctgcatctgacctgggccttgttgccctctggctgagcaactctgggtaaggcctgcccctctctgggtctcagagacctctctgtctttaagaagggtattggactcccagaacccttccatacctgccctttataatgccgggtaccagttagtgaggagctattaggtgtcatacaatgtgccccgtttcacttaatagtcagagcaccttcatgagaaaagaactataattacactcattttacacataaagaaactggggctctgagaggttcagtggcaaggccaaggtcagagccctatgccacgctgcctccacccttgctctgggccagtggttttctgttgagaatcagccatggagctgttggaaaaactcccgatgcctgggccacaccctggatgaagctgtcagtttgtggtgggagggcccaggaatgtggatgtttctaagtgattctgatgtgcaccaaggcctgagacatacagccctggggatctgctttgatgttcacttggccatgacagtcatgcccctcatcgtgctggcaagtggccccatgcatgccttgagctcctagtgggctacaagctcatcaaaccagaagagccaaacttaaggtgacatcagaggatgagcactgtatgtcctagtgaaacttccaaagctggaaaggggttatttggggggtaccgggtgggggaagctttaaaagaattctacctgttcacctatcggcattcaggtgatttccagatccctctcttcctttccttattttgatcattcctgcacatactcctttgcccccacttcctttcccatttacctgctaacatacaggtcatggtcattaacacaacagcgatggatgactgtatgaagccatgaagagtaggaagtctcacattgctagtgactttgctttgttcccaaaggctgtgcttctataaatgatgggcagctcccccaaggttcagatcccagattggggccttttctcattgtttaatatctccccaacctgaggatgcatcttcagaggaaaatttcttatttagataactttatacttttttaaatttttggattatgagtcgttctcgttaaagacaaacaagcagaaatgaagagaatagaaagggaattgccagtcatcccaaataaatgaccactccaaattgttgggtataggttcttccaaattatttttgtgtacacatagcaatgtgtgagagtgtgtgtgtgtgtgtgtgtgtgtgtgtgtgtgtaaaaataaatggaacaatgaatacgatgcctacaatgactgttctgaaacttgtgctttcccaaaaacagtattttaaacagctccccaagaaaacacatccagatctacttctttcctgtaagggctctgttgtattcaattttaccactgcagcctgatgcatttaaccaagactagaaggcagcctaaaagttcaattctatactatggtattccttcgttaaaatctatgtgtctgtagacaggaaagaattaaaactatttagctacttctagttttctctccaatgcctgcctttggcagcatggttcatttagtgacttctgcatagttttgttgaactctccttgaagtgggcagattaccctttgaataacgttctatcccgttttagtatacagacaacataatgccttatttgaaatgtaattagacagtttagatgaaacataataatgaataaataagcactatggttccaaagacaggctgtattttatagttttcacaactataagtctttaaactgagaggtctgttttatcatgcacatttcctgttcattagctttaatgtgccaaacctttataaaaattcctctctctctctctctctctttctctctgtctctctctctctctctctgtgtgtgtgtgtgtgtgtgtgtgtgtgtgtgtcacctctcttcccttctcctctcctctcttctcctcttctcttctcttccattcacagggaactgttaagaggagacaagaagaagaccacttccagtttccagacatggctgatgggggctaccctaataaaattaagaggccttgccttgaagatgtcacccttgcaatgggcccaggtgctcatcctagtactgcttgtgcagaactgcaggtccctccattgacaataaatcctagccctgcggctatgggagtggctggccagtcattactgctggagaataaccctatgaatggcaacatcatgggctcaccatttgtagtaccacagactacagaagtgggactgaaagggcccactgttccttactatgagaaaatcaacagcgtgccggctgtagaccag

SEQ ID NO: 3936 - DNA, 149709 bp, human
atctgcaacagggctgggttccttggcggccgcctgagtccaggctgcccgcgccggcggccgcccgcccctcggacactgcccccgccgccgccggagctctgcagcacggtaaggctgagggcgggtgcaggaagtctgactgttctgggggttccggggtacacttgtagcccccagttatggtccccatcgctgaggatcggggtcccaggggtgcttcgagtcggtagaccctaaagtttgctctgagcacacggcccacctggcgctgcgggcggccacccccttctcgaaccagcccggctgggctgggcgcagctcgaaacgccggagaccacggcctttggctcggcgcccgtcgggcgtctgaaatccggcggggacagccacgtaccggggaggaaaggtagaagggcgcaagctcctcgggctacgctgggctactgggaggctcccactctgtcccagcacccccgggtcgcttgcagcctgggtgtcaccggcgacggtgccttcacatgccagctgcctgagcccaggccagtaggcagtgggcgctggatgaaggatttccccaccccaacgctgtttgccgcctctgagcgagagtgtggagtgtgcgcgccgaatccgctgccctgcactccctcccctgccaactcctgggaagcgcagcccggagctgagctggtgttcagggcagcccggactgggttcctgcggagcagccccggcgcccctgcgtcagagtccgcgcttcaggttccccagcatccgcgcgacgacagagctgggcgcccggcgccggctagcgcgggcgggaagccccccggagcgccgccaaatacttttctcggccagttggcttggccaggctccgtcccaatgcagtgtgtccgaagcctcctggaaagctggagatgtcgtctgattctgatccgtgattaaattcggactgagcagacactaataggattagcctgccagaaagctcggccctgaagccatcggaacctgtgcaaacacgcgcctcgggctggagcattcactcccgccccgccgcgcttctgcagctgggtgcggctgacctgggcacccggagtgtgggtgtgtgtgagcgggcgggagcacagcgtggctgggggacgtggggagaaggggctgcttttgctggggtggcttgtcgttgttgtttggcaccacggtgccccccgggggcgcggtccccacggtgaacgtgctgctcacgggtaggcaaacccaggccggctccgggacattgtctgcaagggcgagcgagccgagcttactagaggcggctgcgctggaacaaaggcgcaaagtctccctgagaccaagcaattttgaaagagttggctagggagagggcctgggtctcccggggtagacccccgcgggaattgcgccgcccccagcggccccggcccgcgcctggggaattgtgttccctggttgcggtgagccggcgagcgacatcgcagcggcgcggcccagctcttggcaggcgtgggttgccgcccgagtgcccaccggccgggcggggtcgaccgtgcacccgccggggcttcccggccgccaccgcagctctgggcccctggaggccgcgcagcttctttccttccctccctcccacctcttcttgtctttatagatcccccctccctcccacccccgccgccgccgccgccaacaatccgctttataaaaagcccctttgtttcccaggaggctggagagagggaaggggaaaagggacgcagaggcagagggcgggggcggctgtctccaagtggtttcgagccgctcgggacaggagggcaagtgtaggcgatgggggagggggctgtgtttcgaggaccctctgtgggaacccacgaaggcgcacggagcctcagccccggccctcgctgcacgcccggcctgccagccctggacaccctaaatcctggcggccgggacggccgagtggactgcactgcgagctggcgggcgcgcgcagaggccctaggctgcaagcgctccgcggggtgggcagacgcgactcgccgatgcgctcgccgggctcgggcatagggggcgccctttccttggtttcgctttgcagcgggcgcccctcgccgccggagctcagggcagctgtcgcgcccgccggtggctaagacggaggcggcagctcggaggcttaggccacccgcgtctggctacacgcctcatttcttcccgcgccctcctgccacaccctccgccccaccacacacaagggctcaaactctccgagcgccctttgtttggaggcgcggaggcagtgggagccgccacctccggggttcgtgtagcctaggcgggcagtgaggatgagcgtgctactctggactgcgcgctggcctgctgcctctgcacctaacccagcgcctgacactaaagctgccagctttagttagattgaccatttagcgggtccttgtcccttataactgcccccctaaaactttcgagaaccagggcttgcactgaggaatgtcaaatataatgttagaagtaacctttcgccattctgttggcctgctccgcccctgtgccccaaagtggtcggtgtctctcatagagtttgttcgggaagggaatactgaaaagaaaaaagtgacaaataaggaaagtgggcggggcccaggctcaggctggtgggtctcccaagcgaagtcagattccacccgctctctggccgcctccgcccctcctacttccatttaatctgatgtcgacgttttatttgtgcctttttgcatatctttctcctactcccctcccctcccatctctggaggttattgataagtgctgctcaaacatttgttttctgcgtctttggagtagaagatgaagcgttaacacccccaacgcgcatacacacatcccaaatgcgcgcatacacacatcccaactgcatctaaaaccacaagaaagtaatcaaagggtaaactactggttctgccttctcctccctcctttgtgcttctcttctggagcaagatcattggaaaataaagctgctgatgtgcgagatggaacatatggtgcctccataagagagaagctgaaatggccttgaacctgccggacagaccagctgtttgctgccagccagagcagctaatcagcttcttccccttaaagtaacagccctcttttcacttcatgaccagtttgcatattaaataggatattctccagaggggaaaagtgatgggctcctatactgctttgtgcttggtggttctccaatgcctgctccctgctctgggggccgccctgccctctcccggtgcctgcctgcgatgtgcgagtgtttctttcagtactgaagtaagaatgttgctcaaagtggaacttgggacagacgaggcaggaaaaaagaaagaaagaggtggggctgagagatttccagatgcctgggaggaaatctctctgttttgttcagcttcggaaaaaactagcattctttcccccctttccccctttaaaaatatcacaaagagctgaagcttttccttacaagatctccttaaaaatcatcctcttccggctgtgaccattttcagtttttcttcagtacaatgtgttggggtggggggtggggaagagtttggcgttggaagaagaaagcctttaggagatacaaggaaattccatgttaggaaatcattagcaaagggtgacttcgtctgttttcctgccactgacgctgacagtgacacagatgtgtgggttgaaataggaacgtcattgaatttttacactccaccaggaaataccctgtttctggggtgggggtggggtctacagattcactgcaacttaaggtaggagattcactactgtcaatcctttttactaaggaaagggatttttttagcttagccagcatgtttaatgtattttcttcccttttaaattgatcacctaaaggcataaaatgcacctgttaatggatggtccctaggaaactcaattactatttggggttatgaaagggaataaactggtcttagacaagtggctcttctgaaaatagctggactatgcctcttctttaaaggagcctcaatatacagtaaaacctttttttattattgcactttaagttctagggtacatgtgcacaacgtgcaggtttgttacatatgtatacatgtgccatgttggtgtgctgcacccattaactcgtcatttaacattaggtatatctcctaatgctgtccctccctcctccccccaccccacgacaggccccggtgtgtgatgttccccttcctgtgtccatgtgttctcattgttcaattcccacctatgagtgagaacatgcggtgtttggttttttgtccttgcgatagtttgctgagaatgatggtttctagcttcatccatgtccctacaaaggacatgaactcatccttttttatggctgcgtagtattccatggtgtatatgtgccacattttcttaagccagtctatcattgatggacatttgggttggttccaagtctttgctattgtgaatagtgccacaataaacatacgtgtgcatgtgtctttatagcagcatgatttataatcctttgggtatatacccagtaatgggatggctgggtcaaatggtatttctacttctagatccttgaggaattgccacactgtcttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgctggctgcgtaaatgtcttcttttgagaagtgtctgttcatatccttcgcccaatttttgatggggttgttttttttttttcttgtaaatttgtttgagttctttgtagattctgtatattagccctttgtcagatgagtagattgcaaaaattttctcccgttctgtaggttgcccgttcactctgatggtagtttcttttgctgtgcagaagctctttagtttaattagatcccatttgtcaattttggcttttgttgccattgcttttggtgttttagacatgaagtccttgcccatgcctatgtcctgaatggcattgcctaggttttcttctagggtttttatggttttaggtctcacatttaagtctttaatccatcttgaattaatttttgtataaggtataaggaagggatccagtttcagctttctacatatggctagccagttttcccagcatcttttattaaatagggaatcctttccccatttcttgtttttgtcaggtttgtcaaagatcagatggttgtagatgtgtggtattatttctgagggctctgttctgttccattggtctatatctctgctttggtaccagtaccatgctgttttggttactgtagccttgtagtatagtttgaagtcaggtagcatgatgcctccagctttgttcttttggcttaggattgtcttggcaatgcaggctcttttttggttccatatgaactttaaagtagttttttccaattctgtgaagaaagtcattggtagcttgatggggatggcattgaataaaccctttttttttaagattctgattttttttttttctgcaacagtgcattgcacagatcattagcctaggagctgggaaacttgtgttctagaaagttctgcccactaattaacagagtgatcttggacaagtccatcctttctctcccccaatcccatgacctctgagtctgagtcccttccagttctaaaacactatggtttgtgaatgaaatagtcattttctgggaaagtgaaacatcaagttcaaccttgtcattgggaaacagctagacagataataaaaaggggctgatattttgaagggcaaggataaaaaggaggagtaaaaaaatggcagaaggccaatcaaaacaatacaaaagtgtgaagtgttcacctttttgtgtcttttgcaagtgtgaacttctaacccagaatcagagacagcagacatcagaaatcaacccaaagtttctcttgtccagtactcctattgatggcaggcctcctaatcattgggttggtatacagataacgggatctaaactctttagagtagactggcatatttccaaaggactcatctaatgtagagcagatttgctgctttgcagttatttagtgaaggtttcaaagacaaaaaggccttccatccacacacacgtgcaccactggggtgtgggttctgaacccattgttgaaccttttcttttcttcctaatccagctgtttttttttttaatcacatttccaactttggggatacagcagccatgtaagaacctgctgctgtcctacttgatgttaatattgattttttaaaggggcaggggtgaacattatgaagaaggactctttatcctctgagttctttggcaattatcttgctgccataaatgttgatacacatataatggatgtaactaaaaaactccttatccaagcagaaaaggctgagtgtttgttggagcagatagaatgctgagagtgtgaatagaccaacccagatgtcactggggagggagataaatgatggaggaacaggagccggttactatggatcagcacaataaaccaattcccatcatacacctctcacaacgccaccgaggggtaacctaggcagcaccagtcaactgtatggcaggaaaaaagcattgcaaagctcaattggaactggcctggttttgtaggcattgggtccttaaacatcttcagtacttcgaggaggaaaatttcataaatccgaatgaacctgaagagactgtgttgcaaatacttattacttcttatttttgttgtgtcattgttgttctttagtctgtaaaggtgtcaaaggaagaagaaaaggccccatggagctgtcaggacagttagtcagggggttctccatggaggtaagaaacagtagcttgtgttataggatatttacatgccaagattggaggtgcatagtcctgtggggtcctgctcccaaattaccagcccagggctgctgaagccccaagagcattttcttccagaggtggagacagaagcaaaagagttgggttaccttatttccctgcctccacccccccagctctggttgctttctttctccccttcacagagcctccctggtttccttcaaacctcgagttttctcctaaaatctgacatctttataacatccaaagcaatcagatatgaaacagttcaaaaatattccccccgggggagggaatagcaaggggcctccctggctgtaggcactgagctcccagagtaaaggcttccagagacagggcctaaggagggtttgggagcaagaagcaaaaagctctttgcaaagtttaggagagctttccttgcccagattggctatcttgagcctccctgaggccccagcttcagactactccctcccttcctcggcctgcaagagggtgggctcttcatacccctggaggaggaccccccacccacccaccaaggcaactcagtcctgcccggctgccctctgacctggacacagccagtgcccctttctgcacagcccagttggagcctcccagacccccatttccttggtgggcaggtggggtaagctaccttaccctcccatgtgccctgctgcttgttctgccaagtaaataaccagtaagtggattttgggaaaggccattttcttaaggctgagaattgttccctgaggttcagagaaggatggagtggaccaggtgatatcatcttgttggaagagggcctagcaggccagccgttgattttttcccctttcttccacctgtgcgagtacctagacactagaccacagggacagttttctgctgattttggaagagatcattggaggccacagcacctgagctagttaatggcatccaggtcaaaaaggcctggtggccccagcttgtgttcacctgtgagaggaaagtgtgggtctttggagcataaagacaggaaaaaaacaaagtcaagtaattctgaacacattgaggaattccaagttcttggtccaattgtcccagctccaccctcaccccacaagtaatgcatttctattttttcctgcatttgaatccgaaattccactctcagcttcggcagcgtgctgtgacagagtggggaggaggaagacaggacccagctctgccttcctttctgtggctatgccagtcagttgaccattgcacctgtacatagttagcacaggtgcaccacctcacctgcaaactcagatgttgaaagatggagaatcttacagctggaagagtaaaaccccatgattttacagaagaggaaactgaggcccagagaagcgtctgactttcctatggggacatagtaaagggagcccaaagttgacagaaccctggtctctagttctcagtcaagtgtagaacatccattttgcacccatgtgtgagcagacaggctttccttttgaggcagagcaaatgtggtaaaaagaaatgcagccaatggagggggagcgcttgtaactgtggcgtaatataatctaccctgtatcaacgtgtgctttgctcagcattgttaggacagcaaaggggcatattagaatctgaactcgaagtctggaagtagctggagaatggagattgtaaattaagaattagaaggtagtgtgtgtctcgttttcgagttgctgtcagagagtcaggcagccagccctgtggagggcttggctgggtgggctcctctggcaatggtgggaggttgtttgggtttggctcttaatgagatctcagtgttaatatctgcctctggaagttccagcaccagcctcggaattttaagtgggacagtagttttggtgcagttgccaacgtcacatggtttgcgtgtctaattctgaaagactggcatgctttatgctaggcttcgggaggagggcacagcgtttctaagctgcttgtctgtcaaggattaatttaacctctaattactacattttcttcgcagtttgctgcacgaacatgttgtaacaaagctcaaagaagtatgccattttatttccctgccactctaaaattaatttccggaatacggagtcaaacctgacacacttggtgttaaaataattgtgctgacattcgagctaaagtgaacaatctggttgtttctagtgatcccccagccatggggtaaagagcattatcatgttagttgccatgacagttctcgaaatgagccctgaaaatatcaaggagtgtcactgcactaatcccaccaggggagcaccagacacaaaggtaacacccgagcacatggctggggtgttagttttggagtatgactgatgccctgtgcaatagggcagccagggagtcctttctcacccactaatagggctcgtggtgaggtcttgtcccacagcacgaggtgagcacattatcaaatcggaggctcccaagagcctgcccctggggccaaacctgttctgagtggctgtgacaatgaaatcacaagatgaagttaatggggattctccaggcaggcttttctccctcctcctgcctgctcttcctgggcgtcccgcaccagcaatccccaagagtaacagccctttggcagtcccacatatctcttttatccccaccttcccaaacagcagcagtggatcccagagtgggaggcccgttccccattctgggtgcttgagaagactgcattctcaggccctggttggggagacttagcagcattgttggttgcctagtttgggtccaccgaagctgatttgtgggatttgagagttggccaggttagccatttgagttctcatctccttgctcaggtggttgtgaagagctctctctctctctctcacacacacacacacacacaggtacacacacacagacacactcacacactcaccctctctcaggagtagaactttgccaagatagcaaaggctaggtctgaagccctattctgcatatggctggggacaggctcactggcattttcagccatgcctttggctgccaaatcccgagcaaatcgagtttaggttcagtacccctacattttccttaccggtttctagacttgcctcctgcttctcacaccccctctccaccttacctagaaagatgccatcctcagcccgctgtaccttagtgggattcccttcctctggagaatctggagcctctaacttgaattaaaagatgcaagagttaccatgccttggagagaatctgctgtttagggcacaggtaaggaggtattcagggcttagggaagccctctaatccacaccccaccctccaccccaccaaatggtaccatgcctggcataaagctggtcctatttatgagttagagaactgcctggttgccaaggtttttctgagcttgccctcagggaagctaaccccagttggtctcttgaacctcaaatcataacaaaaatgactccctatcctctgaagcaggagtggctgtttgcctcttagggatcacagacttctttgtgaatctgatgaaaactctgggtcttctccttagacaattgaaaaataacacgcaatgttgcatctaatttagggtactactaggccttaagcccactcatggttctctcgaggatcttttgtcacaggttaagaaagcctcaatatgagctttcggcaggagacattgaccaactgtgggattttaggcaagtctgtgaacctgccaagtctcagtgccctcagttgtcagatggaaatatcagaatgtcagttccaccaagtttggagcattgtgggagattcaaaagagacggtgttggtgagatggtcctgtaaatatcaggctcagggcacactcatgggttgctctctttagtgtcagtgtttactatttattttgcatttccatttgatgtgagaaatttaacaagagaaaatcaggcttcttttgacttgaaaagtcattttgtccctttctttgatactgcataagttacgcccaggcaaactggcattaaagagactctggcttgggagggacctcaaagagcatgcagtgtgtccaggatctagacagttttagagatcccaattacccagccctcggcagttccagaatgggtcaaggatgtgtgtagccagtccagtgccttgaggaggttccacatttgcctgctgcagaagtgagaaaatgggatctgaggaggcagatagttgtttggtttttcacatttcagtacggtcacaccgggcatgagaaggtaaagtggatcctgggtgtctctctcatagtcactgaaagggcctagccagaccctcatgaaaactgggaagtagtctcaccccaggatctgtccagggccccatcctgaggaagtggggtcgtgtccttttggagaggagcctcaggttgggcctgctggtgtgtggggggtctgcttaggagggaagaggatggctggactccattcaaataagacttccacaaccttccccgtctaaccctggaagtgtggaaagtcttctcatggcaaggccacgagggctcatatatcaaagatggggaaactgaggcccagagaggagcaggtgctggccctgggtctcatgacaagtcatgaagacatttccttggcccttgttgatcctgtgcaccttccaagttctctgtctggctcctcacaatagtgtattttcaattctcctagaaacacaagcccatcatcatattaacctggccctgatgaatgctcaggtcctcaaagtcagccctagaaagtaaatagcaggtttggaaagccctttgaaccctcagagggagatcctggccttgctcagcctgttgctatgcagttccaaagtggaggctgccacgcatttgcagagcttttaagtcccttcccccaccccatgtgcattttaggaaccttttggaaagaaatgtgttgctaggagcttgggctttccctctcctttagaaagagagaactgtttttgctttgaattgccttgcaaacagattgaggtgtctccctacccattctttcttttgttaaaccaacccgatttgccacgggtagttaagtggagatcatgttgaaaaagagtgcttagcacagggtcactacgcagagtggctcccattcccatccttggcagagcatctcacccttaatttcattattaatctggagggagaggaatcgtgcaagtcagttgaaagcagatgccacctaggaattttaggtccatcacgtcatcaaacaaaatgagagtagtttgtaaattggaaagtttggcagtgggtggttgccctttggaagattcactgtttcagaccagctttctgagtctgggaggagtccctggtgctacagtgggaagaatacccacctgagggccaccgacatgtggtctggcttcagctttgataccaactagccatggcacttggggcaagctatttcctcagactgggcatcattttctccatctgtacaatgaaggaatggtgtaggggcatccaaagggctcctccagctctggcatttctgaattctccagtagcaagttaaactctaagttacttaaaatatttgaaaaggataagtaataatttgttctttttgaaattaccagagacttgaaagcatggggttgtatttttgtttgggtaggtggggactgtgactgttacataagtgataacagttttagaagttttagctaaagacaaagttgacatgtatttatgtaggaccaaataatagaaaaaaattcctttagagaccccttgttttatgcttgaggatgctgcagctgaagaaaaatatcatgcttgcccaggcttccctggcaagctgctaggagctgaggtggtccaggacccaggaggcccagcttgcaacccactgcttgccccacaccgcacttcctaggatcttacagaagaagcctccaggccctcaactccaaatgggacctgcagtcagcagaatatagggctgagtgattctgatttctagctatcagatactagcttatcagaatggaatttttattctccacccctgcccccaacatccaagggttctctgttaacagtaaatatttaattttcttggttttgtaccaatgcctaatttaaaataaaacagattttttgaatattggggggtggtccttaggggcttgttatttggatttattttatttcaaacagatgggctgttttaggtttgacttcatatttgctaattttcattatggaaaaaaaaaaaaaacaatcccaagccaccccacccttatttttgtactgagtaacagtttgtcttgtctaaaagaagcttttattttctcaactgtttgcacccagcgtattcagccttattttgtatttttaatcacataaatgtgttggccacctatagcttatgggatgttcacaaaatgcgccccactcattcccgaacagccaccaactttgggactgtatctctcagctccagcccagctacctcttgtctagttcccagccatccactcctctggcctgaagccagactgtatggaggtgcagagtcagagaggccttggccttggagggaggcaccctggtgcctggcccagctctactgccttgctgtgtgaccttgggcaagtcccttcccctctctgggcctcacggttcccactgttacaaagaggaggctgacctaaaggggctttgtggaattttcctcttattatgttagattgttatatttggaagatgtgacttgaccagtacagtacatgacctttaaatcctttctagaagcaatatttagtgatgtttctgaaagagttaggaggtctatatctctgagatgaactagtactttctgaaatttatgaaaacaacagttaccactctttgaatacccactgtgcctggagactcttgtcctgctgtttcttagaaactcacccatcagctgtgagcattttctaatggtttcccctcaggcctttaatctttgatctcaataccttctccctaggagattaattgatcacttctaactctttttttaatttaatttttcacttgacataaattcagactctcagaatatttgcaagaataatacaaataatgtttaaatacctttcacttgattccccaaatgttaacattttaccacattctatgttatatctaccaccccctcacacacacacacacacacacacacacacacacacacacaattttattctgaactttatgagaacaaattgtaggtatgatgctcttttatctccaaatactgcattatatatttcctaacatttcctaaaacgttctcctgcataagcacatattgatcaaaatcaggaagctaatagtggtactaatctatctaaagactttaatctaaaggctttattcagattttgccaattgtcctaataatgtcctttatagcaaaagaaaatccaggatcatgcagtgcattcagtcgttttgtctctttagtgtcctttaatgttgaatggttcctcaatctgtcttagtgttttgtagcattgacatttctgaagagtacacgccagttattttgcataaagtccctcagtttgagtttgttgcctgatgtttcctcatagttagatcagggttatgtactattggcagaaataccacagaagtgatgttgtccatcagtgtatcatatcaggaggtccacgatgttagttccattcatcctattcctggtgattgtcactttgatcacttggttaaggtgatgtctgccagatatctccactgtccagttcctatttcttcccgttgcaattaatgagtatcttggggaaataaatatattttgaggctgttagtatcctagtacacctcaaactttcactcactagtttagcatttattgatggtctgtgcctggggcaagatggtcagtgcattatgctggttgccaaataatgaatttctgattccatcatccattctacatttattagttgactttctactataagaaagaacttttctttcactcccatttatttacttatgcttttatttatattaggttgacttgtgcatttttactttgagttataatcctttcctatcattatttattttgatgctcaaattgcctgaggtttgtcccgtgggaactccttcaaactagttcctatgtctttctgacatgcccctaatcatcctctgagcgcgcccttaatttctggcacatctgctccaggctcatcttgtgctttccctgccttagccttaatatcagccattttcccatggaatcttaacttcttttagtgaagaatggtatttaaaaactaagatctgggtactaaaagcatgcgcatttctacagatgtggcattgttactaaaccctctcagtccacaaagctaggaaaataattaactcacatctatatctattcctttttatttattattttggtaatatctatttctctatctatctatctacctgcctacctacttacccataaaccatgagttcacactgataacctccaaattccaatacaacagcaaagttcattctatcttcccccttcccatatttgtagtttccttgcaaaacagtgagaaatctctctgccattaccataatatatttactcacttaatcctagaatatatagaagctagtttcagagttgctaacccatgactctatgaagaagccaattgacaagagtacaatatttgttcagaattatttttgtcttttcgtaagagtgaatccttcaagcactgttaaaaagttacctgggctagttcatctcccgggccccactgaggtcatttgaatatggtttagttcacttgtttctgtttagattcctttttgtctgccccccacccctgaaccatctttctttgttaattttaattatttttctgtgagcatgtgaaataataacatagtttcaaaagttagaactgtacaaaaagaaatcctcagaaaagtgacatctcccattacttctgtcctttccacctcattccactcatttcctgtaagtaaccaacttcattagcttttctgtgtttccttttgcacaaatgaacagatatctgtgtattttcccataccccttccttacataagggtggcttaatagacatactcttttgagctttgcttgttcactcaaacgcatgtcccagaaatcactccatatagagatcttcttcattctttcattacagctgcatagtactgcattgtgtagatgtaccatagattattcaaccaacctcctatgtgtagccatttagattgtttccaatattttgcaattaaaaataaaacaaacaacccagtacatatgtattttcatattgttagaggtatatcttaaagagtacatttctataagtgggattaatgtgtcaaaatgtaaaaacaaatgtagttttgttaggtattgccaaattcccctccagaaagattgtaccaatttgcattcccattagcaatgtatgagagtgtttttttccccaaagcctcaccaacaaagtatttgctttactttttaatttttacaaatctgataggtgagaaatggtatctcagtgtagtttaattagcatttttctaattaggagtggcttggaacatcttttcatatgcttaagagcccttttgatatttttatgtgtgtgaattatctgttcatgtcttttctccctttttctattgggtttttagtcttttaccctcaattttaagagtatttttctgtgttaggtatattagctttttttatttgtgatatatgttgcaagtaatttcacttaattggtttgtggtttttttcaatgtttgttttgttttgccatgcaaaaaatttttttatgtcgtcaagtatcagtcttttcttttatcatatccggatttgaatcacagttagaaagcctttcctcacatccagtttaaagagaaattcaccaaattttcttccagtatttgtatggtttcatgttttacatttagattcctaatccatttggagtttattcttatgaatggtatatgggagggatcttactttacctctttccttttttctttttgtttctcttttttattcttttttagagacagggtgtcactctttcacccagtccggagtgcagtggcatagtcatagtcagtggtggggtggtgtgccacaaccacacttggctaaatttttttttttttaatgttttgtagagagtggatattgctatgttgctcaggctggtctcaaactcctgggcttaggcgttcctcctgtctcagccttccaaaatgctgggattataggcatgagccacagcacccatccccttcccttttttcaagagactacccagctatcgcagccccattttacaaatgttcatcttgctccagtgatttgaaaagtcaccattattatatattcagtctccacatatacttgggtctatttctacatgcatattttattccactggtcaatttgcctattcttcttccagtaccacactgttttaattatagaggctttattgtgatttttaacagccttttattttgagataattgtagagtcacatacagttttaggaaacaatactagaaagatcctatttacccttcacccagttcacagccaggacagtcacattgatacactccatccaccttattcagagtttaccagttatacatgcacttatttgtgtacatgtgtgagtatttaattcaaagcagttttatcaaatgtgtagagtcatgtgaccacagtcaagaaaaagaaatagtgccatcaccacaaggatatgcaatcctttgtgttgctgttttataccaaacccacttccctcctgatctgctctaccccaacttctgaacccatggcaactaaccagtaatctgttctccattcctatagttttgttatttcaagaatgttatgtaaattcaatcatatagcatgtgatctcttgagattggcttttttccctcagcataattctgatagtggtgtagtgcaatacaggagtagtccattctcacaggtgtgtagagatatctcattgtcatattaatttgcatttccctaacgcctaatgagattgaacatattttctggagtttatttttcatccatataacttcacggaatgtctgttcatgactttggcccattttctagttggattatttgcattttttctcttttttttcactgttgagttttgcaagttctttatatattctagatacttgtattttgtccaatatgtaatttgaaaatactttctctcagtctgtatcttatctttccctccttttaataggttctttcacaaaaagactattttgggggtcagatttttgtggttgagtctaagaactctaccccaagtcttaggtcctgaaaattttctctaatattttttaagtttgatggttacacatttaaggccataatcgattttgagttgatttttgtataaggtgtgaggtttaggttgatgtttattatttttttgcctatggatgctcaatggctctagtagcatttgttgaaaaggctatccccacctcactgaactgcttttacacctttgtcaaaaattcgtgggaaatatttttatgggtctatttctgggctccttattctgctccactgatctatgtgtctatccctctgccaataccacacagtcttgactaatgtagccatataaaaatgttaatactgggtaaaagtactcctcccattgtataattgtttctcaaaattgttttaacctaggacttgtgcctttccatatattttagaataaccttgtctacgtctacaaaaaactttgctgagattttgatgagaactgcattaaacctacaggtcaattcaagaattgacatctttactatgttgagtcttctaggcagtaaacatagtatgtctcctcttttatttaggtctttattcttttatgagcacaaaaaaggtgtttattattatttctatttgatgttcaactctttttttctgaattctttttattaaaattcaaaaatgtcaatattttcaagggaaatacaataagtgaaaatattttaaatatattcttataaatgtattcatacttgttgatgtagtataagactgcagcaatagagtacaaaatttgaaacacttcagattacaaatattttgtcccattttatttttttttttttttttttttttttttattttttttttttttgagacggagtctcgctctgtcgcccaggctggactgcagtggcgcgatctcggctcactgcaagctccgcctcccgggttcacgccattctcctgcctcagcctcccgagtagctgggactacaggcgcccgccaccacgcccggctaatttcttgtatttttagtagagacggggtttcaccgtgttagccaggatggtctcgatctcctgacctcgtgatccgcccgcctcggcctcccaaagtgctgggattacaggcgtgagccaccgcgcccggccctgtcccattttagagtagagttttaaaaaatcactattttcataaagaaaatatagagtttttttaaagagagaaaagaaattgcttataaatgtcagttgcaagtataatttattgtgattggaactactatcaagatttacttcgtatgtaaatttctttgataaattttatggattttaataggtcacaggaaatctcattgtgctcctctttgattttttatattttattttattttaagttccaggatacatgcacaggagtctttatttcttacaaaagcattttgtaactttctggatgcagatcctatacacattatattatattaaatatctaagtattgcattttctatgcagcagttgtaaatggtatgtgttctcttaacacagttttattgataccattcacataccaccgaattcacccatttaaaatattcagttcagtggcttttagtatattcatagttgtaccatcatcaccagtatctaatttcagaatattttagttaccctgaaaaggaaccacatatccattagcaaacatcctcaattaccccctgcccaagcccttagtaactattaatatgctttcggtctatatggatttacttattctaggtatttcctataaataaaaccataagataaatagccttttgtgactgacttctttcccttagcataatgttttcaagcttcatccatgttgtagcttgtattagtacttcattccttttctttgccaaataatattccacatattatttgtgatacaccatatgttgtttctccattcatcagttgatagaaatttgagctgttatcactttttgattcttatgaataatgctgttgttaacattcatgtacaagtttttgtgtggacatatgctttcatttctcttgggcatatacctaggaatggaatttttgcatcatatggtaactctatgtttagcattttgaggaactgccaaactgttccaaagtagttgtgccatttaacaatctcaccaacaatatataagagttccagtttctccacatccttgccaacacttgtaaatttctgtcttttttattatggctgttctagtgagcataaagtggtatttcattatgattgtgatttgcatttccctgttggctatgattttgagcatcttttcacgtgctttattggccatttgtatatcttctttggagaagtgtttatgcagagcctttgcccatttttatattggattatttgtctttctattgttgaactgtaagcattgtttatatattctgaattctagaccttcatcagatataagagttgcaaatatttgctcccattctgtgggtcatatttacacttccttgatggtattattcgcagcacaaaaattttaattttgatgaaagctaatttatttagtttttcttttctcacttgtgctttttgtatcatatctaagaaactatttcttaacccaaagtcaaagatatatttctatgtttcttccaagagttttatagttttagttcttacatttagatttatcttccattttgagtttttaaattttaaaatgtttagttaataaaaattgtgtatattcaaggtgtacatgattcgatatatgtatatattgtgtaatgattaccacaatcaaattaattaacacatccattacctctcataattaccatttttttgtgtatatatgtgtgtggtgaggacacttaaaatctgccctcttagcaagtttcaagggaacaatgcagtactactaactatagtcaccatgctgtacattagattcccagaacttattcatcttataactgaaggtttgcacactttcaccaagatcttcccatttcccccacctctaagacattaacaaccactattctactctctgcttctaggagttcagcattttaaatttctacatataagtgagaccatatattatttgtcttctttgtctggcttatttccacttcaggtcatgcaggttcatccatgttgttgaaaatggcaggatttcttctttatgcctgaacaatactacacacacacacacacacacacacacacacacacacagagtttatgcttgaacaacatagtggtttggggtaccaaccccctgcacaggcacaaatccacttataacttttgacttcccaaaaacttaactaccaatagcctactgttgcctggaagcctcaccaataacataaacaacacatatttcatatgttatatgtattatatactgtgttcttacaattaagtaagttagagaaaagaagaggttattaagtaaatcatatggaagagtaaacatatttactattcactaaatgaaatggaatcatcataaaggtcttcatccttattatcttcatattgagtagactgaggagaaggaggaagaggaagggttgctcttgctgtcttggggatgacagaggcagaagtgaaggaggtggaagaggaggcaggagaggcaggcccacccagtgcaaatttatggaaatacatcataatttctctctaactttttgcttttttatttctctaaaaaatgtttctatataataccaatccttcttccaccatttgctttagcttcaggtcctgtatcatagaagggttcatgctgtaaaggaagtcagaagctgtcttgagtaatcagaacccttctgttcaattgtctaatgtcaatttgtttcccagcactgcttcttttatgtctttgtcctcatggtccagcactagttaggaagcactcatctccataaagttgtcttctgttatttcctctggcatggtgtctattagctctataatttctccaagatccatatcttgaaatccttcaacacccatcttttttttttttgccatatccacaacctctttcatgatttccctgtttattgtcataaattctgtaaagtcatgcacaacatctggacacagttgctttttccagcagtaatttactgtttcaggcttgatggctttcacaggtttttctaaacaattatggcatattcaatagtgtaatccttccagactttcatgatgttctttctattgaggttctcttccaaaacattgacaatctttctatacagtaacctgtgtggtgagtcttagaagtccttatgaccccctgatctaaggctgaattagaattgtgtttgggggcaagtagaccacttcaacaccttcagtgttgaacccatggagttctgggtggccaggagcattgtccaatatcaaaagaactttaaaaggcagtctcttactgacaaggtacttcctgtcttcagggacaaaggatcgatggaaccaatccagaaaaaaatttttttattgtccaggccttcttgctgtgcaacaaaaagatcggcagctggtgtttatcttttcccttcaaggctcaggggttagcacctttatagataagggcagccctgatcatgaacctggactgcctttgcccgaaattgcaaagttagactatcccttcctgccttaaatcctggtgctcgcttctcttccttactactaaatgtcctttatgacatttttttttttccagtataaggcactttcatctgcattaaatcctgttcaggcagatatcctttcttatcaatgattttcttttttctttctttctttctgttttttggataacaaaggatctccaaattatattgaaaaataaatcataattaatattactcaaaaattttcagcatacttttcaaaaatgatttatgtaaaagagaagaaaatacacataattttaaaatatcttaaactcttttattccttactatagacattaattttgtcttttgttttctttcaattttctacaattttcaacttgtacctgtgtttaataggtaagacattaactgattgcttttctcaatctaaggattatatagttttagtataaatatatatcacatattttggtaaaattttgacaaaactgaataatcatgccttgttttaagtccatactccttccactgtttatcaaatctgatttaatggtcaaaaaattcttggttgtcattcttcttttacaagtcttcctgctaaactgccaaccagtttttacgtagtaataaaaagcagtaagaaagccaaagaaatggtgtctgggaacatctctgctacctcttagtcaacagaagctgcttctcctgttattttgatattttttaagccaaactgctttctaaaatttgtgaaaatacagtatttgtgggatgcgtatacagagggctgactttgctcacacataggttctgaagggctgactgtaggactgtagtatgtgtggattttgatatatgagtggggtcctggaaccaacccttcatgtataccaagggaggattgtaaaatattatctgtaaagtttctgtagatgcttgttatcaagttcaggatgttctcgtttgttcctagctttctgagattttttttattattataaatggatgttaaatttgctaaatgctttttctgcatcaactgttatgatcctgtgatttttcttttttaaactgttaatattgtggataacatggagtgtttccaaatggtgaaccagccttgcaatcccgagataaactccacttggtcatggtgtattattctttttatatattcctgaattttatttgtaaatcttttgctgatttttaaaatttaagttcataaaagatatttatttataattgtctttttctgtactgtctttgtcttgttttggtatcagagttataaaatgagttgggaattcttcctttctcttctactttctagaagacattatgtaaaagtggcactaattcttctttaaacatctgggaaaattctccagtgaaaccatctaggtatggatatttccttttcaagagtgtttaactacaaattcatttccttaaggtatatagggcaatttagattatatatttcatgttgtttaagttgtgacagttagctaataatttcttataaatttttgcatctatattcatgaggggttttggtctgtagttttcttttttgtactctttttgattttcatatcagggtaatactaacttcataaaatggattgggaagtaagtattccctgctcttctgtttttcagaagagaatgtgcagaattggtttggttttactttttcaatgtttaataaaattctccaatgaagccatctaggtctggagatttttggagggagttttacaattatgaattcaacttccttaacagtgatagtgctattcaaattgtttattttggtagtttgtgctgtgcaaggaattggtccattttatctaagttgtcaaatttctgtgtagagtttttggtaatattcccctatttttcttttgatttctgtcagatctgtgatattctctgcttcatttctgatagtagtgatttgtatcttctctcttttcaatcttgctagaggtcaattgtattgaccttttaaaaaaactagctttttgcttcattgattttctcttgcttttctattttcaaatccattgatttttatcttatctttattatttcttaccttctgctgctttgagtatattttgcacttcttagattcttgaagtataagcttacatgattgatttagcttacatattaatttgatacctttcgtttttcctaatgtacatatgcttttagtgctatacatttccctcccaactctgcgttagccatgtcccacatgtctttataactgctgttttcattttcattcatttcaatgcattttttttttgagacagaatctcactctgtcgcccaggctgaagtgcaatggcatgatctcggctcactgcaacctctgcctccagggttcaagtgattctcatgcttcagcctcctgagtagctgggattacaggcacacactgccacgcctgactaattttttgtacttttagtaaagatgggtttcgccatgttgcccaggctggtctcgaactcctgagctcaggcaatccgcccaccctggcctcccgaagtgctaggattacaggcgtgaaccactgtacccggcccatttcaatgcatttttaaattttcttggagacttcctctttgactgatggtttattacgaagtgtgttgtttaatttccaagtatttggcgattttcttgatttctttctgttattgatttctagtttgattccattgatcacattagagaatgctgtgatttcaattattttaaatttgttgaggtgtgttttagggcccaggatgtggcctatctcagtatatgttctatgaacacttgaaacaaatgcgtaatatgctgttgctggatggagtgttccataaatgtcatctagaacctttcagttgacgatgtattgttgagttcttcatctttgcagattctgtctagcagttgtatctgttgttgagagtggagtgctgaagtacccagctataattgtagatttgtccatttctccttttagctctctcagtttctacttcatgtgttttgagactccattgtttggtacatacacatctaggaccattatgttttcctagtgcattattattttatcattatgtaatgtctgcctgtctccaataattttctttgctctgaagtcttttttgatgataatgtagccactaatgcttttgtaaaattaatatttgcatggtatgttttctccattgttttactgtcaacttacctatgatgttgtatttagagtaatagaatagagtttggccatgttttcgtttgtttgtctgtttttgtttttgtttttttgagacaaatttgctgtgttaccaggctggagtgcagtggtgcaatcgttgctcactgtgtcctcaaactcctgggctcaagtgatcctcccacctcagtctcccaagtgtctgggactacagacatgcgccaccatgcctggttaattttcgtatgctttgtactctgccaacctctgtctttaattagtgttttagaccatataaataagaggtattgttcacatgttctggcttaagtctgctactttattatttgtttaccctttgcttcctctggttcttgtcctccatttgtttcttctttgtattctcatgctttacttaaatctattttaggattccatcttggtttatgttttatggtttttagcatattacattgtataattttcttagcatttactctagatattacagaatatgtattaatttatcatagtttacagtctacattttataagttcgagtgaagtgtggaaattttacttccatttaggtccttctacccttcctacttttaaaatgtaattatcttaaatatttcctctatacacattcagtatcaaataagatggcattataacttttgcttcattcatccaagatgatttaataaactcgtgagaaaaatagtttattatacttatcactatgtttgcctattctgaatttcttcttttctttatgtagtttcaagcctttttctgttatcatttcctgtctgtttgagaacttcctttaggcattcattaagggtgggattcttagcaacaacatcttttagtttttcttcatctgaaaatacctttatttccccttcattattgaaggatatttttgccagatacataatttggggttgacagttcttttctttcagcacttgaaaaatgtaccacttccttctgtactccatggttcctgaagaaaaatccactgtcatttgaattagtgttcctctttaagtaatgtgccattattctctgattgctcataagggtttttttctgcttcttttagttttcagaatgttaaatgcaatgtgccttggcatggatttctttgggtttattatgtttagatccctcagattctttaatctgtaggtttatgtttttcataaattttgaaaattttcagccattatttctttgactaatttttcttactctctccgctcttcctctctttctgggtttccaatgatagaaacgtttggatcttttgttattgcccacagatccctgagccccctcttcttcttcttcttttttttgttttgtattgttttgttttgttttctttagattactttctctttgttgttcaggttgggtgaattatactgatgtgtcctcaagctcattaactctatcttctttcatctttacactactaattaacccatccagtgagttattttatttttgttattgtatttttcagttctttaatatccatttgtttcttttttataatctcaatttctttgctgagattttctatttcattaatttgtttgaagtgtatttgtgattgctggttgagcatttttatgatgatttatttaacattcttgttaaataattctaatatctgaatcaccttggtgttgacatctgttgatcatctttactcattcattgttgtgattttcttggttctgggtatgattaatgattttattatcataccctagacaatttgcatattatattttgagactttggatggtattcaattttactttttagcgggcagtctttgtgttaaagtgtaatgtaagggccaggtggacatattgttcattttcttgctaggccccactaacaccactctggcaaaatagagcgctgactgacaaagccttattgctgataggtggagtggaagttcagcttaccctgggccctgctggggaaagtggggtactaaattgccctgccttgttgccactgagtaggatgtaagcccagcttcccaccagcccatgctagggaagagggaaatagagactgatccatattgcctttttgctgcaaggtgaaagagaaatctcaaatccctgctgggtccatctgataccaagttgaaagggaggaacaaaagtgcagtctagagctgcctattcttccttattcagtcttgttgctgctaggcaagggtatggaggttcagctccccactagtctttgctgataccagtgattgggtggaaaatggactgctggccatccctgacttgcaggactgagtaggggtggaagtaaaggtttccaatccacctcactaatacctgaggtgggggttacttggtaaagtctagtgctgatttagccccatctcgtaccacctcattaagtctgccaggtgggagtggagactcaactcccctcctgaccttccttacactaccctgatggggaagtggtagcatgcttgggcccctgacacctctgggcaggggaatcagaggaccgacatctgcttacatgagaattggggatggggtggagtggaatatcaacttcccactttgctaggctgaaaccacaggagagggatggtttttctgttggtgttgactaaagtagggtgggtaatttcagaaaggttttctgttatttaggccaccttttccacagtccttttactaggggaaaaggcttttcctggaggagttttttaattaaaaaaaaaatactttttttaacagcagctttaatattacagcaaaattaaaagaaagacagagttccaatatacctcttgccccttcatgtgcatagcctcccccctcccccattacctgcatcctgtatcagaataacacatttgctacaattgatgaacctacatggacacatcattgtcacccaaagtccatagtctacgttagggttcacttttgatgctgtacattctataagtttgaacaaatatatgatgacatgtatccatcattacaatacacagatcactttcattgccttaaaaatcctctgtgctctgcctatttatccctcccttccaatccctggcaaccactgatcttttactaccttcatagttttccttttccagaatgtcatatagtcagaatcatacggtatgtagccttttcagattggcatctttcacttagcaatatacatgtgaaattcctctgtgtcttttcatggctcaataactcatttatttttagtgctgaataatattccattgcctggatgtgtcacagtttatccattcacctactgaagaacatctgggttgcttccaagttttggcaattataaataaagctactataaatatccatgtgcaggcttttgtgctgacataggttttcaactcctttggataaatgtcaaggagcatgattgtcagatcatatggtaagagtatgtttcgttttgtaagaatgccaaactgttttccaagtgtctgtaccacttcgcattcccaccagcaatgaatgagagctcctactgctccacatcttcaccagtatttgttgttgccagttttccagattctaataggtgtgtagccgttatctcattgttgttttaatttgcatttccttaaagaaataagatgtggagcatcttctcacattcttatttgccatttgtgtatcttctttgatgagatgtctgttcaagcctttggcccattgtttaatcaggttgtttgttttcttatattgttgagttttaagagttctttgtctattttggacagcagtcccttatctgatgtgtcttttgtaaatgttttctcccactctatggcttgtcttttcattctctttgcagagctgaagttttccattttaatgaagtccaggttattaattctttctttcatggtttgtgccgttagtgttgtatctaaaagtcattgccacatccggggtgatttaagttttttcttatgttatgctccaggagttttataattttttcttttgcatttatgtctatgattcattttgagttaatttttgtgaggggtgtaaggtctatatctacatccttttttttttttttttttttttttttgcttatcaatgtccagttgttctagcactatttgttgaacagactatctttgctccattttactgcctttgctcctttgtcaaagaacagttgagtatattcctgtgggtctatttctgggttctccattctgctgcattgatctatttgtatattcttttaccagtagcacactgtcttgattattctatctttatagtaagtcttgaggtcaggtagtgtcagtcctttgactttgttcttctctgtcaatattttactaactattctggatcttttgcctctccacataaactttaaaataagtttgttggtgtccacaaaagaatgtgctggagtattgattgggattgcactgaatctatagatcaaattgggaaaaactggcatcttaacaatattgagtcttcctattcatgaacatggaatctctttccatttatttagttctttgattttttcatcagattttttgttttccttatatagatcttgtgcgtattttcttagatttatatgtaagtatttcattttgggggtgctgatataaacagtaatatggttttttttaattttaaattccacttgttattgctggtatgtaagaatgtgattgaccttgtgtcctgtaaccttgctataatgacttattggttccaatggttttgttgctgttgttgttgattctttcagattttctacatagaggatcatgtcatctgcaaacaaaggcagttttatttctgcgttcccaatgggtgtaccttttgtttcctttttttgtcttattgctttagctaagacttccagaacaatgttgaaaaggaatgatgagagtggacatacttgccttgttcccaatcttagtaggaaagcttctagtctcttaccattaagtatgatagtagcagtttttttttgtaaatattctttttcaagttgaggaagttctcaattctgagtttaatgagagtttttatcatgaatgggtgttggattttgttaaatggcttttctgcatctattgatatgatcatgtgatttttcctctatagcctgctgatgtgatggatgacgttaattggtttttaaatgtataatcagtcttgcatacctaggataaattccatttggtcatagtatataattgtttttatacattattggatttgactcatcagtatttcattgaacatttttccatctatgttcatgacagataggaatctgtagttttctttccttgtaatgtctttgtctggtttttgtattagggtgttgctggcctcattaaattgagttataacatattctctctgcttctattctctgcaagataatgtagagaatttgtgtcatttcttccttaagtgttatgtagaactcaccagtgaacccatccaggcctggcgccttctgtttggaaaggttattaactattgattcaatttctttaatagatacaggtttgttttgattgtatatttctgcttgtgtgaggtttggcagattgtgtctttcaagaaattggctcattttatctaggttatcaaactggtgagcctagggttgttcacagtattattttattatgctttgaatgtccatggggtctgtaatgatgtccccactttcatttataatattaataggtcatgttctctttttttccttagctttgtccagaggcttatcaactttattgatctttttaataaactagcttttggtttcaatgatttttctctattgatttcctgtttttaatttctgctctaatttgtattatatattttattctgcttacttagggtttaatgtgcttttttttttcttttttcttttttgagactgggtctcagtttttgcccaggctggagtgcaatggtgcgatcatagctcactgtaatctcaaacttgtgcactcaagcaatcctcccacctcagcctcctgagtagttgggactacaggcatgcaccaccatacctggctaattttttttttttttttttttttttttttgtggaggcttgtcttgctatgctgcccacactggtcttgaactcctgacctcaagtgatcttcccagctcaacctcccaaagtgatgggattacaggtgtgagccaccatgcctacctagcctcttcttttctaatatttacattcaaagctataaatttcttctttatcactgattttgctgcagtacacaaagtttgataagttgtgttttcattttcttcaaaatatattttcaacttctcctgagatttttgacccatgtgttatttagaaatgtgttgtttaatctccatgagttttggcgttttcccattatctttctattcttgatctctagtttaattccatcgtggtctgagagcagacattgtatgaattctgttcttctaaatttggaaaagtttattttatggcccagaatgagatccatcttggtgaatgttccatatgagcttaagaagtatgtgtatctactgttgtttggtaaatgtcagttatatccagtcgatggtgttggtgttgagctcagctacgtcctacctgtgtggggtttttatttctttgttttgttttttgttgtttttcttttgcctgtgcctgttgacagttccatgttggaagcttctgtagtgtcctgtccagaatatatgggagtcaatatggaaacctatggaactcattgctatgttatttcccaagtctaggactctaggttggtcaccttttctttctactttctagaggctttttatgcttttttattatgttatgcccagatttttgtttgtttctgtagtttgctttttaaaacactttaaattgtggtaaaatgcatatgacataaaatttactatcttaatcatttgcaagtgtatagttcagtattgttaagtatattcacattgtcgtgcaatgtctccaggtttgtttagttgtaaggagagagacatgggagaagtaaggctacttcatattggtcagaaccagaagtgacctatagtatgttttcctggctcttcttttatgttttatttttttccatatggaatttagtatcaaattgtctagcaaaattaaaaaacttgttggtattttaaaaattgagatttcatcttatatgtataaattgttaaacagaactgacatctttatgatgttgagtcctcctattcaagagcaaggtgtgtctttccattcattcatgtctacttttgcatctttcaggagtgttttagaatgtcctttgtagaggttttgtacactgcatgtcacgtttatttctaaggatgattttttttgtagataaggttttatttcctattgtgtattcccctttcatggttgtttgggaatatggaataaactagtgactttcaaatctggatcttagccctatcacctgagcccagacccagatttgtgacagttcatcccacctacccatttagctagtcctctcataccttcaactcaatgtgtgcaaaggtcaacttgtgttcttccctgatcactccaaccctcacttggacactcaccagacactgaatttatttctgactcatccctctacacccccttaccagctaattggtcattcagtcctaataattctctagcattctggaagctatggtcatgaaatctatgtgttagatggaaccatcaagtcatctatcataacctcatttctgatgcctaaattcactattcaacatccccattaagaagtttcatggcatatgcttggacatatatttccagggacaggtaacttactaccttatgaggcagcccattttatttctggccattttgatcatcacatacttttccatgtatatgtcagtcaaatccatccccttctttctaaaattatcaccccgtgcttgctcagcacccactccacccacagtgacccttctgcaacagttctgccaggttccagcacacacagactgaagggtaaaatttttcacctaatatccatcgcattttgtgatgctggccccagcctacatctaccacttcatggcttaccacagagagaggagaagaaggagaaggaggagaaggagaagaagaagaagaagaagaagaagaagaagaagaagaagaagaagaagaagaagaagaagaagaagaagaagaagaagaagaagaagaggaagaggaagaggaagaggaagaggaagaggaagaagaagaggaagaagaagaagaagaagacagggaacgaaggagcaaaaatacactagctttccaaaggtccatacgaacattagttgtggatattccttctttcctgctgtatcagtgggggttgcagggaactgggagcactggtattttcagtaggaaggctgtcagtgatagtaattaccctggggtactctcagtgtggactcaataatggatgctactaagcacttgacacaattgggatatagagatatacacactgctatcagaccaataactcaatataacaccaatgactataaatacaaagcagactatagattactacctcctccgtgaactctcataggacatttctatgtcctatgacatagaaggtacagagtgcttgcagccttatggtgtaattatttatagaaggttagttcctgtagggcagttcttttttatccatgtctgcatctcccactctgtcttcttcccttatcagaatctcatgcactctttagggtcccactcagatgtcacttctgctggaaatctttctctggtctctttagccagaagtcagtctacaaacacttccctaagcaccctctctgtgctaggtactgtgctaagcactgagtatgacatgctggtaaacctttggaactttccctggagaaagtgggaagccaccatattttcaagcaaggaagatggtcagagcagtgttgtggaaaggtttctctaccacagtatggaggacaaatgggaaagccaagactggaggcaggggaagccccctgggaggtggctgtggcaggagtccagggaagagatgatgaggataaaccggggcagtggaaggacacagacctggcagacggttgagaggcagaattaacagatggctattactccaaagacagatttgaatgatgtgtcactcatacagagatgcgggctggaatctgtgatagaaatattatcatcggcaactgtggatggtattcaacacaaggacttgaattgggctgtgagttgaattgtgtcccccaaaacaatacattgaaatcttaacccttagaacccgtgaatgtgagtttactgggaaataggatctttgcagatgtaatcaagttaagaagaggccattagggtaaaccttaatccaatatgactagtgtagttataaaaagagggaaatttggagacagagaaggacacagagacatacagggaagagaaagccatatgaagacagagggagagataggagtgatgcatctttaaggaacaccaagaactcttggaagccaccagaagctaggagagggcaatggggcatggaggcctcagagcctccagaaggaatcagccctgctaacatctggatttcagacttctggcttccagaactgtgaaagaatgaattgctgttgttttaagccccacagtttatggtcatttgttatggcagccccagcaaatgcatacaaatggtgcgaaagaacaattgagcaggctttcagaggctattgaggggctgatgaggagacattcattttgtaaaactctggcattggtggtactcaatcatcttatatttaggacccagcctgccctgttttcttgcagggaggttcgctcattagaataaaaagttgtcacatgctgttgtcagagaaacaagacggtggcctaagagatctacaaattcactctgctctagggctgaagtagctccctcttggtcacagactggaagggttcagcactcttttgtgcagaatggaagttccctggggaggtcagaactcagaacttccagaggaatgtacttcttgctctatctcagcatcccttatctcatctcttattgtgacagctacagagacttcaactaatttgagttatagtgagaggattttgatctagaaagtggagaaaaggcaaagatgttaaaagtcattgtggtttaaggagattttgggctgagacaatggggttttctagatatacaatcatatcgtctgcaaacagggacaatttgacttcctcttttcctaattgaataccctttatttccttctcctgcctcattgccctggccagaacttccaacactatgttgaataggagtggtgagagaaggcatccctgtcttgtgccagttttcaaagggaatgcttccagtatttgcccattcagtacgatattggctgtgggtttgtcatagatagctcttattattttgaaatacgtcccatcaatacctaatttattgagagtttttagcatgaagcgttgttgaattttgtcaaaggccttttctgcatctattgagataatcatgtggtttttgtctttggttctgtttatatgctggattacgtttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattatcttttttggttgtgtctctgcctggctttggtatcaggatgatgctggcctcataaaacgagttagggaggattccctctttttctattgattggaatagtttcagaaggaatggaaccagttcctccttgtacctctggtagaattcagctgtgaatccatctggtcctggactctttttggttggtaagctattgattattgccacaatttcagctcctgttattggtctattcagagattcaacttcttcctggtttagtcttgggagggtgtatgtgtcgaggagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacacattcaatgccatccccatcaagctaccaatgactttcttcacagaattggaaaaaactactttaaagttcatatggaaccaaaaaagagcctgcatcgccaagtcaatcctaagccaaaagaacaaagctggagacatcacagtacctgacttcaaactatactacaaggctacagtaaccaaaacagcatggtactggtaccaaaacggagatatagatcaatggaacagaacagagccctcagaaataatgctgcatatctacaactatctgatctttgacaaatctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacattagacctaaaaccataaaaaccctagaagaaaacctaggcattaccattcaggacaaaggcatggacaaggacttcatgtctaaaacaccaaaagtaatggcaacaaaagccaaaattgacaaatgggatctaattaaactaaagagcttctgcacagcaaaagaaactaccatcagagtgaacaggcaacctacaaaatgggagaaaagtttcacaacctactcatctgacaaagggctaatatccagaatctacaatgaactcaaacaaatttacaagaagaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacacttttacactgttgctgggactgtaaactcgttcaaccattgtggaagtcagtgtggcgattcctcagggatctagaactagaaataccgtttgacccagctatcccattactgggtatatacccaaaggactataaatcatgctgctataaagacacatgcacacatatgtttattgcggcattattcaaaatagcaaagacttggaaccaacccaaatgtccaacagtgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacactgcatattctcactcataggtgggaattgaacaatgagatcacatggacacaggaaggggaatatcacactctggggactgttgtggggtggggtaggggggagggatagcattgggagatatacctcatgctagatgacgagttagtgggtgcagcacaccagcatggcacatgtatacatatgtaactaacctgcacaatgtgaacatgtaccctaaaacttaaagtataataaaaaaaaagaaagaaagaaagaaaaaagactatgtgaggcaagaaaagatttgtgaagagttcacatttaagttgtcttccttaatacattccactctttagatggatttagaataataggaaaaaaaccgtagtgttgcgcttagagacttcatgtgaaatcccatctcatgtgaagaaaatgtgctttcattacttataatgatgaaataaattatctccattcttggaaccacttctttgcaaatattttagatattatttcacaaatgaaagaaaacagagaaggctgctaccaccagctttggagggaacaatttaattttcaagatatgtatctattgtgagttggcaacaatggctctggtttccaaagacagtgggaaaattgctgcgcatttcggaaatggttcccagacacttcccttcgaaaacgtaagcaaccaaacgcatacaagcaggcattaaagacaaatgcaattttataggcagccattctgttgcatggcatgataaatagacaagacgagtgttttgcagccagccagcttttggcttctaagagagctggaagggaaaactgacatgaacactttcaacaggctaccctggttgaaattaggaagagtttatttccacagttaaaacaatatgattctatttctattgcctgtgttacgtcgagttcccctatttatcaaacacaaagttccattgttgtgatctatggtgagcaaaggagaacctgccgagtcccaagcagatcttagatgtaaatcatttgatccgttgctcaaaactattctatcccataagcccaagagctcatatcagggtgaacaagacatttgaaaaaaaccaaaactctcctcctggagtcaacaggaaaacatgcccctggacaaagcttataactgttgaggccacatgtgcaatgtgctagttaactaggaggaggaagttccaggaaaacgaccaacatctggtttcaggcttattccattcttctcaggggcccccagtcaactgtgctcacctgaagagacatcttgagccagccagagagtaagcagctctagtttctcctgagcttgactttgtccattgtatttatttcttctgaactgatttctccaaaatcgaaatctgtagcacctccacaactttgatagccttttttgctccaattccttcaaggataaatatttaactccattttgggtcaaatacaaacttatatttctggggtttaaggattcacacagctagagcttgaaaggcatgttactttaacatgtttcagacccacagagctgtccagtggaatgtcatccactaccattcctcgactgtaagcatagttgattatcaattcagaaacactccgaataagcagttgtgtgccaagactttgcagttcattcatccaattagccatttgtttattcatctaatcaagctgcctatgtcatactgattccagtactcatccttcctctttttgcttatgcaaagcaagtatgagagaattgtagaaaaggtatagaaaagagacaaacttttcattctgtattgtattctgtattcaaagttaaggtacagtaaagtcctgttaacgatgtaaccttaatgcatctgaaaggtattgttttaatgacgcttaccttttaaatgatgaagatgcctctggcggtttatggaattcattttatattcgtttaagaaattgctttttatgagagagtatttctgctgagtttctcttgggcattggaagttagagggggtagcccacacatctgcgaaggtcaatagggtctttgctttccattaaaatgttttccaattctcacagcatttgtcaatatacccagaagaatcagaataaaatgaatccatggcttggtatccagtatgcagcagacatgctgcctgctgagtcttgcacaggtgttctctaaaaagcgctgaagttggaactgggagccctgggttcaagtctcagcccagggagatcattcactggctgcatgcatgcatgcagttataagcctcctcatcaccctggtgtctcaagagcctggatacctctacttgtctatatgactgatatgaactgagctccatgcttaagggttgtcaaaaagcagcaccttcaccctgatgcctacaggtcatagtttgtagagcagcctgagatgatggtactggattgctggcaggcccagctcactgctgaattataccaagatgactgcaattaacagtccctagtttttttctcaagccacatttcctccacactatacttcagcagataacccaaatgtagaacttgccatttatccctgttaaatttcccatgaccatcttgagctcgtcaagatctttttggatctcaatttcatgctacagagaactcatcaccttctggcactatctcaggggcaaatgtggtaagagtgaattctcaatcctcctccagatcattgagaaaaagtgaaggaagccgggaggcagccctgggacttgcctccaggtccctctctgtaagggagggtgttaatccattatccatggcctttagattcagtcttttaattggttacgcaatcacataactgggctgtaaatgaagattttacaacagatgctgcctagtgctttgctgaggttcaaaaacacttgcctgcttttctgtgatccacctgcctggtgagctcttccaacaaaaaaggtaagctattctaacacagcaagctactcctaatgagctcttttttgcttttgtcttaaacacactttgcgctggcttccttttctaagcactcactcactattcttttaatagtatgttcctgaatttttccaggggggccacatcaagcaaaccatagctacataagatattcagttaaaggaattttccttcggaaatttggaagtacatgcccatctagtagtttatggctcttttttttttttttttttttttttttttgcagttttctgtggttccttaatgctccatgataaaagctcacagtcttgttagcaagtgctctctctctctctccctcagcaccctagcatgtcgtttgccctggccatcgatgaccaggcagttctctcacaatcacttcctccatcacagacttcaaggccaactgaggagttctatcctttgtacattaaagatcattctcctattctatgaagaagcctgaaacttttctccaaagactctggtttctccttctgtggggtatgacagtctctttgctattcagggactccaggggtgtggtgtctctttatctcttttctctttcaggggtacattcttgtagctcctcccaccccttccccctttccccctgactctggttgtgattcatatagataggttgcattcatcaggtgctgctgcctctcctgaagaagctgctacctctcccctttcctcttcttggtgtgatgagccttcaactgtttgtttctttttagtggaacagggtttcttctcttctcccctgcctcgtgcttctctttgcattcctgattcagtcttttgttctcaaacagtgttcctgggtagcgtggaaagggagaagctgcacctccgtagcaaactcatcaatgtccaggcttatgaattgccctgggcccacagatttccagtgatggctgagcttccatcattgcatttccaaaacagcgaccatatgacacttacacagaagggaaggattcaagaaatactgtggaagagaagtcaagtaagggcaactgagtggtctgtaagcaaaaagacatctcagatgatctctcaagatccatgaataagtaggagcggtgatctgatcacccacagtaacaagaaatacagataccagcaagtgaacaccccaaaaatgtccaagtcaggtttgcaatgcctcaggtagctaaaggagagttgtgataggagtaaaattaatagtacttaccttaacttaaaagcaggccagacacagtggtctaggcatgtaatcccagccctttaggaggctgaggcaggcagatcacttgagcccaagggttccaagaccagcctgggcaacatagggaaatcccacctctacaaaaaatacacaaaaaacatattagctgggcatggtggtgggcgcctctagtcccagctatgtgggaggctgaggtgggaggatgacctgagcccaggaggtcgagtttgcactgagctgtgagtgtgccactgcactccagcctaaataacagcagaatgagaccctgtttcattaaaaaaaacaaacaaacaaaaaaacaaacaaaaactcgtaaggctgtttatggatggggcggggaagagagggcgaggaaataaagggtagccgtgaaatcaagttagtgggggaagttgtaacaactctgtaagggcttaaggcaaactccatcagtccacatggagtctatggggttgagcttgagatgccagtgagaagtatggctggaccagtggaagaactggcaagaagcacctaaaaggtttcagctggtggagagccagctaagatgtagagtccatcttgagggatgcaagaagggaaagagcctgatgatggagctgaagaggtagatttgcagggagtgcaggtggtttctccgtctgtgtcagtgcttgaagcttaggggaagcctggaggggtgggggtacaatgcaaggaagactggggagagcttcacatgttgttcccagttagttaggtatgagatttcagggagaactgaaatctttccctctcacactcctaattgttttgatgtgtttggatgtcaagtcacgagtctcagagccttcacattgttgtttgtagccaaaagtacaaaatagaatcccagtattgtcaacatgctgacacatggacttctctcttcttaataagtgtttgattatgtttccttctatgaaaatctgtatccccacacaaacaccattttagttttagaacattttgtgggggcactttaaatcattaacttttaaaaatatggttctcgatcatatggttttaattattaaatttttattccctaaatttgactaaaaatcatgtgatttgcacagcaaacaggccagttaaatgaagtgaattccattcactggcagcctgcctgctgttcctgtcaataagtaagtttagtttctgcttctggggctcacaactcctgacaggtggcttgctgggaccggggaagcaaggaaatcagccagagaaagtgtccttggcagcaaagggtctcactgggcaggtttttagggaaatcttgagattggggcaatgtgggatgtggtggcagcatcctagacatgacagacagcctctgagcaacctctggtcctacttgtacatatcccctctgttcattaaagcggcctcagctagagcttttccaggtggttggaggccaagaggcattgtgcataccaaaggctgaactggacttgctgctggcaagactgctccaaagcacagggagcagtggcaaagaactcatcaagcaaggcaacaatctatcatcctctgctaaacctgatgtcccagcttggaatccagagttggggtggggggccatcagtgctggcaaacttgtgggggacaggggctggtgtaattggagccagctccctggagcctcacaaccatcctgtgaagcaaatggggctgtggttcctatcccagaggaaagcactttggctgaggaaggggaacggagcactggtcaggcctggcgatacctagccagtacatggctgcctctgacttccttccagagtgaaggtgcttacccttagtagggaggaccctggcctggctggtatgcctccttggacttagcggggtctgggaatgcaggagaggctttagactctaagccaggggtgtccaattttttacttccctgggccacagtggaagaagaattgtcctgggccgtacataaaatacactaaaactaacaataactgatgagctaaaaaaatcaaaaaaaacttcataatgttttaacaaagtttacaaatttgtgttgggccgcatccaaagccatcctgggctccacacagcccaccggccatgggttggacaagcttgttctaagccatcctgacaggcagtgtagtcaggtggttcaagctgaactctggcacccagtggtctgtgtttgaatcttagctctgccactgatgagctgtgtggccttgcaggaagatattcaacctctctgtgtttatctatttcctcatctgtaaaagagagatgataataatagcatctgccttgtaaggatgtggtgaggatcaaaggcacatctgtaatatgcttagaacagttgttgacatgtggtaagccctaccgatgttagctagtggcactgtcttcctccaagcctccattccagtcctagcagagggaaacctggccactgtgatgatagctgctggatggagtgaaacattgtcatggtgcagaaaacaatgctgattgtttttctgtctgtctctcccctccaaaataggagactcatgctgaatgtccagtccgtagaagccagcctggcatgtggcaggtgcacaatgataaattaatgagtgagtgcaagaattcccccttgtggcaaatggctctggaaagaatgccaaccttaaaaaattactaacttcaatgcaaatgcagttgggtagcagagaacaaagggacctataaaggtgccagacattctactggggtagacttaagagctggcctaggagtcaagaggctggcttttgagaggctttactgcttcgttgctgtggggccttgagccagctcctgacttcttctgagcttcagtgtcctctctgaatgacaaacaatgtaaggtgggaccaaggtctgcgacctccagggagttcctttcctatcagggcccagaacaaacaagagatcaaggaacacacccagttcctaggcctgggctcactactatcaggttcaaggtcctgctcaatttctgacagcaatatccacataccatttctatgtcaattataggagccagtttctccagcttactttataaaatgttaattacttcccccacctccccacaaatgtgaaacttggatttaaaaagacattttggaaaacaggtacattttgacaggaacaatctgaaattgccacaggcataaacacatacaagtggatactgtttggtttgcttctgagagccccgtttagtggagagccggccgagccagtgactatctgaatgaagtataccagccatgccattatcagaggaaaggatgagtgtggactagtcaagtggctggatgctaattttatcacctttgctttcagaaaccagatcccattctggcagcaatggttcacatccctggctccttactgtctttaggtaatcataatattaatgtcccagtgcacccttaagccctttgcatctctcttcaaagcctttttcagacatgcaatacttatctggggtgaggggttgaacttcccactgagagaccagaactgatcagatgggcgggcctccaatcgcgagcttggctttaggcttgtagtcctcacttttctcaagtccagccacggcagcctgccaggcctgcctgccacaggcagccttattcaattgaatggggtcttaacaaggggaaaagccagagacatgaactggcgcatggagcacaatgatgctgactacccagcaaaggtaagcttgagacactctgaagcaccacactgactgtaaccacattgcataaaacccaacacaatccaagagaaatggaatcctcgtggggatagcattgggccaatagctcaacagccacccaaagtctccatggaacaactcaaggccagagcaaatttagtgacatgccttccctgttggagcacctgtatagcagccccgcagaagaggttgtctagtcccttccaggactcatgggagcccacgactctatagccattcttctccgccagattccacatcttcatagctttaagttttttcctttgccactccctatcttatttcctttctccattgtgtgttagcatacttaacagatggagaacagcatatacaagtggcttacaggactgtcaaggtagcagaggcacatttgaaaacagctcatgcaaccaaatgccaatgattgagcaaaccaccactcaggactgactcccccgcgttggccctgaaaatctagctactcagtgcttccatttgcagacataaacatccacttaggagttctgaaaacaccatctaagccaacatttggactcaagtaacaccaacagggctgcataatcagtaaactcacttttctgctctgtgcctttgcaacactctctgggaaagatgcagtagactcttacagataaaagttgacatggaggcaagttactaatatatagaaatgttggattttaagtaaagtatatttcactctgcagataaagggaacagagattctttttttcttatctcaaaacagactctttttgtagaattgatgaaatggaagtaattgtcaagaactgagagcattaatcaagaaaaagatgaaaaaaaaatggagagcaaattaaattaacttggaccacaaagaatatttaatgtttttgcccctgaaatccatttgatgtttcattttccccagatatagtacaggtggcctcaccatcattttgataagagcggcgccccagtcaccctctcccagtgatgcactgtgaagtgtttaacaaggggctctctaggaggaaaaaaaaaaagctctgattaaagtgatagcactgactgccgtgttgtaaatactcttgttgtggccgatttctagctaccaacatgatgtcacccaccttgcaaaattcctgaaaacataacagttggcttttgggagcccgtttgagataactctagcccaccactgtcccctcctctgcctgtatgtttcctatgctctccactctgggatcatagagccagcaaagagagaaatcacataagaataagacagattgttataatgatcaacacacacatgctaccttttggtttataaactctttccccaacattaattattgtggctaaactaacctctatgtgctaacagagtgccagaatgttttacaagcatttcatttaatcaataccaagaagtaggtactattagtatccccatttcacagaggagaaaactgatgttcaaacagattcagcaactcattcaaagtcacacagcttgtaagtgggtgagctaggactagaacctaagctccttggttgtgctttggcagtaagaagaaaacacagtatcagaaaaagtggtaaggacaacagtttggcttagctgaggaatcaggaaaaaaaaagcctaagtaatcaaataggtttcagtgtttctttagcaggtgatcttatcctaggattcaaggatagaattcagggagtctgtaaacttgaatgaggaaaaaattatatttctgttttcactaacctctaattgaaattcagcctttcttcaattatgcatgttggcaacaaaccacagtagtatttacataatctgtgactttgtcgccaagagaaatcatagatattttaatttcacattacagtcatagcaggaatcttcaaatatcactaccttgaaattacagtaattatgagacctactgctaggtcttatttaatgagttaagaagcacataaattaatatatcgcaaatttgttttgttaatatgttaataactattttgatcccattgttttattttatgcttttaaaaacatttatttattattattatttttttcctgagatggggtcattaagtttcaccagaaaatcgagggcatccatgaatctatagcctctctgcttcctcttcaggtataatgaaactttttatggccagttagagaggttctcctgagagctttatgtttgagttccggaatggctgggcccatatggacagaggacacagccgtcgcctgtaatagtcgatgggcactccaccatttttccccactgagagagtttgggagccatgagtcagtccttcctgggaaatggctgagaagaagctttcagagatgaaaatgaagtggagagcgcaaatgaaggaggggcaggggagaagctgagtcagaccctcgaccactcttctaggggtactgtctcatcctcttggggctgaatcataccagggtggctctgctcttctgcctctgcctgaatttcccttggtagggctccaggccttcatttgaggccaaaatgaagggccccaaacccagccaatgtgtgccaaagagaaattctagaacatgtgtgttactatcttgatggaaaaatatcaatggtgggggtcttccaaggactatgggacccacgtctgcttgacttgaccatcagggatcatgagcccagggacacctgtatttcaacagactaacaagctgaagctgcagcttgggatgtggggttacttggttttggtcatttctacctcacaatgaaggctctttgaggtgatggggtctggagcagtgtgcctttcctttctgacttgtacttttagattgcatctgtctgggaaagatttcctttcttttttttttcccagctcttccattacctgctatgtgatgggggtgaggcttttaccctttctgtgccttagtgtcctcctttgtaaaatggaggcaataatagcatctacccatcagatgctgcgagggttaaaaagagacactataaggtcctaagcaccatgttcaatccagagggagaactcagtaaagatcaactgttgtcatagttcttagcatgatgcgaaagacacacagcacatatgcctggccaagagggtaggctgaataaacgttcaagacctttctcttcctcctcatcccaccctctcaccccatcactttaaatccaaggatggtcagagtctgctctcaggagcagaggagctgaaaatggccacgctggggagggttggtgaccttagagtggaagtctcctgactccaggtctggcattctttttgctcccccactttgacagtcctcaggcaccttctgacacacctccagagcctcagaatgcccagcacaaaggcctctgtccagcagggggcctctgtaaggtgaggaattcgctgatattaagcctcgtctactccccactttgcctctctccaactgacctctaaagagatgataagaaaagagaagaagggctgtaaaaaacagtaagtgctcaaagcgtggaaaacatataacatcacaaccaccctctctttctagcttattccaagttataggccaagtatatcctgtcccattgcgatgggttcccagatccaggcaataacatggctgcacaggtgggctccaggatctggaagtgagtgcccagaaaaactgcccattcattcttcagggagttccaattccttaggcaggcaatcaggggctctgaacacttggctgtcccctcccttccttcatccacctgcagctgtcagccttcccctcaaaggacctagtttgactccttttgatggccccctattcccaatgcagccctattccccacatccagttttcccttcaccacttgaccctcctcccaatcatgtgtaataatatagcctccagaatcaggtcacaggttatttctggatccagcccaatgtctaatttgctgcagaacatgtgtgaaaaatcatgaacctctgccaactccatagagagccatggatttttaaacaattacaccagtgctggaatgtaatattgtacaactactttgaaagaaacaatttgggaatttctttaaaagttaaacgtacaccatataacccaagcattctactgctgggtatttgccaaagactaatgaaagtgtatgtccatacaaacacctgtatagctacgttgatagcagctgtatttgtagtcaccccaaaccagaaaacaatccaaatgcccatcaacaggtaaatagataaataaattgtggtataattcatataatagaatactattcagtaatttgtagaaaggaatgaatgatgaatatgcatgcaacaacctgaatgggtctcagtcattatgctgaatgaaagaaaccaggcataaaggattccctattctatggttgcatttatacaaaactctagaaaatgcaaactacagatcagtggttgcctgcagatgatggagaggggccagagggagggactacaaagggccacaaggaaactttggggactgatgaatatattcatcatcttgactggggtgatggtgtacacatatgcaaaactgatcaaattgtactttagatattttcagtttactgtacatcaattacacctcaacaaagctgtagaataatcaccccagcagctcatcttgcagttgttggtgacatccctgagcctcagaaaatgggaatgtgtgcaatgttttcatatataatgtactaacatgctttgttcattgctctgatggccctgtgctttcttagctttctgggtgagaatctccaatatattttcacttgtactttctgaagggctctcaggaagccacagcctagagagaagctgtttatgaaggaaattgttctttaaaataacaatcatttgtgatacctttagtagagatccaatgaatacagtggaccttgcctccttacccttcagtttttacctttttccattacagggtgcagttgatccattcagaagtaagatgtcctgtgaaatgttttgccatgtgggctgcctgtggtggctctcagaagggctgatctgccttgcccttcctaccttttcctccctccctcctttccttccttcctttccttccttcctttcctcccttccttcctcccttcttctttcttccttcctttcttctttctttcttcctttctttctttctttctttctttctttctttctttcttttctttctttctctgtctttctttctttttctttcttctttctttttctttcttctttctttcctttctttcttctttctttctttccttctctttctctctctctctctctctttctttctttcttcctttcttcctttctttctctcagtctgtcaccccaggctggagtgcagtggcactatcacaactcactgcaacctcagactcctcggttcaagcgatcctcctgcctctgcctcccaaagtgctgagactacaggcatgagccacagtgactggccttgctcatctttccatgttggcaaatgggagttaatgttggctcacttgggctgtctgtgctgcccactgcttagctgaaagtgagaagactgccctgccctccttagggccacaaatttgaccttcaatttccataaactgagtacaaaaatatgatttcaagcctgcaatgacttttttgttgaggtaaaatctacataacataaaattggccattttaatgtttacaattcagtgccatttagtacattcacactgctgtgcaactatactttctagctagttccaaaacatttatgtcaccccaaaagaaaactctctagtcactaccagtcactcatcatcccccacaccccacctcagtccctggcaactactaacttgttttttgttcttatgatttactgatttgccacattccatgtaaatggaatcatacagtatgtgacttcttgtgtctgggttcttaaactcagtatcatgttttggggattcctccatgatgtagcatggatcagtactttatttcctttgggggctgaatcatatttcagtgtatggaccacaatgacttttttttttattactatactttaagttttagggtacatgtgcacaatgtgcaggttagttacatatgtatacatgtgccgtgctggtgtgctgcaccagtaactcgtcatctagcattaggtatatctcccaatgccatccctccttcctccccccaccccacaacagtccccagagtgtgatgttccccttcctgtgtccatgtgttctcattgttcaattcccacctatgagtgagaacatacggtgtttggttttttgttcttgcgatagtttactgagaatgatgatttccagtttcatccatgtccctacaaaggacatgaactcatcattgtttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttattgtcctttgggcatatacccagtaatgggatggctgggtcaaatggtatttccagttctagatccctgaggaatctccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgctttttggctgcataaatgtcttcttttgagaagtgtctgttcatgtccttcgcccactttttgatggggttgtttgtttttttcttgtaaatttgtttgagttcattgtagattctggatattagcactttgtcagatgagtagtatctgaatgatgctggcctcataaaatgagttagggaggattccctctttttctattgattggaatagtttcagaaggaatggtaccagttcctccttgtacctctggtagaattcggctgtgaatccatctggtcctggactctttttggttggtaggctattgattattgccacaatttcagctcctgttattggtctattcagagattcaacttcttcctggtttactcttgggagagtgtatgtgtccaggaatttatccatttcttctagattttctagtttatttgcatagaggtgtttgtagtattctctgatggtagtttgtatttctgtgggatcggtggtgatatcccttttatcattttttattgcgtctatttgattcttctctcttttcttctttattagtcttgctagcggtctatcaattttgttgatcctttcagaaaaccagctcctggattcattaattttttgaagggtttttgtgtctctatttccttcagttctgctctgattttagttatttcttgccttctgctagcttttgaatgtgtttgctcttgcttttctagttcttttaattgtgatgttagggtgtcaattttggatctttcctgctttctgttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagacagtttgttataatttctgttcttttacatttgctgaggagagctttacttccaactatgtggtcaattttggaataggtgtggtgtggtgctgaaaagaatgtatattctgttgatttggggtggagagttctgtagatgtctattaggtccgcttggtgcagagctgagttcaattcctgggtatccttgttgactttctgtcttgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttcttgaattgatccctttaccattatgtaaccgccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtctttttattggagcatttagtccatttacatttaaagttaatattgttatgtttgaatttgatcctgtcattatgatgttagctggttattttgcttgttagttgatgcagtttcttcctagtctcgatggtctttacattttggcatgattttgcagcggctggtaccagttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttccaacttggttccattctccccatcactttcaggtacatcaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagctcagagtaatttgatcgtctaaagccttcttctctcagctcgtcaaagtcattctccatccagctttgttccgttgctggtgaggaactgcgttcctttggaggaggagaggtgctctgctttttagagtttccagtttttctgttctgttttttccacatctttgttgttttatctacttttggtctttgatgatggtgatgtacagatgggtttttggtgtggatgtactttctgtttgttagttttccttctaacagagaggaccctcagctacaggtctgttggagtaccctgccatgtgaggtgtcagtgtgcccctgctgggggtgcctcccagttaggctgctcgggggtcaggggtcagggacccacttgaggaggcagtctgcccgttctcagatctccagctgtgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagattcccggctgctttgtttacctaatcaagcctgggcaatggcgggcgcccctcccccagcctcgctgctgccttgcagtttgatctgactgctgtgctagcaatcagcgagactccgtgggcgtaggaccctctgagccaggtgcgggatataatctcgtggtgcgccgtgttttaagcccgtgggaaaagcacagtattcaggtgggagtgacccgattttccaggtgccgtcagtcacccctttctttgactcagaaagggaactccctgaccccttgcgcttcccaggtgaggcaatgcctcgccctgcttcgctcgcgcacggtgcacgcacccactgacctgcacccactgtctggcactccctagtgagatgaacccggtacctcagatggaaatggagaaatcacccgtcttctgcgtcgctcacgctgggagctgtagaccggagctgttcctattcagccatcttgccatttttcttctttctttctttaatggctattctggttcttctcttaactcactgctacttttggccacttgttaaacactctttctctccctacccaccttcttaggtagttttctctgttggacttaccaccagtataattggagacagaggctagacatgtatgcaaacctatagggacatcccctcaaaatgccgagtgacaactgcccacatctctttcttagctgtgagtttgttttctgacactttctttttagaacgtgttgggctctaagtttgctgaataatcttgagcattgtcccaattaatgattcagggcttcaattccccagattgctttgcttgaaatctgggggaagagggatgtctcactagtctttggtttaatgtggaaagaagggaccccaagctccacccaaccccactgggaatctggaggcggtctaagatctttccagcagccactgaagggaagtctgttcgtaccctcctctggctggggaattgtaatcggtggatgaccatagaggaaagctagtcaccaacacagggatgatgccagctggcaagcctcgtagagtcctcctggccaagctctttagtacattgaaagaaagtgcaactcagagaggtgaagctactcgtctgtcagcttgccagggagaggttgaaacctcagtgatgtcggcacttctttaaggagaggcggtcactggacagcctgggaggctgccttgcagatttatgaggcttctatccaggatctttcagaatgtggacccaaggaaatattacatagagcgtctgtctttaagtccggtctgctgggctcatgccctggcttgggattcagggaatctgacttctagagtcatctctcaccatcttttgctagcatatgttcctgggtgagtctcttcctcagtttccctatctgtacaagaaggggattggacctttttggtgtgtgtgacagagactcgctgtgtctcccaagctggagtgcaataatgtgatctgtgctcactgcaacctccacctcccggggttcaagcaattctcctgcctcagcctcccaaatagctgggattagaggtgagcaccaccatgcccagttaattttgtgtgtgtgtatttttagtagaaataggatttcaccatgttggccaggctggtctcgaactcctgacctcaagtgatccacccacctcggcctcacaaagtgctgggattacagacgtgagccactgggcctagcctggactttataatctctagttttccctcctgatattaacattctaggattctaaccaagctttgctataaaaaaggaggagaacaaaaagggattgctgtccttcagctcagttgctgtctccattgcctgcattgaaaaaaaagggctgcccttcccttgtgcctttagtgcacacagcaccaccctgtccaaggggctttctggttcaaggtctcatttgatccttatgtgcaccatgggaggggaggagagtaaagaggatcagccccattttgtagatcaggaacctgagactcaaagaggtcaaatgacctatggatggaagtggaactcaggtctcctggtcctcaaccccatgttcgtttcattatttctcctagaccgccagctaaaaatgctttgcaagcctttgttgggccagctggtatgactggcacctgggcccaagtgtaacatgtttgcaaactgtttctacactctgaggcaactgcctgctgaaattactacaaaaccaaacaatttccaacattttcctcctgcctagtgcaacatttccagttgttcctgtagggtaagtctagggacacattgtttttaaaatcatttccaggggggaaaaacattatactctgtgtgtgtgtgtgtgtgtgtgtgtgtgtgtgtgtgtgtgcacctttggggctacggttgagcagtccataagggcagaaaaggaaaagaccagctgctgcccctgtttcctttgctagtcagctgtagaacaaccggagtagcaatttgagaggaagatagaggaatctatgcctaccagtactgatggggataaccccaagcttaaagagggggcccttttcctccagggcttctagtgccatagtgctttccagaagagagagaaagagagagagagagagagagagagagtataccaactaatgagtggtatgttgtgtccctgcaatggacactggaacagcaccctccaacacacaccaactttggtggtcgactatggaaaagcttaagggaattaagcctgtaggcatttagctcatgagaaaactagcacggagatcacttgaattttcagtttggactgccactttaaatccaaggtatctttgaattctcaaagtgtatgatgtttatagcataggaaaagatgatgcttatagcataggaaaagatgatgctaaacaagttcaacttttctttttcaagaaataaggacttgaaaaaacttggactcacattactttgaaggctagttctgcagtcaatcatgtgacaagatgagcattgctattgttggtgtaagatagtcttgctctgccttcgtttcttgatgtccccaagttccagaaaactctgttctctgccataatgggaggtcactgtgtgctgtttgattttagagtcaaataagttttcagcacatggtcagcttgagagacagtttgccctcaattggcttattggtttgtacaattcttggctccttcaagcagggtcctgccatctgagcccactctgtgggattatgggatacctgtacttgccaggaagtcctggcctcaagctgattcatcactgggtagcacatgacgcccagatgagaggggggcatttttaacctcaatggcatgaaaatttcctgaaatcaaaaggacagagattgggagttcctggggagcagcagcagcagcaatgtcaaaagtaggatcaaccagagcttagaatattcctacaccaactttgcaagttgttcattgatatgtgggttgctggaagaaagtttccagcactgctgggtcagcatataaacaaggaaaaaagggtgtgttgatggcccatttcaaagggaaccagtcttgctaatggtagagggtataaacatttttctccttcaaaacttaaaagattttgttgtatcttttctctaaaagaaacatctttctaaaatgtcaaattagagcaaagagtgataacaatttggactagaaaaagcagcctcattaagatataattcatataccattcaattaatccattgaaagtttacaattcaatgtgttttagtgttttcacagagatgtgcaaccatcaccacaattaattcaagaacattttcatcaccctcaaaagaaaccctgtacccattagtagtcagtccacattctcccttccttcccctagccctaggcaaccactaagctactttcagcctctatggacttgcctattctggatatttcgcataaattgaatcatacaatatgtagttttctgtatctggcttctttcacttagcacgatgtttaaacggttcatccatgttataacatggatcagtacttcattcttttttatggatgataatattatactgtacagctagaccacattttacttatccacttacctgatgatagacatttgggttgtttctactttgggctactactatgagtagtgtttctatgaacattcctgttcaagattttgtacgaatctctgttttcaatcctcttgcgcatatatctaggagtggaattgtaggatcatatagctactctatgttagtttttcataacaacttcactgttttacattcccaccaacaatgtatgagggccccaatttctccacatcactttgagctttttaaagtcaacttttcaaagctaaaagtgatgttttagaatattgatatatctattagcacaaggctataattatatgcctcacagctcttgtatagtgtcaaaacagtcctttaaaattcacagaaatattaagcaatgtgttatgcattgctaagctcacttgtgctccagcacaccaagtcatccaggctctaggttgggtgatgccttcagagagttctagtccagccctccacccaagcttgaatccaccctgcagatccattcgggagatcattcccgagaccctactattctctgaacactctggggctacagccacataaaagacatgtttccttctctcacaagaatttacagtctagaggaggaatcaaatgctagacaaatacttcctgccaaggacctggggaacacagagggagcacctgtacagaaggctcttcctatgtaccttgtggggttgttggagcgagccagtgaaatgctctgtgtaaattgtcaagcccagtgtctggatcatagcaggcacccaaagatagctgttatattcctgtatagaactttgcattttacctatgaggaaactgagtcctaaagtttaaacagctttcccagagccctgtaactcatgactgagaagccaacctttctgtttcaggtcctgcttgttgggctccaaagccttggctatactgacatctaggaggccagccttattaaccttgccctgcctgtctccagactgggctcttctgcttctcccaggtctggtttcctggatcaaggcatcctactttattcatgtcctagcataacactaagattgttagtggtatacagtaactagtaacagttagctagtccctagtacagcagggtgatctgctctaattgcagccagaagtggtcatgactgatgacagtggcttgaggagtctattgctggtgcagcattctctgcctatcagcagccccacatttcttcccaacatccaggccggaagtctggaaagtaggaatggccttagcctcctggtctgtattcagctggccatcaagccatgcaaaatttccatgaagatgctgccttccgattgcttcttctccattcccatatggcccctgtaccacagttttgtctacagaagtttataagcatttgccatgagcaaagtattttgttgggttttctggttgagagccacctgagataaatgatccctggtttcaggctcatagggatagcagaataataagaatccagagctaggtgtcctctaaatgccaagagccaaggactgctctgggctcaggatctcaggatgttccagctcttattcatcataatgagagatgatcagtccctcaccacagaagactaagcaggcccagaagctcaaagtaaccagcaagtatggtctgctgtggaaatgggccagtctccactggcatcttcaccttgcctgcagaaacatttttatccccaatgtattagtttgctagggctgtcataacaaaatattaaaactagatgacttaagcatcagaattgattgtctcacagttctggaggcagaagtccaagatcaaggtgtgtcagcagggccacacttcctctgacagctctagggaaagacctgttctaggcctctttccttggcttgaggcagcagagctccaatctttacatagtgttctctctgtgtgcatgtttctgtgtccaaatttcccctttttatacagacaccaatcatattggattaagggcccaccctactccagtaagacttcatcttacctcattatatctgcaatggccctatttccaaataagatcacattatgaagtactgggagttagaatgacaacatattaatttggaggacataattcaatccataacatcaacatgcatgtttgaagatagacttgaattactctgccatcaacattatcttcacccaagtagatgtgttccattcttctgcaagctcatttgaaagcaggagttcttttggcttttcttttctttgagggccaaatttcacccttgaaaaatgatggctctaatattcaatgtcttctgccttaaccccaaatctgcccaatagtctggagactccaggtaggacatgatggcctcacctcagaacttttcttgggaatgcctgaaccacacctcaccctatccaggcaacagaggaagaagctattaggatgagggacagactcaggcatgtccagcaacttacctggagtcactaagagtacagctcagaaacaggcacagagcttgacttcacaatgcagctcacctttggacgttccaggctgaagcccaaagttgtttctgccccttagttcatttttcctctgatttggtgagggttgtgggactcagacacctttgagcttctaaagatttcagccttttggggttgctcaatcaatatccacatactcctcttcctttcttgccaggtgcctttgatttggttcctcatttacttcctgtcatgcctagagtcaggtggcagcaaggtagatctagctccaactggcactttgagatgggcattagggatccagcagggtccatggtctgggagctaaaggtcccagataagcaagaggtcgtagataatgtaaggaggggtaaaccagtgataactctggggttactggggtgccttcagagcccagcacagagggtctttgctctctttcatatcttcttctgggtatgggtggctaagggctcccaggtgtgtacttagagcctgatgtgggaaaagagactgcccacaggcctctgtttctgtgactaaggtgtgagtacagtactcactccactccacttcctgggtccacaagtaacaaagccatagagcaacacatgtccctggaacaaccatttacttgaggacgcaggcattttttcctatattaaagcaaacatggatgtaatataaaatcgaaagttgaagacccacagatttatttgactaaactccaaattgcatgtggcagatggctttggagttcctctttatccctggattgttcatgagtgagaaacattgctgaggatttggtttctttctatcagaggcataggcttcctgggcaggtgctcatgaacattgccatgggaagatggtacacagccaggcatttggatgcaaaaggtggcttactcctgctttggacagaaaggtctgcttaagggctatttcataggcttggattcatgtagagggaaagaagaaacaaagctgtgtccacaggctaatgtgctgaggttgtgagatacctttcaacttggaccaaagtcaatgtacaggcagtgatccctctccagtgtcccttccattggccctgcttcctgggtccagccagtacctgatgaagattgtggtggtgagggagtaggcagctactgcacaccagagaattgagcctttgtgtaggaagttttggccactacctcaccagtcccctttacattggctctgggtgtcacaaagggggaaggcataaaatcaatagagtggagtctttgaaagccaaagcagcattttaaaccttttttctttagggctgaatgggcagcttgcttgaagttgataggttttgtgttgccagtcctataatgagatctgagcttccatcctccagagaagctggagatgctgggcctatctggatgagggagttagtgatggcctcagcagtatcagaggcctcttttttttcttcttcatttgggtgcattgtatatcatgccattttatctttactgggatgtctctagaccctcacatttgtatgaggtcactcctgaggcctcaggcttggcccctgaagcacccaagaaatatttgggtgggaattggtttttttttaaataagaaagtctgtacaaacatcaaaagttgattgaaaaaaatagtgctatgtaggaaaggtcccaaaagcagtaagaagaattgatgtccccctgcatctggaccctgaagtccttttggaatagcagttagtttcttacttgggaaaaattagattcacaggaagttgcaaacacagtaaagaggcccccctgtaccttacatctagttttccccagtggttacaactcatataacaatagtgcaatatcaaaacttggaaattgatattgctacaggtttccgtataaaaattttaaaaatttataagaaccattttctattctaaaatataaatttttatatataaatttttgatataaactttcatgtctctgggataaatgcccaggagtacagttgctgagtcatatggaagttgcatgttgagttgtgtaagacactgtcaaactgatttccaccagcagtaaatgagtgatccagtttctccacttcctcaccagcatttgatgttgtcattgttttttagcttagccactctgttaagtaggtagtggtatctcattgtggttttaaattgcatttccctaatagctaatgatgttgaacgtctttgcatgtgtttacttgccatctgtatatcctcttcagtgaaattcagtgaaatgcctcttcatatcttttgcccattttcttttctttctttcttttctttttttttttttttttttttttttgacagtctcactcctttgcccaggctggagtgcagtggtgtgatcttggctcactgcaacctccacctcatgggttcaagcgattctcctgcctcatgagtagctggaattacaggtgcacaccaccacacccggctaatttttgtatttttaatagaaatggggtttcgccatgttggccaggctggtcttgaactcctgacctcaggtgatccactcaccttggcccccaaaatggcttctgcccgttttctaattggatggtttgtcttcttactgttaagttttgatattctttatacactctagatacaagtcctttgttaaacataaggtttgcaaatattttctcccagtctacagcttgacttttcattctattcacagggtctttcacagggtctttcacagagcgaaagattttatttttgatgaagtctagtttatgaatttttccttttatgggttatgcttttggtgtcacgtctaagaaagaactctttgcctagctctaaatccagaagattttctcctatttttcctaaaacttttatagttttatattttaaatttagctcagtgatcactttgagtgaatttttgtgtaaggtataaggtatagattgaagttcatgttttgcctatagatattccagaaccatgtgttgaaaaggctattattcctccactgaattgcttttgcacttttgtcaaaaatcagtttggcgtatctacgtgagtctatttctaggttctctgtccagttccaattatctgtctgtccctctgccattactgcacagtcttgattaatgtagccctataataagtctttaaatcaggtacactggttattcttctttttcacaattgtttcagcccctctacttcctttccataaaattttggaaaaatcttttttatatctacaaaaaatcttacttgaattttgataagaattggttaaacctggatgtctatttgggagaagtcaatgtctttactatgttgagttttccaatctatgaacatggtatattactccatttctttaattctttgatttctttcatcagtgttgtgtaattttcagtttatacgtcctgtacatgttttccttgatttacacgtaagtgttttttgagcaatagtatatggtattgtgttttcattccgatgtctgtgtgttcattgctagtatacaggaatgcaattaatttttatatgttgatcttgtatcctgagaatttgctgaactcatgtatgagttctagcagtttctctgtagatactttgagatttttcagatagacaatcatgtcaactgcaatcgttttacttcttcttcttccttgttttttttttctactttttaaaaaaaaattaggtcaaggggtacatgtgcgggtttgatatataggtaaattgcatgtcacaggggtctggtgtacaggttattttgccacccacgtaataagcatagtacctgataggtagttttttgattctcaccctcttccctccgtccaccctcaagtaggcctcagtgtctgtcgttcccctctttatgtccatatgtactcgatgtttacctctgacttgtaagtgagaacatgcagtttgtggacttttgttcttttcacttaggataatgtccaccagctccatccacatttatgcaaagggccaaaggacatgatctccttttttttttttacagctgcatggtatttcacagtgtatatatacaacattttctttatccagtctacttttgatgggcatttaggttgattccatgtatatgctattgtgaatagtgctgtgatgaacacatgcgtgtgtgtgtctttatggtagaatgatttatattcccttgggtatatacatgataatgggatggctgggtcaagtgttaattctgctttgagttctttgagaaatcactaaactgtttttgttctgtagatgtctattagttcagttagttatatattcccactagtagtgtataactatcccctttctccacaacctctgttttttttttatgttttagtaatagccattaaatgtctggggtgagatggtatctcattgtgatattgatttgcatttctctaatgattagtgatgttgagcattttctcatatgcttgtttgccacatgtatgacttcttttaaaaagtatctattcgtgtgctctgccactttttaatggggttatttttgcttgttgatttaagttccttatagattctagatattagacctttgttggatgcatagtttgagaatattttgtcccatttcgtaggttatctgttcacactgttgatagtttcttttgctgtgcagaagttccttagtttaaataggtcttatttgtcaatttttgggtttttttgcaattgcttttggcatctttgtcataaaatctttgccagagcctatatgcagaatgatatttcctaagttatcttccaggatttttatagtttgaagtattacatttaagtctttaaacctcctggagttgatttttctatatggtgtaaggaaggggtcaagtttcaatcttctgcatatggctagccacttatcccagcaccatgtactgaatatggagttctttcttcattacttgttgtcaactttgttgaagatcagatggttgtaagtgtgcaacattatttccgggctctctattatgtttcactggtctatgtgcctgttattgtaccagcatcatgctgttttgggtactgtagcattgtagtacagtttgaagtttggtaacatgatgcctccagctttgctctttttccttaggattgccttgactatttcagtttcttttaggttccatatgaattttatttttttttctaattctctgaagaatgtcattgttagtttgataggaataatattgaatctgtagattgtttcaggcagtatggccattttaacaatattgattctttctatccatcagcatggaatgtttttccatttgtttgtgtcatttctgatttatttgagcagttttttttagctcttgttctagagatctttcacctccttggttagccatattcccaggaatttttctctttttgtagctattgtgaatgggattacatccttaattggctctcagcttggatgttgttggtgtataggaatgctactgatttttgaacattgattttatattccgaaactttgctgaagttgtttatcagatcaggtaacttttaggcaagaatatggcattttctaggaatagaataatatcgtctgcaaatggataatttggtttcctctttccctatttggatgccctttatgtatttctcttgcctgattgctcctgataggacttccaatactatgttgaatagaagtggtgagagagagcatctttgtcttgtcccagttttcaaggggaatacttccagcttctgcccatttagtatgatgttggctgtaggcttatcatagatggctcttattattttgaagtatgtcccttcaatgcctagtttgttgagattttttaacatgaaaggatattgaattttattgaaagcctttttatatctattgagatgatcatgtgggttttgtttttagttctgtttatgggatgaatcacatttattgatttgcatatgttgaaccgaccttgcatcacaaggataaagcctacttgatcatgatgaattagctttttgatgtgctgccggattcagtttgctagtattttgttgaagatttttgtatctatattcatcaagaatattggccgtaagttttcttttttgttgtgtctctgccaggttttggtatcaggatgatgttggcctcacagaatgagttatagaggattctttcctccgcagttttttgaaatgatttcagaaggagtggtaccaggaattacacatctggtggaatttgactgtgaatccatctggtcctgggcttttttctggttggtaggatttttattactgattgtatttcagaactcattattggtctgttcagggattcaatttcttcctggttcaatcttgggaggttgtatgttatcagcaatttatccatttcttctaggtttactagcttttgtgcatagaggtgttggtgtagtctcaggggattttttgtatttctgttgggtcagtgataacatgccttttgtcattttttattatatttatttggatcctctctctttttttctttattaatctatctagtggtctatctgtcttattaattctctgaaataaccaacttctggatttttcaatcttttgtatgtttttcacatcttttccctcaattcagctttgattttggctatttcttgtcttctgctagttttggggctcatttgctcttgtttctctagttactctacatctcctgtagtggcgatgttaggttgttaatttaagatctttctaactttttgatgtggacacttagtgctatgaaattccctcttaacactggtttagctgtgtcccagggattctggtatgttgtatctttgttctccttagtttcaaataatttgttgatttctcccttaatttcattatttactcagaagtcattcaggaggacgttgtttaatttccatgtaatcatatgattttgagaaatttttagcattgatttctttttttattgcactgtgatccaggaatatggttggcatgatttcagtttttttgaatgtgctgaggattgttttatgtctgattgtgtggtggattttagagtatgtgccatttgcagatgagaggaatgtatattatgttgttttggggtggagagttctgtggatatctgttaggtccatttggtcaagttctgagttcaggtcctaaatatctttgttagttttctgcctcgatgatctgtctaatactgcctgtggagagttgaagtctcccactattattgtgtggttatctaagtctctttggaggtccctaagaacttgctttatgaatctgatgctcctgtgttgggtgcatatgtatttaggatagttaggtcttcttgttgaattgaggcctttaccattatataatgctcttcttgtcttttcttatctttgttggtttaaagtctgttttgtctgaaataagaatagcaacccctggccaggcacggtggctcacatctgtaatcccagcactttgggaggccaaggcgggtggatcatgaggtcaggagttcaagaccagcctagccaagatggtgaaaccccatctctactaaaaatacaaaaaattagctgggcatggtggcaggcacctgtaatcccagctactcgggaggctgaggcaaagaattgcttgaacctgggaggtggaggttgcaatgagttgaggttgtgccacttcactccagcctgggcaacagagcgagactctgtctcaaaaaaaataaaagaatagcaacccctgcttttttgtgttttttgtttgcttggtagatttttctctatcactttactttgagcctatgggtgtcgttgcatgtgatatgggtctcatgaagacagcataccattgggtctcacttctttactcaacttggcactctgtgcctttcaattggggcatgtagcctatttacattcaaggctagtattgatatgtgtgcatttgatcctgtcatcatgttgtttactggttattatacaggattttttgtgtggttgctttatagtgtcactggtctatgtacttaagagtgcttttgtaatgggtggtaacaacctttcctttccatatttagcactcccttcaggatctcttgtaaggcaagtctgctgttaatgaattcccttcacatttgctagtctgaaaaggatcttatttctccttcacttatgaagcttagtttggctataaataaaattattggttgtaaattattttctttaagaatgccgaatataggcccccaatcttttctagcatgtagggtttctgccgaatggtctgctgttagcctgatggggtttcctttgtaggtgacctgccccttttctttatctgcctttaacatgatttttttttttttcatttcgatcttggagaatgtgatgactgtgcatcttggggatggtcttcttgtgtagtattttcaggggttctctgtatttcctgaatttgaatgctggcctgtctaggtaggttggggaaattcttgtggacaatatcctgaaatatgttttccaaattgtttgctttctctccttctctttcagggatgccaatgagtcatagatgtgatctttttgtataatcctatatttctcagaggtattggtcattcttctttattgcttcctctttatttttgtctgagttatttcaaagagccagtcttcaagctctgagattctttcctgagcttggtcagtcctgctgttaatacattcagttgtatcctgaaattcattaagtgagtttttcaactctctcagatcagtttggctcttgcttaagatggccatttcgtctctcatttcctgtattgttttattgtattcctcagaatccttggattgagttttgactttttcctgaatcttgatgatcatcatttctatccatattctgaattctatttctgtcatttcagccatttcagccatttcagcctggtaaagaaccattatggggaagtagtgtggtcacttggaggtaacaagacactctggctttttgagttgccagagttcttggcctggttctttctcatctttgtgggctgaaattctttcagtctttgaagttgcattcctttgcatgttttttttttcttttttgatgtccttgggggtttgattgtgatataaggtgagttcagttggctggttttgtttctgggagattttagtggggcaaagctcagctcaggacttctgggctgtgtgttctaactctgaggggctggtatcaagtcctcagttttgttctctggcccttcaaggttagaaacctgctgtgctgaaggggctgaggtgttcctggactgctggtcacaacactgcaatggatggtgccagccaaagcactccatcggacagtagcagcaggatccatgctcattcacatgtgccagcagcagtagcagaacggcagggtgcactttctttggttggggtgggtgccggtaggtgcaggggttgccagcctccatgcagatgttcacagtgtcagcgatggcaatgtggcatggaggcagctacttcttcttttttaaaatgtgtgcattttatttcattttcttgccttattggactagctagagcttccggtattatgttgaatatcagtgtcaagagcagatagccttgccttgttgccactcttagaaggaaagcagtcagtctttaaccatgaagtgtgatgttaactgtagatttactgtaaatattctttatcaagttaaggacattcccctctgtgcctggtttttatcatgaatgagtgttgaattttgttgaaggctttttctgcatcacataataggatactatgattttaattatttttttgagatgatgtagattcaaatgaagttgtaagaactaatacagatagatgctatgtactcttcagccatattcccctaatgataacatctggtgaaatgatcatacaatatcacaaatgggatattgacattgacacagtcaaaatacagaacatttcaatcaccatgggtagctctcattttgctcacatatagacatatctacttcccttccatacccactctctccttaatctctggaaaccactaatcagttctccatttctatagttttgttattttaagaatgttacataaatagaataatatagtatggaacctttggggatggtcttttttttttcacttacaatcattctctacagattcatccaggccgttgcttgtatcaactgtgtatttctttgtatcgctgagtagtcttccatagtatacatgtaccatcattgaagcattactgagttgtttccagttttttactattatgaatagtgctaccacaaacacttatgtgcaagttttgtgtcaacacaagtctttattcctctgggataaatgcccaggagtgcaattactgggtcatatagttgctggatatttagtttttaaggaaactgccaaactgttttccaatgtggcaataccattttacattcccaccagcaatgttatgagtgattcagtttctccacattcttaccagcatttggtgttgtcactatatttttacaaagatgaaattcacataacaatctgtgatatttagtacattcacaatgttatgcaaccatcacctctatctaatttctaaacatttgcatcaccataaaataaaacctcatactcattcggcagttagtcctcattcttcccctcccctcagttcgtggcaaccaccaatctgctttctgtctctatggatttacctattccagacattttatgaagatggaatcatacagtatgtaacctattatgattggcttctttcagttagcttaatgttttcaaggttcattcatgtttcagcatgttatcagtacttcgttccctttatggctgaataatattccactgtgtggatataccaaaattttgtttatctgtttattaattgatgtacattcggtatgtttccacttttggtgctgctaagaacatttgtgcaaaagtatttgtttgagtccttattttcaattcctttgggtatataccgaggagtggaattgtggggtcaaatggtaattctatgtttaactttttgagagaccgccaaactgtttttgatagcaggtgcaacattttaaattcccaccagcaatgtatgagggttccaatttcttcaccttctcaccaacacttgttattttcttcttttttaattatagccattctagtgggtgggaagtggtatgctgtggtttcggttgtcatttttctgatgactaataatgttgaacatcattacatatgcttgttggccatttatatatcttctttgggaataaatctatttaagtcctttgcctgttttttattgtgttgtcttttttattgttgcattttaggtgttatgtgtatattctagagactaggttttaattagccatatgatttgcaaatgttttctcccattccgtaggtcttttcattttcttgataacgtcctttgatgcccaaaagtttttatgaagtccaatttatctattttgttgttgttgttcatgttcttagggtcataaagttccattgcgaaattcaaggtcatgaagatttacttctatgttttcttttaagagttttacagttttaactcctatgtttaggttgttgatcagttttgagctgaattttgtatatgatataaggtaggagtccaacttcattcttttctctgtggatatccagttgtcacactaccatttgttgaagactaatctttgcctcattgagtggtgttggcaccctggttgaaaatcaattggccatagattaatgggtttaggggccaggcatggtggctcacgcctgtaatcccagcactttgggaggctgaggctagcgaatcacttgaggtcaggagttccagaccaacctggccaatgtggcaaaacaccgtctctaccaaaaatacaaaaattagccgggcatggtgtagtctcagctacctgggtgcctgtaatcccagctccccaggaagctgaggcaggagaatcgcttgacctgggaggtggaggttgcagtgagcctagatcgaaccactgctctccagcctgggagacagagcaagactctgtcttaaaaaaaaaaaatggatttatttctgaattctcaagcctatttcattggtctatatgtctatacttataccagtgctacattgttttgattactattgctttgtggtaagtcttaaaatcaggacgtgagtcttcttgtttttcaataatgttttgaggtgatcacatgatttttagtctttgcctgttaacatagcatattatggtaatatggtggtatgtatgattaacatggattgacttttgcatattgaactacccttgcacaccaagaataaactcaacttgatcatggtatataaaacttttttataaattgctgaaactttcttaaggatttttgtgtctatattcatgggaaatattggtctgcagggttttttttttttcttgcttgtacagtgtttgtctttgctgtcaaggtaatacaatgagttgggaggtgtttcctcttctcttttctgtaggatattatgtagaattggtgctaattcttctttaaacaactaatataattctttagtgaggtcatctgggcttaaagttttcatttcagatttttaaattatgaatttgatttctttcataattatatagccattcagattatttcatattgggtaaattttggcagtttgtgcttttataatgattggtccattttatctaagtttccaaatttatatgtgtattcatagtagtagtcccttattatccttttcatgtctgcagtctatagtaacatctcccttttcaatcagagtattggtaatttgcatcttccctttttcctttgtcagtcttgctagagattggtacattttattaattttatgaaagaactagatttgtattgggtttctctattgtttttctctctttaatattattattaatattaaattattatttatttaataattaataatatttaatatttaatataatatttattaaatttaaaatattatttattaaatataatattattatttattattaaaataatttaataaaaattattaaatataaaataatataatataatatttaatataaatattaatatttaataatttaataattaataataataaaaatattattaatattacgtttattgatacaaatatttgtacatcttcatgcggtacatatgatattttgttaaatgcatagactgtgaaagtatcaagttagggtacttggggtgtccattatcgctaatatttatcatttctatgtgttgggaacattgcaagtcctctctcctagctatttagaaatatacaatacattgttgttagctatggtcaccatatactctgctatcaaactgtcttcagtattattgatttttattattattttcttccttctgcttgctttgggtttattttattcttattcttgtaggttccttaagtggaagcttatattattaattttagattttccctcatttctaacacaaaaatttagttttatacattatcatctcagcacagctttacctgtgtcccacaaattttgatacattgtattttcactttaattcagttcaatgtaatttttatttcttttaagacctcgttaacccatgaatttgtttcaaagtatgctttttaatttctaagtgtttgtagattttcaagttgtctctctgttattgttttccaatttgattccatcatagagaaaacatcatttattatttgaattcttttaatattttgtggattgttttatcaccaaaaatatgtctatattggtatatatttcttgggtgtttgaagtaatgtaaattatattcttttcaggtggagcaatctatacattttatttaggccttattgaaacctgttgttgggctcttatacatcttgctgattttctgtgtagttgttctatcagttgttgagagagggtgttgaagtccccatctataaaggtgaatttttctatttctccgttcagttctaaaaacgtttgcttcctatatttgcaggtcttctgtttaaagcatacacatttaaaagtactatgtcttgttggtggattgacactttcagcattatgtaatgtccctatctgtcgctggtatttttttttttttttgctctgaagtctactttatctaatatcactagagccacctctgttactttttaaaattaatatttgcatggtgtatctttttccattattttactttcagcctttctaaatcattatatctgaggtgagcatcttgcaacagcatatcattggatcatgttatcttctttgccaatctctgtcttttaattggtatgtttagaccattttcatttattgtatttattgataaattagtgcttagttctgccaatttatttttgttttctgtttgttctctggttttttgtttttctattttcttttttctgacttcctgtgggttactcaaacaatgtttagaattccatttggttcatgtatagcatttttgaatctatctttttgtatagcatttttagggatcactctaggtattacattatatatatgcataacataataatctactggtgtcaacattttgccagtttcagtgaagtatagaaaccctacctctcctttcacccctttactttcctctatttataatgtaattgtgttaaatattccttccacatacatttacagacacatcagacaatgttataatcgatgatttaaccttcaaacataatttggaaaactcaagaggagaaggaaagtccattatatttacccataattttttctctttccattggtctttattcccttctaatgttcaatatcctttcttttatcatttcctttctgcttagagaattttctttagatattctctttgtagaggcatattgttgactaattttgttagtgtctcttgatctgagaatgtcttgatctccctttcatatctgaagcatattttcactgagtatagggttctgggttgacagttctctttattcagcatttgaaaaatattatgctacttccttctggaatccatggtttatgaacaaaaattcactctcattcaagttatttttcttctataggtatcatttctctttcactgtattcaaggcttttctcttcatgtttcagaagttttgttgttacaggtcttggagtggatttctttatatttatactgtttgaggttcactcagcttcttaaatttccagatgtatgtcttttgtcaaatttggggagttttcagcaattatgtctttgaatacttttttttttttttttttggtctcattctctttctcatctccttctggaattccagtgacatgaaagttagatcttttgtttgtaattctgtatgtccctgagtctatgtttacttttttttccaggatatcttctctctgttgttcagattgatcatttctttttattttattttattttattttattttattattattatactttaagttttagggtacatgtgcacaatgtgcaggttagttacatatgtatacatgtgccatgctggtgtgctgcacccattaactcgtcatttagcattaggtatatctcctaatgctatccctcctccctcccccctccccccaccccacaacagtccccagagtgtgatgtttctattgttctatcttaattctttcctctgttcttaccattatcctcttgatttgattcactgaatttatttccattattgtatttttcatttctaaaatttccatttggttcttttttatatgttctgtttctctgctgagaattctgattactttgctgagactttctatatttttttcatttgcttccaagcatggttgtaattgttggttgaagcactttaatgattacttctttaaaatccttgtcaggcagttctgacatctgtgtcatcttgctgttggcatctgccgataatattttccattccatttgatatcttactggttcttggtctgacaagtgctttgctactgaaacttgggcattttggatattgcattataagactggatcttatttaaattttctgttttagctgacttcctctgacactgctctggcagggaaggcgggcaccatcttattcttcattgacatcagggaggatggagctcctcattactgctggacaggggtgaggattccaactccctactaggcttttactgatactactctagtgcggatagggaagggcacctcattactgctatgtgggggtggagtctaggctcctcatttggcttttgttgatggaatataatgggactgcattttcttctatggtgtttggctggagtagagcagttattgtctaaaagttttctgtcttgctaggttacctctttcctggtcttttggctagaaagagcaggcttttgttggggcttctttgttagtgcccattggcattctgggtttctggcttcttcagctccaagtctggtatatatgaggcagaaacaaaatccagagaactcgccactgcatcattgctcaggtcccaaggtccctaaccagtatacttttttctttccaccttttaatgtcttattatgtttgttttatatataatgcccagaggttttagtgatactcagtgagagaatggggaaaagtacttctccatatttccagaggcagaggtttagacttgagattttagaggctgatgctgtactgccaaggaggtttatgggaagtagagctgtccttatatattaatgtcttagtggagctcttatttcatgtctacatcatgaaaaacaaaaagaaatgaaactttacctgggtttgcatatgtctgcttatctgtcactggaggagtagccatgatcataacctgctcagtcagtttcctttacatcagtgcaccagggtttcatgagccccctttcaatatctgttgctcccttcctgtgtctgtcaggctttgaactgttagctcacttggctgtatcctaacagtgccacagtgggtgtctgcttcttctatgaaccataaagcttactctagtagagctgagaaggccctaagccatcacctaattgagccaccatgtttgcatataaggaaattgcatctcagagaacagaggaagttttcctgaatctcactgcatatcacacaaaagcaaatccagacgtaggacccagatatcatacttgtaggcccagtgttattttagtcacatgaagctgctcctccatccacccctctaccttccagtgaactttgtcctttcctctggtcaaggactgtcattttatcccagccaactgtctcacaaaaatgcccctcattcttgggggtgggggtgctcaatgagggtggtgggtgggaggaagggaaaaggaatgtggttgactccacacaaacctgtcttcagagtgaaagtctgtgattcacggggtcagtggtctcatcttcatatctgaaagacagtgtactttttgtctccctaagccctgtgtctaggtcgtttgggaaacgccttggagagtcaagaataaatttgcaggtcaaacaatggatgactggaaaagtcggcttgtaatcaagagcatgcttccccatttcgccatggtgggaaatcgtcaggagcccagaaagctccaggaatcggtcagacaatgggccatggggggaggggggtatttaatgcttctaatcttaaacttgaacgtaagatgtgttattgaaattttctgtgcaaacttggtggcagggatccaactcaaaatataaggaattcaaatgtgatctagaagagatctaggagatgagctgatcccaccccttgtgggtttctagaagagctggaaatatagtctaaggttccatatagcctcccagtctagtagtgatcactgcattgcacccattcaataagaaaaatgaggaaggatgagagagggaagacgagtttactttttctcttaatagaagccagtcagaatggcaagcactagatatattgcatgagcttcctagtatgactgagaacaaaaagctagtgagtaggcacagagaggtcttcccattcaactttctggccctgttgtccttttagaaactcatctgacacacttctactttcctccctgggaactcagacatcatccaagtgttctgaacctcaggattagggattccagtggtagttctaggagcaggatgatgatagaagggactatgagagccattgactagtttaatttgacaataaaagcctgcaacaccaccaatctaccaagattagctctgttagcaggaattgcagcaaacacaatagctgttatctcagggtattagggccacagaggagtggcttgcttaatctctggaattaatagagcagagaggaaatggctcttatagagccgtgggtcggcttccttccttttcatagaactggaagccctgggctctgaggtaatgccatttcacataactagagggcctgtcttctccaattcccagggcaatccactttcagcaagtcagctttcaatttattttaaaattctgatatgtgcacagatgtggatggaggtgattgaaatcttgttttctctttgtttcctcattgtcaaccaccaacaatgtattgagaatgtgctatcaagttgagcatgtagacatttacaaaactgtttactgcactccccagctctcacagagattgcagtcaggtgggatggcagagatggagacattacttggccagcagcctgtccaaattgccaggccttaggcctcttctagaaagaaatctctaacctccatcctaattaccctttatatttcatgcttctcttttatgatcaacaattgagtcagtaaagaaaaacctgataatgctcccagagtccgtgatcagttttagcatgactttaaatttctcttttatttcccacttgtttccattcacttgggccaaattgtagaagaaagtgttgatggattgtggatgcaggggtcctcttccccttctccccaactccatcaacactcttaaaaagtgtggccagtaagtaactgctttggttttgatcagtgtacagttgaatgcacagattccagtgggggttgtccttagaataggtccttggagtggccatctgtgcatttactctggaaaagttgtcattgcttacgtcatttccaggcttggcttctctttgcagatggcctttagagccctttgtaagctttgccaaaaattcacattcattgctttagagtcacactttggatttgatcaagatcagccctctgcctcctctatgccacaccttgttctctgaaagagttctctgttggttctgagtggcttgactctttctaaaacttcaagctgtcctagaagaccaagaattcaccccagttgaggagaacaaagaattttaaaaatttgcctcagcctccaaaagcaactctctcagatggtcttcttcacagttgaaacagcattggatgacattgagagagcccactcctttggctggacgtgacaggtgctgctgtacggtatccctgtagcctcagaaaggtacccagtgctaatatgaaactctgctgcacatgctgaggatctcagcatctgggtgcttgtgaactgaggttgaccaaataaaagcagaatggcctgtgagtccaccaagaaacctgcagtccaaacaagttattgtaaggcctggaaggtgagtggccaaaggaggtcctttgcaagagctgggcttgcatttccagggtgtagccttagctggatctcagatgtttcccttgtttgctctccttctgacacttaataacacccagggatgacaccctgaaccctagtcccaggaaaccatgtgcatctggaagcacgtttcttgcaccactctccctcatcctgaaaacatcgctaacagagatttgcttcaggcattcagcttgactggttctcttgttctttcctagaaaacaaacaaacaaacaaaaaacatgtttcaaatcaatcttgaaataaaatgatatcagtcccagaggagagttctcttttagcagtccttgaatttacatggaaataattgtgagctcccttgaaggaaaacgtgcatctcacgtaacagttgttcttggcctaagactagggctcagaacacctgggttctagtcttgcagctactcctcactagctatggggctttgtctatcctttgccctccctgagaacaaagttcaaatgaacgaaaagtaagaataaccacctttaattcagcattgactaggtgctaggcactttactaagcatttttggggcattatctcctgtaatcctcatgataaccctgggaagaagaagctattattatctccaggaaaccgagactcagagagattaagcaatttgaccaaagtcacagatataagaagtggcaaactcagaggccaatgtcatcaccactatactctaatgcacattgaaaactacaaaatgctgaatacatatcaggcaggggccatcaccataagaaatctcagtaatgcaagtaccttttcagcatctgttcattcatttaatagtgtgactggttaatgactctggcgatctggggaacagaagagtttgaccttttgaacatttgggcatctacccaaggttaataaggcatccagtctctgcacttagtgtatggagttttaacaggaggcagaacattttgtccttccctttgaagttaagatcacgattctttccctagatccctagatcagtaggtcaaaggattgctagtgtgagaatttaaaaggcattagtactccaatttgagagtgctccagagcctgcatggagttgagactcagtgcgcatgtcacatgccatctctgtctcagtccataccccaccataagtggcaaagattcctccagctcggagcaggtacctattcccttcataaggcagctcctagacaaaatgagggtgcaaagggcatgaaatgttcagttggaggaggaaggggacacagtactttttgcacatcttctgtgttcagccatttaatattaagaagcgactcactctatagattacaatgggatgccgtgcccagtatttcttctgagcttcccaaccagtcagtggttgggcagggtggggggattattattattctccttctttatggataaagagaataaagtctgagaaattcagtgactttcagaaggatggccatccagaaggtggggtgctacatcaaggtccacatttggatggccccaagggcagtgtgctttccatctacaatacgatgaaaaacaacccctcagcccatatctttctcacctctaaatgcaagtagggctgaagacgggggagagaggagccctcagtgtaacagcgtatgtggacatttggatggctgcaaaaatactggcctcattctatccatcccttttctttagactggtgaccttagacatatccagtaggaggagctctagtcacctcctccctttgtgtttatgtgacggggttcaagatttgcgcccatcagctttggaggcatatacttcttgcagaaaaagtgctggactcaggaaggagtcctcagactcgattcagggttggaacaagctctttgtgagattttgagcaggtttctttcttcttgaggtcagagggcatgggtatgagctctaagggcctgtctatctctggcctcctgccacatttccagggtcccttctgtgtgcctggccctgtgctcgatcttgagccccaggaattcatagtctaggggcaaattattcccaggcttcctccactgggaacaaatctatcttactctgtagttctcggtgaaacctggaggcaagtgtttgagcgtctctcttgtgcaaggtactttgtgcacattcgctcatttgcttctgtgtcacagagattgatatttccacttccccagggtggagactgaggctcagaaaggatggagactttcccaatgtcacacaggcaggaagttgtagatctcaaactcaggtgccctgcctccaaagctcttcctactcctattcccagattaggagctcaggtatttccagggccttctgcaggccaggcactgttctcagtgcctttcattccagtggcagagacagcccataaacaggtaaagagtagaagcaaacttacttcattctggtagctctctgggatgttctgaccagcgttgtccactgccaagcctggcagaaagctaggctgctttaaaaccctatgcaggggcagccagctgggaacagagtgagttgtcgaaacagctcccttagaagcctcaagagaaaacccagatttacagctttgagtctttgccagcagcccctgcttcatgcaggctgaaggcgcggcacaggtgcaaatctggccccaagagaggggagctcatgtttatgggtccccttccaagacccaggtgatcctaggggctagttaatctagaggcaactgtccctgccacttattgataacttgcatgagcctctgggcctcagtatccacatcagtaaagtagggttaataactctgctctttgcctgcgtcagggtttctgggatggtgatgaacaaggtgtggttgtgcacgtgttccaaaccacacagggcatgatcctaaaccacacactgctgtgagcacttttttttaatgatcagaggttggcattggctcagaggttttttgccatcagaagagtgatggaaaatgtgtgtcctgacccctgaggatgccacagtctcatcagcagccccactacactgaggagacctgaatctgtaatgtagctgtgagcattctgggtcaagggctgcagtgtgtatgcgcctttctactttggggatcctccccatggagcacgcagctgttcgctccctttgctccctcctcctttttctgcagtaagggctccttcctgttccagacacccaactggggtgagaagccaggcagaggccttgccttcacacagacctttttttgcaagaactgagcactgctcagcttgcaggacaccactgggcttggcatctgggtcctgcctgggtagcctggcttggtaaaccagtgacctgcaaatcacagtctgtttgaagggagagtgctggtgaggggagctccatttttcagctggtttatgcaggcacctgggagcatgacactgcctatttctaaacttttaggagcccatgctggcctcatctgcattcctgcctagctctttcccacagtttccttgacataaggcccaaggtaacaggtttctggaggtggaactgccccaggaaggagagggatgctgttagactccaggacagagttgaggctcagaagtgtgcacatttctagggagtatgcagacccaggggccagccctgtgggtgtgggcctggggttcctcaaactctgggctggcctgtgtaggctgaggcctcttgcttttactgagaatccacagctcgaaagcccaatgtttctctttttacagatagatatttgggttataagctacccctggagtgctgcattccagacttctggggaggagggacatgagcttctaagatttgggcaacaaattttgatttccgcagttgatatagaataatttgttggaaaccttcctcctccccttttgcttttcctttccctccccttccttcctgcctttcccttctcctcctcatctccctcctaccttctcaccagatctccaacccctaaattccaaagttagaaaggcaagcatcagccacagggaagtggatttgaccactgggcactcaaacccaaggcgcaggcatgtctctgctgtcattgcctccctctctcttgctccgggccccctcagcacaggcctgtctttgtctgcctccctccagtgctgcaggcttccatcaccctctcaagtccccatccagaggcagggctggcataggtgctcgcttgctcactcactgccctgaccctgagagctcctgcttctatgcccctagagctgtggctgagtatatggcacatagtaaatgctcagtaagatgcagctgctgttcatcttggccagaagtcccttagaaatcatctaggccacccacattgctggacacaagagaaggccagtgtcatacagaggggaaggggtgcaattaaaaagtcattgtctctaggccttacacaggaaatgggaaaataacagagttatttgcagagtaccattttctccaatggttcattcacatccgcagatgccagctgagccctgtcacgaggctttggggttaccaagatgaataggaaactacctggccttcagagagttatgtggtggaggtgggaaatgcatagacctaacatggcagcctcaaggttggccatagcacctaggatggtgatggaaagggtagaaggtgagactgtattatcatagagacccttgagggcctgagggtggagggtgtgctttaatccactagcccatgcaaattgttcaacaatgtacaagactataagaacaaggcccaagggtatcctggaggggatgatgtttctctcctctcttttttttttcttttattattatactttaagttttagggtacatgtgcacattgtgcaggttagttacatatgtatacatgtgccacactggtgcgctgcacccactaacttgtcatctagcattaggtatatctcccaatgctatccctcccccctccccccaccccacaacagtccccagaatgtgatgttccccttcccgtgtccatgtgatctcattgttcaattcccacctatgagtgagaatatgcggtgtttggttttttgttcttgcgatagtttactgagaatgatgatttccaatttcatccatgtccctacaaaggactggaagcttcggagcacctgagaacgggcgcacaatgagaagtgaaacaacttttgggactgctggatcacttgcacggtttagaaatggtcaccttacttgcactacggaagaaatctttacgtttttctgctccagaaaggttgcccacccactcttctgtgaataatgggcctacatggccccctgcaatgtgaggagggcaacttggaaagaacttatttccctccaagaagatgctcagttcatgctctaggtcagaggttggcaaactacagcctgtgagctaaatccagcccacgggctgtttttgtaaataaacttttattagcacacagtcacgcccagtcattaacatattgtctactacacagagcttcaacagagaccacatggcctgcgaagcctgagacatttactacctgggccatcacagaagaagtttgccaacacttggtctgtatcactgggcatttggttcatttgtttaccctaacaaatggtacccatttcaggtagaattacaggccctcatgcggccacgtgtttagcttcccctcctgtgccaaagctggccccaactccacactcccaattccacccttctcaaaagttcttgcccctaaaagtgtttcttttccttccatttctcctcccatcagcatccagagagaactttttcaaagagatgaagccaatccttcctctgcttaagtcccccgatggcttccctacaaacaaaatacaatccaatccctttcccatagcctgcaagaccctctgcaaattcacgactacttccctggtgcattgtgtgacaggcacactggctgcctgcccgtcactggaacagtccaaaagccccaccccagggccttcccacttgctgccctcctgcctgggatgctctgcccccagtccttctcctggcctgctcagagccacctgccattctatcacatcactattttttcagtctttgaaagaatactgcacacactcttaacttgttcttgttgttcacttaccgtttgtcctactagaattccagctccttctctctggttccccacttctctccctggcctgtgctcattctaatggaagtgtcagttctgggccccctaggcagccctgcctgccctttactgtcatatgacttcatctctatagtggaggggagcccagtgccactctgtaggtgcttctttcctagaataagcttcaggccctaaagttgtctagccttagggctgcccatgtgatgctgtcagcaaaactaaacatgttcttgcctcttttcctccctcaagtcaagcccttagagtttagaacaatgaacttggcctatataaaatacctccaggaaatcagtcctcaaacaccaactcccaacatctgctttctgaatatatggcttcaaacagctaagtgtacagtatctaactgctgtccatccttttgttttttttagccacatgacatctaaggaacttagaaaatgccttgccctttcctgtagttaaatttgacataaaattactttattggcagcatattaacaaacaaaaatctcctgtgtttttcccggtaattcagtttcagttttccaggtaagaaaaagataattttgaatgactacaaggagacagactgttttgaggtttctgttaataacacattcagagtgtgccttcttcctctgtcccagtcagtggtgctgttgacagagtggtacaacaagaatgaaatatactgtgggaactcaccctgatcccaacaccctcatcaacaccatcaccaccatcactattgctaccagcaccaccacctccaccaccactaccctcaccttcactaccaccaccctttaaatcaacaccattaccaccatcaccatggctaccaccatcccaccatcccaattgccaccaccacatccaccaccattaccaccaccaccatcatcactaccacccttacctccgtcattaccacctccatcacctctaccattaccatgattactatcgccatcccctctaccaccaccaccctaccacttctctctctatctctctctcatgtacacgtacatggttatatgacacttcatgatgcaatcatagacactgtccacatacacacatacagtgaaataagtacatgtttttaaattgtcattattttcaatatagaacctactcttgttgctatgtgctttggggtggggaacatcaacgtgtgtttatggccaaaattgaattaggattcataagaaagggctatatctccaaatgcgcacttttaaaaaagttaagtttggatgagggatctttcatttcataaaaggatatactgaggatttcctttcagtgacaaatttttgctgcattttattttgatttggtttacaaaagttagcctttcacacagctgttcaggagcgcagccaatgactaaaggcagatctgccttgaatagcaaatgctgctgagtaaaccatgttacaggctattttaggaccaccaagaatgtgtttgcattttcaagagtagaaggagagatcatatttatttggtatctacactatgccacacactatgctaattacatttctaagctcatgtaatccttacaacaaatttacgaaggctttactttccccattttgtaggtaagaaaacaggctcacagagggaaaaatgacttgcccaaggtgaccaccaattagagacaaggtttaaacagaccatgagggctcagggcctacctcaagccctctaatcaccctacactgctaagttcttctattagaatttgttgtgcagaaggttttcttcttcttcttcttcttttttttttttttgtataatcagattatccatttgcctacaaagcctatagtgtgcaaggagtgtgtagtggtccagtcagtgtaccctggcacttgagagctcattaagggcccaggagaatcagcaaattctcagcagccaagctaccctaacgtatatcatagaaactacaataggagatttcttctctgaggtcactgctatctggcactatcctgtgatgtatggtttggaaaaccgtgggtcaaatacaaccgtccctacaggcaagtcaaaatatcgtggctgaaactaaaagtgattttttatcctcagtctaagtgtgaagagctgaagtgatctgcctttcctttagcaccccagaattacctctgggttcattcggggaaggctggcttactgctgaggtgtccacacatctaccactatacatgcctggggttcttgggggttctgttacctgggctgaactctggagtcctgagtgccaagctcttctctgccactatctatatgacttttagtaagccacctgcaactccttcacctcagtttacccatgtgtaaatcagggaccccaagcaaagccctgcctacctcctaggattcttgttagaatcaaaggctgatgaatgagaaagtacactgtccactgaaagggcctgggattttataaaggcctgtagttggtaacaccaagacttggatctgaaggtctagaaaagcacaacatcctgagactctgtgtggatccctttagcctactgtgagtgcttatgtcatgtcatgaacatgatataccccccatacagccctaaaaagtctttgctactagaagccgcatcctgtatgtgtataaaaatacagaaccaacctcccaggtacacacccgttgcacaggcagtctctgctgagtcattgtgcagacacgtctcttgctgcttctggccatgttgttcccagaaatggctctagagggatttcccgcatggctgaatagatggggagcatacgaggagctcaccttttcagggttccagatatacagctgggccggaggggctgggaggcagaagagtgggtgcagcagagtaggcttgtggaagacaaagccttcagaaaagtttcttgcccgaggcaaatgcagtccatgctagatggtacattcccagccaggaagagagtgcaatgtcctctccaactcaaatggcagtgaccagtgggtctccccaaactctgccataggacattagggctttaccaagcactgtccaggttgcagttttagatgggaaagggcacttggccttgagaaggtacagaagccaactccctggtcaccgcatttgttcatgctttttcccttggccctcagcctctggatgccatcatttggcctggagataggaaaagtgttgcctacatctgcctctggtactagcaaagggcatggtacagtgtggtgcagaccagcagcaggaacagaaaggtgcttctctaaggaagctgcagagatttctctgccagtctggagatcagctttgggtcccagctctccctgctactcttccatatacctccaatgatgcaagtttccaagaagaccaaggctgtgaaaaacagtgtggtggttcctcaagaagttagttcaacataaaattacaccatgacctagcaattccactccttggtatacacccaaaagaactgaaaacaagtgttcaacaaaaacttgtatgcaaatgttcacagcaacactattcacaatagccaaaagacagaaacaacccaaatgtccatcagatgaatggactgaccaagtgtggcacgtccacacaatggaatattatttggccacaaaaggaacggagtactgaggcatgccacaacatggatgagcccagaaaacatgatgccgggtgaaagaagccaggcacaaaacgccacatattgtatgatcccatttatatgaagtattcagaataagcaaattcatagagacagagggtagataaatgtgttgccaggagctgggggtttccatttgggatgatgaaaaagttctggaactagatagtggtgatagttgcacaacattgtgaatgtcctaaatgctaccgaattgtacacttttaaaaagttaatttcatgctatgtctattttacctcaatttaaaaagagaggacctagaccatgggaagagtctttggactgactccttatcccatgttccctccaagtttcagctgctctgatgccaagactctcatggcatcagagctcaccagcctggctctaaatctactaagtggggtcgatatctctgcaggctaaaagttggcactcaggagctaaaatgtgcttattcaataagcatgtgacccctctgctaagctacagaggcatgttctggacataaattgttttaaatgtggccattgatagcagcatctctctttggtgtgtcctagcaggaagaggtcatagacaggatgcccctctagaaggttctgaactaatcaggtgtctctggaatcttctcccacctacatagcagttgaatttctcaagcagggaaatattctgcatggtctgaagcttgttgccattttatttagcctactgttggggcacagagagaggtaaggtcacctctggcctaagcttcaaagttcatccctcaagccttctaagacccggtacctaattttgttttaattttatattctgtttcataaagagggccccagattataaaagcttcagtcccaaaactagagacccaaacacctcactataggaaagaaggctctgattaaccagcagctgttttttttctttctctttattctttccagctctattgaggtataagtgacaaattaaaaatgtatatttaaggtatacagtgtgatgatttgatatacatatatattgtgaaatgattaccacaatcaagttagtcaatgcatccatccataacttcatctagttatatttgtttctgaactcatagaactgttttaaaatcatagaaacagtagaaggctggttaccaagagttgcagggggtggagtgtgaaatggggagatgtcagtcaatgggtacaaattctcagttataggatgcataaatttgggcaatctaatgtacagcactgtggctatatttaataatgctgtattgcatatttgaaatttactgtgagagcagatcttaaatgttcttatagcaactatttttctatttgccccatttaaactactctagttggtgtcctggcaatgaggaggactgtcaccttgtttcctgaccttgccactgcaatccaaatggggtctgtttttatcatgccaggaaaggagggggaggctgcgtgggttcagcaggggtgtctcctgactgtgccttccaggcagtctgtcactgtgtgttcccccaggaggccctggaccaaaggccttttcatctcagtaccccaatttctaacctcataaggttacactgaagatgaaaggaattgatgtagttaacagggctgaagcagaggcttggtaactagttgctcttgttatttcctctgcttgtagaggaagttggtatagtctctctctctctctctctttctctagctctggctctccttcaaccattgccctatcatctgaatggcaccttggcccatttcctccaagccccacttctgcttgaggacagggctctggaggctgacaaacccaagttcactccctggttccaccactttttagccagccaaatgcccttaagcaagtgacactccctgtcttcaactgggcaccctcatctgtacaatgagggtgggggtgatcacattagtactgactttcttgagtcactgggaacattaaggtaaagcctaaaatgcatttggaactgtacctgtcacttagtaagtattccaaagtcactcttgaagtctacttataaatcaggtctcccttactaaaacaaaaggaaatggagaaagagaagaaaggagaaagatgggaataagaaaggaagagagggagggatggagggagggagggagggaggaaggaaggaagacaggcaggcaagactctttaatctttgctccttgttctctctagccactcacactcaagttccagcccccaccaatttggagatgattccctgataaacctctaaactgcaggcatctctgttcttcatttctaagatgaggatgataatgggaatatctttctcatagagttgtgaagataactatgtgaatgcatacaaagtgcttagtaccacaatagtcatttgtgtcttgtgattccaggagttttgggcagaggattgtgtgccctggtcagggtgcccacaggcaaggttgccactgatctgatggggccaatccaacaggcatggagcccagaaacaggcttccatgtccaatcccatgtcctgctcttgggaaggctttcccactccgaaccacaaaaccactgggtttatctgggccactctgatgaaagtcacattcccctgaacaaatatcctcaccacaagggcacctgggtcatcctgctctgtgaagcactgaaagagtgaggcagaaaatggagtgactacttccagaaatggaatcacctcaagtcatatcaattctcttgggaagagccccttgggtttgtatagttctttaaagtctgagggacagtggagaggcaggtcccaaggagtgctaatgcagaagtaacatactatggcagcctggcatgggtcagatcataaggggggccagccagggcgtggaggcaggactggcagggcctggcagtaagaagagatattgctactgcattcacacggtcccaatcagaagtcttagagattatctgtagagagagctgtggctaccccatatagtacgtgacttccacacagcccaaactaccctaattaataatgacccagaagctgattgtttctagctctcagattagcagtggctccttattgccccagcttagctctaccagatgtcctgtccctgaaatgtaccagtagcccctctaaaaacccacttggctcatcagggcccagtccagggccctccccacctatcccattcctaatcccatcagcattagcgagaagcctgccactgcctcagggacctcgcatctggagactcagccaagatggtggcacctgtgagaggatccacaggtagccaagtccaggtagccagaggccaggtggcaatggggaagagcataagtgacccctgtccaatatgccctcatcagccaaatctggggcctcagtttgggctttgtggtgtgaaggtaccacccgccaaatgggcctggagccaccagcatagctgccctccttctccctgggtggccctggaggtgccacacttgcagcattcctgggtggtccttctgtgcatgggctgtaggtggaggtgtggaaagctgaagacagggtcaggcacagcccagggcagcctagagatatttacatcatgatgatgggattagacagcccactcgcttgtgcggtatctggacgccactggcttgcagagcatttgggggttactgcttgagagtgttttccactggtcttgtcactccctaggtgaaggaaagtctggcttttgtaggaactgcctgggtctctggtggagtatttccttcctcacctctggattattctgcctctttagagcattctagaaaaggggtgttttctcggttcattggccacacggcatggctgcatcctggtgacattttcccagcatcagatggttggagactgcaatgaggaggctccacacaattcatagccttcagccaggccccttgctaaagtgctgcatgggacggagaagaccaaaccaattggagagggactcgatggaagccacacatggagttttgtgttgttgtccagtacttactgtggttgccctgctcccattgacctggacgatccatgttaccatctgcccctcctcccaaaaaagggaagcttcctgttcttggagttggcactaggagccaccctcagtggcttaaacagatttcttttaactatgaggtagtgcactagatgaaccagactacaggagatgccagctctgtagccatcatttcacaatgcagccatacctaagagcctaggacaggccatacccggtgggcggagcagggatgggccacagctggaggactgaaagtgggatctcagcctcagttacagaggcactccctgatggccaggcagcaatcctgtggagggctttgtcatcagaaaataggagcccatcatctctggaaggttggaagcaccatggtgagatgggatgtgtgtccaagagttaaactggtctggagttctcttttaacaccatcatcacaccccttcatttaatctatgctggactttgaccataaaaaaccaaacttgaaattgggatccctgcaccgactggtgaggcacataggagagggttggtttgggttccatatgactgacataaagcagagcaaatattggcttgggacccaaaccaaccctctcttaggcttgttaaggccccattcaggatagttccctggaggtggttggagagctggcagcctttctggtgactggtgacctggtagtactctctaatagaatatgtcaataagcacagctcatttgaccagaattgtaggccgcctttctcgatccaacaggtgcagacctgctactctcaggattcactttgctagtctcctgcactccacaccggatcccaaagtctatgttcaagtaatcccctatttaaatgtcatagatatatttggggaggctcataatttgattcaagtaacagtctgatctgtgcctctcactgagctggtgcaggtaatactttctttaagagtgtgtgcaagtggctctcctcagcctactctcacccccagggaaagaagccctcgtggatggaggaagaagatttatcttttctctacaagagcagcccaggaagaaagcatcaggtaagcataagcttaccaaagctgggacccattcactttacagtggggaaactgaggccccgagtgtgaaagggacctacaagaggtcacaccacaaggtcctttaagagaggcagagcccagggagaagtgagaaggttgggcttaaatgatctctgcccggtggccctggtggcctccaacctcggttctgcctccacttctccctttgcctgtgtgattttgggcttgttagccaaatttaggtgaaatgtagattaagcttgtgaacctgggtccagcagaagtggagtcatctggattgggacagggccctctcctttgacctttagcttctattacagctacctcaggcagcacctacttcctctatagatcaacctcaccaaatccatccagatgtttctcttctccccacagtaatcatctctatcccactaatgacagaacctgggaatgtgtttggggaagactgggtgaggatttcttcctgtgaaaacagagtacaggcctcaccaggcttaacatgagtgggtgtgagcagcccgtcttgaagggcccagcagttctgacggtctaggagttagaggctagctctcaacaaatgcttgttcaatggcagaataccttgattcttctcaggagatggtacaatacaaattctgagctcattaaattcatatacatctataggttgaggatcatccttagagctgtcagttcttccaactggcatgtctacactacagaaaaggagaaagtagttctagaacactgcccacccaggtttgctcatctctgcctttgtcagtgcacttccagccactccaggctgctgctcagatagttctggcagaagcctgttgaagccccagccctcaggtcagggtggctaaaggctgatgactgtggcagccttcagagtggcaggtggtggcaagcagcaggaggcaggagtttccaggctcagccaccaagacagcatccctggctgtcaggtcagtgctgtcaggtcagtgctgtcaggactaagctgcttgcctccccctacttccactccatccccctatcctagtgaatgcatccttatttgtaagaaagcaacagaggcccaacacgaagacacagggccttgagaatgatatcagtagtgattactgctccccaagtgctctcctcagtgagtacagtggaacctttcactaatgctgtgaagcacacatggtgggccaagtacccattttacagaagaagaaattgagcttcagggaggggagtggcttgcccacagccacacaacaaacggaggagctaggacttaactgcaggtcttctcatgtgcattccagggccccttcctccaccgcagcctgcatctgcctgcatcgagtgctggttcagggcgaatcagggacaccaataaatccccgatttgtaggtcgaggttcttgctccaaaccacccattatcagagatttgctcctgagacataactgactcctcttgaagccaatcagcattagcattcagggttccctgccattcccaaccaccctggtattctccagagcctcatgtcttgcaattctggaaatgctcaaaatcctgtttgttctacagaaagatcagtttcagtttgctgggacattctgctgaaaataaacatgtaaataacacatccccaaatacaggcattgatactatacacacggatattcctttgatcccatgtgcaaatgcaaacatattcattctgtctttctctcctcctcgctctcactctctctctttctctccatcccccatctctttgtctcttcaaacccattcctgatacattattttcttatctattctacagctacctccatcatgccccacgacatcttcattactttcttctgagatagtctactgggggccatccttgtcctcagagggcttgaagtctaatttagttggccaacatcaggtgcctcaaaattcatagggggaaaatgtaacaatattgaataaagttgttcatggagtatggatgtaagggaagagactaggagaactggctagcaaattggcctgaactgaactggtgaggcactagtgaagaaagagcagactaaataaaccacaggcgattttcacctttttgacaattttgcccagggcctacaagcccagtgccctctggagggaaaataagtctccctgagtttatctttcctggttacctttgacctcctatcttcttgcccaataggaacagtgcataccctttgctgacctttttattggtgtccatgttaaacctccaactacagtgtccaaaatcaagcatttataacagcctgccagacttctttggataagttatattctttattctccttatgctcatttcatggactgtattcgtataatctctaccttctctaagaaatttttccccttttttgtcattctggactagaactatagaaagggaagagttgccatatgtcattgttcagacagaaccagaaataatgttgacttcagagctgaacttgtctctatcagaagagaaacctttgttttctcattatctagggggtggggaggccatcacatgccttgaaatgcattttaatgaatgtttataaggtcatggggatcacattggtggctttgtctgccggattctgaaatgggactctgcaggcatttatgtatggagagaaaggaattcgtttctaaaagatgccagggcactgtcactcactccctcccccttcctcaccaccaaaggccgggcctgtgagggctctggctgggagttgggacgtctggggtccagtgtccttttaactaattgtctgaaagcaaatcgagatatgctctgaggaaatcctgccagtggctactgattgtcacagggagaggcctgaaagaagtaggagctgtgggacagctaggactaataccctgctgtcatcaagaccgcagagactggagaaaagcacatgggtgaagcagggagattcatttagaaagggctgggagcttggttggggaccttccgcccctaccaggattctgggaggggaggtcattccggagcagtgagctatctcctgcccttgatctaaaatggtggctgtgggatttagtcagaaacacccagtctgggcaggcaaaacctcagcggcatcagccacaggcacaggtgacccagtgaaggcacgagtgtggcactgggcacaggggaaagcccagccaacttctcgcagttgagatgagtaacagatcatgggactgtgaaagagaagacacgaaagcaagtctttatctaggggcaaaattaactggataatagatttccacgcctcactgatgtctggtgaaggcagacgctattacagcaaggctgagccttccgtgtaaacacagccgcctctcctcggccttgtttagggttggctggtgttcttgctgttcagccagggcacttcaggctcactgttgaaagctcattccatgaaatccaaaacatggagctgcatggcctctgacaaagtgagttctcactgaagtccattgaaaaatgaaagctcagaagaggcttgcagcttgccactctgccaaaacagcagcctctatcggcaccccaaaccccacccctgagaaaagccaggtgagcctgccccctttattaggcatccttatgaaagtcagtgagtgtacatgccagcagctgtccagccacagacttggcatagcaaaagtggcatccgctccagcagtggcggcctgctgggatctactttgttattgagtagtcagttggtttctagaattggaattgatcagggaccatttgcttgggatgcagttgatgagtgctggaaaaggtgtgtgtatacgggctctcatgtaggagaggtgcagcctccttccctttgccagtggccccagctggtacctttagtgtctggtggtcatgccctgcctcctccatccctgcaccttactcccagcaggttagtggcagaccaacaattaagtgaaagctctgggagcccatagaagctgccagcaaatttcagaggctcacgtggcagggatgccagaccattgcccctcacagccccttccctcccttcctttccccaacccccaccccctccttggcctgcctggttctgcattgcttcgccattgttaaaactgtcttgcagttcgagacatcatggacagcactttgggcctgactgttgccagctcagactccctgcaggggatccttatgtcaaatccacatgcaatcatccctgattgatctatttcatacatttctatttttaacctattggattctttgggagaatgtagaagagacacaatttcagtttgggacccagtggcttgtttgtaggttactccataatggattgagtaaatggctgagctccctgtgtgttgggtaatttatgttcctttgtccattgattcgttcaactgccatttactgagcacctgctgtgggccaaacagttagtgagctgctccatggaccagctcagggacactatgggtgctgtgcccagtcagactcctgggaaagtgggcactgatgactgcatgggcctcagccctcttattgtgcctgctctacacctctccaacccattcctgcctgacccatggtattcaggcctcagatgagtttggtgacagagctgtcccttgaagtgcccttgttcagattgtgggcatctcaaaagaaaagtcaaagaagtgtgcaagtcctctcactcaagttggcaagccccttctgtgggggcgatgcagtgtcctaccaacaacatggcgaaggcagtgggtctggaggcagctgagtggtggtggaggggccctgcatctgacctgggccttgttgccctctggctgagcaactctgggtaaggcctgcccctctctgggtctcagagacctctctgtctttaagaagggtattggactcccagaacccttccatacctgccctttataatgccgggtaccagttagtgaggagctattaggtgtcatacaatgtgccccgtttcacttaatagtcagagcaccttcatgagaaaagaactataattacactcattttacacataaagaaactggggctctgagaggttcagtggcaaggccaaggtcagagccctatgccacgctgcctccacccttgctctgggccagtggttttctgttgagaatcagccatggagctgttggaaaaactcccgatgcctgggccacaccctggatgaagctgtcagtttgtggtgggagggcccaggaatgtggatgtttctaagtgattctgatgtgcaccaaggcctgagacatacagccctggggatctgctttgatgttcacttggccatgacagtcatgcccctcatcgtgctggcaagtggccccatgcatgccttgagctcctagtgggctacaagctcatcaaaccagaagagccaaacttaaggtgacatcagaggatgagcactgtatgtcctagtgaaacttccaaagctggaaaggggttatttggggggtaccgggtgggggaagctttaaaagaattctacctgttcacctatcggcattcaggtgatttccagatccctctcttcctttccttattttgatcattcctgcacatactcctttgcccccacttcctttcccatttacctgctaacatacaggtcatggtcattaacacaacagcgatggatgactgtatgaagccatgaagagtaggaagtctcacattgctagtgactttgctttgttcccaaaggctgtgcttctataaatgatgggcagctcccccaaggttcagatcccagattggggccttttctcattgtttaatatctccccaacctgaggatgcatcttcagaggaaaatttcttatttagataactttatacttttttaaatttttggattatgagtcgttctcgttaaagacaaacaagcagaaatgaagagaatagaaagggaattgccagtcatcccaaataaatgaccactccaaattgttgggtataggttcttccaaattatttttgtgtacacatagcaatgtgtgagagtgtgtgtgtgtgtgtgtgtgtgtgtgtgtgtgtaaaaataaatggaacaatgaatacgatgcctacaatgactgttctgaaacttgtgctttcccaaaaacagtattttaaacagctccccaagaaaacacatccagatctacttctttcctgtaagggctctgttgtattcaattttaccactgcagcctgatgcatttaaccaagactagaaggcagcctaaaagttcaattctatactatggtattccttcgttaaaatctatgtgtctgtagacaggaaagaattaaaactatttagctacttctagttttctctccaatgcctgcctttggcagcatggttcatttagtgacttctgcatagttttgttgaactctccttgaagtgggcagattaccctttgaataacgttctatcccgttttagtatacagacaacataatgccttatttgaaatgtaattagacagtttagatgaaacataataatgaataaataagcactatggttccaaagacaggctgtattttatagttttcacaactataagtctttaaactgagaggtctgttttatcatgcacatttcctgttcattagctttaatgtgccaaacctttataaaaattcctctctctctctctctctctttctctctgtctctctctctctctctctgtgtgtgtgtgtgtgtgtgtgtgtgtgtgtgtcacctctcttcccttctcctctcctctcttctcctcttctcttctcttccattcacagggaactgttaagaggagacaagaagaagaccacttccagtttccagacatggctgatgggggctaccctaataaaattaagaggccttgccttgaagatgtcacccttgcaatgggcccaggtgctcatcctagtactgcttgtgcagaactgcaggtccctccattgacaataaatcctagccctgcggctatgggagtggctggccagtcattactgctggagaataaccctatgaatggcaacatcatgggctcaccatttgtagtaccacagactacagaagtgggactgaaagggcccactgttccttactatgagaaaatcaacagcgtgccggctgtagaccaggagcttcaagagctgctagaggagctcaccaaaattcaagacccttctccaaatgagctagatcttgagaagatactggggacgaagccagaagagccactggttttagatcatccccaggcaaccctaagcacaactcccaagccttcggttcagatgtcacacttggagagcctggcttccagcaaggagtttgcttctagttgcagccaagttactggcatgtcacttcagatcccatcctcctccacagggatcagctattcgattccttccaccagtaagcagatagtgtcaccgagttcttcaatggcacagtccaagagccaggtccaggccatgctccctgtcgctctgccccccttaccagtgcctcagtggcatcacgcccaccagctgaaggcgttggcagccagcaagcaggggtctgctacaaagcagcaagggcccacccccagttggtctggtctgcctcctccaggactctctccaccttaccgcccagtgccatcaccacacccaccaccgctgccactgccaccaccaccacccccattcagcccccagagcctcatggtgtcctgcatgtcgtccaataccttgtcgggtagcactctccgaggctctcccaatgccttactgtcaagcatgacgtccagcagcaatgctgccctggggcccgccatgccctatgctcctgagaagctccccagccctgctctcactcaacagccgcagttcggccctcagagctccattcttgccaacctcatgtcctctaccatcaaaacccctcaaggacacctgatgtctgctctgcctgccagcaaccctgggccgtccccaccctatcgcccagagaagctctctagcccaggcttgccacagcagtccttcaccccacagtgttccctgatccgaagcctcactcccaccagtaatcttctaagccagcaacagcagcagcagcagcagcagcagcaagcaaatgtgatctttaagcccataagcagcaactcatccaaaaccctgagcatgatcatgcagcaggggatggcaagctccagcccaggagccacggagccatttacttttggcaacaccaagcccttgtcccattttgtttctgagccgggtccccagaagatgccctccatgcctaccacctctaggcagccttccctgctccactacctgcagcagccgacaccaacgcaggcctcctcagccactgcctcctccacggccactgccaccttgcagctgcagcagcagcagcagcaacagcagcagcagcctgaccattcttcattccttctgcagcagatgatgcagcaaccccagcgttttcagcgatcagtggcctcagattccatgcctgctctgcccagacaggtaagacaatctcatatctggctgtgttcttttgttttggaagtaacaactgtgtttcatgttgccaatatctggctctggagggtaaatccaggctatagttctctctgagactggaaaagactctgaaaaagtctactgaagtcagctaatcctgtgtggttaaaagcacagtgttaataaggccaaggttatggtttcagtgcctgttcaagtcacctaacttccctagaaggagagctgcacccacaaggtgctcccggtggaaggagccaggtgggacaagtccgaatacagaaatgccttccctgcactgggccatgtagaaagactagtgaatccttcttaagatgtaaggaaattgcactgaagcatttaatcttatccctgctggcagaaggacaaacactgagccttctagaaatgccacagcaaacttttgctgagcaacctcagcatgccatttgtcactgtgctggatactcagtcaggtcgtgaaaggaaaaagacaggtatttgcaaggtagtcactctcatcatctccattttacaaatgaagaaactgaggctcagagagttgaaagacttgcccagagtcacatagttcgcaagggacagagcaggaacttgaagccaggtggtctcactccagagcctgtgctcttcttgaaattacttttgacttctcaccctccctcatctcctccaggcttttcaatcatgaaatgcagctgattccacctgggtcgtgtctatcacagttcccagttttcatttctgtgacccctgcctgtattagttatctgtggctgcataacaaattaccccaagcaccagcttcgaaccatatgcatacgttaccaccacatcctgatttctgggtgttaggaatcctggcatggtttaactgagtcttctggctgagtatctcctaaggctgcagtcatctcaaggctcagtggggaaggatctgcttccaagcccactcatgtggttgctggcaggaagcagttccttgcaggttgttggactgaggcctcggtttctcatgagctattggccagaggcctccctcagttccttgccacacggtctcttcacagagcatctcacaacatggcagctggcttcatctgagtgagcatgagagagtgtgccagtgaagcagggtaatggggagagagggaggagggatagtgccagcaagtcagaagtcacagtctctatgacctggtctagaaagtaacatcccaccacttttgctgtattctattcatgagatgtaagccagaggagattgcatgagggtgtaaataccaggaggcagggttcagtggggccaggtcacacgtgtgcctacacagaatactcagtcaccatctaccatccctccttcccattcctctcatccttgcccaagttcaggtcctcttgattctttatctgaactcatacagttgacccttaactggtctctcccaataaaccatccattgctctgagtcgtcttgctaaaacagtgacctgatcatgttttacacttgctcagaagtccccagaggcccataagctggccccaccagcctcctgggcccttcagcatccatcaggccctgccttgcactttgtttctattacccagaagtgcctgcagcacttggcccacgccatctggtctcagcctttactctggccgttccctgggcctggtcatcccttcccacattttctctcctgtccaacacctgcagctacttagggctcaggcaccatccctccaggaagcttttccatgactgtcctcagtacttccatttcccactgtgcctccctcttctggagagtggtcaaggaggagattataaagtgcttggccagagacctggcccaagggaagcacctgtcaagggctgacctcttatttaagagctctgtatgagcacacctgtggcaacccctagagtacagaggttgtgtcttttccatccaggtttcctggagcataaccatgcagagtgcttgacaccagggagttggtcatttgatagaccatgcggcaagcagagctcccatgggggtggccgggggagcggtgtggagataggcaaagcacataggacacggcaggccacctggggctcgggccctggtctgcagttcaggagcactttggtttgattttattatagggctgttgccatctgtttgcatggacttctgcagctagctcggtgaagccccagcatcaacacgggaactctttcactagcaggcaagatcctcagcctggagacgtgtcaccgtctaacattgtgagcctttctgttttgttttgtcttcaattgggtacatttttgtagactgattgtgttgtcccagagctggatcagctggctcagagggagaattcttaattattggggtcatgcaaatcatacccaaccaattacctaggtggggttggagaaagtgttcaggagaaagaccgaacagtcaagctccctggggctaggagcacaataaagggggcaagcgacttttgccagcagaggcaagaagctgggtccccaaattggaaatgctattgccaccaagagctgcctttccagcccatgctggcctgtgcccaggggccaggcatgggacctggtgcttcacctgcctcttctcattttaatcctcagaggcaggggctgttaccattctcctgagagttggggggaaaggcacagagaagtgaccgaagttgcccacagtcacacagcaagctggggccagagcagacaatctggctacagagcccacactcatactcccatgcatggggcactgcctctgtagccttctgtttccactgtcacctcttaactgtttcctcctctacaaatcaaggtgatgataggttgtctgaggactaagtgtgttaatacatctaaagcactttgaacagggcctggcataaagtatgtgctgagaagggatttgctgtcacgatgactctacctcctgaccctgtgctcccagatctgtttcatgggactaagatgtggttctaaaaaccagtagctgtggcaggacagacacaagccacgttatctccagaccctgtacccaccatgagattgataggagttgtgcagcctctgagccttgtgggctccttttgctctaggccctgcctctcctggacaactcccagcctgatgggaaaggggaaaggggaaaggtccatccctgctttgcagactggggatctcactttgctctttcttgagctctccggcactctcactccgctcctctccctagcactctgttctctacctggtattcttccaggcctccaagctgggggaatctcaacagtccttctgtttcttcttatggcctctccctattaactctaagacctaagaactcagccctggtcattcttccaggggagagaaaaaaataaagaaaaaagcgagtgtttgaggcaagagctgggaccgctgtagaaggacagatggtggccccaatggtggggaagaacatatttcccacttccagcaggctaagcaaacctcccaagttttactgatggccaagctgagcctcaggaacactaattacctatgatatggcatttactagcctgttacatttgccatggacgataatggttaccatggaaaaactggacattcatttgaatctggatctttgaggttttgtgcggggggtgggggcttttttggtttttgtctgttcatttctttagaggcagggtctcactatattgcccagtctggtctcaaactcctgggctcaagtgatcctcccacctcagcctcccaaagcactgagattacaggcaggaaccaccgcacctggtctagatcttagttttctaaaggagttatttttaaatgtgagatgagacacaaacgcttgagtaagctgaaaagccaaatccagccttctatagaggagctcatttttatgtacagaccagcatctctctatttggaggattttgctttaccagttgagtgaactattcaatttcaatgcaccattcatgtccacgtaaggtaaaaggcaaatgccacatgactttggggcagctgtttagcatgggaggttgagcaagcaagggcactggaggcagacagaactgaggctcaagtctggctacagatgctgactgattcaggtcccatgagcaatgttactcaactcctgagcctcagctgaaaatggggaaaggaatagtccccttcacttagggcattgggaaggcaaaggagatgctaacctgaaactgcttagaacggtgcccagcacacactacaggctcaatcagggctagggcagccttgtgggcttggacctgaaacctccggggcctgatgaatttccaaattcagaacatttgggactttgggaaggtaatgtggtgcaaataccaaatgtcacacaaccctccagtgtaatctgaagcagtgtttcattacttttgcagagaaatatgaatatttaaggaagtccagagtcaacttttgcccccacataaaatttggcaccaaatttacaaaagtaaaattggctttcagagcttcttggactttaaattacagataagggatgtggacctggaattattaagggagggatctttaactctttatggagttgcaacacccagcactggtttgtcagattttaatgaccccaaattgcgtcactgaattccccaccctccctccaggctgggtgatatatcttgatgtttaatcagactgaggcaaaatgaattttgtttgcatcatctgatgtcccttctccctgcagattactggagataccttggcgtgttgcaaaaatcgcggttaggacttacttcagtttcactattcacgactgcagaacagatcttacatttactcaaagacacaaacaagtatgtcaaggagatgggagttggactgtggaagactggggatagcaagaggcagcctctggccagagtgccctcagtgcacgtgcatttgagccccactcagatctgcagagctgggagtgtggtttcatggggaggagggatgtggatggaggccagttggaataagaacaaaaaaaagcctggaatctgatccttgaggcaggctgtgcagcacagagggaagagggcagctgtggagaaatagaccaaggaggcacatgatgttgttttgacaaatatggagagggtagagaagggggaatcaaacctgccttggagaaggctggattaagcccctactgggtctgatatgctttctatcttaaggataagctttagcttaggcagtcgtgagcaccaggcaattgcagaggcagtgaactcaccatcttccctttctgaggggttgggcctatgaagaggatctgggcagctccctctaaagtggggccttggggaagcccccactatccccacctgtggcctctctcacccctggtagactgaaccctccgaagtgcagtacttccagcacccagggcctgaagatagatggcacagggcgggggacacaggggccttaccctggggccttggcaggggacaggccctggggctgggctcaaggccaagttcaagaaagctcagactttggatcacttgggtccaaatcccagttctgccaccttttccgcggggcaagcgatttaccctttccaggcttcagtctgtaaaatggagatactagcatacctatctcatggggctgctgtgaggattaaatgagatgaggtaacagcgcttggcatagggcctggtacacaattatgctccattgatattagctgtcactctcaggaaagttcccgaaacccagaacaccagtaacccaatggaatgaatttagtcagcctcggctcagcatccaggctcctctctgacccccaggggtggacggtgacttggagagaaagggcaggggagagctcagtccctctggggctgcgtgctcacggacagtcccttaggggcgttaaggaagacttttgccaggtggctgaggagcagccaaggcagcagacacaggttggtgactccagaaggaagtagagccgccaagccaggctgtggtttcctgagtgcccctgaccgtgggtaggggagaatgttgtcttctcttccctctaagcacggccagctgaacttctaggagttacatggatgctgaataacaaatgcaaccacaggacgactttaggtgggcagagaggagggggaaggaggagctaagttccacctgcagccagcgtggatctgaccccacctgcttgcagcaggctcaggggtgcctgacatttcaagactcaggcagagggcttactgatacacagtgacaatgaacagggcggaaagcgtgtacatgagtggccaggaaggaaagctggtcctgcatagtcatggcgcacagagcacgcatcctgaggggatacctcccctctctcctctcgtttccgtccttcttctgcaccactgactctcactcctaaagcctccaaaaagaatctttgcagaaacccaagattccttttggtttgaacttccaaggctacactagcccactcagtagggcataacctttaattactgctgtctcaattagctctgcaaattaaattctttatatttgaaccatgacttttcatggaaaacaaaaaggaacaaaccaggttagtgaggccaagagaatttccgattctgatcaaagttacatctgctccatttacaactagagtcaggagaggcagagacagcaagtgagccttttcctagtctcagaatcactcattaacattttcaaaaagtaattattatattactaaaatacatgacctccaccccaaaatcagatccaccacatattttcaaggaagggcctgtcaccttggacttacaggtcttctccctcacttccctgcattcctctctcgttttgagagtaaggcttgcgggaaagcaatactgctgtctgtgttctcagagaaattttgtcttttactaattctggcgagaaacatcacagattttatttcaaaggttagtcctgctaaaatgcaagaacagaagcctctagaggaatctctgtgttgtccaccagtcaaatgataagtaaggaagtgcctccacttgccagataaaggactggggaccaggcagatttcaaagagcccgtgggtcagagccggggcctgccctgtgcgtattctctggcagacaaggaaatgttttcctgaatgagcattcttattttgtatttaaacatgatggtacatacaagcttagttttaccattctttctaaattaagctgcaaagagctgtttggtttcgggaaactttttcttagctgttttgtgtggaactatgattagacaccgtgtaacatgcattttgaaaattcggggaccgatatctcagtgttgaaaatgttttgttttaacctctctaaattgccaggaaatgaaaccacatgggctgttgaatttgggaaacacaggcttagaacttggtattaatcttaccaagaatcaaaaaaaagtttttttttcagtttctttttcggtttctaagggccattagtgatcctccacctcaaagctatttttctttttcaaaaagcggaaatttaaaatgagctgcttgttaaatgctaaccttttaaatgtcaacattttttttctattaaaagttaaagaataagtgagacgacactttcaaatgaaggtgactttacattgttcccctggaggaatgagccatcagttagtgtggtcaaccccaaaacttacggggatgcacaaggccgcctacttaagatgcatcagtagtagagatcaatagatacaatttttttcattgcttagtaactggcttatgaaagctgaagaggcaatcattttcagaaacctcctgtcaagttttttgttttgttttttgtttgttttgtcttaacatatctgaagagaaacaaggaaacttgctgaagttaggacacccaaaatgagcccttttaaaaatgaagtgcacaaattattttatgctaagttaattaagacaacctacttatttgtcactgtaaagcaaggcaaggaatctcattgcgcttttcaaagaacgtaagaggacagaaataaatcattgtgtcgtgctgctttaagctgtatctccttatgaatacctacaaacccaaaacacagaacaccatatggagcgagcagtccagttttgcgcacacaacaaacatgaaagagaagtgctgtcgctctactactactatgtccccaggtgaaaagttcgcaaaatgtaaacaagatctagagcagatgaaactcacggtagacttgctccattcagctgtggccctaacacctacagccagcactgtcactgagtgcaggagtggatggtgcagagcgccaaggggaatcaaagacgtgacccttccatccaggtgagcaaaggatgagtactcagagggctggactgcaccctcccctccccatcctgtgcttctgactctcagatccacttctgactctcacttccagcttctgactctcagatccactcatggtcccatatcgtggatttatggaatcctttcccgagtctatttgtacttttagcctgttctgtcccttagggattgacaaatcccacgatctgggcctgccctgtaaaacaactatgtggggcctgacctggctgctttttagcttgaaggggatagcagagggtagaatgctggttacatttaaagcaccctgctcccagatccaaaagaaagtttctgctttttcctaaggagttgaaacagtctgggattttatctgattttgttattttgcctacaatgacaaacactgcttttgtttgttttatcatgttgtgttttttgctagatgagtgtttatcatgccggctgcacccatccaaagcagtaaggttgttgaaagccaaaagcagcagaaaggcccaaagagatcaccccacctcacccacaggctcacctctgcaggtgtcttcagacagctgactcttaactctcatctcagcaacagtttctaagatagagagtggaataaagagtcagcattcatccatttcttcgatgttttctcctttaccccatgtgaaccaagtttcttggtaacgtgcagctaggactcacacagacgaaaagcacagagccacaggccttggctgggttattggagctaggtgcacaggaaaaataaaagtgggtgctccaggacattatatatatagtcctgggctaaaggtggccttcagggcctgaaagatggatagctgtacctcactaggaattatcccacctcttgctttgcttgtgggagctttcagtttgcagctaaaggctcaggttccggccagctttttcccctgtagcatgctaccaaatccggccatcttccagttttgagcagaggaggtgagcgtagctgtggagacacatattcttctgcaggcccatgtcggggtggcccatgaagagaatttgccaaagccagctggctcagcagaccaacagatgaaggtggactactcatttgcaattgtgattaatgatcatttatttccatgtgacaaagctttgaacgatgtgggaggccctcacccatccctgagtgggaataactgggaatgattccatgaccctttccctttatctggcaatcctttcaaagatgagctctggaaaatgtgaacagacaatgcactccactatagctttctagtttcacatcttcaaacaccaaaatgttgacacccattgggatggttattataaacacatacacacagagagagaaaataacaagtgatggtgaggatgtggagaaattggaacccttgtgcattgttggtgggaatgtgaaatagtgcagccactgtggaaaaaagtacggcagttcctcaaaaaattacacagagaaataccgtatgatccagtgattccacttctgggtatatgcctaaaagaatcgaaagcaaggctggacacagtggctcacacctgtaatcgcagcactttgagaagccgaggtgggaggatcgcttgaggccaggagttcaatgccagcctgggcaacatagtgagatcccacctttacaaaaaattacaaaaattaaccaggcatggtggcgttgcctgcagtttcagctactccggaggctgaggtgggaggattgcttgagaccaggaggttgaagctgcagtgagctgtgatcactgccctgcactccagcctgggtgacatagagagaccccatctcaaaaaataaaaaaaaagaaagaaagaaagagagaaagaaagaaagaaaaagaaagagagaaagaaagaaagaaagagagacagagacagagacagagaaagtaagaaagaaagaaaaaagaaagaaagaaagaaaaaagaaagaaagaaagaaagaaagaaagaaagaaagaaagaaagaaagaaagaaagaaagaattgaaagcaggggctcaaccagttatctgttcatagcagttttgttcacaatagtcaaaagagagagacaacccaaatgtccatcagctggtaaataaatttaaaaaatgcagcatgcccatacaatagaatattattcagccttaaaaaggaaggaaattctgacatgtgctataacatggatgatcactgaaggcattaagctaagtgaaacaagccagccaccaaaggacaaatattgtatcattccactcatgtgaggtccctagagtagtccaattcatggagaaaggcagatagaactgtgagtgacaggggctaggggagggaggaaattaggagtgcatgtttaatggggacagagtttcagtacaggaaaatgaaaaagttctggagatggatggtggtgatagttgcacaacactgtgagtgcacttaatgccactgaattgcacacttaaaaattgttaaaatggtacattttatacatatttttaccacaatgaaaaagtaaaggctgcaattttaaaacacttgctagtcctctcctaatcaaaagcagtcttttcttttgcaataatattagtgtacaatctaaaagaagcagcaagctgaactgctcattttccatccctggtaagagcagtatttactgcacatccactcatcatgttgtatgggccatctgggttttttgtatgtcttactgaggtgcatgtttgttaaatgcacaggcataaccagaaataactttcctggaaaattgagcataatggctgtccctctcttgacattttggagaaatgataatacgtaggtgggggaaacaaagaagtgactgtaaacaagaacggacattatctctgcttctgaatgagatgagaaacccacttgcttcattagctctctggtatatctgcaagtctggaaacaccgggatgactcacagtttgctgagtaatacaggagccgacagaatgctgctagtgactcgccatctctgactggctttctgtgcaaactgtcactctagagcaagtgctaggccttggaatagagttctgaaaaaggttacggttctcaactacagggagaaccagctcctaaggccttgacactggtacacaaagtaggacacctctgaccaatgccaaaatgacttttagaaagttcacacctggtcattgtgtccctgctcatgctccagctcacaagatctctggtttctgcctttcagggtgtggtgatgtccacttcttcatcagagttctttgtgacttgtctgcttctccacttggtagtaaactcctcaggcataggaagacgtcttcgctagctctgtaatgtaagctgaatgatccttggaatgaatgagtagaatatagaggggaatgaaccaatgaatgagctgtatctgctagccattgcggaatgctaagttttggaaactgttttgagcattttagaggaagtattgatagacactctcagtcttcaaggcttggaggccgatgaacccatattcttgcactgggcagaaaggagaactttgcatctgcatgtagggcccatttacccactgaccatgatgcatttctctggtccagttaagctccttatccttctatagcacttgtgcaatgtctgaaaacatgtgatttcttcaacttccaacaagtacacaattttataccgccagtggtaatttgtcctggtggttctgttgtttctgctgttgttgttgttgtcgtcatttaatgcaatttacaaggacaaaacaaaacttctggctgccatttcacataccacagtgacagcttcacatggtaagaaaagccaaaaacagctagtttcgaaattcaggccactcattttattacttttccctgattaagattcattcataccactttggggtggtgctgatattcctaacataagccaatcgattttggtcagttctgagagcagtgagtggtcttcacttacacacagtgtgtttgtaactctgctatttctttatgactagcacagtataaagtgaacgtttttggaaggctgttaagcatatgttctcctggtaggcttaaatgtgacttataaaaatacttgatagtatatgaacaagctcccactactggtttaaaccaaaaaaaagaggtttattttactagctcataagcacagattctacattctttgtgagaattatctttttaggtttttgtttttatttgttcttatcattttgatagccattttaatcatttcttttattcttttgtttgctttgttgacttttaatttggaaatgtctgctttggcagaataattacatcacaaggaggccctttccccacccacctacccagaaaggtctcctgactcccttatgctctatgaattgccctagttcaagattgatacagatcaaagcagcagaatggggttgaaagagcagcctctggcaatggccttgaccatgtcaattccctgtgcattcatatagatctggaatcatgtagatctattctgcccagcttgttccacagcagctggtgggcagaaccactcttccaagccgtgtagttattctgcactgcaagaggcaagattacaaccgaggactcattcattaataaaattgtttaagttggctttctgaatgacaacgtggtctcaggaacttaaaagacttcaccaagtccctgctgcaaacaaaaagtctgcattgtgatttgtcagagctagattgacatccagtttagagtttagaatccttctccatgccccacttttgagacaaattacaaatcttgaggttcatcaacattctagtacaatatgaccccccaaggtttaagagccctttagagatttgaagacaactgtgatgttcccactaactctccctccttcccccagttctttgcccctatcttggctgctggcctctgaactcatcacagagcactggagtgagggcctctgggtaagtaaggctctgctaaactgatcaaatgctccacgtacatttgtcccagtagagaggaaagctcctcttttccaaacaatctactttattcctgctcccctacatcccacttgcaagggtagcagccacatcccccatctgtcctgcccgagctcattgtccaagccaactccagctcagaaatttcccccagagaagaggttcctgaaggctaagcattgctctgtaaccctgaacttgatttgtgtctatttctcactctctcattatataaagtttttcaaataatattagactaggaattgagaaagagaatgagcgctcacaattgtttctagagccatcacaatcctacccagcaacaccttttacgggcttttaatttttttgtttacagttattacctttgaaaccaaatcttgactttctggtatgctcttggactttttaagggatttaaaaattcaggagtttgatgccaataattgcttttatgagctagcattgcttcttttctatagatgaatcccattttaaatcatcaattattttcttcacagaaacccacaaagtacatattctagtttgcatcagaattgaatatgacccagaaattcttaatgttattaagctagactattgtatctaaaatgtgtatcacattcaactaatgcatattgaagatcttgagtaccacacttgagatctgaatgaagagcccaggattgtgatatttgatccatactgaatgtatttgctagagtgcattgtacagatggttcaggtgtgttagatttgtctctgtaaatgaattggtcagtagataaaagaacatgactcaaggctgagcagggttcagcaggccccaagcttcatcattaaaaatcgggtgttttttaatatgaggctggctgtgtaaagcagacctcatgaactcaggggtctgagaggccaggccagattatcagttgggatgttttcagtcccaattagcagacagcgcagttcacactggcttaaacaataaaggggacttactgattcctgaaagttaaagtccagcggttgggtggacttcagggttggtttgaatcaacagttcctcagtgtcatcaaagatgctgtttctttctggctgtctactctgccttcagtggcatgagcctcatcctaaggctggctcccccttgtgggcacaagatagtgccagcaactccagaggctacaaatttcctcctgccccattcagagagcaggagaatggcttctagaatctctgtcagaagagccaggaagcttctttcccagaagcccccccagatttcatgctttttagtctgaatggatccaacgcctactagcctactgtgctgcttcatgtcagctgtgtcccccgctagaaccttgtgtggagccaggttcctcctaagcacagaggtggtatgggccaaacgaagctgcctaaatgaaaatggggaaaggtgtcaagagaaggaagacttagtgctggcaaccaacagtatttgttgcaatcaatctcttggccatcctcattcatacacaccttccttcccacgcatacacctcccaaaatgcccacacttagggaaaacctatttacccctttcccaaagggatccaactccaatccggaaaccctaggtgatgtgtcatcctctgaatttggtcagtatatagctcttcatgtttcagggaccactggtcaccatgctcaccttggcatagaaagtaagagtgcaataaaaagaaaaaaaaatttcaattgggaaagaggaagttggaaagcagcacacggtggtcactgatccatcatccatatcacatcctgctggacagcagtagcaaggcttgaccaggggtcagactcagtttcctattctgtataatgagaggattggattaaattagtggttctcacattggaatgtggcctggagagcttgttaaaatgcagattactgggttccatccccagagtttctgactccacagatacaggtggggccctggaatttgcatttgtaatagatttccaggggctgctgctgctgctgctgctgctagtacaaggacacccctgcccttccactttgagaacctctgatttagattatccttatgggcccttctgattctgacatttaggactcagggatttttcttagctatctcttctgctctatactgacttatgatggattgttttataaatgggacacacccaactctactgtgtgaacaacttaaaaacatatcatggaattcctgctttggtttgtaatctaattttcaacaattgaggctgaaaatgaaggacaccttacagcttcaggaaagtaaattttctggaattgaagaaattagaaacagaaagataaaggctttcccatcctccccaaccccatctactacagcacagcggtctgtgggatgattccacgtgactgcagaaagcagctcttttcccaaggacatccaacattttgcaagcattctccctatgtgacccgggtattcattgggtcttagaataggagtagcactgggtgaagctgtgacatagatcaagttggtttaggaattttgccaactttcttccccagggcccctcacctggccaacatctattcatcctcaggtcacagcttaaacctcatgtcctccaaggagcctcctctaaccaacgccccaccccagcctaagtcaggttctcctgttctttgttctctagtgtcctacaatgttcctttatagcacttaccagcctttgttaaaaatcctcactgacgtgctccaccatctgccttgtccatcaatgttttcacaacacaggtcctggatcactgtaaatgctcagtaaatgtgtgttgcacaagtgctatcaaaggcagactgggagcagattccagtcacagtattttattacagtggtgaactatcaagcaatctatataacacatcccacagtgtatgattatgcatgctccaaaggaatgaaacataagtcttcagaagacacaaacacacagctggagagtcccagtgtccctggcatctacagccaactttttcatggccctcccccttctctctgggaagctggtgccttccagtgcccaaggtatctctctaccaggcaccctgggcattggcccagctccctcttcccccatgcccatttgggttgttgattgacacttaggtgaagacaatagaagaccctccagcttacagagtgcccaactcagcagggcctggagagctaatctgggtcaacaccacatttttcccctgagaaagtgggagtccagcaaggctgtaaaatgatgagctccaaataacagcctgagtctcctgacttctggctgcatcttgaatgcatctgcaggcagcttcaaatgtgagaataagatatgaacttatgacactctatagtttatcaccattgctataattctctgccactaaatataattttaccattaaatcaaaccaaaccaaacacttaaaataatttctttagagaagccagattatttattacaaataacgtctacaaactgactaaaagtatatcccacatatattgaatttgaagactgtgcctaagtttaaggtaattgatggattccattctcattagatattcacacatcaaaaaagttgtctgctttcccaggcacagtggtaggttatgcttatgctcatcgtttttcttcccagagctggctcttcctttgaaacagacccatataagccacccatttgctgggtcgcaagcccttcatgagggagagagaagtatggtgggacaccagcaccttctctacagaaacgagcagcatgtttgctaagggctgctggactttggcaggtagagaccatcagaggactcaactgaatccccttttatcaggaaccctaggagagtagagttgtcaggagtttccccatgacttacattgtcttttttaaaacaaccaattcatgactgaggtgaagaaggaaaataacagaaaaatatatctagcccaagaaatctacagaataacaataaaactcaggcagaaatgaacccactgatctgtgagccaagtgcttaagggaggggttggggcacttctcatgtggctcactgtcttagtcagttcaggctgctatgacaaaataccataggctgggtggcttagagacaatggaaatgcattatgcatagttctggaggctgggaacttcaagatcaagacactggcagattcagtgtctggtgagagctctcttcctgattagtagatggtgccttcttgctgcattctcatgtgatggaagagtcaaggtagcttccttgggcttcttcttataagggcactaatctcattcaggagagctccaccccatcatctaatcacctcctcaaggtcttgcctcctaatgacatcatattgtgggttaggtttcaacatatgaatttggggggacacaaatactaggtaggtgcaaaagtaattgcggtttttaccattaaaagtaatggcaaaaaccgcaattacttttgcaccagcctaatattataccacagctctctctgtggttgttcactggggcagtgggggtgtggcagaggggtgagggaaaaagggttccctcgatgtttgtggtagaaagaagagctaggtaaccaagtactcctttttgtctgcttaggtctgccaaaagtcaggcacccgtatcgggttagacattcaaggaatgtactgggggaaatgcctgtgaaagataaacagggaagagcaagagaaggtggggagagactcagaccacaatgcaggtggtctgtgacaattggggcgagaaagaggattgggtaagaagagtctcagacagtagcacagttcaggaaaagttcaaccaggccaatagagagtccttgagccaaagtcacctactggaggagtcctgctcctcacagaaatgggcctgcattactatgctcaccatgttcagtcattggccgggagtacagcccaggccaagtgcagcaaaaatgatggatctaagggggaggctgctggaggcaattatgtttcccatggcaggagatgtcagcagccactggtatggtcaccacatccttccattggtagttgtgggtgggaaggcagagtccctggcaggcagtagacagctacaggaacagaaactggtggtagaattagactgactactttggataacaaagccaaggctggcttgactggctgatagctagactatttctttgttactttgtcactcagtgtttagattgttgtttttccccctttccattgtttgtcaaattccccatctgaacccaggtctggaaaaataaaaccctatgcatttggaagaactttaaaatgaattagcttttaggctttagttgccatcataagcatctagagatattcaggcctcggagttggggcagactggagaaactaaggttatttgagaaataagcacactgaatatttggcttcctaattattctacaaggagtctaagttttgcctgcctggtgcctatgaatcactatttcttaattttcttagtttcacagaatcagaggacatgaatactgaaagatattggaggttgtctagttcgactacatcattgtagggaaactgtggccataaaaggggaaggtacaccaatattccttatgaatcaagacataaaaatcttcaacaaaatactagcaaactcaacccagcaacatttgtataaaggattatacaccatgaccaagtgagatttatccctggaatacaaggctggttcagtctatgaaaagcaatcaatgtaacacactatattaacagaataaaggacaaaaaatgcatgatcatctcaatagatgtaaaaaggaaagggactttctcaagttcacacggctaatggcaaagctgagattaaaactcaggtcatctgacttgtaggccagagttctttatactggtgagggtaggggtggagggctgaaccggaccttgcaagactgtccactgcactgaatcctgtactgagggatttctgtttgttttttcatcctgtcctcacaacacccccaagcagtgggctccgttgttattccccctccttttgcatgaggaaactgaggcttagagaggtaacactggttgtctgaggtcatacagctgccaagtatatgaggagctaagcctagatttcaggtctcctgccttgtctctgatattttccagtgcccgccactgctctcctcactcaacagtgccacaggattaacctggttccattggttctcagatcacctactgccaagcacagtggatgggctttttgttgtaagtggatgggagtgccctccaaattctctggaagaatagcctcctctcttgtgccagtgtgtgacaattctcagagccccagctgttgacctcactgtaatctgggctaagtggccatttatatacactaatgactagaaggtcttttcaaggaatggaggaccacaaagaagcaggcagctctggggaagccagaagctgaatggctgggaggtggggcaggggcaggggacagtggggataagatagaaacaaggctgttctttgctccttgagaagctgggtaacaagctggcttggcttctggtggagtctggcccagtgatagctcttgcctcctgatgggacaaaaaaggggagacaggcatctcagagaatgaggtggagagagacacaactgggccaggacccagaaaagagagttacctttttcgtctcagacctgggcatcccagatggaaccgtgctgagcttctggttagtctagcttcctccaggtgtgcaacacaggggtcctgctagggagccttcccagttgagattaaggaggttgctttcaaaatggccagctgcccaagattgcacctctgtcactgttgaggacagtgggggtaaacatgcctgatgttctgccctggaagggctccagagcctttggattgaagccacaaaggaggcctggcatttggctaccattccttcatctggttcactatcaaggatccctcatctcacccattctgctcccccgttctaatgtgggcttccataagcctctgtcccatcttccaaaatgcagtctggagagcgaggcaccaaggctgcaggccatttgcagggcacagccctggaggctaaagtggaggtgcagtggctttcctaacactggtctgcatgttgaactcagaaatacacggtacccttttcagcaagaatcaaagcaaggttgaaacaggccagcaacgtatgggacactttcttctcttccctttcgtgaaatttgcttctcggatagatctgttttcaccaggaaatgaatcaaagccgcatactctgccttccatccttctcttctcttctctcttcaggtctttcagaccagggaaagtggctgcctttgggatagtcacaacaaggtgccctggactgaaaattgagagtgatgagttacactctgccctggcttggggcaaggccctttcctgccatgagtttcagtgtccccacctaccaagtggggagttggtgtcagacaatgtttcttagtgggtggcattccaggagtccacacacaaaggctaagtccctgcaaaacagtgcagatagatgctttctgtaggtcttgctgactctcatactctctgtctttaactcgcttggcaattcttgagcaaaccattgggcctcttcatctacagagaatgatgacctgactaggtgatctctcatttctcctcaagttacaaaagcgttagggtggtaaggagaggaggtggccccaggaaaaccagatgggtcagaagaagacagaaggtggagccttcagtgacaggagagcagagaatgatgtccccctcccataaatgtagggaaggaaggataccagaaaggttaccatgaaagagaggagtaataggaaagtacaggtcatttgtagttgaaatacatacttgagtgtctgtgtggaccaaatctggggtgggaaggcaggcttcaaatcctgaacctcggaagggtcggcattcctgacaagagctcagagagccaacaccagacaaactctaagtcccctgaagagagtgtgctgagctaggtacttgcagccttgaacccaccctaatcccctctgcctggagcacgtccagaaggagcgtggtttgctgcagaaaagacaagtcagttagaccaaaattccaaagcaactttttaagcctataaatgatgatgattttatataaacttgagttgttccttcaacatagcaccatattttctacttatgtgattctggttttctctaaaggaaatctttttttggaatccacaccatacatacggaagagtatataaaacatataataataaaaccaacagtcatgtacccaccaaccaggttcagaaatagaacattcagaatgttttagaagccccttgtgtgcccctccctcttcccagagataacaactatcctggcttccaagagccaaccctagaaatagaccctaggctctggcaagctttgtgctcatcctagtgagatcatgcacgtcaccaatctctttaggtagtattctgtgcggatttccacagatggctcatctgttttgtgttgatccttattagtttcaattttgtctttttaaatatattttatgactttctgattataagagtaatatgtgctctttgtagtaaacttggaaaatgcagaaaagtggagagaaaacacaaacctcatggcataatacaatatataaacatttaatatataaataatccagaaacaactactgtgtgaacacattggagtgcagtatttcagtcatttttttttctatgtagaaatatatgtttcacattactggtatcaagttgtgtatataccttttccctttattgtggaatataacattgatgcagaaaagtgtgcaaggcctatatgtacagtttaataaggaagtaaaaaatgggccgggcgcggtggctcaagcctgtaatcccagcactttgggaggccaaggagggcggatcacgagatcagaagttcgagaccagcctggccaagatggtgaaacccagtctctactaaaaatacaaaaattagctggtcgtggtggtgcctgcctgtaatcccagctactggggaggctgaggcaggagaacagcttgaacccaggaggcggaggttgcagtgagccgagatcataccactgcactccagcctgggagacagagcaagactccgtctcaaaaacaaacaaacaaaaagaagtaaaaaattaaaacctgctgtcaacactgatcaggtcaagaaatagaatattgacaacccccaagtagatcctcatgtgaccttcctgatccaagataattattctgcttttctacatagcttcatcacttattaatagacttaaacttgtaattgcttcattttcaaaaccttagtggcggggccgggtacggtggcttacacctgtaatcccagcactttgggaggctgaggcaggcagatcgcttgagcccagagtttgagaccaacctgggcaacatggggaaaccctgtctctactaaaaacgcaaaaattagctgggagtggtggtacaagcctgtagtcccagctacctgggaagctgaggtggcaggatcacctgagcccgccagggaggtggaggtttcagtgagccgtgattgcactactgcactccagcctgggtgaccagagtgataccctgcctcaatacaaaacaaacaaacaaacaaacaaacaaaaaccttggccgggtgtggtggctcacaccagtaatcccagcactttgggagaccaaggtaggcagatcacctgaggtcaggagttcaagaccagcctggccaacatggcgaaatcctgtctctactaaaaatacaaaaattagccaggcatggtggcatgtgcctgtaatcctagctactcaggaggctgaggcaggagaatcccttcaacctaggaggtgaaggttgtggtgagctgagattgtgccactacactccagcctgggcgacagagtgagattccgtctcaaaacaaacaaacaaacaaacaaacaaacaaacaacagcaacagcaaaaaaccttagtggaagacacaatctaagcatttaagggaagagtcccaggccattagtagatgaaggctttcagaagaagagaggttgacctgtcctggtcattatctgccttcagcttcccgggaatgtgtagagcccaccaccatcaggacactagcagagttgtggacatggtattggatatgcagaagaaatatggccaaagagattggactgccctctgtgttttgctttcaagctcaccacagcctgcctccagtacctccagttcccaggtgtagggcaacacagaacatccctgtggggtgaagtgagtggcctccactgatctggccagcaggaccaggaaagcagagcaggaaattcaccagacaaagggtcaagccagacctcttccagggtgggggacaggcagatgcctggggacacagagtcagagaggggattcagagatctgcctgctccttaaccagcttccagcccaaccccattacgctgaccatgtccccccattccactttacctcccagatctgggaacatctagagctcctcctcctgaggcttgggaagattctgccgtatagaccacgatcctttccagttttctcctctgctgtcttgtgattcagcttccttggtgctgtgtagtcagttaatcctggtctatctgcattttagtttcataaattatgatgctgttatctcctctcctattctctctatcctggtgggattttgtctttaaaaacaaaacaaaacacaaactcttactgtagttttaatgagactctgggaggaagagaatttagatgcttgcattaaactgctgtctaattccagaagtctccaaaggaaatcctgccactcccttcttcggttgcccgaacatgacggttagttggatggctcccttggaagcccaaggtgccatcagggagatactgagagaatttgaggctgggaaggcaggtgggggttggggtgagggttatgttttgaatattgcttcatattgaagcatttgtagtatttgcggttaagagcctggattttcatgtaagtcaactccaggttcagcttccagctctgccagttacatatggtgtgactttgagcaagttactttgcttttctgaaccttattttccccacctgttaagtggggatcataatggtacccatctttcaggcttgccatgggtattgaatgtttcacttagtaaacatttacagcgtttcactcagtgcctggcacattgtatgtgttcaatacatggtagctattgtcatcatcattatcgtcatcatcatgagaaaatagaaaccttccagaaactgtcagggcaacgattgccacaggccgttgttggctactaaaactctagactctggagagccttgatgcccttcctcttttaccccgtccctgatgctcccccaagtagcatgatgcccagtggcccaccaacctcattatccagcattgctgacaacaggcacagccttggtcactgtgaaaatgccccacagcctcaacctcagaagtgggaagtatactgcagattcactctatgccaagcactatgggatatccacaggaatgtgccacagtgaggtaactgcccaggggatagtaattccttcatttctttatacattatggattctaccattttgttattgggttatttttccccttgtcaaagtagcaatttatcagttgaacttaattctctaattaaatttcaaatctgagaatttacatgatgaagtgaatttgattttggacccagtcaatttcagtcagccctaaacatattttgaaatgttaaagttaaattatatacgtttgtggaggaaaaactccaggaaagcctaaatttttccaggtcttgcttaggggataccctgctccaagaaaacttttacaaaatgcaaatttacagaacagatccaccaaatgggtgggattggtgctaccctagagttttctgtagaatttcttttttaaaaaatttttttcttttttttcttttttttttttttttttgagatggagtctcactttgtcgcccaggctggagtgcagtggcgtgatcttggctcattgcaaactccacctcctgggttcaagtgattctcgtgcctcagcctcccaagtagctgggactacaggcacgcaccaccatgcccggctaactttttgtatttttagtagagacggggtttcaccatgtcagccaggctggtctcgaactcctgtcttcaggtgatccacccacctcagcctcccaaaatgctgggattacaggtatgagccactgcgcccagccagaatttctttagtgagacttatctacccccctccacccaccataccacacgtatcataacagaggtcccccaacttggagttctcctcatttcaaggtacagttattataaaaagaagaggacacctgggtctcacagcagccagctctgcggccattgcacagtagaacctcagtggccttacaaaatattcttgctgttagtctacttactgcaataacaaaagtttcacttgggcactttgatcacacaaagcttggcacaggctttgaaatcagacaatacctaggttctagtctaggctctggcacttaactaatgggtgatcatgggcaggtcgcttaacctttttgtgcctcagtttccttatctttacaatgggattataatagtacctccttcataggattgtcctgaggattcattaattgaaatgaccctaggaaagggtcagtgccttacactgagtaagttctcagtaaatatttataatatcatcatcatcatcaattattattattattaatttactttaccaaaacacaggtcctgctgagccatgttggccagaccacacctagaacagcatgtccagttttaggctaatctgtgtaaaattcagtgcctggaccattgaaaggggctcgatatatggtggaggtattattgttaattaatgctgctgctaaccttcctggagtgcatacaacatgccaggcactgcatacgtgctaattctattagtcctcttaacctttaccactctatgaataatatacaattattaatcccttttgcagatgagaaaattaaggcacagaaacgttaagtaactctcccacaattacaaagcatggaagtggcaaacccataattcaagtctagactctctttttccagagcctggactcttagccaccatgccaaagagctgtgctgtccactgctgtagccagcagtcacatgtaactatttaaattaataaaaaatttaaaaaacaagaattcagttcttcatttttactagccacatttcaagtgctacacacttcatgtggccagtggctaccatattgaacagcacagctctagagcattctattctttctgggatgattcagcatcaactcaggaagttctgttggatggtgatgcttacagagattctgtttcttacaaaatctcagacttcagttgtacagctttcttgcattgttattaatagatgcatacttatgatatattgaaatcccatttgcacttggccaagtagggtaatggcaagaaaaaagccaagaagcgtgacttacattacgttttcctgtttccccggtgcattatttcaaattcacaaagttgtctcctatcacctctctttgatatggggcaggaggcattcatcaacttgcccaaaaatccaggttcttccacatgtctgccttcacctctttgggctatctggataatatttagtgctctagcatagtaacctcacaagtgacttgaacaacggaggttggcttctgaagtcagtgagccacagaggaccttggactctgagcatctttgacacactcatcaagtctccagttcgctttcttgggttttctctgctcatttctgttacatggttagtaaaggccagggaaagaaaaggtgttgaggatccattaccttaattccagaatgattaagtcaagaaacctacaagctctcagaagccagtggaattagagtgcactactataaccttgcaaatgtgcatatgcctccttccgaatcaccagagtggagattgggccaatatccaatctagtcaataatttataaagccagagcattcatccacttcttgcaaagcagctgaatatctatgggggttagtcataatctgagctccttgcaccagagccatttgagctacagaatagcacagagtgtcacagaatagccaaaagtgcagagttatttcagtatgagagaaggaggagcacctgactgctcctcgccatgtgcagaggaggagcccatgcatttccaaacccaggggttgcttggtttctagcttggtttctgtctgtaccccatcttgctattgtgtgacttgagtaagcccatctccacttcctcatcttattagctaggaacaatctatctcaaattcacatgtgcacagagttcagtgcccagcacactaaagcatgttcagtaaatatgttagctgatgttattttcaccatatgattatgatcactctctgttctactgatgggttttataaacccaccagcattgaaaagagatgagtagatgtgctaaaatgagagtaaaggctcagtttatcattggtgtttatcccaaaaaaaagactagcacaatgctcaccagattataatctcccaagtgcctagaacatcatgccaagctagtaacatagtaaagtttattgaattttgcaagtatttgctgagccctttgcctgggctagatactgtcggggcaccagagggatttagagatgattaagacttggcccagcaagaatgttcagtcagccaagggtattcagccacaggagctggacctggaaagagaggcagaatttccagggtggaggagcttcatctcgaaagacacacagaattcccagagtacaatcatggagaaagggcattccaggcttggcaaaccaaggagcacaagcacagagggccgaccacacatggcagcctgtctggagagctccaaggagattggtatgactgggggtacgtgacattatggaacgcaaaacctggctgctgagagggtggatgtgcttgcacttgcatctctagtcttggtgcgagccattggaggatttttcaggggaagggaaactgggctgacctggttccagcaaactctctgacaatcatgagaagcccagggtccagggggatgagtaagtgtgacctccaggaaacggggcaccactatcagactctatctgtcccatggcttacttctgtgagattcgaaatagtgtagaccttgtcagtccatgagctagtaattatgcccaccaattactgatttatttgcctttctgagatgtgcagtgatcccaaggacaaagatggatttaccttatgtttagaaacttctagaagttgaaatgttcctaacaacctttcctgtggaggttgtacctcacacgtagagtgtgtgataagcatttcttttcctaattaaataaaatggagaaaagacacaagcatcagctataaagctcccagtcagtcacagtcaagagactgaatctcatctcttttatttattttttgtgttaactggggattgcattggtctgcacagtgcttgctcccatcctgctccacttgattgagtggctccaggccccctcttgattgctgctgaaatagaactgcccacactgtcggggtatcttccgccgctggtcatttccatgtgccatctgcagttttttctgcctgatggactactgaggcactgcgtatgttatgctgatggggggtcctgtttcttgacccatcactaatatcttgcaagtcacaggaagctaccagggattcctgagcaaaagcttaaaatgcttcagttctctacaaataagccccattcattgcttttagagtgtgttatcatggagcagacaagtaatcagaacctgagtaatatttgcatattgaggtcttcaaaactccagtgtggctataaaatggtatttaaagttatcaaggagctaggtatgcaggcagaaagaactgtccattgcagaaagcaatgcctctgctcatgtcccagataaccttgctccaaggacaaactggagcttgataacatgaagctgcagatggccggtgagctcagctctgtactcactaaccaccccatgggaggggcactgagccctctatggttggcataaatcccattagaatggtaaagaaatccttttcacaagtacatagaaatcgcttgctaagatttcatgggttttcttgactttgttgtttttgtttgggttttagagggtgggcatgagtcatctctaaaactgttcaggtagttaggttgtcttcttattcccatttttaagtatttataattagttcttaaaaatttgtccggaggtccacacctccccttggaaaaccttgcctgtacttttcttaatggcacattttaagtttctatgtttcaaaacttgcttatcatataacatgctaatgactaaacacatgcacacctccacaccaatgcaaacgacatgtgggcttgggaacgaggcaagcctgggtttgcatcctgctctgccactagtgggctgtatgattttgggcaacttagttaacctctctgggcctcattggcctcatttgtaaaataagggcaataatagtccctttctcatagatggctatttatacagatcgaataagaccaaatatttaaagaacctgggttagtgcctaaagcacagcaaatgctcaataaattcagtggtggcaatttttattgttatttcaaatattacatcaaaatatctactgaactattatccattgcaaagacttgcccacaataggtgcttagtaagtgtttattgcaataagttgaagtgattccaactatgtagcttagatttcgggtatgagtgtttccttctccactgggatgtttgctaatggacatagatgatcactcacagctcaggtattaaaagcaggagagtagaggtgttccttcatgtagaaagaagagcaacttctcatcaaggcaggcttccagctggtcctttggacaccactgttgctaagcacttggtgtgctcgtcagggtaccagggctcttagcagccacccatttgcgttttgcagcttttgctgacatggatatcaagtatgaagttattttaattgcctttggctgaaaaaaatgggtcatatgttcaatatgttcaattctggtgaaatccctgtcttctaaagcatgatagaaaggggaggtcccacccacacacaagtcctaaaatcttggggccctagtggggtatagttcaacaagggctgcagctcaggacgtggttgttgtgagatttactcgtgactgtttggttttgcactcaccatttggttttgcagattcctcagcgtgttcacacacacatacctacaaaccagtttagagttgtgtgctccattgtggggggtggtcactggggtggggtggggtagggtgggatcaggcttggtcaaagtcattgctgatgaaccagctatctgacttagctttgttcccattttcaacaagacagtgatttctcaagccaggggagtcttcacatgagatccatggatgggtattaagtggtccagaaaacccccccaaattagatgtaaaatgttggtgggctggaaagggggagacaccataagtgctttttctgtggagagaaaccatagcttataactggttctcaaagaagtctatgacccaagacaagctaagatcacaaagctgtttggtttcgttccaccaaagcagttggtgggtataaccacaacacccagatgacccagctagacactcagggcagtgacaagatcagtcagaaccattttgtggccaagcagctgatggattgttcaatcggttgttgtagactcatgtagacaaagcctgcaagcttggggaagccaggcacccccaggtcagcctcgggcgacagcccccgtcctgccaggccctggggagtgagtccttcctgcccggcagctcctttgctcatgagctggcccgagtcacctcctcgtacagcacctcagaggcagcgccctggggcagctgggatccgaaggcctggaggcaggtgcccgctccactactgcctagctgcgacgccacaggtaagtcacttccccctgagcctcgctttcctcatctgtcaacggggcacagtcccctgctcagcctgcccgcctgcctcacagggttgttgggaggaacacaggaggtgacagctccgaaggtaaagctctgtccacccatgagggacttctagtgcttcctgggcctgcttgttctctactttctgcccggcattctttggcaaagggacaacccaagcaagcagagtgctccaggtgcctcagccccacctccagggaaatgagtgggggattgaccagggtgcagctgctctctccctcagctgtatgccttccagtaccccgtttccatacctacctgcctgtctgtccctgaggccagactgggaacctgagggggacaggggctgtgcttctgcacctccgaagccctgcacctgatacctgcctgcttggcacctagtgggtgctcgggaactgcctctcctgccagccatctgctgtggattccaaaccccgcccaggactcccacaccctagaggcaggaagttggattgccctgctggaggactggcagtctgggtagtacaggcagaaggaatccaaagcaagcttgtccaagaggcctgtgagttgggatcatcctctagattctagagtctagaaggaatggcttgacttgcccccagagtcgcatcagtggtcatgagagcaagcggatggacaccagccagaggggacctttgcagagaattgcatctggtgcataaaatatcaatgtgcacaggatgtctgcactatctgcagagaaaactggagacatgaacattttctaagtgatagtgatcagaagatggtcattaagctgaaagggcctcccaggattctggcctttaatggaaattcggctttggtatgtacagccttgttctctttatcctgcctgccctggcctggaagaacaagcagtgctttcctttcaagggctattgatttctctctctctcagagtcacagagctcctcagctgttcactcttcagctgaaaccagagaaatcttgtccagcacaaagctgccagggaaacagaattagcaaaacggacgtcgtcccctcaggatgtcgctgtttccaccctggtctgccttgcctttccctgtctttggaagccacaaatgaaaggatatcagctagcttgccttgagaattattgtccctcacctattctctctcttctcaagccaacagctttcacccagcagtgaagtggcagagcagatttgtggccccaaatcttctctaagaaccttggaaattggccccacctgagggcctttgagggtcaggcctggcatccactaaatcctccctgtcaacacagccactttgtcagtccagcctgtgagtcagtgcgagacagaggatgcaggcaccacaggggaagaagaaaagcaagctggaaatatatttgtttcctttgcccgggatcattcccagcatctaaaccaagttcttcccagaccggccaagactgaggaggagtcagaatagagtttgcagcagtcatagatcatgtgggaagacagaaaacaaagggtaaaaagaatttcatatacagatctctgccgtttgctttcagtggcattcattttgtgaagcccccagtgacagcttcagaccagttcaaacctgagggcagcatcattaccatgggtgaggtctctagaagggcaaggaaagacccctaacatagaaaatggtgtggcagtttccagttccccattggggtcccatgacttgaccttaggtttctgccagcacctgcccaccctccatcccttcaccctactgggtggtcattagaacattatctgctttgattgatttacttgtgtccataagagtagagacacacggtgttatccccatgcccggaacagagcctggcccatagtagacccatgaccatgtttgttaactgagtgacagagggactgactggactgtcatgtaagcaataccttcccgtcagggtcttgggaaggtaggttcaggggccccagagttactgtggcccgtatccctctggctgcattctgggcaacgcaaaagggcaggtgttcagtgggttccaccccagatctcggcgttaacagtccactgggagaagtggcccaattcgtgctcattactcccagtggtcctgcctccctgcaggcattctggagaagctgagtcacaggctctgagagttagggggaacttaggaaacaatcaaaacttgcctgccattcattttaggaagccgttgtagtttctgagggacgactaaagggaattttttcctaaaagcatccatccgtcctccaactaggcttcagatagcagtgtgtatgttgtcactatctatgggccatggccagtcagagcccacgggtctcagggggctccacccatgtgggggtgggggtccccacaactcagatcttgaatgtgtggtggtcccatgcagtatactatcttcctgtcattgcaaagggaaagtcagaagggtgaacgagttgtttctaattctggcttccaaacagtacaaaagaaggtttttttccttgtggaatacactagtgctcaacctttgggacagatagctgagcaccttctgctgtgtggcaggctggctctctgtgggggcactcatggagcagtgtctgctggaaaaggagacaggagttccctagcatggaggggtagataatctccccgctccctcccctcttctgtcctcccttccccttctccctcctcctctaccctcccctttttcctctcccctccccttcctcctcctcctcttccttctcttcctcttctttattctctctccctctcagtctccccttccctcccttccttcctcccttcctccacattctttataaaacaaggctttggatccattcactgccatcccccagaagtcttgtcatttgaattcttgtctgagtcaggatgctctcctccaagggctcatagggcaaggaacttcagcccgaatccggctaaaatccaggaacattttgtgggcatctgtctcagtccccgaatcgtttgtcctctgcctttcccccgttggagtccttttgcctgcttaagtggttgaattggtaatgagatcattcttcccatgcagtggtgagaaagcagcactcaggtgattgcacctgggtaaacaggagacattagcatgtggtagctggtgagtgaagctggtgcagtgcctggcgtgggctcagttgtgccagcaggcagtggtggagtttgggctctttcccctctctcctgcccagcacacaacccccagggacaggtgggggctttacagctccctggcgtcagcctaaagcttctagaaaggcatccccaggacttccaaggttgccatcttggctgagactgtctgtgaatgtggtcccttgtctgacagtgggggctgggaggggtgtgacagaggaagagctgggccttagttctctgggggtcaccatgagagaagcacacctgggcttgcatagaactcagtgctgcttgtcagtgtcacctggcacaacaggacgtagtgccacagttgcagccctagaaaatttgacgaccccttcatagctttgtttataaaaggccacacggcctaggctgtccttcataagagagcagaaagcgagtgtcccagtcactaagcagcaactttcaggcacggtttcctcctggtcactgaaaccatttgccatttcctgttttctccattttccaacgattctaattgtcagtgtcaaaaggcaacaactgttttcttggggcttatctttggagcacattgattcagaacaaaggatgggagcctccatctgcaaaacaaaggaagcagcctcctcgggaggcctggagagaatgctctggctcctttggccagggacagcaggaccagcataggagcagaggactggcggtgcctctggacactgccgtaaggtgaagagcccatggaggaccgtcgcttgctggtggcaccccagacttgaagatcctgcagagctggccaccggcacccaggctgggtgtcagcagcgctgtgtggccttggcagtttccatagtgataggctggccagcttttccattagactccggggtcctctggaatgtgtgcttcccgggatgaagacgccccagcacccgctgaagcctgccctgccccggcgtggcctttccttttgtctggcacgcccctgggcttggctttctctttccgtccctcccttcggactttaccgcacttcccctgctgtttccttagtcacactctccagcctccatctgcccctgcccctgaacccctacctctgtacaactgtgttatttgatgaaactaatgcagcaaccggtggggatggagttaaggaccgtttagacctagccagccacgcaggaatctgtccccagaagcagcagaagcacctggtctgcagttaggagatactgtacttcttagccgtgtcaccttgggcaagtcatttaacctctctgagcctctgctgtcacatcagtaagctggggactgtagatcttctgccctgatgtcctgagactggtacaagaagagccaaagcgaaaggactgccttcagaaatggctgccaaccctgaccatctcaggcagatccggatggtgtggccttgggcagtggtcatgtgacccccatgctcctcagtgtccacatggggtgttgctagatgacataaaataatgggtgagacgtgctcagtataatgagagcttgagaaggcagatcccaccccccatccccacccccaccccttgccgccttgccaatgctttggcagggagagggcagctccatagggcagctgagaaacagcccctcactgcccacacggcagctccagtggagggggaggcagggaccaggacaggaagcaggctaagggcgggatagaaaagcaaaccccagtctggtggaatcgcttctggtgtagtcttcccggtgccatgtgtttgtcctctctgccttggcaggaaccaaggccaggaactgctgccaggcctgagagctgggcacagtcccaagcactgggtcgctaccccgccccactcccaccagccccactgagtgcagagaagggttcccagaagccctttgctggaaaagcaggcactgcacgggcagcccgtgttgtagaggcaagtcctctggcatcttgggggggacacagaccagaaagtggacttggagcttgtgctcccagacagagctgccttggtggttgagaaggggagagagatggcagcagttgagcagagatggccgggctcccctcactgtgtggggtgaggcttcaagcactggactgggagtcagacctggatccgagtcacaacctgacaccaaccggctgagggtctcagagcaagtcatgccttttctgggtctgggggccttcatgttattccctcctggctatgttcttcccctttgctccttgagccgatcccagactgagtgctgaaactgcggccttgaaacttggctcgctcctccccctgcccacccagccagctttcagatggagacaggaagctcctcccaattgcctatgctgcaactagtcaggagaagggcgggaggttggcagtaagtgtttggctactcccagtgttggagactgtgtccacctgaccatgtgatcatctggccgttcatgccaggaccaccaggaacaagcctcagtcctcttctcaatgtcctttccctatgacagccctgcagaggctaggtatccaccactacatagcccacagtctgctctgccccagccacagcatccttggcttgctcagccattctttgtctgggtagtttgaagtccaatccccactctcattacttaccatcctctgaatgcagccagtctgtctgggtctccctgagactggcatgcccagactcctgtgggtatagtctggccaaggcagagttagcataggactgtcacctccctccttctacatactctgcttctattaatgcagcctaatgttacatttgttcttttggtgaccgcatctcactgctgacccatcctgagcagatggacatccaaaatgcctaaaacttttttctgtgtgctcttgctattaagttctgtctctcctgccccattctatgctgttgcagttgtgtttttaacccaggtgcagaatcttactttatttatacctgtggaattttgctcgagagggtggggcatgcatgcgagtgtatgctggtgtgtttattcatgctttctgctgcaccaaagccaagtcctaggtccccacgcagcgatcctaaggctaattattaattggtagctgtaatctaatttgtctttttcatcttctgtttagcaagaggaacagagatcaggtcttatggcaatgacccctgaacggcagaatgcatatatctcccaacagatgagtccatttgaaggtaagcagttaaggccagtgttcccaaaggggtgggcaaggggtgcatatgtggaagtggggtgagaattcatttcagagtaagcagttactgtgcttctgaaagcattgagaaagaggagatctgaaaatcagttaaataattcatccaactctaagagcaggatcccaattgaaggcctggtctaaatgactccaaaatcaccacttaattcaagagactgatttccctgagtcaggccccttaaagcagctatttcaatgggacagggaaacaaccctaggatctggattagaatcacttgggggctgccacacccccagggctctgatcctgcccttctcccacacgcacattcacatactgctgcagtgaccttccatttctaatgggttcctgggccatctgtcaggtatagggaatggaaaaggggttggggaggctctgcttcagaaagtttgtgtcaggggctcccagagcctccacagatagatagcaggggtccccaccctaccatggcagctataaatgtgatcaacatttattggcctaggatacagcagttagcaaaatgcctgatgtagttcccactccgtggaggttgcaggctagccaagaagtcatgagttcagcaacccttacgcaccagtgggatgagattggaccaggccgagggtagtcttgggaacactcagcatttgtctgagggccagaagaggctgcttgccctcagacaggaggtcagcatctttattgtagcccatgacacctctacaccattgctcttctggtcttatggaagacatctttgggcctgataacagcggagtctgtgtcccacttgtccaggctggagtgccacatcaggcacactccagttgcagggacagcacagacaagtttcaggaaggctggtggcctccaggaggttaaccttataaggccagattgtaacctagttgaaaaacatacacatgccatgataataaaagaacctaggcaccattacaagagaaaaaatcatttttgtagatacgagcatggattcttgggtgggtcagacacactgggcttgtgctctgactgcactgtctcccctacctgaccttgggtaaaccataagactgctgcatgactcagtgtccaccccaaaaaagtaccggtagatattggccacagtagatatcagctagagtggactctcatgacaatgaggggagatgtattccccatcttaggcacctgggactctaccttccatcttctgctccgtgtctctccatccccaggctcttcagaactcagggagtccagaatgtcagctcccagatttcagccttcagaaaggaaacccattaccgttcagttgaacaaatgttgtctgagccccagatctgggctcagaggccatctaggctatgagacaagaggggaacaaagcaccgtctgcactcactcaccacactcacttgctgtcccaggtcacatccatcgggtagagaatctaagaggctgagctagctcccgccaccagcccagcccaccccacctggccccttccttccttctacaaaatatgcaccacctgtcaaagggtgggcagtgccaggcctgcatacagagcactgagtgtaaaagcagacatggaccctgacctccaggagcttccaattttcttgaagagacaaatcagctggcatttcagtccagtgtgatctgctcttggtgagcacagacctagggagttggggcagcttcccagaagaactgcagtccaggctgagggcagagaaatgaggggaatggcgaggaattggggagcaggggggagctcagtagagagccaagggcgggaggtgagaagtccgtgttgggccaggagctaccctccggtggccacagccgaagtcgaggatgcctttggaactcatccccacttctctctttctgtatgtagccgtccaagaacaagtcacctccaagtgtagccggatcaaggcaagccccccatctagcaagcacttgatgccacccagaactgggcttcttcagaacaatctgagtccaggaatgatcccactcaccaggcaccagagctgcgagggcatgggagtgatctcaccaactctggggaagcggcaaggaattttcacctccagcccccagtgtcccatcctctcacactcaggccagactcccctgggcagacttgactctgtctgccagcatatgcagagccccaaggccaccccaccagaagtgcccctgcctgggttctgtcccagctccctgggcacccagtccttgagtccccaccagctcagacggcctagtgtgccaagaatgcccactgcgttcaacaatgctgcatgggtcacagcggcagcagctgtgaccacagcagtttcggggaaaacacccctcagccaagtggataatagcgttcagcagcactcaccttctggccaggcctgccttcagaggccatctgattgggaggcacaagtgcccgctgcgatgggaacacaagtgcccctggccaacaaccccagcttcagcctgctgggcagccagagcctcaggcagagcccggtacagggcccggtgcctgtagcaaacaccaccaagttcctccagcagggtatggccagctttagtcccctgagccccatacagggcatcgagccaccaagctatgtggctgctgctgccaccgctgctgctgcttctgccgttgctgccagccagttcccaggtccgttcgacagaacggatattccccctgagctgccacctgccgactttttgcgccagccccaacccccactaaatgatctgatttcgtcacctgactgcaatgaggtagatttcattgaagctctcttgaaaggctcctgtgtgagcccagatgaagactgggtgtgcaacttgaggctgatcgacgacattttggaacagcatgctgctgctcaaaatgccacagcccagaattctgggcaagtcacccaggatgctggggcactttaaatctgagcaggatgcccatagaaacccccatggtgacatcactctaggaagt

SEQ ID NO: 3937 - DNA, 150667 bp, human
ccagatgtgttggtgacaggttgctactcagaggtgcggacaggagctgagcgctgctgctgtcggagcagacgcggcgttcccgggttgtgctcagcccctgcagctgccatcggctggagaagtccaggttaggaaacgcatccggggaggggatcctagagaaggggcgcagccaaatacccgggaggtgggataggtgggaggggagtcgctggactcggcgccagggcagatggtggacagggcgcgctggcccgcccggcagttcccaaggaacctatgttcctgcagaagccgcaggtgtccgtcttgggataactgcggagggagccaatccagcccagcttgggcgggagcatcgcgtgccctggtccagtggaacgggagactggccagcgagcctggactctgagctaagcgtactggcgggcgacgccgacagcgtccgcgctaagggtgggggactgggaagtggggagtggggcactcggccgggatggagagaatgcagttcactaactgccacctgagagccctggtccccgctgccgccacagcgggtctgtttggcagtcagggcgcgagctggtgagcggatgcgtgggcggagggactggcgctacccacccagcagccacccactgcaggtgagtgcccctcccagggcgaggggaggagaagggcctggccgctagccctagggtcaggctctggtgaaaatgggaagggggatgggggctgaataggctactttgtgatgagactcccgtccctgtgacacttcagggtcctctggggatctgtcattcctcttgcaagctctcttgttctctggtccctctcctcctctccttatttcctcctctcctctcctctcctctcatctcctctcctctcctctcccttcatcgtgtctctacctctatctccgccggtgcctctctcggtatctgtctctcagtctctgccttctctgtgtctcgtacggtctcctgtctttcttggtctctcggtcctgagcgctctctcgccctgtcactgatgaccgctggcttttggctctccgtgctcgctcttcgtgtgtcccggccacgcacggctcaccagctcgttttccccagacgcggaaagtctaccttcggcgtgcgggtttcccaagcgcgccgggccccgcctgcggccctccggcgggctctgtctgctggaggcgctccgctaaccctgctgtcgcctctttccaccagcgcaccgcctaggcaagccagctgacgccgggggcacagaccaccctccactgagtgcggagcagccaaggtgagtgcaccgatgccccttccgcccctccgatccctccccagctgccctggttcgagccgactggagaaatgaggctgcaacagcgaagccagcctgcggccgctttctcctctaaagactggtgggagggcccgggaggcccctcgggcggccgcagctctttggctgcccgctgccccatcccggagtggaaaccctgagtttccaggcttcgggctggcggggtcgcgggcagggcagcgcggcttcccctttaaggccggagccgctcgtcgccgtgagtgtgagggtgtgtgagtgtgcggcgtgcgtgtctcctcctccccgagtgacacagcagtgagaaatgcctatcagtaacttaaacccccgaaactccaccttccgggcgcgcggcgcggagccgggcggtgggaatggagcgagcagattgaggccgccactgcagcgccgccagcatgaacttggccgcgagctgaagcggccggcggcgggcgggcgcgggggcaccggccgctagccagggggtgatctgcaacagggctgggttccttggcggccgcctgagtccaggctgcccgcgccggcggccgcccgcccctcggacactgcccccgccgccgccggagctctgcagcacggtaaggctgagggcgggtgcaggaagtctgactgttctgggggttccggggtacacttgtagcccccagttatggtccccatcgctgaggatcggggtcccaggggtgcttcgagtcggtagaccctaaagtttgctctgagcacacggcccacctggcgctgcgggcggccacccccttctcgaaccagcccggctgggctgggcgcagctcgaaacgccggagaccacggcctttggctcggcgcccgtcgggcgtctgaaatccggcggggacagccacgtaccggggaggaaaggtagaagggcgcaagctcctcgggctacgctgggctactgggaggctcccactctgtcccagcacccccgggtcgcttgcagcctgggtgtcaccggcgacggtgccttcacatgccagctgcctgagcccaggccagtaggcagtgggcgctggatgaaggatttccccaccccaacgctgtttgccgcctctgagcgagagtgtggagtgtgcgcgccgaatccgctgccctgcactccctcccctgccaactcctgggaagcgcagcccggagctgagctggtgttcagggcagcccggactgggttcctgcggagcagccccggcgcccctgcgtcagagtccgcgcttcaggttccccagcatccgcgcgacgacagagctgggcgcccggcgccggctagcgcgggcgggaagccccccggagcgccgccaaatacttttctcggccagttggcttggccaggctccgtcccaatgcagtgtgtccgaagcctcctggaaagctggagatgtcgtctgattctgatccgtgattaaattcggactgagcagacactaataggattagcctgccagaaagctcggccctgaagccatcggaacctgtgcaaacacgcgcctcgggctggagcattcactcccgccccgccgcgcttctgcagctgggtgcggctgacctgggcacccggagtgtgggtgtgtgtgagcgggcgggagcacagcgtggctgggggacgtggggagaaggggctgcttttgctggggtggcttgtcgttgttgtttggcaccacggtgccccccgggggcgcggtccccacggtgaacgtgctgctcacgggtaggcaaacccaggccggctccgggacattgtctgcaagggcgagcgagccgagcttactagaggcggctgcgctggaacaaaggcgcaaagtctccctgagaccaagcaattttgaaagagttggctagggagagggcctgggtctcccggggtagacccccgcgggaattgcgccgcccccagcggccccggcccgcgcctggggaattgtgttccctggttgcggtgagccggcgagcgacatcgcagcggcgcggcccagctcttggcaggcgtgggttgccgcccgagtgcccaccggccgggcggggtcgaccgtgcacccgccggggcttcccggccgccaccgcagctctgggcccctggaggccgcgcagcttctttccttccctccctcccacctcttcttgtctttatagatcccccctccctcccacccccgccgccgccgccgccaacaatccgctttataaaaagcccctttgtttcccaggaggctggagagagggaaggggaaaagggacgcagaggcagagggcgggggcggctgtctccaagtggtttcgagccgctcgggacaggagggcaagtgtaggcgatgggggagggggctgtgtttcgaggaccctctgtgggaacccacgaaggcgcacggagcctcagccccggccctcgctgcacgcccggcctgccagccctggacaccctaaatcctggcggccgggacggccgagtggactgcactgcgagctggcgggcgcgcgcagaggccctaggctgcaagcgctccgcggggtgggcagacgcgactcgccgatgcgctcgccgggctcgggcatagggggcgccctttccttggtttcgctttgcagcgggcgcccctcgccgccggagctcagggcagctgtcgcgcccgccggtggctaagacggaggcggcagctcggaggcttaggccacccgcgtctggctacacgcctcatttcttcccgcgccctcctgccacaccctccgccccaccacacacaagggctcaaactctccgagcgccctttgtttggaggcgcggaggcagtgggagccgccacctccggggttcgtgtagcctaggcgggcagtgaggatgagcgtgctactctggactgcgcgctggcctgctgcctctgcacctaacccagcgcctgacactaaagctgccagctttagttagattgaccatttagcgggtccttgtcccttataactgcccccctaaaactttcgagaaccagggcttgcactgaggaatgtcaaatataatgttagaagtaacctttcgccattctgttggcctgctccgcccctgtgccccaaagtggtcggtgtctctcatagagtttgttcgggaagggaatactgaaaagaaaaaagtgacaaataaggaaagtgggcggggcccaggctcaggctggtgggtctcccaagcgaagtcagattccacccgctctctggccgcctccgcccctcctacttccatttaatctgatgtcgacgttttatttgtgcctttttgcatatctttctcctactcccctcccctcccatctctggaggttattgataagtgctgctcaaacatttgttttctgcgtctttggagtagaagatgaagcgttaacacccccaacgcgcatacacacatcccaaatgcgcgcatacacacatcccaactgcatctaaaaccacaagaaagtaatcaaagggtaaactactggttctgccttctcctccctcctttgtgcttctcttctggagcaagatcattggaaaataaagctgctgatgtgcgagatggaacatatggtgcctccataagagagaagctgaaatggccttgaacctgccggacagaccagctgtttgctgccagccagagcagctaatcagcttcttccccttaaagtaacagccctcttttcacttcatgaccagtttgcatattaaataggatattctccagaggggaaaagtgatgggctcctatactgctttgtgcttggtggttctccaatgcctgctccctgctctgggggccgccctgccctctcccggtgcctgcctgcgatgtgcgagtgtttctttcagtactgaagtaagaatgttgctcaaagtggaacttgggacagacgaggcaggaaaaaagaaagaaagaggtggggctgagagatttccagatgcctgggaggaaatctctctgttttgttcagcttcggaaaaaactagcattctttcccccctttccccctttaaaaatatcacaaagagctgaagcttttccttacaagatctccttaaaaatcatcctcttccggctgtgaccattttcagtttttcttcagtacaatgtgttggggtggggggtggggaagagtttggcgttggaagaagaaagcctttaggagatacaaggaaattccatgttaggaaatcattagcaaagggtgacttcgtctgttttcctgccactgacgctgacagtgacacagatgtgtgggttgaaataggaacgtcattgaatttttacactccaccaggaaataccctgtttctggggtgggggtggggtctacagattcactgcaacttaaggtaggagattcactactgtcaatcctttttactaaggaaagggatttttttagcttagccagcatgtttaatgtattttcttcccttttaaattgatcacctaaaggcataaaatgcacctgttaatggatggtccctaggaaactcaattactatttggggttatgaaagggaataaactggtcttagacaagtggctcttctgaaaatagctggactatgcctcttctttaaaggagcctcaatatacagtaaaacctttttttattattgcactttaagttctagggtacatgtgcacaacgtgcaggtttgttacatatgtatacatgtgccatgttggtgtgctgcacccattaactcgtcatttaacattaggtatatctcctaatgctgtccctccctcctccccccaccccacgacaggccccggtgtgtgatgttccccttcctgtgtccatgtgttctcattgttcaattcccacctatgagtgagaacatgcggtgtttggttttttgtccttgcgatagtttgctgagaatgatggtttctagcttcatccatgtccctacaaaggacatgaactcatccttttttatggctgcgtagtattccatggtgtatatgtgccacattttcttaagccagtctatcattgatggacatttgggttggttccaagtctttgctattgtgaatagtgccacaataaacatacgtgtgcatgtgtctttatagcagcatgatttataatcctttgggtatatacccagtaatgggatggctgggtcaaatggtatttctacttctagatccttgaggaattgccacactgtcttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgctggctgcgtaaatgtcttcttttgagaagtgtctgttcatatccttcgcccaatttttgatggggttgttttttttttttcttgtaaatttgtttgagttctttgtagattctgtatattagccctttgtcagatgagtagattgcaaaaattttctcccgttctgtaggttgcccgttcactctgatggtagtttcttttgctgtgcagaagctctttagtttaattagatcccatttgtcaattttggcttttgttgccattgcttttggtgttttagacatgaagtccttgcccatgcctatgtcctgaatggcattgcctaggttttcttctagggtttttatggttttaggtctcacatttaagtctttaatccatcttgaattaatttttgtataaggtataaggaagggatccagtttcagctttctacatatggctagccagttttcccagcatcttttattaaatagggaatcctttccccatttcttgtttttgtcaggtttgtcaaagatcagatggttgtagatgtgtggtattatttctgagggctctgttctgttccattggtctatatctctgctttggtaccagtaccatgctgttttggttactgtagccttgtagtatagtttgaagtcaggtagcatgatgcctccagctttgttcttttggcttaggattgtcttggcaatgcaggctcttttttggttccatatgaactttaaagtagttttttccaattctgtgaagaaagtcattggtagcttgatggggatggcattgaataaaccctttttttttaagattctgattttttttttttctgcaacagtgcattgcacagatcattagcctaggagctgggaaacttgtgttctagaaagttctgcccactaattaacagagtgatcttggacaagtccatcctttctctcccccaatcccatgacctctgagtctgagtcccttccagttctaaaacactatggtttgtgaatgaaatagtcattttctgggaaagtgaaacatcaagttcaaccttgtcattgggaaacagctagacagataataaaaaggggctgatattttgaagggcaaggataaaaaggaggagtaaaaaaatggcagaaggccaatcaaaacaatacaaaagtgtgaagtgttcacctttttgtgtcttttgcaagtgtgaacttctaacccagaatcagagacagcagacatcagaaatcaacccaaagtttctcttgtccagtactcctattgatggcaggcctcctaatcattgggttggtatacagataacgggatctaaactctttagagtagactggcatatttccaaaggactcatctaatgtagagcagatttgctgctttgcagttatttagtgaaggtttcaaagacaaaaaggccttccatccacacacacgtgcaccactggggtgtgggttctgaacccattgttgaaccttttcttttcttcctaatccagctgtttttttttttaatcacatttccaactttggggatacagcagccatgtaagaacctgctgctgtcctacttgatgttaatattgattttttaaaggggcaggggtgaacattatgaagaaggactctttatcctctgagttctttggcaattatcttgctgccataaatgttgatacacatataatggatgtaactaaaaaactccttatccaagcagaaaaggctgagtgtttgttggagcagatagaatgctgagagtgtgaatagaccaacccagatgtcactggggagggagataaatgatggaggaacaggagccggttactatggatcagcacaataaaccaattcccatcatacacctctcacaacgccaccgaggggtaacctaggcagcaccagtcaactgtatggcaggaaaaaagcattgcaaagctcaattggaactggcctggttttgtaggcattgggtccttaaacatcttcagtacttcgaggaggaaaatttcataaatccgaatgaacctgaagagactgtgttgcaaatacttattacttcttatttttgttgtgtcattgttgttctttagtctgtaaaggtgtcaaaggaagaagaaaaggccccatggagctgtcaggacagttagtcagggggttctccatggaggtaagaaacagtagcttgtgttataggatatttacatgccaagattggaggtgcatagtcctgtggggtcctgctcccaaattaccagcccagggctgctgaagccccaagagcattttcttccagaggtggagacagaagcaaaagagttgggttaccttatttccctgcctccacccccccagctctggttgctttctttctccccttcacagagcctccctggtttccttcaaacctcgagttttctcctaaaatctgacatctttataacatccaaagcaatcagatatgaaacagttcaaaaatattccccccgggggagggaatagcaaggggcctccctggctgtaggcactgagctcccagagtaaaggcttccagagacagggcctaaggagggtttgggagcaagaagcaaaaagctctttgcaaagtttaggagagctttccttgcccagattggctatcttgagcctccctgaggccccagcttcagactactccctcccttcctcggcctgcaagagggtgggctcttcatacccctggaggaggaccccccacccacccaccaaggcaactcagtcctgcccggctgccctctgacctggacacagccagtgcccctttctgcacagcccagttggagcctcccagacccccatttccttggtgggcaggtggggtaagctaccttaccctcccatgtgccctgctgcttgttctgccaagtaaataaccagtaagtggattttgggaaaggccattttcttaaggctgagaattgttccctgaggttcagagaaggatggagtggaccaggtgatatcatcttgttggaagagggcctagcaggccagccgttgattttttcccctttcttccacctgtgcgagtacctagacactagaccacagggacagttttctgctgattttggaagagatcattggaggccacagcacctgagctagttaatggcatccaggtcaaaaaggcctggtggccccagcttgtgttcacctgtgagaggaaagtgtgggtctttggagcataaagacaggaaaaaaacaaagtcaagtaattctgaacacattgaggaattccaagttcttggtccaattgtcccagctccaccctcaccccacaagtaatgcatttctattttttcctgcatttgaatccgaaattccactctcagcttcggcagcgtgctgtgacagagtggggaggaggaagacaggacccagctctgccttcctttctgtggctatgccagtcagttgaccattgcacctgtacatagttagcacaggtgcaccacctcacctgcaaactcagatgttgaaagatggagaatcttacagctggaagagtaaaaccccatgattttacagaagaggaaactgaggcccagagaagcgtctgactttcctatggggacatagtaaagggagcccaaagttgacagaaccctggtctctagttctcagtcaagtgtagaacatccattttgcacccatgtgtgagcagacaggctttccttttgaggcagagcaaatgtggtaaaaagaaatgcagccaatggagggggagcgcttgtaactgtggcgtaatataatctaccctgtatcaacgtgtgctttgctcagcattgttaggacagcaaaggggcatattagaatctgaactcgaagtctggaagtagctggagaatggagattgtaaattaagaattagaaggtagtgtgtgtctcgttttcgagttgctgtcagagagtcaggcagccagccctgtggagggcttggctgggtgggctcctctggcaatggtgggaggttgtttgggtttggctcttaatgagatctcagtgttaatatctgcctctggaagttccagcaccagcctcggaattttaagtgggacagtagttttggtgcagttgccaacgtcacatggtttgcgtgtctaattctgaaagactggcatgctttatgctaggcttcgggaggagggcacagcgtttctaagctgcttgtctgtcaaggattaatttaacctctaattactacattttcttcgcagtttgctgcacgaacatgttgtaacaaagctcaaagaagtatgccattttatttccctgccactctaaaattaatttccggaatacggagtcaaacctgacacacttggtgttaaaataattgtgctgacattcgagctaaagtgaacaatctggttgtttctagtgatcccccagccatggggtaaagagcattatcatgttagttgccatgacagttctcgaaatgagccctgaaaatatcaaggagtgtcactgcactaatcccaccaggggagcaccagacacaaaggtaacacccgagcacatggctggggtgttagttttggagtatgactgatgccctgtgcaatagggcagccagggagtcctttctcacccactaatagggctcgtggtgaggtcttgtcccacagcacgaggtgagcacattatcaaatcggaggctcccaagagcctgcccctggggccaaacctgttctgagtggctgtgacaatgaaatcacaagatgaagttaatggggattctccaggcaggcttttctccctcctcctgcctgctcttcctgggcgtcccgcaccagcaatccccaagagtaacagccctttggcagtcccacatatctcttttatccccaccttcccaaacagcagcagtggatcccagagtgggaggcccgttccccattctgggtgcttgagaagactgcattctcaggccctggttggggagacttagcagcattgttggttgcctagtttgggtccaccgaagctgatttgtgggatttgagagttggccaggttagccatttgagttctcatctccttgctcaggtggttgtgaagagctctctctctctctctcacacacacacacacacacaggtacacacacacagacacactcacacactcaccctctctcaggagtagaactttgccaagatagcaaaggctaggtctgaagccctattctgcatatggctggggacaggctcactggcattttcagccatgcctttggctgccaaatcccgagcaaatcgagtttaggttcagtacccctacattttccttaccggtttctagacttgcctcctgcttctcacaccccctctccaccttacctagaaagatgccatcctcagcccgctgtaccttagtgggattcccttcctctggagaatctggagcctctaacttgaattaaaagatgcaagagttaccatgccttggagagaatctgctgtttagggcacaggtaaggaggtattcagggcttagggaagccctctaatccacaccccaccctccaccccaccaaatggtaccatgcctggcataaagctggtcctatttatgagttagagaactgcctggttgccaaggtttttctgagcttgccctcagggaagctaaccccagttggtctcttgaacctcaaatcataacaaaaatgactccctatcctctgaagcaggagtggctgtttgcctcttagggatcacagacttctttgtgaatctgatgaaaactctgggtcttctccttagacaattgaaaaataacacgcaatgttgcatctaatttagggtactactaggccttaagcccactcatggttctctcgaggatcttttgtcacaggttaagaaagcctcaatatgagctttcggcaggagacattgaccaactgtgggattttaggcaagtctgtgaacctgccaagtctcagtgccctcagttgtcagatggaaatatcagaatgtcagttccaccaagtttggagcattgtgggagattcaaaagagacggtgttggtgagatggtcctgtaaatatcaggctcagggcacactcatgggttgctctctttagtgtcagtgtttactatttattttgcatttccatttgatgtgagaaatttaacaagagaaaatcaggcttcttttgacttgaaaagtcattttgtccctttctttgatactgcataagttacgcccaggcaaactggcattaaagagactctggcttgggagggacctcaaagagcatgcagtgtgtccaggatctagacagttttagagatcccaattacccagccctcggcagttccagaatgggtcaaggatgtgtgtagccagtccagtgccttgaggaggttccacatttgcctgctgcagaagtgagaaaatgggatctgaggaggcagatagttgtttggtttttcacatttcagtacggtcacaccgggcatgagaaggtaaagtggatcctgggtgtctctctcatagtcactgaaagggcctagccagaccctcatgaaaactgggaagtagtctcaccccaggatctgtccagggccccatcctgaggaagtggggtcgtgtccttttggagaggagcctcaggttgggcctgctggtgtgtggggggtctgcttaggagggaagaggatggctggactccattcaaataagacttccacaaccttccccgtctaaccctggaagtgtggaaagtcttctcatggcaaggccacgagggctcatatatcaaagatggggaaactgaggcccagagaggagcaggtgctggccctgggtctcatgacaagtcatgaagacatttccttggcccttgttgatcctgtgcaccttccaagttctctgtctggctcctcacaatagtgtattttcaattctcctagaaacacaagcccatcatcatattaacctggccctgatgaatgctcaggtcctcaaagtcagccctagaaagtaaatagcaggtttggaaagccctttgaaccctcagagggagatcctggccttgctcagcctgttgctatgcagttccaaagtggaggctgccacgcatttgcagagcttttaagtcccttcccccaccccatgtgcattttaggaaccttttggaaagaaatgtgttgctaggagcttgggctttccctctcctttagaaagagagaactgtttttgctttgaattgccttgcaaacagattgaggtgtctccctacccattctttcttttgttaaaccaacccgatttgccacgggtagttaagtggagatcatgttgaaaaagagtgcttagcacagggtcactacgcagagtggctcccattcccatccttggcagagcatctcacccttaatttcattattaatctggagggagaggaatcgtgcaagtcagttgaaagcagatgccacctaggaattttaggtccatcacgtcatcaaacaaaatgagagtagtttgtaaattggaaagtttggcagtgggtggttgccctttggaagattcactgtttcagaccagctttctgagtctgggaggagtccctggtgctacagtgggaagaatacccacctgagggccaccgacatgtggtctggcttcagctttgataccaactagccatggcacttggggcaagctatttcctcagactgggcatcattttctccatctgtacaatgaaggaatggtgtaggggcatccaaagggctcctccagctctggcatttctgaattctccagtagcaagttaaactctaagttacttaaaatatttgaaaaggataagtaataatttgttctttttgaaattaccagagacttgaaagcatggggttgtatttttgtttgggtaggtggggactgtgactgttacataagtgataacagttttagaagttttagctaaagacaaagttgacatgtatttatgtaggaccaaataatagaaaaaaattcctttagagaccccttgttttatgcttgaggatgctgcagctgaagaaaaatatcatgcttgcccaggcttccctggcaagctgctaggagctgaggtggtccaggacccaggaggcccagcttgcaacccactgcttgccccacaccgcacttcctaggatcttacagaagaagcctccaggccctcaactccaaatgggacctgcagtcagcagaatatagggctgagtgattctgatttctagctatcagatactagcttatcagaatggaatttttattctccacccctgcccccaacatccaagggttctctgttaacagtaaatatttaattttcttggttttgtaccaatgcctaatttaaaataaaacagattttttgaatattggggggtggtccttaggggcttgttatttggatttattttatttcaaacagatgggctgttttaggtttgacttcatatttgctaattttcattatggaaaaaaaaaaaaaacaatcccaagccaccccacccttatttttgtactgagtaacagtttgtcttgtctaaaagaagcttttattttctcaactgtttgcacccagcgtattcagccttattttgtatttttaatcacataaatgtgttggccacctatagcttatgggatgttcacaaaatgcgccccactcattcccgaacagccaccaactttgggactgtatctctcagctccagcccagctacctcttgtctagttcccagccatccactcctctggcctgaagccagactgtatggaggtgcagagtcagagaggccttggccttggagggaggcaccctggtgcctggcccagctctactgccttgctgtgtgaccttgggcaagtcccttcccctctctgggcctcacggttcccactgttacaaagaggaggctgacctaaaggggctttgtggaattttcctcttattatgttagattgttatatttggaagatgtgacttgaccagtacagtacatgacctttaaatcctttctagaagcaatatttagtgatgtttctgaaagagttaggaggtctatatctctgagatgaactagtactttctgaaatttatgaaaacaacagttaccactctttgaatacccactgtgcctggagactcttgtcctgctgtttcttagaaactcacccatcagctgtgagcattttctaatggtttcccctcaggcctttaatctttgatctcaataccttctccctaggagattaattgatcacttctaactctttttttaatttaatttttcacttgacataaattcagactctcagaatatttgcaagaataatacaaataatgtttaaatacctttcacttgattccccaaatgttaacattttaccacattctatgttatatctaccaccccctcacacacacacacacacacacacacacacacacacacacaattttattctgaactttatgagaacaaattgtaggtatgatgctcttttatctccaaatactgcattatatatttcctaacatttcctaaaacgttctcctgcataagcacatattgatcaaaatcaggaagctaatagtggtactaatctatctaaagactttaatctaaaggctttattcagattttgccaattgtcctaataatgtcctttatagcaaaagaaaatccaggatcatgcagtgcattcagtcgttttgtctctttagtgtcctttaatgttgaatggttcctcaatctgtcttagtgttttgtagcattgacatttctgaagagtacacgccagttattttgcataaagtccctcagtttgagtttgttgcctgatgtttcctcatagttagatcagggttatgtactattggcagaaataccacagaagtgatgttgtccatcagtgtatcatatcaggaggtccacgatgttagttccattcatcctattcctggtgattgtcactttgatcacttggttaaggtgatgtctgccagatatctccactgtccagttcctatttcttcccgttgcaattaatgagtatcttggggaaataaatatattttgaggctgttagtatcctagtacacctcaaactttcactcactagtttagcatttattgatggtctgtgcctggggcaagatggtcagtgcattatgctggttgccaaataatgaatttctgattccatcatccattctacatttattagttgactttctactataagaaagaacttttctttcactcccatttatttacttatgcttttatttatattaggttgacttgtgcatttttactttgagttataatcctttcctatcattatttattttgatgctcaaattgcctgaggtttgtcccgtgggaactccttcaaactagttcctatgtctttctgacatgcccctaatcatcctctgagcgcgcccttaatttctggcacatctgctccaggctcatcttgtgctttccctgccttagccttaatatcagccattttcccatggaatcttaacttcttttagtgaagaatggtatttaaaaactaagatctgggtactaaaagcatgcgcatttctacagatgtggcattgttactaaaccctctcagtccacaaagctaggaaaataattaactcacatctatatctattcctttttatttattattttggtaatatctatttctctatctatctatctacctgcctacctacttacccataaaccatgagttcacactgataacctccaaattccaatacaacagcaaagttcattctatcttcccccttcccatatttgtagtttccttgcaaaacagtgagaaatctctctgccattaccataatatatttactcacttaatcctagaatatatagaagctagtttcagagttgctaacccatgactctatgaagaagccaattgacaagagtacaatatttgttcagaattatttttgtcttttcgtaagagtgaatccttcaagcactgttaaaaagttacctgggctagttcatctcccgggccccactgaggtcatttgaatatggtttagttcacttgtttctgtttagattcctttttgtctgccccccacccctgaaccatctttctttgttaattttaattatttttctgtgagcatgtgaaataataacatagtttcaaaagttagaactgtacaaaaagaaatcctcagaaaagtgacatctcccattacttctgtcctttccacctcattccactcatttcctgtaagtaaccaacttcattagcttttctgtgtttccttttgcacaaatgaacagatatctgtgtattttcccataccccttccttacataagggtggcttaatagacatactcttttgagctttgcttgttcactcaaacgcatgtcccagaaatcactccatatagagatcttcttcattctttcattacagctgcatagtactgcattgtgtagatgtaccatagattattcaaccaacctcctatgtgtagccatttagattgtttccaatattttgcaattaaaaataaaacaaacaacccagtacatatgtattttcatattgttagaggtatatcttaaagagtacatttctataagtgggattaatgtgtcaaaatgtaaaaacaaatgtagttttgttaggtattgccaaattcccctccagaaagattgtaccaatttgcattcccattagcaatgtatgagagtgtttttttccccaaagcctcaccaacaaagtatttgctttactttttaatttttacaaatctgataggtgagaaatggtatctcagtgtagtttaattagcatttttctaattaggagtggcttggaacatcttttcatatgcttaagagcccttttgatatttttatgtgtgtgaattatctgttcatgtcttttctccctttttctattgggtttttagtcttttaccctcaattttaagagtatttttctgtgttaggtatattagctttttttatttgtgatatatgttgcaagtaatttcacttaattggtttgtggtttttttcaatgtttgttttgttttgccatgcaaaaaatttttttatgtcgtcaagtatcagtcttttcttttatcatatccggatttgaatcacagttagaaagcctttcctcacatccagtttaaagagaaattcaccaaattttcttccagtatttgtatggtttcatgttttacatttagattcctaatccatttggagtttattcttatgaatggtatatgggagggatcttactttacctctttccttttttctttttgtttctcttttttattcttttttagagacagggtgtcactctttcacccagtccggagtgcagtggcatagtcatagtcagtggtggggtggtgtgccacaaccacacttggctaaatttttttttttttaatgttttgtagagagtggatattgctatgttgctcaggctggtctcaaactcctgggcttaggcgttcctcctgtctcagccttccaaaatgctgggattataggcatgagccacagcacccatccccttcccttttttcaagagactacccagctatcgcagccccattttacaaatgttcatcttgctccagtgatttgaaaagtcaccattattatatattcagtctccacatatacttgggtctatttctacatgcatattttattccactggtcaatttgcctattcttcttccagtaccacactgttttaattatagaggctttattgtgatttttaacagccttttattttgagataattgtagagtcacatacagttttaggaaacaatactagaaagatcctatttacccttcacccagttcacagccaggacagtcacattgatacactccatccaccttattcagagtttaccagttatacatgcacttatttgtgtacatgtgtgagtatttaattcaaagcagttttatcaaatgtgtagagtcatgtgaccacagtcaagaaaaagaaatagtgccatcaccacaaggatatgcaatcctttgtgttgctgttttataccaaacccacttccctcctgatctgctctaccccaacttctgaacccatggcaactaaccagtaatctgttctccattcctatagttttgttatttcaagaatgttatgtaaattcaatcatatagcatgtgatctcttgagattggcttttttccctcagcataattctgatagtggtgtagtgcaatacaggagtagtccattctcacaggtgtgtagagatatctcattgtcatattaatttgcatttccctaacgcctaatgagattgaacatattttctggagtttatttttcatccatataacttcacggaatgtctgttcatgactttggcccattttctagttggattatttgcattttttctcttttttttcactgttgagttttgcaagttctttatatattctagatacttgtattttgtccaatatgtaatttgaaaatactttctctcagtctgtatcttatctttccctccttttaataggttctttcacaaaaagactattttgggggtcagatttttgtggttgagtctaagaactctaccccaagtcttaggtcctgaaaattttctctaatattttttaagtttgatggttacacatttaaggccataatcgattttgagttgatttttgtataaggtgtgaggtttaggttgatgtttattatttttttgcctatggatgctcaatggctctagtagcatttgttgaaaaggctatccccacctcactgaactgcttttacacctttgtcaaaaattcgtgggaaatatttttatgggtctatttctgggctccttattctgctccactgatctatgtgtctatccctctgccaataccacacagtcttgactaatgtagccatataaaaatgttaatactgggtaaaagtactcctcccattgtataattgtttctcaaaattgttttaacctaggacttgtgcctttccatatattttagaataaccttgtctacgtctacaaaaaactttgctgagattttgatgagaactgcattaaacctacaggtcaattcaagaattgacatctttactatgttgagtcttctaggcagtaaacatagtatgtctcctcttttatttaggtctttattcttttatgagcacaaaaaaggtgtttattattatttctatttgatgttcaactctttttttctgaattctttttattaaaattcaaaaatgtcaatattttcaagggaaatacaataagtgaaaatattttaaatatattcttataaatgtattcatacttgttgatgtagtataagactgcagcaatagagtacaaaatttgaaacacttcagattacaaatattttgtcccattttatttttttttttttttttttttttttttattttttttttttttgagacggagtctcgctctgtcgcccaggctggactgcagtggcgcgatctcggctcactgcaagctccgcctcccgggttcacgccattctcctgcctcagcctcccgagtagctgggactacaggcgcccgccaccacgcccggctaatttcttgtatttttagtagagacggggtttcaccgtgttagccaggatggtctcgatctcctgacctcgtgatccgcccgcctcggcctcccaaagtgctgggattacaggcgtgagccaccgcgcccggccctgtcccattttagagtagagttttaaaaaatcactattttcataaagaaaatatagagtttttttaaagagagaaaagaaattgcttataaatgtcagttgcaagtataatttattgtgattggaactactatcaagatttacttcgtatgtaaatttctttgataaattttatggattttaataggtcacaggaaatctcattgtgctcctctttgattttttatattttattttattttaagttccaggatacatgcacaggagtctttatttcttacaaaagcattttgtaactttctggatgcagatcctatacacattatattatattaaatatctaagtattgcattttctatgcagcagttgtaaatggtatgtgttctcttaacacagttttattgataccattcacataccaccgaattcacccatttaaaatattcagttcagtggcttttagtatattcatagttgtaccatcatcaccagtatctaatttcagaatattttagttaccctgaaaaggaaccacatatccattagcaaacatcctcaattaccccctgcccaagcccttagtaactattaatatgctttcggtctatatggatttacttattctaggtatttcctataaataaaaccataagataaatagccttttgtgactgacttctttcccttagcataatgttttcaagcttcatccatgttgtagcttgtattagtacttcattccttttctttgccaaataatattccacatattatttgtgatacaccatatgttgtttctccattcatcagttgatagaaatttgagctgttatcactttttgattcttatgaataatgctgttgttaacattcatgtacaagtttttgtgtggacatatgctttcatttctcttgggcatatacctaggaatggaatttttgcatcatatggtaactctatgtttagcattttgaggaactgccaaactgttccaaagtagttgtgccatttaacaatctcaccaacaatatataagagttccagtttctccacatccttgccaacacttgtaaatttctgtcttttttattatggctgttctagtgagcataaagtggtatttcattatgattgtgatttgcatttccctgttggctatgattttgagcatcttttcacgtgctttattggccatttgtatatcttctttggagaagtgtttatgcagagcctttgcccatttttatattggattatttgtctttctattgttgaactgtaagcattgtttatatattctgaattctagaccttcatcagatataagagttgcaaatatttgctcccattctgtgggtcatatttacacttccttgatggtattattcgcagcacaaaaattttaattttgatgaaagctaatttatttagtttttcttttctcacttgtgctttttgtatcatatctaagaaactatttcttaacccaaagtcaaagatatatttctatgtttcttccaagagttttatagttttagttcttacatttagatttatcttccattttgagtttttaaattttaaaatgtttagttaataaaaattgtgtatattcaaggtgtacatgattcgatatatgtatatattgtgtaatgattaccacaatcaaattaattaacacatccattacctctcataattaccatttttttgtgtatatatgtgtgtggtgaggacacttaaaatctgccctcttagcaagtttcaagggaacaatgcagtactactaactatagtcaccatgctgtacattagattcccagaacttattcatcttataactgaaggtttgcacactttcaccaagatcttcccatttcccccacctctaagacattaacaaccactattctactctctgcttctaggagttcagcattttaaatttctacatataagtgagaccatatattatttgtcttctttgtctggcttatttccacttcaggtcatgcaggttcatccatgttgttgaaaatggcaggatttcttctttatgcctgaacaatactacacacacacacacacacacacacacacacacacacagagtttatgcttgaacaacatagtggtttggggtaccaaccccctgcacaggcacaaatccacttataacttttgacttcccaaaaacttaactaccaatagcctactgttgcctggaagcctcaccaataacataaacaacacatatttcatatgttatatgtattatatactgtgttcttacaattaagtaagttagagaaaagaagaggttattaagtaaatcatatggaagagtaaacatatttactattcactaaatgaaatggaatcatcataaaggtcttcatccttattatcttcatattgagtagactgaggagaaggaggaagaggaagggttgctcttgctgtcttggggatgacagaggcagaagtgaaggaggtggaagaggaggcaggagaggcaggcccacccagtgcaaatttatggaaatacatcataatttctctctaactttttgcttttttatttctctaaaaaatgtttctatataataccaatccttcttccaccatttgctttagcttcaggtcctgtatcatagaagggttcatgctgtaaaggaagtcagaagctgtcttgagtaatcagaacccttctgttcaattgtctaatgtcaatttgtttcccagcactgcttcttttatgtctttgtcctcatggtccagcactagttaggaagcactcatctccataaagttgtcttctgttatttcctctggcatggtgtctattagctctataatttctccaagatccatatcttgaaatccttcaacacccatcttttttttttttgccatatccacaacctctttcatgatttccctgtttattgtcataaattctgtaaagtcatgcacaacatctggacacagttgctttttccagcagtaatttactgtttcaggcttgatggctttcacaggtttttctaaacaattatggcatattcaatagtgtaatccttccagactttcatgatgttctttctattgaggttctcttccaaaacattgacaatctttctatacagtaacctgtgtggtgagtcttagaagtccttatgaccccctgatctaaggctgaattagaattgtgtttgggggcaagtagaccacttcaacaccttcagtgttgaacccatggagttctgggtggccaggagcattgtccaatatcaaaagaactttaaaaggcagtctcttactgacaaggtacttcctgtcttcagggacaaaggatcgatggaaccaatccagaaaaaaatttttttattgtccaggccttcttgctgtgcaacaaaaagatcggcagctggtgtttatcttttcccttcaaggctcaggggttagcacctttatagataagggcagccctgatcatgaacctggactgcctttgcccgaaattgcaaagttagactatcccttcctgccttaaatcctggtgctcgcttctcttccttactactaaatgtcctttatgacatttttttttttccagtataaggcactttcatctgcattaaatcctgttcaggcagatatcctttcttatcaatgattttcttttttctttctttctttctgttttttggataacaaaggatctccaaattatattgaaaaataaatcataattaatattactcaaaaattttcagcatacttttcaaaaatgatttatgtaaaagagaagaaaatacacataattttaaaatatcttaaactcttttattccttactatagacattaattttgtcttttgttttctttcaattttctacaattttcaacttgtacctgtgtttaataggtaagacattaactgattgcttttctcaatctaaggattatatagttttagtataaatatatatcacatattttggtaaaattttgacaaaactgaataatcatgccttgttttaagtccatactccttccactgtttatcaaatctgatttaatggtcaaaaaattcttggttgtcattcttcttttacaagtcttcctgctaaactgccaaccagtttttacgtagtaataaaaagcagtaagaaagccaaagaaatggtgtctgggaacatctctgctacctcttagtcaacagaagctgcttctcctgttattttgatattttttaagccaaactgctttctaaaatttgtgaaaatacagtatttgtgggatgcgtatacagagggctgactttgctcacacataggttctgaagggctgactgtaggactgtagtatgtgtggattttgatatatgagtggggtcctggaaccaacccttcatgtataccaagggaggattgtaaaatattatctgtaaagtttctgtagatgcttgttatcaagttcaggatgttctcgtttgttcctagctttctgagattttttttattattataaatggatgttaaatttgctaaatgctttttctgcatcaactgttatgatcctgtgatttttcttttttaaactgttaatattgtggataacatggagtgtttccaaatggtgaaccagccttgcaatcccgagataaactccacttggtcatggtgtattattctttttatatattcctgaattttatttgtaaatcttttgctgatttttaaaatttaagttcataaaagatatttatttataattgtctttttctgtactgtctttgtcttgttttggtatcagagttataaaatgagttgggaattcttcctttctcttctactttctagaagacattatgtaaaagtggcactaattcttctttaaacatctgggaaaattctccagtgaaaccatctaggtatggatatttccttttcaagagtgtttaactacaaattcatttccttaaggtatatagggcaatttagattatatatttcatgttgtttaagttgtgacagttagctaataatttcttataaatttttgcatctatattcatgaggggttttggtctgtagttttcttttttgtactctttttgattttcatatcagggtaatactaacttcataaaatggattgggaagtaagtattccctgctcttctgtttttcagaagagaatgtgcagaattggtttggttttactttttcaatgtttaataaaattctccaatgaagccatctaggtctggagatttttggagggagttttacaattatgaattcaacttccttaacagtgatagtgctattcaaattgtttattttggtagtttgtgctgtgcaaggaattggtccattttatctaagttgtcaaatttctgtgtagagtttttggtaatattcccctatttttcttttgatttctgtcagatctgtgatattctctgcttcatttctgatagtagtgatttgtatcttctctcttttcaatcttgctagaggtcaattgtattgaccttttaaaaaaactagctttttgcttcattgattttctcttgcttttctattttcaaatccattgatttttatcttatctttattatttcttaccttctgctgctttgagtatattttgcacttcttagattcttgaagtataagcttacatgattgatttagcttacatattaatttgatacctttcgtttttcctaatgtacatatgcttttagtgctatacatttccctcccaactctgcgttagccatgtcccacatgtctttataactgctgttttcattttcattcatttcaatgcattttttttttgagacagaatctcactctgtcgcccaggctgaagtgcaatggcatgatctcggctcactgcaacctctgcctccagggttcaagtgattctcatgcttcagcctcctgagtagctgggattacaggcacacactgccacgcctgactaattttttgtacttttagtaaagatgggtttcgccatgttgcccaggctggtctcgaactcctgagctcaggcaatccgcccaccctggcctcccgaagtgctaggattacaggcgtgaaccactgtacccggcccatttcaatgcatttttaaattttcttggagacttcctctttgactgatggtttattacgaagtgtgttgtttaatttccaagtatttggcgattttcttgatttctttctgttattgatttctagtttgattccattgatcacattagagaatgctgtgatttcaattattttaaatttgttgaggtgtgttttagggcccaggatgtggcctatctcagtatatgttctatgaacacttgaaacaaatgcgtaatatgctgttgctggatggagtgttccataaatgtcatctagaacctttcagttgacgatgtattgttgagttcttcatctttgcagattctgtctagcagttgtatctgttgttgagagtggagtgctgaagtacccagctataattgtagatttgtccatttctccttttagctctctcagtttctacttcatgtgttttgagactccattgtttggtacatacacatctaggaccattatgttttcctagtgcattattattttatcattatgtaatgtctgcctgtctccaataattttctttgctctgaagtcttttttgatgataatgtagccactaatgcttttgtaaaattaatatttgcatggtatgttttctccattgttttactgtcaacttacctatgatgttgtatttagagtaatagaatagagtttggccatgttttcgtttgtttgtctgtttttgtttttgtttttttgagacaaatttgctgtgttaccaggctggagtgcagtggtgcaatcgttgctcactgtgtcctcaaactcctgggctcaagtgatcctcccacctcagtctcccaagtgtctgggactacagacatgcgccaccatgcctggttaattttcgtatgctttgtactctgccaacctctgtctttaattagtgttttagaccatataaataagaggtattgttcacatgttctggcttaagtctgctactttattatttgtttaccctttgcttcctctggttcttgtcctccatttgtttcttctttgtattctcatgctttacttaaatctattttaggattccatcttggtttatgttttatggtttttagcatattacattgtataattttcttagcatttactctagatattacagaatatgtattaatttatcatagtttacagtctacattttataagttcgagtgaagtgtggaaattttacttccatttaggtccttctacccttcctacttttaaaatgtaattatcttaaatatttcctctatacacattcagtatcaaataagatggcattataacttttgcttcattcatccaagatgatttaataaactcgtgagaaaaatagtttattatacttatcactatgtttgcctattctgaatttcttcttttctttatgtagtttcaagcctttttctgttatcatttcctgtctgtttgagaacttcctttaggcattcattaagggtgggattcttagcaacaacatcttttagtttttcttcatctgaaaatacctttatttccccttcattattgaaggatatttttgccagatacataatttggggttgacagttcttttctttcagcacttgaaaaatgtaccacttccttctgtactccatggttcctgaagaaaaatccactgtcatttgaattagtgttcctctttaagtaatgtgccattattctctgattgctcataagggtttttttctgcttcttttagttttcagaatgttaaatgcaatgtgccttggcatggatttctttgggtttattatgtttagatccctcagattctttaatctgtaggtttatgtttttcataaattttgaaaattttcagccattatttctttgactaatttttcttactctctccgctcttcctctctttctgggtttccaatgatagaaacgtttggatcttttgttattgcccacagatccctgagccccctcttcttcttcttcttttttttgttttgtattgttttgttttgttttctttagattactttctctttgttgttcaggttgggtgaattatactgatgtgtcctcaagctcattaactctatcttctttcatctttacactactaattaacccatccagtgagttattttatttttgttattgtatttttcagttctttaatatccatttgtttcttttttataatctcaatttctttgctgagattttctatttcattaatttgtttgaagtgtatttgtgattgctggttgagcatttttatgatgatttatttaacattcttgttaaataattctaatatctgaatcaccttggtgttgacatctgttgatcatctttactcattcattgttgtgattttcttggttctgggtatgattaatgattttattatcataccctagacaatttgcatattatattttgagactttggatggtattcaattttactttttagcgggcagtctttgtgttaaagtgtaatgtaagggccaggtggacatattgttcattttcttgctaggccccactaacaccactctggcaaaatagagcgctgactgacaaagccttattgctgataggtggagtggaagttcagcttaccctgggccctgctggggaaagtggggtactaaattgccctgccttgttgccactgagtaggatgtaagcccagcttcccaccagcccatgctagggaagagggaaatagagactgatccatattgcctttttgctgcaaggtgaaagagaaatctcaaatccctgctgggtccatctgataccaagttgaaagggaggaacaaaagtgcagtctagagctgcctattcttccttattcagtcttgttgctgctaggcaagggtatggaggttcagctccccactagtctttgctgataccagtgattgggtggaaaatggactgctggccatccctgacttgcaggactgagtaggggtggaagtaaaggtttccaatccacctcactaatacctgaggtgggggttacttggtaaagtctagtgctgatttagccccatctcgtaccacctcattaagtctgccaggtgggagtggagactcaactcccctcctgaccttccttacactaccctgatggggaagtggtagcatgcttgggcccctgacacctctgggcaggggaatcagaggaccgacatctgcttacatgagaattggggatggggtggagtggaatatcaacttcccactttgctaggctgaaaccacaggagagggatggtttttctgttggtgttgactaaagtagggtgggtaatttcagaaaggttttctgttatttaggccaccttttccacagtccttttactaggggaaaaggcttttcctggaggagttttttaattaaaaaaaaaatactttttttaacagcagctttaatattacagcaaaattaaaagaaagacagagttccaatatacctcttgccccttcatgtgcatagcctcccccctcccccattacctgcatcctgtatcagaataacacatttgctacaattgatgaacctacatggacacatcattgtcacccaaagtccatagtctacgttagggttcacttttgatgctgtacattctataagtttgaacaaatatatgatgacatgtatccatcattacaatacacagatcactttcattgccttaaaaatcctctgtgctctgcctatttatccctcccttccaatccctggcaaccactgatcttttactaccttcatagttttccttttccagaatgtcatatagtcagaatcatacggtatgtagccttttcagattggcatctttcacttagcaatatacatgtgaaattcctctgtgtcttttcatggctcaataactcatttatttttagtgctgaataatattccattgcctggatgtgtcacagtttatccattcacctactgaagaacatctgggttgcttccaagttttggcaattataaataaagctactataaatatccatgtgcaggcttttgtgctgacataggttttcaactcctttggataaatgtcaaggagcatgattgtcagatcatatggtaagagtatgtttcgttttgtaagaatgccaaactgttttccaagtgtctgtaccacttcgcattcccaccagcaatgaatgagagctcctactgctccacatcttcaccagtatttgttgttgccagttttccagattctaataggtgtgtagccgttatctcattgttgttttaatttgcatttccttaaagaaataagatgtggagcatcttctcacattcttatttgccatttgtgtatcttctttgatgagatgtctgttcaagcctttggcccattgtttaatcaggttgtttgttttcttatattgttgagttttaagagttctttgtctattttggacagcagtcccttatctgatgtgtcttttgtaaatgttttctcccactctatggcttgtcttttcattctctttgcagagctgaagttttccattttaatgaagtccaggttattaattctttctttcatggtttgtgccgttagtgttgtatctaaaagtcattgccacatccggggtgatttaagttttttcttatgttatgctccaggagttttataattttttcttttgcatttatgtctatgattcattttgagttaatttttgtgaggggtgtaaggtctatatctacatccttttttttttttttttttttttttttgcttatcaatgtccagttgttctagcactatttgttgaacagactatctttgctccattttactgcctttgctcctttgtcaaagaacagttgagtatattcctgtgggtctatttctgggttctccattctgctgcattgatctatttgtatattcttttaccagtagcacactgtcttgattattctatctttatagtaagtcttgaggtcaggtagtgtcagtcctttgactttgttcttctctgtcaatattttactaactattctggatcttttgcctctccacataaactttaaaataagtttgttggtgtccacaaaagaatgtgctggagtattgattgggattgcactgaatctatagatcaaattgggaaaaactggcatcttaacaatattgagtcttcctattcatgaacatggaatctctttccatttatttagttctttgattttttcatcagattttttgttttccttatatagatcttgtgcgtattttcttagatttatatgtaagtatttcattttgggggtgctgatataaacagtaatatggttttttttaattttaaattccacttgttattgctggtatgtaagaatgtgattgaccttgtgtcctgtaaccttgctataatgacttattggttccaatggttttgttgctgttgttgttgattctttcagattttctacatagaggatcatgtcatctgcaaacaaaggcagttttatttctgcgttcccaatgggtgtaccttttgtttcctttttttgtcttattgctttagctaagacttccagaacaatgttgaaaaggaatgatgagagtggacatacttgccttgttcccaatcttagtaggaaagcttctagtctcttaccattaagtatgatagtagcagtttttttttgtaaatattctttttcaagttgaggaagttctcaattctgagtttaatgagagtttttatcatgaatgggtgttggattttgttaaatggcttttctgcatctattgatatgatcatgtgatttttcctctatagcctgctgatgtgatggatgacgttaattggtttttaaatgtataatcagtcttgcatacctaggataaattccatttggtcatagtatataattgtttttatacattattggatttgactcatcagtatttcattgaacatttttccatctatgttcatgacagataggaatctgtagttttctttccttgtaatgtctttgtctggtttttgtattagggtgttgctggcctcattaaattgagttataacatattctctctgcttctattctctgcaagataatgtagagaatttgtgtcatttcttccttaagtgttatgtagaactcaccagtgaacccatccaggcctggcgccttctgtttggaaaggttattaactattgattcaatttctttaatagatacaggtttgttttgattgtatatttctgcttgtgtgaggtttggcagattgtgtctttcaagaaattggctcattttatctaggttatcaaactggtgagcctagggttgttcacagtattattttattatgctttgaatgtccatggggtctgtaatgatgtccccactttcatttataatattaataggtcatgttctctttttttccttagctttgtccagaggcttatcaactttattgatctttttaataaactagcttttggtttcaatgatttttctctattgatttcctgtttttaatttctgctctaatttgtattatatattttattctgcttacttagggtttaatgtgcttttttttttcttttttcttttttgagactgggtctcagtttttgcccaggctggagtgcaatggtgcgatcatagctcactgtaatctcaaacttgtgcactcaagcaatcctcccacctcagcctcctgagtagttgggactacaggcatgcaccaccatacctggctaattttttttttttttttttttttttttttgtggaggcttgtcttgctatgctgcccacactggtcttgaactcctgacctcaagtgatcttcccagctcaacctcccaaagtgatgggattacaggtgtgagccaccatgcctacctagcctcttcttttctaatatttacattcaaagctataaatttcttctttatcactgattttgctgcagtacacaaagtttgataagttgtgttttcattttcttcaaaatatattttcaacttctcctgagatttttgacccatgtgttatttagaaatgtgttgtttaatctccatgagttttggcgttttcccattatctttctattcttgatctctagtttaattccatcgtggtctgagagcagacattgtatgaattctgttcttctaaatttggaaaagtttattttatggcccagaatgagatccatcttggtgaatgttccatatgagcttaagaagtatgtgtatctactgttgtttggtaaatgtcagttatatccagtcgatggtgttggtgttgagctcagctacgtcctacctgtgtggggtttttatttctttgttttgttttttgttgtttttcttttgcctgtgcctgttgacagttccatgttggaagcttctgtagtgtcctgtccagaatatatgggagtcaatatggaaacctatggaactcattgctatgttatttcccaagtctaggactctaggttggtcaccttttctttctactttctagaggctttttatgcttttttattatgttatgcccagatttttgtttgtttctgtagtttgctttttaaaacactttaaattgtggtaaaatgcatatgacataaaatttactatcttaatcatttgcaagtgtatagttcagtattgttaagtatattcacattgtcgtgcaatgtctccaggtttgtttagttgtaaggagagagacatgggagaagtaaggctacttcatattggtcagaaccagaagtgacctatagtatgttttcctggctcttcttttatgttttatttttttccatatggaatttagtatcaaattgtctagcaaaattaaaaaacttgttggtattttaaaaattgagatttcatcttatatgtataaattgttaaacagaactgacatctttatgatgttgagtcctcctattcaagagcaaggtgtgtctttccattcattcatgtctacttttgcatctttcaggagtgttttagaatgtcctttgtagaggttttgtacactgcatgtcacgtttatttctaaggatgattttttttgtagataaggttttatttcctattgtgtattcccctttcatggttgtttgggaatatggaataaactagtgactttcaaatctggatcttagccctatcacctgagcccagacccagatttgtgacagttcatcccacctacccatttagctagtcctctcataccttcaactcaatgtgtgcaaaggtcaacttgtgttcttccctgatcactccaaccctcacttggacactcaccagacactgaatttatttctgactcatccctctacacccccttaccagctaattggtcattcagtcctaataattctctagcattctggaagctatggtcatgaaatctatgtgttagatggaaccatcaagtcatctatcataacctcatttctgatgcctaaattcactattcaacatccccattaagaagtttcatggcatatgcttggacatatatttccagggacaggtaacttactaccttatgaggcagcccattttatttctggccattttgatcatcacatacttttccatgtatatgtcagtcaaatccatccccttctttctaaaattatcaccccgtgcttgctcagcacccactccacccacagtgacccttctgcaacagttctgccaggttccagcacacacagactgaagggtaaaatttttcacctaatatccatcgcattttgtgatgctggccccagcctacatctaccacttcatggcttaccacagagagaggagaagaaggagaaggaggagaaggagaagaagaagaagaagaagaagaagaagaagaagaagaagaagaagaagaagaagaagaagaagaagaagaagaagaagaagaagaagaggaagaggaagaggaagaggaagaggaagaggaagaagaagaggaagaagaagaagaagaagacagggaacgaaggagcaaaaatacactagctttccaaaggtccatacgaacattagttgtggatattccttctttcctgctgtatcagtgggggttgcagggaactgggagcactggtattttcagtaggaaggctgtcagtgatagtaattaccctggggtactctcagtgtggactcaataatggatgctactaagcacttgacacaattgggatatagagatatacacactgctatcagaccaataactcaatataacaccaatgactataaatacaaagcagactatagattactacctcctccgtgaactctcataggacatttctatgtcctatgacatagaaggtacagagtgcttgcagccttatggtgtaattatttatagaaggttagttcctgtagggcagttcttttttatccatgtctgcatctcccactctgtcttcttcccttatcagaatctcatgcactctttagggtcccactcagatgtcacttctgctggaaatctttctctggtctctttagccagaagtcagtctacaaacacttccctaagcaccctctctgtgctaggtactgtgctaagcactgagtatgacatgctggtaaacctttggaactttccctggagaaagtgggaagccaccatattttcaagcaaggaagatggtcagagcagtgttgtggaaaggtttctctaccacagtatggaggacaaatgggaaagccaagactggaggcaggggaagccccctgggaggtggctgtggcaggagtccagggaagagatgatgaggataaaccggggcagtggaaggacacagacctggcagacggttgagaggcagaattaacagatggctattactccaaagacagatttgaatgatgtgtcactcatacagagatgcgggctggaatctgtgatagaaatattatcatcggcaactgtggatggtattcaacacaaggacttgaattgggctgtgagttgaattgtgtcccccaaaacaatacattgaaatcttaacccttagaacccgtgaatgtgagtttactgggaaataggatctttgcagatgtaatcaagttaagaagaggccattagggtaaaccttaatccaatatgactagtgtagttataaaaagagggaaatttggagacagagaaggacacagagacatacagggaagagaaagccatatgaagacagagggagagataggagtgatgcatctttaaggaacaccaagaactcttggaagccaccagaagctaggagagggcaatggggcatggaggcctcagagcctccagaaggaatcagccctgctaacatctggatttcagacttctggcttccagaactgtgaaagaatgaattgctgttgttttaagccccacagtttatggtcatttgttatggcagccccagcaaatgcatacaaatggtgcgaaagaacaattgagcaggctttcagaggctattgaggggctgatgaggagacattcattttgtaaaactctggcattggtggtactcaatcatcttatatttaggacccagcctgccctgttttcttgcagggaggttcgctcattagaataaaaagttgtcacatgctgttgtcagagaaacaagacggtggcctaagagatctacaaattcactctgctctagggctgaagtagctccctcttggtcacagactggaagggttcagcactcttttgtgcagaatggaagttccctggggaggtcagaactcagaacttccagaggaatgtacttcttgctctatctcagcatcccttatctcatctcttattgtgacagctacagagacttcaactaatttgagttatagtgagaggattttgatctagaaagtggagaaaaggcaaagatgttaaaagtcattgtggtttaaggagattttgggctgagacaatggggttttctagatatacaatcatatcgtctgcaaacagggacaatttgacttcctcttttcctaattgaataccctttatttccttctcctgcctcattgccctggccagaacttccaacactatgttgaataggagtggtgagagaaggcatccctgtcttgtgccagttttcaaagggaatgcttccagtatttgcccattcagtacgatattggctgtgggtttgtcatagatagctcttattattttgaaatacgtcccatcaatacctaatttattgagagtttttagcatgaagcgttgttgaattttgtcaaaggccttttctgcatctattgagataatcatgtggtttttgtctttggttctgtttatatgctggattacgtttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattatcttttttggttgtgtctctgcctggctttggtatcaggatgatgctggcctcataaaacgagttagggaggattccctctttttctattgattggaatagtttcagaaggaatggaaccagttcctccttgtacctctggtagaattcagctgtgaatccatctggtcctggactctttttggttggtaagctattgattattgccacaatttcagctcctgttattggtctattcagagattcaacttcttcctggtttagtcttgggagggtgtatgtgtcgaggagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacacattcaatgccatccccatcaagctaccaatgactttcttcacagaattggaaaaaactactttaaagttcatatggaaccaaaaaagagcctgcatcgccaagtcaatcctaagccaaaagaacaaagctggagacatcacagtacctgacttcaaactatactacaaggctacagtaaccaaaacagcatggtactggtaccaaaacggagatatagatcaatggaacagaacagagccctcagaaataatgctgcatatctacaactatctgatctttgacaaatctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacattagacctaaaaccataaaaaccctagaagaaaacctaggcattaccattcaggacaaaggcatggacaaggacttcatgtctaaaacaccaaaagtaatggcaacaaaagccaaaattgacaaatgggatctaattaaactaaagagcttctgcacagcaaaagaaactaccatcagagtgaacaggcaacctacaaaatgggagaaaagtttcacaacctactcatctgacaaagggctaatatccagaatctacaatgaactcaaacaaatttacaagaagaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacacttttacactgttgctgggactgtaaactcgttcaaccattgtggaagtcagtgtggcgattcctcagggatctagaactagaaataccgtttgacccagctatcccattactgggtatatacccaaaggactataaatcatgctgctataaagacacatgcacacatatgtttattgcggcattattcaaaatagcaaagacttggaaccaacccaaatgtccaacagtgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacactgcatattctcactcataggtgggaattgaacaatgagatcacatggacacaggaaggggaatatcacactctggggactgttgtggggtggggtaggggggagggatagcattgggagatatacctcatgctagatgacgagttagtgggtgcagcacaccagcatggcacatgtatacatatgtaactaacctgcacaatgtgaacatgtaccctaaaacttaaagtataataaaaaaaaagaaagaaagaaagaaaaaagactatgtgaggcaagaaaagatttgtgaagagttcacatttaagttgtcttccttaatacattccactctttagatggatttagaataataggaaaaaaaccgtagtgttgcgcttagagacttcatgtgaaatcccatctcatgtgaagaaaatgtgctttcattacttataatgatgaaataaattatctccattcttggaaccacttctttgcaaatattttagatattatttcacaaatgaaagaaaacagagaaggctgctaccaccagctttggagggaacaatttaattttcaagatatgtatctattgtgagttggcaacaatggctctggtttccaaagacagtgggaaaattgctgcgcatttcggaaatggttcccagacacttcccttcgaaaacgtaagcaaccaaacgcatacaagcaggcattaaagacaaatgcaattttataggcagccattctgttgcatggcatgataaatagacaagacgagtgttttgcagccagccagcttttggcttctaagagagctggaagggaaaactgacatgaacactttcaacaggctaccctggttgaaattaggaagagtttatttccacagttaaaacaatatgattctatttctattgcctgtgttacgtcgagttcccctatttatcaaacacaaagttccattgttgtgatctatggtgagcaaaggagaacctgccgagtcccaagcagatcttagatgtaaatcatttgatccgttgctcaaaactattctatcccataagcccaagagctcatatcagggtgaacaagacatttgaaaaaaaccaaaactctcctcctggagtcaacaggaaaacatgcccctggacaaagcttataactgttgaggccacatgtgcaatgtgctagttaactaggaggaggaagttccaggaaaacgaccaacatctggtttcaggcttattccattcttctcaggggcccccagtcaactgtgctcacctgaagagacatcttgagccagccagagagtaagcagctctagtttctcctgagcttgactttgtccattgtatttatttcttctgaactgatttctccaaaatcgaaatctgtagcacctccacaactttgatagccttttttgctccaattccttcaaggataaatatttaactccattttgggtcaaatacaaacttatatttctggggtttaaggattcacacagctagagcttgaaaggcatgttactttaacatgtttcagacccacagagctgtccagtggaatgtcatccactaccattcctcgactgtaagcatagttgattatcaattcagaaacactccgaataagcagttgtgtgccaagactttgcagttcattcatccaattagccatttgtttattcatctaatcaagctgcctatgtcatactgattccagtactcatccttcctctttttgcttatgcaaagcaagtatgagagaattgtagaaaaggtatagaaaagagacaaacttttcattctgtattgtattctgtattcaaagttaaggtacagtaaagtcctgttaacgatgtaaccttaatgcatctgaaaggtattgttttaatgacgcttaccttttaaatgatgaagatgcctctggcggtttatggaattcattttatattcgtttaagaaattgctttttatgagagagtatttctgctgagtttctcttgggcattggaagttagagggggtagcccacacatctgcgaaggtcaatagggtctttgctttccattaaaatgttttccaattctcacagcatttgtcaatatacccagaagaatcagaataaaatgaatccatggcttggtatccagtatgcagcagacatgctgcctgctgagtcttgcacaggtgttctctaaaaagcgctgaagttggaactgggagccctgggttcaagtctcagcccagggagatcattcactggctgcatgcatgcatgcagttataagcctcctcatcaccctggtgtctcaagagcctggatacctctacttgtctatatgactgatatgaactgagctccatgcttaagggttgtcaaaaagcagcaccttcaccctgatgcctacaggtcatagtttgtagagcagcctgagatgatggtactggattgctggcaggcccagctcactgctgaattataccaagatgactgcaattaacagtccctagtttttttctcaagccacatttcctccacactatacttcagcagataacccaaatgtagaacttgccatttatccctgttaaatttcccatgaccatcttgagctcgtcaagatctttttggatctcaatttcatgctacagagaactcatcaccttctggcactatctcaggggcaaatgtggtaagagtgaattctcaatcctcctccagatcattgagaaaaagtgaaggaagccgggaggcagccctgggacttgcctccaggtccctctctgtaagggagggtgttaatccattatccatggcctttagattcagtcttttaattggttacgcaatcacataactgggctgtaaatgaagattttacaacagatgctgcctagtgctttgctgaggttcaaaaacacttgcctgcttttctgtgatccacctgcctggtgagctcttccaacaaaaaaggtaagctattctaacacagcaagctactcctaatgagctcttttttgcttttgtcttaaacacactttgcgctggcttccttttctaagcactcactcactattcttttaatagtatgttcctgaatttttccaggggggccacatcaagcaaaccatagctacataagatattcagttaaaggaattttccttcggaaatttggaagtacatgcccatctagtagtttatggctcttttttttttttttttttttttttttttgcagttttctgtggttccttaatgctccatgataaaagctcacagtcttgttagcaagtgctctctctctctctccctcagcaccctagcatgtcgtttgccctggccatcgatgaccaggcagttctctcacaatcacttcctccatcacagacttcaaggccaactgaggagttctatcctttgtacattaaagatcattctcctattctatgaagaagcctgaaacttttctccaaagactctggtttctccttctgtggggtatgacagtctctttgctattcagggactccaggggtgtggtgtctctttatctcttttctctttcaggggtacattcttgtagctcctcccaccccttccccctttccccctgactctggttgtgattcatatagataggttgcattcatcaggtgctgctgcctctcctgaagaagctgctacctctcccctttcctcttcttggtgtgatgagccttcaactgtttgtttctttttagtggaacagggtttcttctcttctcccctgcctcgtgcttctctttgcattcctgattcagtcttttgttctcaaacagtgttcctgggtagcgtggaaagggagaagctgcacctccgtagcaaactcatcaatgtccaggcttatgaattgccctgggcccacagatttccagtgatggctgagcttccatcattgcatttccaaaacagcgaccatatgacacttacacagaagggaaggattcaagaaatactgtggaagagaagtcaagtaagggcaactgagtggtctgtaagcaaaaagacatctcagatgatctctcaagatccatgaataagtaggagcggtgatctgatcacccacagtaacaagaaatacagataccagcaagtgaacaccccaaaaatgtccaagtcaggtttgcaatgcctcaggtagctaaaggagagttgtgataggagtaaaattaatagtacttaccttaacttaaaagcaggccagacacagtggtctaggcatgtaatcccagccctttaggaggctgaggcaggcagatcacttgagcccaagggttccaagaccagcctgggcaacatagggaaatcccacctctacaaaaaatacacaaaaaacatattagctgggcatggtggtgggcgcctctagtcccagctatgtgggaggctgaggtgggaggatgacctgagcccaggaggtcgagtttgcactgagctgtgagtgtgccactgcactccagcctaaataacagcagaatgagaccctgtttcattaaaaaaaacaaacaaacaaaaaaacaaacaaaaactcgtaaggctgtttatggatggggcggggaagagagggcgaggaaataaagggtagccgtgaaatcaagttagtgggggaagttgtaacaactctgtaagggcttaaggcaaactccatcagtccacatggagtctatggggttgagcttgagatgccagtgagaagtatggctggaccagtggaagaactggcaagaagcacctaaaaggtttcagctggtggagagccagctaagatgtagagtccatcttgagggatgcaagaagggaaagagcctgatgatggagctgaagaggtagatttgcagggagtgcaggtggtttctccgtctgtgtcagtgcttgaagcttaggggaagcctggaggggtgggggtacaatgcaaggaagactggggagagcttcacatgttgttcccagttagttaggtatgagatttcagggagaactgaaatctttccctctcacactcctaattgttttgatgtgtttggatgtcaagtcacgagtctcagagccttcacattgttgtttgtagccaaaagtacaaaatagaatcccagtattgtcaacatgctgacacatggacttctctcttcttaataagtgtttgattatgtttccttctatgaaaatctgtatccccacacaaacaccattttagttttagaacattttgtgggggcactttaaatcattaacttttaaaaatatggttctcgatcatatggttttaattattaaatttttattccctaaatttgactaaaaatcatgtgatttgcacagcaaacaggccagttaaatgaagtgaattccattcactggcagcctgcctgctgttcctgtcaataagtaagtttagtttctgcttctggggctcacaactcctgacaggtggcttgctgggaccggggaagcaaggaaatcagccagagaaagtgtccttggcagcaaagggtctcactgggcaggtttttagggaaatcttgagattggggcaatgtgggatgtggtggcagcatcctagacatgacagacagcctctgagcaacctctggtcctacttgtacatatcccctctgttcattaaagcggcctcagctagagcttttccaggtggttggaggccaagaggcattgtgcataccaaaggctgaactggacttgctgctggcaagactgctccaaagcacagggagcagtggcaaagaactcatcaagcaaggcaacaatctatcatcctctgctaaacctgatgtcccagcttggaatccagagttggggtggggggccatcagtgctggcaaacttgtgggggacaggggctggtgtaattggagccagctccctggagcctcacaaccatcctgtgaagcaaatggggctgtggttcctatcccagaggaaagcactttggctgaggaaggggaacggagcactggtcaggcctggcgatacctagccagtacatggctgcctctgacttccttccagagtgaaggtgcttacccttagtagggaggaccctggcctggctggtatgcctccttggacttagcggggtctgggaatgcaggagaggctttagactctaagccaggggtgtccaattttttacttccctgggccacagtggaagaagaattgtcctgggccgtacataaaatacactaaaactaacaataactgatgagctaaaaaaatcaaaaaaaacttcataatgttttaacaaagtttacaaatttgtgttgggccgcatccaaagccatcctgggctccacacagcccaccggccatgggttggacaagcttgttctaagccatcctgacaggcagtgtagtcaggtggttcaagctgaactctggcacccagtggtctgtgtttgaatcttagctctgccactgatgagctgtgtggccttgcaggaagatattcaacctctctgtgtttatctatttcctcatctgtaaaagagagatgataataatagcatctgccttgtaaggatgtggtgaggatcaaaggcacatctgtaatatgcttagaacagttgttgacatgtggtaagccctaccgatgttagctagtggcactgtcttcctccaagcctccattccagtcctagcagagggaaacctggccactgtgatgatagctgctggatggagtgaaacattgtcatggtgcagaaaacaatgctgattgtttttctgtctgtctctcccctccaaaataggagactcatgctgaatgtccagtccgtagaagccagcctggcatgtggcaggtgcacaatgataaattaatgagtgagtgcaagaattcccccttgtggcaaatggctctggaaagaatgccaaccttaaaaaattactaacttcaatgcaaatgcagttgggtagcagagaacaaagggacctataaaggtgccagacattctactggggtagacttaagagctggcctaggagtcaagaggctggcttttgagaggctttactgcttcgttgctgtggggccttgagccagctcctgacttcttctgagcttcagtgtcctctctgaatgacaaacaatgtaaggtgggaccaaggtctgcgacctccagggagttcctttcctatcagggcccagaacaaacaagagatcaaggaacacacccagttcctaggcctgggctcactactatcaggttcaaggtcctgctcaatttctgacagcaatatccacataccatttctatgtcaattataggagccagtttctccagcttactttataaaatgttaattacttcccccacctccccacaaatgtgaaacttggatttaaaaagacattttggaaaacaggtacattttgacaggaacaatctgaaattgccacaggcataaacacatacaagtggatactgtttggtttgcttctgagagccccgtttagtggagagccggccgagccagtgactatctgaatgaagtataccagccatgccattatcagaggaaaggatgagtgtggactagtcaagtggctggatgctaattttatcacctttgctttcagaaaccagatcccattctggcagcaatggttcacatccctggctccttactgtctttaggtaatcataatattaatgtcccagtgcacccttaagccctttgcatctctcttcaaagcctttttcagacatgcaatacttatctggggtgaggggttgaacttcccactgagagaccagaactgatcagatgggcgggcctccaatcgcgagcttggctttaggcttgtagtcctcacttttctcaagtccagccacggcagcctgccaggcctgcctgccacaggcagccttattcaattgaatggggtcttaacaaggggaaaagccagagacatgaactggcgcatggagcacaatgatgctgactacccagcaaaggtaagcttgagacactctgaagcaccacactgactgtaaccacattgcataaaacccaacacaatccaagagaaatggaatcctcgtggggatagcattgggccaatagctcaacagccacccaaagtctccatggaacaactcaaggccagagcaaatttagtgacatgccttccctgttggagcacctgtatagcagccccgcagaagaggttgtctagtcccttccaggactcatgggagcccacgactctatagccattcttctccgccagattccacatcttcatagctttaagttttttcctttgccactccctatcttatttcctttctccattgtgtgttagcatacttaacagatggagaacagcatatacaagtggcttacaggactgtcaaggtagcagaggcacatttgaaaacagctcatgcaaccaaatgccaatgattgagcaaaccaccactcaggactgactcccccgcgttggccctgaaaatctagctactcagtgcttccatttgcagacataaacatccacttaggagttctgaaaacaccatctaagccaacatttggactcaagtaacaccaacagggctgcataatcagtaaactcacttttctgctctgtgcctttgcaacactctctgggaaagatgcagtagactcttacagataaaagttgacatggaggcaagttactaatatatagaaatgttggattttaagtaaagtatatttcactctgcagataaagggaacagagattctttttttcttatctcaaaacagactctttttgtagaattgatgaaatggaagtaattgtcaagaactgagagcattaatcaagaaaaagatgaaaaaaaaatggagagcaaattaaattaacttggaccacaaagaatatttaatgtttttgcccctgaaatccatttgatgtttcattttccccagatatagtacaggtggcctcaccatcattttgataagagcggcgccccagtcaccctctcccagtgatgcactgtgaagtgtttaacaaggggctctctaggaggaaaaaaaaaaagctctgattaaagtgatagcactgactgccgtgttgtaaatactcttgttgtggccgatttctagctaccaacatgatgtcacccaccttgcaaaattcctgaaaacataacagttggcttttgggagcccgtttgagataactctagcccaccactgtcccctcctctgcctgtatgtttcctatgctctccactctgggatcatagagccagcaaagagagaaatcacataagaataagacagattgttataatgatcaacacacacatgctaccttttggtttataaactctttccccaacattaattattgtggctaaactaacctctatgtgctaacagagtgccagaatgttttacaagcatttcatttaatcaataccaagaagtaggtactattagtatccccatttcacagaggagaaaactgatgttcaaacagattcagcaactcattcaaagtcacacagcttgtaagtgggtgagctaggactagaacctaagctccttggttgtgctttggcagtaagaagaaaacacagtatcagaaaaagtggtaaggacaacagtttggcttagctgaggaatcaggaaaaaaaaagcctaagtaatcaaataggtttcagtgtttctttagcaggtgatcttatcctaggattcaaggatagaattcagggagtctgtaaacttgaatgaggaaaaaattatatttctgttttcactaacctctaattgaaattcagcctttcttcaattatgcatgttggcaacaaaccacagtagtatttacataatctgtgactttgtcgccaagagaaatcatagatattttaatttcacattacagtcatagcaggaatcttcaaatatcactaccttgaaattacagtaattatgagacctactgctaggtcttatttaatgagttaagaagcacataaattaatatatcgcaaatttgttttgttaatatgttaataactattttgatcccattgttttattttatgcttttaaaaacatttatttattattattatttttttcctgagatggggtcattaagtttcaccagaaaatcgagggcatccatgaatctatagcctctctgcttcctcttcaggtataatgaaactttttatggccagttagagaggttctcctgagagctttatgtttgagttccggaatggctgggcccatatggacagaggacacagccgtcgcctgtaatagtcgatgggcactccaccatttttccccactgagagagtttgggagccatgagtcagtccttcctgggaaatggctgagaagaagctttcagagatgaaaatgaagtggagagcgcaaatgaaggaggggcaggggagaagctgagtcagaccctcgaccactcttctaggggtactgtctcatcctcttggggctgaatcataccagggtggctctgctcttctgcctctgcctgaatttcccttggtagggctccaggccttcatttgaggccaaaatgaagggccccaaacccagccaatgtgtgccaaagagaaattctagaacatgtgtgttactatcttgatggaaaaatatcaatggtgggggtcttccaaggactatgggacccacgtctgcttgacttgaccatcagggatcatgagcccagggacacctgtatttcaacagactaacaagctgaagctgcagcttgggatgtggggttacttggttttggtcatttctacctcacaatgaaggctctttgaggtgatggggtctggagcagtgtgcctttcctttctgacttgtacttttagattgcatctgtctgggaaagatttcctttcttttttttttcccagctcttccattacctgctatgtgatgggggtgaggcttttaccctttctgtgccttagtgtcctcctttgtaaaatggaggcaataatagcatctacccatcagatgctgcgagggttaaaaagagacactataaggtcctaagcaccatgttcaatccagagggagaactcagtaaagatcaactgttgtcatagttcttagcatgatgcgaaagacacacagcacatatgcctggccaagagggtaggctgaataaacgttcaagacctttctcttcctcctcatcccaccctctcaccccatcactttaaatccaaggatggtcagagtctgctctcaggagcagaggagctgaaaatggccacgctggggagggttggtgaccttagagtggaagtctcctgactccaggtctggcattctttttgctcccccactttgacagtcctcaggcaccttctgacacacctccagagcctcagaatgcccagcacaaaggcctctgtccagcagggggcctctgtaaggtgaggaattcgctgatattaagcctcgtctactccccactttgcctctctccaactgacctctaaagagatgataagaaaagagaagaagggctgtaaaaaacagtaagtgctcaaagcgtggaaaacatataacatcacaaccaccctctctttctagcttattccaagttataggccaagtatatcctgtcccattgcgatgggttcccagatccaggcaataacatggctgcacaggtgggctccaggatctggaagtgagtgcccagaaaaactgcccattcattcttcagggagttccaattccttaggcaggcaatcaggggctctgaacacttggctgtcccctcccttccttcatccacctgcagctgtcagccttcccctcaaaggacctagtttgactccttttgatggccccctattcccaatgcagccctattccccacatccagttttcccttcaccacttgaccctcctcccaatcatgtgtaataatatagcctccagaatcaggtcacaggttatttctggatccagcccaatgtctaatttgctgcagaacatgtgtgaaaaatcatgaacctctgccaactccatagagagccatggatttttaaacaattacaccagtgctggaatgtaatattgtacaactactttgaaagaaacaatttgggaatttctttaaaagttaaacgtacaccatataacccaagcattctactgctgggtatttgccaaagactaatgaaagtgtatgtccatacaaacacctgtatagctacgttgatagcagctgtatttgtagtcaccccaaaccagaaaacaatccaaatgcccatcaacaggtaaatagataaataaattgtggtataattcatataatagaatactattcagtaatttgtagaaaggaatgaatgatgaatatgcatgcaacaacctgaatgggtctcagtcattatgctgaatgaaagaaaccaggcataaaggattccctattctatggttgcatttatacaaaactctagaaaatgcaaactacagatcagtggttgcctgcagatgatggagaggggccagagggagggactacaaagggccacaaggaaactttggggactgatgaatatattcatcatcttgactggggtgatggtgtacacatatgcaaaactgatcaaattgtactttagatattttcagtttactgtacatcaattacacctcaacaaagctgtagaataatcaccccagcagctcatcttgcagttgttggtgacatccctgagcctcagaaaatgggaatgtgtgcaatgttttcatatataatgtactaacatgctttgttcattgctctgatggccctgtgctttcttagctttctgggtgagaatctccaatatattttcacttgtactttctgaagggctctcaggaagccacagcctagagagaagctgtttatgaaggaaattgttctttaaaataacaatcatttgtgatacctttagtagagatccaatgaatacagtggaccttgcctccttacccttcagtttttacctttttccattacagggtgcagttgatccattcagaagtaagatgtcctgtgaaatgttttgccatgtgggctgcctgtggtggctctcagaagggctgatctgccttgcccttcctaccttttcctccctccctcctttccttccttcctttccttccttcctttcctcccttccttcctcccttcttctttcttccttcctttcttctttctttcttcctttctttctttctttctttctttctttctttctttcttttctttctttctctgtctttctttctttttctttcttctttctttttctttcttctttctttcctttctttcttctttctttctttccttctctttctctctctctctctctctttctttctttcttcctttcttcctttctttctctcagtctgtcaccccaggctggagtgcagtggcactatcacaactcactgcaacctcagactcctcggttcaagcgatcctcctgcctctgcctcccaaagtgctgagactacaggcatgagccacagtgactggccttgctcatctttccatgttggcaaatgggagttaatgttggctcacttgggctgtctgtgctgcccactgcttagctgaaagtgagaagactgccctgccctccttagggccacaaatttgaccttcaatttccataaactgagtacaaaaatatgatttcaagcctgcaatgacttttttgttgaggtaaaatctacataacataaaattggccattttaatgtttacaattcagtgccatttagtacattcacactgctgtgcaactatactttctagctagttccaaaacatttatgtcaccccaaaagaaaactctctagtcactaccagtcactcatcatcccccacaccccacctcagtccctggcaactactaacttgttttttgttcttatgatttactgatttgccacattccatgtaaatggaatcatacagtatgtgacttcttgtgtctgggttcttaaactcagtatcatgttttggggattcctccatgatgtagcatggatcagtactttatttcctttgggggctgaatcatatttcagtgtatggaccacaatgacttttttttttattactatactttaagttttagggtacatgtgcacaatgtgcaggttagttacatatgtatacatgtgccgtgctggtgtgctgcaccagtaactcgtcatctagcattaggtatatctcccaatgccatccctccttcctccccccaccccacaacagtccccagagtgtgatgttccccttcctgtgtccatgtgttctcattgttcaattcccacctatgagtgagaacatacggtgtttggttttttgttcttgcgatagtttactgagaatgatgatttccagtttcatccatgtccctacaaaggacatgaactcatcattgtttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttattgtcctttgggcatatacccagtaatgggatggctgggtcaaatggtatttccagttctagatccctgaggaatctccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgctttttggctgcataaatgtcttcttttgagaagtgtctgttcatgtccttcgcccactttttgatggggttgtttgtttttttcttgtaaatttgtttgagttcattgtagattctggatattagcactttgtcagatgagtagtatctgaatgatgctggcctcataaaatgagttagggaggattccctctttttctattgattggaatagtttcagaaggaatggtaccagttcctccttgtacctctggtagaattcggctgtgaatccatctggtcctggactctttttggttggtaggctattgattattgccacaatttcagctcctgttattggtctattcagagattcaacttcttcctggtttactcttgggagagtgtatgtgtccaggaatttatccatttcttctagattttctagtttatttgcatagaggtgtttgtagtattctctgatggtagtttgtatttctgtgggatcggtggtgatatcccttttatcattttttattgcgtctatttgattcttctctcttttcttctttattagtcttgctagcggtctatcaattttgttgatcctttcagaaaaccagctcctggattcattaattttttgaagggtttttgtgtctctatttccttcagttctgctctgattttagttatttcttgccttctgctagcttttgaatgtgtttgctcttgcttttctagttcttttaattgtgatgttagggtgtcaattttggatctttcctgctttctgttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagacagtttgttataatttctgttcttttacatttgctgaggagagctttacttccaactatgtggtcaattttggaataggtgtggtgtggtgctgaaaagaatgtatattctgttgatttggggtggagagttctgtagatgtctattaggtccgcttggtgcagagctgagttcaattcctgggtatccttgttgactttctgtcttgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttcttgaattgatccctttaccattatgtaaccgccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtctttttattggagcatttagtccatttacatttaaagttaatattgttatgtttgaatttgatcctgtcattatgatgttagctggttattttgcttgttagttgatgcagtttcttcctagtctcgatggtctttacattttggcatgattttgcagcggctggtaccagttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttccaacttggttccattctccccatcactttcaggtacatcaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagctcagagtaatttgatcgtctaaagccttcttctctcagctcgtcaaagtcattctccatccagctttgttccgttgctggtgaggaactgcgttcctttggaggaggagaggtgctctgctttttagagtttccagtttttctgttctgttttttccacatctttgttgttttatctacttttggtctttgatgatggtgatgtacagatgggtttttggtgtggatgtactttctgtttgttagttttccttctaacagagaggaccctcagctacaggtctgttggagtaccctgccatgtgaggtgtcagtgtgcccctgctgggggtgcctcccagttaggctgctcgggggtcaggggtcagggacccacttgaggaggcagtctgcccgttctcagatctccagctgtgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagattcccggctgctttgtttacctaatcaagcctgggcaatggcgggcgcccctcccccagcctcgctgctgccttgcagtttgatctgactgctgtgctagcaatcagcgagactccgtgggcgtaggaccctctgagccaggtgcgggatataatctcgtggtgcgccgtgttttaagcccgtgggaaaagcacagtattcaggtgggagtgacccgattttccaggtgccgtcagtcacccctttctttgactcagaaagggaactccctgaccccttgcgcttcccaggtgaggcaatgcctcgccctgcttcgctcgcgcacggtgcacgcacccactgacctgcacccactgtctggcactccctagtgagatgaacccggtacctcagatggaaatggagaaatcacccgtcttctgcgtcgctcacgctgggagctgtagaccggagctgttcctattcagccatcttgccatttttcttctttctttctttaatggctattctggttcttctcttaactcactgctacttttggccacttgttaaacactctttctctccctacccaccttcttaggtagttttctctgttggacttaccaccagtataattggagacagaggctagacatgtatgcaaacctatagggacatcccctcaaaatgccgagtgacaactgcccacatctctttcttagctgtgagtttgttttctgacactttctttttagaacgtgttgggctctaagtttgctgaataatcttgagcattgtcccaattaatgattcagggcttcaattccccagattgctttgcttgaaatctgggggaagagggatgtctcactagtctttggtttaatgtggaaagaagggaccccaagctccacccaaccccactgggaatctggaggcggtctaagatctttccagcagccactgaagggaagtctgttcgtaccctcctctggctggggaattgtaatcggtggatgaccatagaggaaagctagtcaccaacacagggatgatgccagctggcaagcctcgtagagtcctcctggccaagctctttagtacattgaaagaaagtgcaactcagagaggtgaagctactcgtctgtcagcttgccagggagaggttgaaacctcagtgatgtcggcacttctttaaggagaggcggtcactggacagcctgggaggctgccttgcagatttatgaggcttctatccaggatctttcagaatgtggacccaaggaaatattacatagagcgtctgtctttaagtccggtctgctgggctcatgccctggcttgggattcagggaatctgacttctagagtcatctctcaccatcttttgctagcatatgttcctgggtgagtctcttcctcagtttccctatctgtacaagaaggggattggacctttttggtgtgtgtgacagagactcgctgtgtctcccaagctggagtgcaataatgtgatctgtgctcactgcaacctccacctcccggggttcaagcaattctcctgcctcagcctcccaaatagctgggattagaggtgagcaccaccatgcccagttaattttgtgtgtgtgtatttttagtagaaataggatttcaccatgttggccaggctggtctcgaactcctgacctcaagtgatccacccacctcggcctcacaaagtgctgggattacagacgtgagccactgggcctagcctggactttataatctctagttttccctcctgatattaacattctaggattctaaccaagctttgctataaaaaaggaggagaacaaaaagggattgctgtccttcagctcagttgctgtctccattgcctgcattgaaaaaaaagggctgcccttcccttgtgcctttagtgcacacagcaccaccctgtccaaggggctttctggttcaaggtctcatttgatccttatgtgcaccatgggaggggaggagagtaaagaggatcagccccattttgtagatcaggaacctgagactcaaagaggtcaaatgacctatggatggaagtggaactcaggtctcctggtcctcaaccccatgttcgtttcattatttctcctagaccgccagctaaaaatgctttgcaagcctttgttgggccagctggtatgactggcacctgggcccaagtgtaacatgtttgcaaactgtttctacactctgaggcaactgcctgctgaaattactacaaaaccaaacaatttccaacattttcctcctgcctagtgcaacatttccagttgttcctgtagggtaagtctagggacacattgtttttaaaatcatttccaggggggaaaaacattatactctgtgtgtgtgtgtgtgtgtgtgtgtgtgtgtgtgtgtgtgcacctttggggctacggttgagcagtccataagggcagaaaaggaaaagaccagctgctgcccctgtttcctttgctagtcagctgtagaacaaccggagtagcaatttgagaggaagatagaggaatctatgcctaccagtactgatggggataaccccaagcttaaagagggggcccttttcctccagggcttctagtgccatagtgctttccagaagagagagaaagagagagagagagagagagagagagtataccaactaatgagtggtatgttgtgtccctgcaatggacactggaacagcaccctccaacacacaccaactttggtggtcgactatggaaaagcttaagggaattaagcctgtaggcatttagctcatgagaaaactagcacggagatcacttgaattttcagtttggactgccactttaaatccaaggtatctttgaattctcaaagtgtatgatgtttatagcataggaaaagatgatgcttatagcataggaaaagatgatgctaaacaagttcaacttttctttttcaagaaataaggacttgaaaaaacttggactcacattactttgaaggctagttctgcagtcaatcatgtgacaagatgagcattgctattgttggtgtaagatagtcttgctctgccttcgtttcttgatgtccccaagttccagaaaactctgttctctgccataatgggaggtcactgtgtgctgtttgattttagagtcaaataagttttcagcacatggtcagcttgagagacagtttgccctcaattggcttattggtttgtacaattcttggctccttcaagcagggtcctgccatctgagcccactctgtgggattatgggatacctgtacttgccaggaagtcctggcctcaagctgattcatcactgggtagcacatgacgcccagatgagaggggggcatttttaacctcaatggcatgaaaatttcctgaaatcaaaaggacagagattgggagttcctggggagcagcagcagcagcaatgtcaaaagtaggatcaaccagagcttagaatattcctacaccaactttgcaagttgttcattgatatgtgggttgctggaagaaagtttccagcactgctgggtcagcatataaacaaggaaaaaagggtgtgttgatggcccatttcaaagggaaccagtcttgctaatggtagagggtataaacatttttctccttcaaaacttaaaagattttgttgtatcttttctctaaaagaaacatctttctaaaatgtcaaattagagcaaagagtgataacaatttggactagaaaaagcagcctcattaagatataattcatataccattcaattaatccattgaaagtttacaattcaatgtgttttagtgttttcacagagatgtgcaaccatcaccacaattaattcaagaacattttcatcaccctcaaaagaaaccctgtacccattagtagtcagtccacattctcccttccttcccctagccctaggcaaccactaagctactttcagcctctatggacttgcctattctggatatttcgcataaattgaatcatacaatatgtagttttctgtatctggcttctttcacttagcacgatgtttaaacggttcatccatgttataacatggatcagtacttcattcttttttatggatgataatattatactgtacagctagaccacattttacttatccacttacctgatgatagacatttgggttgtttctactttgggctactactatgagtagtgtttctatgaacattcctgttcaagattttgtacgaatctctgttttcaatcctcttgcgcatatatctaggagtggaattgtaggatcatatagctactctatgttagtttttcataacaacttcactgttttacattcccaccaacaatgtatgagggccccaatttctccacatcactttgagctttttaaagtcaacttttcaaagctaaaagtgatgttttagaatattgatatatctattagcacaaggctataattatatgcctcacagctcttgtatagtgtcaaaacagtcctttaaaattcacagaaatattaagcaatgtgttatgcattgctaagctcacttgtgctccagcacaccaagtcatccaggctctaggttgggtgatgccttcagagagttctagtccagccctccacccaagcttgaatccaccctgcagatccattcgggagatcattcccgagaccctactattctctgaacactctggggctacagccacataaaagacatgtttccttctctcacaagaatttacagtctagaggaggaatcaaatgctagacaaatacttcctgccaaggacctggggaacacagagggagcacctgtacagaaggctcttcctatgtaccttgtggggttgttggagcgagccagtgaaatgctctgtgtaaattgtcaagcccagtgtctggatcatagcaggcacccaaagatagctgttatattcctgtatagaactttgcattttacctatgaggaaactgagtcctaaagtttaaacagctttcccagagccctgtaactcatgactgagaagccaacctttctgtttcaggtcctgcttgttgggctccaaagccttggctatactgacatctaggaggccagccttattaaccttgccctgcctgtctccagactgggctcttctgcttctcccaggtctggtttcctggatcaaggcatcctactttattcatgtcctagcataacactaagattgttagtggtatacagtaactagtaacagttagctagtccctagtacagcagggtgatctgctctaattgcagccagaagtggtcatgactgatgacagtggcttgaggagtctattgctggtgcagcattctctgcctatcagcagccccacatttcttcccaacatccaggccggaagtctggaaagtaggaatggccttagcctcctggtctgtattcagctggccatcaagccatgcaaaatttccatgaagatgctgccttccgattgcttcttctccattcccatatggcccctgtaccacagttttgtctacagaagtttataagcatttgccatgagcaaagtattttgttgggttttctggttgagagccacctgagataaatgatccctggtttcaggctcatagggatagcagaataataagaatccagagctaggtgtcctctaaatgccaagagccaaggactgctctgggctcaggatctcaggatgttccagctcttattcatcataatgagagatgatcagtccctcaccacagaagactaagcaggcccagaagctcaaagtaaccagcaagtatggtctgctgtggaaatgggccagtctccactggcatcttcaccttgcctgcagaaacatttttatccccaatgtattagtttgctagggctgtcataacaaaatattaaaactagatgacttaagcatcagaattgattgtctcacagttctggaggcagaagtccaagatcaaggtgtgtcagcagggccacacttcctctgacagctctagggaaagacctgttctaggcctctttccttggcttgaggcagcagagctccaatctttacatagtgttctctctgtgtgcatgtttctgtgtccaaatttcccctttttatacagacaccaatcatattggattaagggcccaccctactccagtaagacttcatcttacctcattatatctgcaatggccctatttccaaataagatcacattatgaagtactgggagttagaatgacaacatattaatttggaggacataattcaatccataacatcaacatgcatgtttgaagatagacttgaattactctgccatcaacattatcttcacccaagtagatgtgttccattcttctgcaagctcatttgaaagcaggagttcttttggcttttcttttctttgagggccaaatttcacccttgaaaaatgatggctctaatattcaatgtcttctgccttaaccccaaatctgcccaatagtctggagactccaggtaggacatgatggcctcacctcagaacttttcttgggaatgcctgaaccacacctcaccctatccaggcaacagaggaagaagctattaggatgagggacagactcaggcatgtccagcaacttacctggagtcactaagagtacagctcagaaacaggcacagagcttgacttcacaatgcagctcacctttggacgttccaggctgaagcccaaagttgtttctgccccttagttcatttttcctctgatttggtgagggttgtgggactcagacacctttgagcttctaaagatttcagccttttggggttgctcaatcaatatccacatactcctcttcctttcttgccaggtgcctttgatttggttcctcatttacttcctgtcatgcctagagtcaggtggcagcaaggtagatctagctccaactggcactttgagatgggcattagggatccagcagggtccatggtctgggagctaaaggtcccagataagcaagaggtcgtagataatgtaaggaggggtaaaccagtgataactctggggttactggggtgccttcagagcccagcacagagggtctttgctctctttcatatcttcttctgggtatgggtggctaagggctcccaggtgtgtacttagagcctgatgtgggaaaagagactgcccacaggcctctgtttctgtgactaaggtgtgagtacagtactcactccactccacttcctgggtccacaagtaacaaagccatagagcaacacatgtccctggaacaaccatttacttgaggacgcaggcattttttcctatattaaagcaaacatggatgtaatataaaatcgaaagttgaagacccacagatttatttgactaaactccaaattgcatgtggcagatggctttggagttcctctttatccctggattgttcatgagtgagaaacattgctgaggatttggtttctttctatcagaggcataggcttcctgggcaggtgctcatgaacattgccatgggaagatggtacacagccaggcatttggatgcaaaaggtggcttactcctgctttggacagaaaggtctgcttaagggctatttcataggcttggattcatgtagagggaaagaagaaacaaagctgtgtccacaggctaatgtgctgaggttgtgagatacctttcaacttggaccaaagtcaatgtacaggcagtgatccctctccagtgtcccttccattggccctgcttcctgggtccagccagtacctgatgaagattgtggtggtgagggagtaggcagctactgcacaccagagaattgagcctttgtgtaggaagttttggccactacctcaccagtcccctttacattggctctgggtgtcacaaagggggaaggcataaaatcaatagagtggagtctttgaaagccaaagcagcattttaaaccttttttctttagggctgaatgggcagcttgcttgaagttgataggttttgtgttgccagtcctataatgagatctgagcttccatcctccagagaagctggagatgctgggcctatctggatgagggagttagtgatggcctcagcagtatcagaggcctcttttttttcttcttcatttgggtgcattgtatatcatgccattttatctttactgggatgtctctagaccctcacatttgtatgaggtcactcctgaggcctcaggcttggcccctgaagcacccaagaaatatttgggtgggaattggtttttttttaaataagaaagtctgtacaaacatcaaaagttgattgaaaaaaatagtgctatgtaggaaaggtcccaaaagcagtaagaagaattgatgtccccctgcatctggaccctgaagtccttttggaatagcagttagtttcttacttgggaaaaattagattcacaggaagttgcaaacacagtaaagaggcccccctgtaccttacatctagttttccccagtggttacaactcatataacaatagtgcaatatcaaaacttggaaattgatattgctacaggtttccgtataaaaattttaaaaatttataagaaccattttctattctaaaatataaatttttatatataaatttttgatataaactttcatgtctctgggataaatgcccaggagtacagttgctgagtcatatggaagttgcatgttgagttgtgtaagacactgtcaaactgatttccaccagcagtaaatgagtgatccagtttctccacttcctcaccagcatttgatgttgtcattgttttttagcttagccactctgttaagtaggtagtggtatctcattgtggttttaaattgcatttccctaatagctaatgatgttgaacgtctttgcatgtgtttacttgccatctgtatatcctcttcagtgaaattcagtgaaatgcctcttcatatcttttgcccattttcttttctttctttcttttctttttttttttttttttttttttttgacagtctcactcctttgcccaggctggagtgcagtggtgtgatcttggctcactgcaacctccacctcatgggttcaagcgattctcctgcctcatgagtagctggaattacaggtgcacaccaccacacccggctaatttttgtatttttaatagaaatggggtttcgccatgttggccaggctggtcttgaactcctgacctcaggtgatccactcaccttggcccccaaaatggcttctgcccgttttctaattggatggtttgtcttcttactgttaagttttgatattctttatacactctagatacaagtcctttgttaaacataaggtttgcaaatattttctcccagtctacagcttgacttttcattctattcacagggtctttcacagggtctttcacagagcgaaagattttatttttgatgaagtctagtttatgaatttttccttttatgggttatgcttttggtgtcacgtctaagaaagaactctttgcctagctctaaatccagaagattttctcctatttttcctaaaacttttatagttttatattttaaatttagctcagtgatcactttgagtgaatttttgtgtaaggtataaggtatagattgaagttcatgttttgcctatagatattccagaaccatgtgttgaaaaggctattattcctccactgaattgcttttgcacttttgtcaaaaatcagtttggcgtatctacgtgagtctatttctaggttctctgtccagttccaattatctgtctgtccctctgccattactgcacagtcttgattaatgtagccctataataagtctttaaatcaggtacactggttattcttctttttcacaattgtttcagcccctctacttcctttccataaaattttggaaaaatcttttttatatctacaaaaaatcttacttgaattttgataagaattggttaaacctggatgtctatttgggagaagtcaatgtctttactatgttgagttttccaatctatgaacatggtatattactccatttctttaattctttgatttctttcatcagtgttgtgtaattttcagtttatacgtcctgtacatgttttccttgatttacacgtaagtgttttttgagcaatagtatatggtattgtgttttcattccgatgtctgtgtgttcattgctagtatacaggaatgcaattaatttttatatgttgatcttgtatcctgagaatttgctgaactcatgtatgagttctagcagtttctctgtagatactttgagatttttcagatagacaatcatgtcaactgcaatcgttttacttcttcttcttccttgttttttttttctactttttaaaaaaaaattaggtcaaggggtacatgtgcgggtttgatatataggtaaattgcatgtcacaggggtctggtgtacaggttattttgccacccacgtaataagcatagtacctgataggtagttttttgattctcaccctcttccctccgtccaccctcaagtaggcctcagtgtctgtcgttcccctctttatgtccatatgtactcgatgtttacctctgacttgtaagtgagaacatgcagtttgtggacttttgttcttttcacttaggataatgtccaccagctccatccacatttatgcaaagggccaaaggacatgatctccttttttttttttacagctgcatggtatttcacagtgtatatatacaacattttctttatccagtctacttttgatgggcatttaggttgattccatgtatatgctattgtgaatagtgctgtgatgaacacatgcgtgtgtgtgtctttatggtagaatgatttatattcccttgggtatatacatgataatgggatggctgggtcaagtgttaattctgctttgagttctttgagaaatcactaaactgtttttgttctgtagatgtctattagttcagttagttatatattcccactagtagtgtataactatcccctttctccacaacctctgttttttttttatgttttagtaatagccattaaatgtctggggtgagatggtatctcattgtgatattgatttgcatttctctaatgattagtgatgttgagcattttctcatatgcttgtttgccacatgtatgacttcttttaaaaagtatctattcgtgtgctctgccactttttaatggggttatttttgcttgttgatttaagttccttatagattctagatattagacctttgttggatgcatagtttgagaatattttgtcccatttcgtaggttatctgttcacactgttgatagtttcttttgctgtgcagaagttccttagtttaaataggtcttatttgtcaatttttgggtttttttgcaattgcttttggcatctttgtcataaaatctttgccagagcctatatgcagaatgatatttcctaagttatcttccaggatttttatagtttgaagtattacatttaagtctttaaacctcctggagttgatttttctatatggtgtaaggaaggggtcaagtttcaatcttctgcatatggctagccacttatcccagcaccatgtactgaatatggagttctttcttcattacttgttgtcaactttgttgaagatcagatggttgtaagtgtgcaacattatttccgggctctctattatgtttcactggtctatgtgcctgttattgtaccagcatcatgctgttttgggtactgtagcattgtagtacagtttgaagtttggtaacatgatgcctccagctttgctctttttccttaggattgccttgactatttcagtttcttttaggttccatatgaattttatttttttttctaattctctgaagaatgtcattgttagtttgataggaataatattgaatctgtagattgtttcaggcagtatggccattttaacaatattgattctttctatccatcagcatggaatgtttttccatttgtttgtgtcatttctgatttatttgagcagttttttttagctcttgttctagagatctttcacctccttggttagccatattcccaggaatttttctctttttgtagctattgtgaatgggattacatccttaattggctctcagcttggatgttgttggtgtataggaatgctactgatttttgaacattgattttatattccgaaactttgctgaagttgtttatcagatcaggtaacttttaggcaagaatatggcattttctaggaatagaataatatcgtctgcaaatggataatttggtttcctctttccctatttggatgccctttatgtatttctcttgcctgattgctcctgataggacttccaatactatgttgaatagaagtggtgagagagagcatctttgtcttgtcccagttttcaaggggaatacttccagcttctgcccatttagtatgatgttggctgtaggcttatcatagatggctcttattattttgaagtatgtcccttcaatgcctagtttgttgagattttttaacatgaaaggatattgaattttattgaaagcctttttatatctattgagatgatcatgtgggttttgtttttagttctgtttatgggatgaatcacatttattgatttgcatatgttgaaccgaccttgcatcacaaggataaagcctacttgatcatgatgaattagctttttgatgtgctgccggattcagtttgctagtattttgttgaagatttttgtatctatattcatcaagaatattggccgtaagttttcttttttgttgtgtctctgccaggttttggtatcaggatgatgttggcctcacagaatgagttatagaggattctttcctccgcagttttttgaaatgatttcagaaggagtggtaccaggaattacacatctggtggaatttgactgtgaatccatctggtcctgggcttttttctggttggtaggatttttattactgattgtatttcagaactcattattggtctgttcagggattcaatttcttcctggttcaatcttgggaggttgtatgttatcagcaatttatccatttcttctaggtttactagcttttgtgcatagaggtgttggtgtagtctcaggggattttttgtatttctgttgggtcagtgataacatgccttttgtcattttttattatatttatttggatcctctctctttttttctttattaatctatctagtggtctatctgtcttattaattctctgaaataaccaacttctggatttttcaatcttttgtatgtttttcacatcttttccctcaattcagctttgattttggctatttcttgtcttctgctagttttggggctcatttgctcttgtttctctagttactctacatctcctgtagtggcgatgttaggttgttaatttaagatctttctaactttttgatgtggacacttagtgctatgaaattccctcttaacactggtttagctgtgtcccagggattctggtatgttgtatctttgttctccttagtttcaaataatttgttgatttctcccttaatttcattatttactcagaagtcattcaggaggacgttgtttaatttccatgtaatcatatgattttgagaaatttttagcattgatttctttttttattgcactgtgatccaggaatatggttggcatgatttcagtttttttgaatgtgctgaggattgttttatgtctgattgtgtggtggattttagagtatgtgccatttgcagatgagaggaatgtatattatgttgttttggggtggagagttctgtggatatctgttaggtccatttggtcaagttctgagttcaggtcctaaatatctttgttagttttctgcctcgatgatctgtctaatactgcctgtggagagttgaagtctcccactattattgtgtggttatctaagtctctttggaggtccctaagaacttgctttatgaatctgatgctcctgtgttgggtgcatatgtatttaggatagttaggtcttcttgttgaattgaggcctttaccattatataatgctcttcttgtcttttcttatctttgttggtttaaagtctgttttgtctgaaataagaatagcaacccctggccaggcacggtggctcacatctgtaatcccagcactttgggaggccaaggcgggtggatcatgaggtcaggagttcaagaccagcctagccaagatggtgaaaccccatctctactaaaaatacaaaaaattagctgggcatggtggcaggcacctgtaatcccagctactcgggaggctgaggcaaagaattgcttgaacctgggaggtggaggttgcaatgagttgaggttgtgccacttcactccagcctgggcaacagagcgagactctgtctcaaaaaaaataaaagaatagcaacccctgcttttttgtgttttttgtttgcttggtagatttttctctatcactttactttgagcctatgggtgtcgttgcatgtgatatgggtctcatgaagacagcataccattgggtctcacttctttactcaacttggcactctgtgcctttcaattggggcatgtagcctatttacattcaaggctagtattgatatgtgtgcatttgatcctgtcatcatgttgtttactggttattatacaggattttttgtgtggttgctttatagtgtcactggtctatgtacttaagagtgcttttgtaatgggtggtaacaacctttcctttccatatttagcactcccttcaggatctcttgtaaggcaagtctgctgttaatgaattcccttcacatttgctagtctgaaaaggatcttatttctccttcacttatgaagcttagtttggctataaataaaattattggttgtaaattattttctttaagaatgccgaatataggcccccaatcttttctagcatgtagggtttctgccgaatggtctgctgttagcctgatggggtttcctttgtaggtgacctgccccttttctttatctgcctttaacatgatttttttttttttcatttcgatcttggagaatgtgatgactgtgcatcttggggatggtcttcttgtgtagtattttcaggggttctctgtatttcctgaatttgaatgctggcctgtctaggtaggttggggaaattcttgtggacaatatcctgaaatatgttttccaaattgtttgctttctctccttctctttcagggatgccaatgagtcatagatgtgatctttttgtataatcctatatttctcagaggtattggtcattcttctttattgcttcctctttatttttgtctgagttatttcaaagagccagtcttcaagctctgagattctttcctgagcttggtcagtcctgctgttaatacattcagttgtatcctgaaattcattaagtgagtttttcaactctctcagatcagtttggctcttgcttaagatggccatttcgtctctcatttcctgtattgttttattgtattcctcagaatccttggattgagttttgactttttcctgaatcttgatgatcatcatttctatccatattctgaattctatttctgtcatttcagccatttcagccatttcagcctggtaaagaaccattatggggaagtagtgtggtcacttggaggtaacaagacactctggctttttgagttgccagagttcttggcctggttctttctcatctttgtgggctgaaattctttcagtctttgaagttgcattcctttgcatgttttttttttcttttttgatgtccttgggggtttgattgtgatataaggtgagttcagttggctggttttgtttctgggagattttagtggggcaaagctcagctcaggacttctgggctgtgtgttctaactctgaggggctggtatcaagtcctcagttttgttctctggcccttcaaggttagaaacctgctgtgctgaaggggctgaggtgttcctggactgctggtcacaacactgcaatggatggtgccagccaaagcactccatcggacagtagcagcaggatccatgctcattcacatgtgccagcagcagtagcagaacggcagggtgcactttctttggttggggtgggtgccggtaggtgcaggggttgccagcctccatgcagatgttcacagtgtcagcgatggcaatgtggcatggaggcagctacttcttcttttttaaaatgtgtgcattttatttcattttcttgccttattggactagctagagcttccggtattatgttgaatatcagtgtcaagagcagatagccttgccttgttgccactcttagaaggaaagcagtcagtctttaaccatgaagtgtgatgttaactgtagatttactgtaaatattctttatcaagttaaggacattcccctctgtgcctggtttttatcatgaatgagtgttgaattttgttgaaggctttttctgcatcacataataggatactatgattttaattatttttttgagatgatgtagattcaaatgaagttgtaagaactaatacagatagatgctatgtactcttcagccatattcccctaatgataacatctggtgaaatgatcatacaatatcacaaatgggatattgacattgacacagtcaaaatacagaacatttcaatcaccatgggtagctctcattttgctcacatatagacatatctacttcccttccatacccactctctccttaatctctggaaaccactaatcagttctccatttctatagttttgttattttaagaatgttacataaatagaataatatagtatggaacctttggggatggtcttttttttttcacttacaatcattctctacagattcatccaggccgttgcttgtatcaactgtgtatttctttgtatcgctgagtagtcttccatagtatacatgtaccatcattgaagcattactgagttgtttccagttttttactattatgaatagtgctaccacaaacacttatgtgcaagttttgtgtcaacacaagtctttattcctctgggataaatgcccaggagtgcaattactgggtcatatagttgctggatatttagtttttaaggaaactgccaaactgttttccaatgtggcaataccattttacattcccaccagcaatgttatgagtgattcagtttctccacattcttaccagcatttggtgttgtcactatatttttacaaagatgaaattcacataacaatctgtgatatttagtacattcacaatgttatgcaaccatcacctctatctaatttctaaacatttgcatcaccataaaataaaacctcatactcattcggcagttagtcctcattcttcccctcccctcagttcgtggcaaccaccaatctgctttctgtctctatggatttacctattccagacattttatgaagatggaatcatacagtatgtaacctattatgattggcttctttcagttagcttaatgttttcaaggttcattcatgtttcagcatgttatcagtacttcgttccctttatggctgaataatattccactgtgtggatataccaaaattttgtttatctgtttattaattgatgtacattcggtatgtttccacttttggtgctgctaagaacatttgtgcaaaagtatttgtttgagtccttattttcaattcctttgggtatataccgaggagtggaattgtggggtcaaatggtaattctatgtttaactttttgagagaccgccaaactgtttttgatagcaggtgcaacattttaaattcccaccagcaatgtatgagggttccaatttcttcaccttctcaccaacacttgttattttcttcttttttaattatagccattctagtgggtgggaagtggtatgctgtggtttcggttgtcatttttctgatgactaataatgttgaacatcattacatatgcttgttggccatttatatatcttctttgggaataaatctatttaagtcctttgcctgttttttattgtgttgtcttttttattgttgcattttaggtgttatgtgtatattctagagactaggttttaattagccatatgatttgcaaatgttttctcccattccgtaggtcttttcattttcttgataacgtcctttgatgcccaaaagtttttatgaagtccaatttatctattttgttgttgttgttcatgttcttagggtcataaagttccattgcgaaattcaaggtcatgaagatttacttctatgttttcttttaagagttttacagttttaactcctatgtttaggttgttgatcagttttgagctgaattttgtatatgatataaggtaggagtccaacttcattcttttctctgtggatatccagttgtcacactaccatttgttgaagactaatctttgcctcattgagtggtgttggcaccctggttgaaaatcaattggccatagattaatgggtttaggggccaggcatggtggctcacgcctgtaatcccagcactttgggaggctgaggctagcgaatcacttgaggtcaggagttccagaccaacctggccaatgtggcaaaacaccgtctctaccaaaaatacaaaaattagccgggcatggtgtagtctcagctacctgggtgcctgtaatcccagctccccaggaagctgaggcaggagaatcgcttgacctgggaggtggaggttgcagtgagcctagatcgaaccactgctctccagcctgggagacagagcaagactctgtcttaaaaaaaaaaaatggatttatttctgaattctcaagcctatttcattggtctatatgtctatacttataccagtgctacattgttttgattactattgctttgtggtaagtcttaaaatcaggacgtgagtcttcttgtttttcaataatgttttgaggtgatcacatgatttttagtctttgcctgttaacatagcatattatggtaatatggtggtatgtatgattaacatggattgacttttgcatattgaactacccttgcacaccaagaataaactcaacttgatcatggtatataaaacttttttataaattgctgaaactttcttaaggatttttgtgtctatattcatgggaaatattggtctgcagggttttttttttttcttgcttgtacagtgtttgtctttgctgtcaaggtaatacaatgagttgggaggtgtttcctcttctcttttctgtaggatattatgtagaattggtgctaattcttctttaaacaactaatataattctttagtgaggtcatctgggcttaaagttttcatttcagatttttaaattatgaatttgatttctttcataattatatagccattcagattatttcatattgggtaaattttggcagtttgtgcttttataatgattggtccattttatctaagtttccaaatttatatgtgtattcatagtagtagtcccttattatccttttcatgtctgcagtctatagtaacatctcccttttcaatcagagtattggtaatttgcatcttccctttttcctttgtcagtcttgctagagattggtacattttattaattttatgaaagaactagatttgtattgggtttctctattgtttttctctctttaatattattattaatattaaattattatttatttaataattaataatatttaatatttaatataatatttattaaatttaaaatattatttattaaatataatattattatttattattaaaataatttaataaaaattattaaatataaaataatataatataatatttaatataaatattaatatttaataatttaataattaataataataaaaatattattaatattacgtttattgatacaaatatttgtacatcttcatgcggtacatatgatattttgttaaatgcatagactgtgaaagtatcaagttagggtacttggggtgtccattatcgctaatatttatcatttctatgtgttgggaacattgcaagtcctctctcctagctatttagaaatatacaatacattgttgttagctatggtcaccatatactctgctatcaaactgtcttcagtattattgatttttattattattttcttccttctgcttgctttgggtttattttattcttattcttgtaggttccttaagtggaagcttatattattaattttagattttccctcatttctaacacaaaaatttagttttatacattatcatctcagcacagctttacctgtgtcccacaaattttgatacattgtattttcactttaattcagttcaatgtaatttttatttcttttaagacctcgttaacccatgaatttgtttcaaagtatgctttttaatttctaagtgtttgtagattttcaagttgtctctctgttattgttttccaatttgattccatcatagagaaaacatcatttattatttgaattcttttaatattttgtggattgttttatcaccaaaaatatgtctatattggtatatatttcttgggtgtttgaagtaatgtaaattatattcttttcaggtggagcaatctatacattttatttaggccttattgaaacctgttgttgggctcttatacatcttgctgattttctgtgtagttgttctatcagttgttgagagagggtgttgaagtccccatctataaaggtgaatttttctatttctccgttcagttctaaaaacgtttgcttcctatatttgcaggtcttctgtttaaagcatacacatttaaaagtactatgtcttgttggtggattgacactttcagcattatgtaatgtccctatctgtcgctggtatttttttttttttttgctctgaagtctactttatctaatatcactagagccacctctgttactttttaaaattaatatttgcatggtgtatctttttccattattttactttcagcctttctaaatcattatatctgaggtgagcatcttgcaacagcatatcattggatcatgttatcttctttgccaatctctgtcttttaattggtatgtttagaccattttcatttattgtatttattgataaattagtgcttagttctgccaatttatttttgttttctgtttgttctctggttttttgtttttctattttcttttttctgacttcctgtgggttactcaaacaatgtttagaattccatttggttcatgtatagcatttttgaatctatctttttgtatagcatttttagggatcactctaggtattacattatatatatgcataacataataatctactggtgtcaacattttgccagtttcagtgaagtatagaaaccctacctctcctttcacccctttactttcctctatttataatgtaattgtgttaaatattccttccacatacatttacagacacatcagacaatgttataatcgatgatttaaccttcaaacataatttggaaaactcaagaggagaaggaaagtccattatatttacccataattttttctctttccattggtctttattcccttctaatgttcaatatcctttcttttatcatttcctttctgcttagagaattttctttagatattctctttgtagaggcatattgttgactaattttgttagtgtctcttgatctgagaatgtcttgatctccctttcatatctgaagcatattttcactgagtatagggttctgggttgacagttctctttattcagcatttgaaaaatattatgctacttccttctggaatccatggtttatgaacaaaaattcactctcattcaagttatttttcttctataggtatcatttctctttcactgtattcaaggcttttctcttcatgtttcagaagttttgttgttacaggtcttggagtggatttctttatatttatactgtttgaggttcactcagcttcttaaatttccagatgtatgtcttttgtcaaatttggggagttttcagcaattatgtctttgaatacttttttttttttttttttggtctcattctctttctcatctccttctggaattccagtgacatgaaagttagatcttttgtttgtaattctgtatgtccctgagtctatgtttacttttttttccaggatatcttctctctgttgttcagattgatcatttctttttattttattttattttattttattttattattattatactttaagttttagggtacatgtgcacaatgtgcaggttagttacatatgtatacatgtgccatgctggtgtgctgcacccattaactcgtcatttagcattaggtatatctcctaatgctatccctcctccctcccccctccccccaccccacaacagtccccagagtgtgatgtttctattgttctatcttaattctttcctctgttcttaccattatcctcttgatttgattcactgaatttatttccattattgtatttttcatttctaaaatttccatttggttcttttttatatgttctgtttctctgctgagaattctgattactttgctgagactttctatatttttttcatttgcttccaagcatggttgtaattgttggttgaagcactttaatgattacttctttaaaatccttgtcaggcagttctgacatctgtgtcatcttgctgttggcatctgccgataatattttccattccatttgatatcttactggttcttggtctgacaagtgctttgctactgaaacttgggcattttggatattgcattataagactggatcttatttaaattttctgttttagctgacttcctctgacactgctctggcagggaaggcgggcaccatcttattcttcattgacatcagggaggatggagctcctcattactgctggacaggggtgaggattccaactccctactaggcttttactgatactactctagtgcggatagggaagggcacctcattactgctatgtgggggtggagtctaggctcctcatttggcttttgttgatggaatataatgggactgcattttcttctatggtgtttggctggagtagagcagttattgtctaaaagttttctgtcttgctaggttacctctttcctggtcttttggctagaaagagcaggcttttgttggggcttctttgttagtgcccattggcattctgggtttctggcttcttcagctccaagtctggtatatatgaggcagaaacaaaatccagagaactcgccactgcatcattgctcaggtcccaaggtccctaaccagtatacttttttctttccaccttttaatgtcttattatgtttgttttatatataatgcccagaggttttagtgatactcagtgagagaatggggaaaagtacttctccatatttccagaggcagaggtttagacttgagattttagaggctgatgctgtactgccaaggaggtttatgggaagtagagctgtccttatatattaatgtcttagtggagctcttatttcatgtctacatcatgaaaaacaaaaagaaatgaaactttacctgggtttgcatatgtctgcttatctgtcactggaggagtagccatgatcataacctgctcagtcagtttcctttacatcagtgcaccagggtttcatgagccccctttcaatatctgttgctcccttcctgtgtctgtcaggctttgaactgttagctcacttggctgtatcctaacagtgccacagtgggtgtctgcttcttctatgaaccataaagcttactctagtagagctgagaaggccctaagccatcacctaattgagccaccatgtttgcatataaggaaattgcatctcagagaacagaggaagttttcctgaatctcactgcatatcacacaaaagcaaatccagacgtaggacccagatatcatacttgtaggcccagtgttattttagtcacatgaagctgctcctccatccacccctctaccttccagtgaactttgtcctttcctctggtcaaggactgtcattttatcccagccaactgtctcacaaaaatgcccctcattcttgggggtgggggtgctcaatgagggtggtgggtgggaggaagggaaaaggaatgtggttgactccacacaaacctgtcttcagagtgaaagtctgtgattcacggggtcagtggtctcatcttcatatctgaaagacagtgtactttttgtctccctaagccctgtgtctaggtcgtttgggaaacgccttggagagtcaagaataaatttgcaggtcaaacaatggatgactggaaaagtcggcttgtaatcaagagcatgcttccccatttcgccatggtgggaaatcgtcaggagcccagaaagctccaggaatcggtcagacaatgggccatggggggaggggggtatttaatgcttctaatcttaaacttgaacgtaagatgtgttattgaaattttctgtgcaaacttggtggcagggatccaactcaaaatataaggaattcaaatgtgatctagaagagatctaggagatgagctgatcccaccccttgtgggtttctagaagagctggaaatatagtctaaggttccatatagcctcccagtctagtagtgatcactgcattgcacccattcaataagaaaaatgaggaaggatgagagagggaagacgagtttactttttctcttaatagaagccagtcagaatggcaagcactagatatattgcatgagcttcctagtatgactgagaacaaaaagctagtgagtaggcacagagaggtcttcccattcaactttctggccctgttgtccttttagaaactcatctgacacacttctactttcctccctgggaactcagacatcatccaagtgttctgaacctcaggattagggattccagtggtagttctaggagcaggatgatgatagaagggactatgagagccattgactagtttaatttgacaataaaagcctgcaacaccaccaatctaccaagattagctctgttagcaggaattgcagcaaacacaatagctgttatctcagggtattagggccacagaggagtggcttgcttaatctctggaattaatagagcagagaggaaatggctcttatagagccgtgggtcggcttccttccttttcatagaactggaagccctgggctctgaggtaatgccatttcacataactagagggcctgtcttctccaattcccagggcaatccactttcagcaagtcagctttcaatttattttaaaattctgatatgtgcacagatgtggatggaggtgattgaaatcttgttttctctttgtttcctcattgtcaaccaccaacaatgtattgagaatgtgctatcaagttgagcatgtagacatttacaaaactgtttactgcactccccagctctcacagagattgcagtcaggtgggatggcagagatggagacattacttggccagcagcctgtccaaattgccaggccttaggcctcttctagaaagaaatctctaacctccatcctaattaccctttatatttcatgcttctcttttatgatcaacaattgagtcagtaaagaaaaacctgataatgctcccagagtccgtgatcagttttagcatgactttaaatttctcttttatttcccacttgtttccattcacttgggccaaattgtagaagaaagtgttgatggattgtggatgcaggggtcctcttccccttctccccaactccatcaacactcttaaaaagtgtggccagtaagtaactgctttggttttgatcagtgtacagttgaatgcacagattccagtgggggttgtccttagaataggtccttggagtggccatctgtgcatttactctggaaaagttgtcattgcttacgtcatttccaggcttggcttctctttgcagatggcctttagagccctttgtaagctttgccaaaaattcacattcattgctttagagtcacactttggatttgatcaagatcagccctctgcctcctctatgccacaccttgttctctgaaagagttctctgttggttctgagtggcttgactctttctaaaacttcaagctgtcctagaagaccaagaattcaccccagttgaggagaacaaagaattttaaaaatttgcctcagcctccaaaagcaactctctcagatggtcttcttcacagttgaaacagcattggatgacattgagagagcccactcctttggctggacgtgacaggtgctgctgtacggtatccctgtagcctcagaaaggtacccagtgctaatatgaaactctgctgcacatgctgaggatctcagcatctgggtgcttgtgaactgaggttgaccaaataaaagcagaatggcctgtgagtccaccaagaaacctgcagtccaaacaagttattgtaaggcctggaaggtgagtggccaaaggaggtcctttgcaagagctgggcttgcatttccagggtgtagccttagctggatctcagatgtttcccttgtttgctctccttctgacacttaataacacccagggatgacaccctgaaccctagtcccaggaaaccatgtgcatctggaagcacgtttcttgcaccactctccctcatcctgaaaacatcgctaacagagatttgcttcaggcattcagcttgactggttctcttgttctttcctagaaaacaaacaaacaaacaaaaaacatgtttcaaatcaatcttgaaataaaatgatatcagtcccagaggagagttctcttttagcagtccttgaatttacatggaaataattgtgagctcccttgaaggaaaacgtgcatctcacgtaacagttgttcttggcctaagactagggctcagaacacctgggttctagtcttgcagctactcctcactagctatggggctttgtctatcctttgccctccctgagaacaaagttcaaatgaacgaaaagtaagaataaccacctttaattcagcattgactaggtgctaggcactttactaagcatttttggggcattatctcctgtaatcctcatgataaccctgggaagaagaagctattattatctccaggaaaccgagactcagagagattaagcaatttgaccaaagtcacagatataagaagtggcaaactcagaggccaatgtcatcaccactatactctaatgcacattgaaaactacaaaatgctgaatacatatcaggcaggggccatcaccataagaaatctcagtaatgcaagtaccttttcagcatctgttcattcatttaatagtgtgactggttaatgactctggcgatctggggaacagaagagtttgaccttttgaacatttgggcatctacccaaggttaataaggcatccagtctctgcacttagtgtatggagttttaacaggaggcagaacattttgtccttccctttgaagttaagatcacgattctttccctagatccctagatcagtaggtcaaaggattgctagtgtgagaatttaaaaggcattagtactccaatttgagagtgctccagagcctgcatggagttgagactcagtgcgcatgtcacatgccatctctgtctcagtccataccccaccataagtggcaaagattcctccagctcggagcaggtacctattcccttcataaggcagctcctagacaaaatgagggtgcaaagggcatgaaatgttcagttggaggaggaaggggacacagtactttttgcacatcttctgtgttcagccatttaatattaagaagcgactcactctatagattacaatgggatgccgtgcccagtatttcttctgagcttcccaaccagtcagtggttgggcagggtggggggattattattattctccttctttatggataaagagaataaagtctgagaaattcagtgactttcagaaggatggccatccagaaggtggggtgctacatcaaggtccacatttggatggccccaagggcagtgtgctttccatctacaatacgatgaaaaacaacccctcagcccatatctttctcacctctaaatgcaagtagggctgaagacgggggagagaggagccctcagtgtaacagcgtatgtggacatttggatggctgcaaaaatactggcctcattctatccatcccttttctttagactggtgaccttagacatatccagtaggaggagctctagtcacctcctccctttgtgtttatgtgacggggttcaagatttgcgcccatcagctttggaggcatatacttcttgcagaaaaagtgctggactcaggaaggagtcctcagactcgattcagggttggaacaagctctttgtgagattttgagcaggtttctttcttcttgaggtcagagggcatgggtatgagctctaagggcctgtctatctctggcctcctgccacatttccagggtcccttctgtgtgcctggccctgtgctcgatcttgagccccaggaattcatagtctaggggcaaattattcccaggcttcctccactgggaacaaatctatcttactctgtagttctcggtgaaacctggaggcaagtgtttgagcgtctctcttgtgcaaggtactttgtgcacattcgctcatttgcttctgtgtcacagagattgatatttccacttccccagggtggagactgaggctcagaaaggatggagactttcccaatgtcacacaggcaggaagttgtagatctcaaactcaggtgccctgcctccaaagctcttcctactcctattcccagattaggagctcaggtatttccagggccttctgcaggccaggcactgttctcagtgcctttcattccagtggcagagacagcccataaacaggtaaagagtagaagcaaacttacttcattctggtagctctctgggatgttctgaccagcgttgtccactgccaagcctggcagaaagctaggctgctttaaaaccctatgcaggggcagccagctgggaacagagtgagttgtcgaaacagctcccttagaagcctcaagagaaaacccagatttacagctttgagtctttgccagcagcccctgcttcatgcaggctgaaggcgcggcacaggtgcaaatctggccccaagagaggggagctcatgtttatgggtccccttccaagacccaggtgatcctaggggctagttaatctagaggcaactgtccctgccacttattgataacttgcatgagcctctgggcctcagtatccacatcagtaaagtagggttaataactctgctctttgcctgcgtcagggtttctgggatggtgatgaacaaggtgtggttgtgcacgtgttccaaaccacacagggcatgatcctaaaccacacactgctgtgagcacttttttttaatgatcagaggttggcattggctcagaggttttttgccatcagaagagtgatggaaaatgtgtgtcctgacccctgaggatgccacagtctcatcagcagccccactacactgaggagacctgaatctgtaatgtagctgtgagcattctgggtcaagggctgcagtgtgtatgcgcctttctactttggggatcctccccatggagcacgcagctgttcgctccctttgctccctcctcctttttctgcagtaagggctccttcctgttccagacacccaactggggtgagaagccaggcagaggccttgccttcacacagacctttttttgcaagaactgagcactgctcagcttgcaggacaccactgggcttggcatctgggtcctgcctgggtagcctggcttggtaaaccagtgacctgcaaatcacagtctgtttgaagggagagtgctggtgaggggagctccatttttcagctggtttatgcaggcacctgggagcatgacactgcctatttctaaacttttaggagcccatgctggcctcatctgcattcctgcctagctctttcccacagtttccttgacataaggcccaaggtaacaggtttctggaggtggaactgccccaggaaggagagggatgctgttagactccaggacagagttgaggctcagaagtgtgcacatttctagggagtatgcagacccaggggccagccctgtgggtgtgggcctggggttcctcaaactctgggctggcctgtgtaggctgaggcctcttgcttttactgagaatccacagctcgaaagcccaatgtttctctttttacagatagatatttgggttataagctacccctggagtgctgcattccagacttctggggaggagggacatgagcttctaagatttgggcaacaaattttgatttccgcagttgatatagaataatttgttggaaaccttcctcctccccttttgcttttcctttccctccccttccttcctgcctttcccttctcctcctcatctccctcctaccttctcaccagatctccaacccctaaattccaaagttagaaaggcaagcatcagccacagggaagtggatttgaccactgggcactcaaacccaaggcgcaggcatgtctctgctgtcattgcctccctctctcttgctccgggccccctcagcacaggcctgtctttgtctgcctccctccagtgctgcaggcttccatcaccctctcaagtccccatccagaggcagggctggcataggtgctcgcttgctcactcactgccctgaccctgagagctcctgcttctatgcccctagagctgtggctgagtatatggcacatagtaaatgctcagtaagatgcagctgctgttcatcttggccagaagtcccttagaaatcatctaggccacccacattgctggacacaagagaaggccagtgtcatacagaggggaaggggtgcaattaaaaagtcattgtctctaggccttacacaggaaatgggaaaataacagagttatttgcagagtaccattttctccaatggttcattcacatccgcagatgccagctgagccctgtcacgaggctttggggttaccaagatgaataggaaactacctggccttcagagagttatgtggtggaggtgggaaatgcatagacctaacatggcagcctcaaggttggccatagcacctaggatggtgatggaaagggtagaaggtgagactgtattatcatagagacccttgagggcctgagggtggagggtgtgctttaatccactagcccatgcaaattgttcaacaatgtacaagactataagaacaaggcccaagggtatcctggaggggatgatgtttctctcctctcttttttttttcttttattattatactttaagttttagggtacatgtgcacattgtgcaggttagttacatatgtatacatgtgccacactggtgcgctgcacccactaacttgtcatctagcattaggtatatctcccaatgctatccctcccccctccccccaccccacaacagtccccagaatgtgatgttccccttcccgtgtccatgtgatctcattgttcaattcccacctatgagtgagaatatgcggtgtttggttttttgttcttgcgatagtttactgagaatgatgatttccaatttcatccatgtccctacaaaggactggaagcttcggagcacctgagaacgggcgcacaatgagaagtgaaacaacttttgggactgctggatcacttgcacggtttagaaatggtcaccttacttgcactacggaagaaatctttacgtttttctgctccagaaaggttgcccacccactcttctgtgaataatgggcctacatggccccctgcaatgtgaggagggcaacttggaaagaacttatttccctccaagaagatgctcagttcatgctctaggtcagaggttggcaaactacagcctgtgagctaaatccagcccacgggctgtttttgtaaataaacttttattagcacacagtcacgcccagtcattaacatattgtctactacacagagcttcaacagagaccacatggcctgcgaagcctgagacatttactacctgggccatcacagaagaagtttgccaacacttggtctgtatcactgggcatttggttcatttgtttaccctaacaaatggtacccatttcaggtagaattacaggccctcatgcggccacgtgtttagcttcccctcctgtgccaaagctggccccaactccacactcccaattccacccttctcaaaagttcttgcccctaaaagtgtttcttttccttccatttctcctcccatcagcatccagagagaactttttcaaagagatgaagccaatccttcctctgcttaagtcccccgatggcttccctacaaacaaaatacaatccaatccctttcccatagcctgcaagaccctctgcaaattcacgactacttccctggtgcattgtgtgacaggcacactggctgcctgcccgtcactggaacagtccaaaagccccaccccagggccttcccacttgctgccctcctgcctgggatgctctgcccccagtccttctcctggcctgctcagagccacctgccattctatcacatcactattttttcagtctttgaaagaatactgcacacactcttaacttgttcttgttgttcacttaccgtttgtcctactagaattccagctccttctctctggttccccacttctctccctggcctgtgctcattctaatggaagtgtcagttctgggccccctaggcagccctgcctgccctttactgtcatatgacttcatctctatagtggaggggagcccagtgccactctgtaggtgcttctttcctagaataagcttcaggccctaaagttgtctagccttagggctgcccatgtgatgctgtcagcaaaactaaacatgttcttgcctcttttcctccctcaagtcaagcccttagagtttagaacaatgaacttggcctatataaaatacctccaggaaatcagtcctcaaacaccaactcccaacatctgctttctgaatatatggcttcaaacagctaagtgtacagtatctaactgctgtccatccttttgttttttttagccacatgacatctaaggaacttagaaaatgccttgccctttcctgtagttaaatttgacataaaattactttattggcagcatattaacaaacaaaaatctcctgtgtttttcccggtaattcagtttcagttttccaggtaagaaaaagataattttgaatgactacaaggagacagactgttttgaggtttctgttaataacacattcagagtgtgccttcttcctctgtcccagtcagtggtgctgttgacagagtggtacaacaagaatgaaatatactgtgggaactcaccctgatcccaacaccctcatcaacaccatcaccaccatcactattgctaccagcaccaccacctccaccaccactaccctcaccttcactaccaccaccctttaaatcaacaccattaccaccatcaccatggctaccaccatcccaccatcccaattgccaccaccacatccaccaccattaccaccaccaccatcatcactaccacccttacctccgtcattaccacctccatcacctctaccattaccatgattactatcgccatcccctctaccaccaccaccctaccacttctctctctatctctctctcatgtacacgtacatggttatatgacacttcatgatgcaatcatagacactgtccacatacacacatacagtgaaataagtacatgtttttaaattgtcattattttcaatatagaacctactcttgttgctatgtgctttggggtggggaacatcaacgtgtgtttatggccaaaattgaattaggattcataagaaagggctatatctccaaatgcgcacttttaaaaaagttaagtttggatgagggatctttcatttcataaaaggatatactgaggatttcctttcagtgacaaatttttgctgcattttattttgatttggtttacaaaagttagcctttcacacagctgttcaggagcgcagccaatgactaaaggcagatctgccttgaatagcaaatgctgctgagtaaaccatgttacaggctattttaggaccaccaagaatgtgtttgcattttcaagagtagaaggagagatcatatttatttggtatctacactatgccacacactatgctaattacatttctaagctcatgtaatccttacaacaaatttacgaaggctttactttccccattttgtaggtaagaaaacaggctcacagagggaaaaatgacttgcccaaggtgaccaccaattagagacaaggtttaaacagaccatgagggctcagggcctacctcaagccctctaatcaccctacactgctaagttcttctattagaatttgttgtgcagaaggttttcttcttcttcttcttcttttttttttttttgtataatcagattatccatttgcctacaaagcctatagtgtgcaaggagtgtgtagtggtccagtcagtgtaccctggcacttgagagctcattaagggcccaggagaatcagcaaattctcagcagccaagctaccctaacgtatatcatagaaactacaataggagatttcttctctgaggtcactgctatctggcactatcctgtgatgtatggtttggaaaaccgtgggtcaaatacaaccgtccctacaggcaagtcaaaatatcgtggctgaaactaaaagtgattttttatcctcagtctaagtgtgaagagctgaagtgatctgcctttcctttagcaccccagaattacctctgggttcattcggggaaggctggcttactgctgaggtgtccacacatctaccactatacatgcctggggttcttgggggttctgttacctgggctgaactctggagtcctgagtgccaagctcttctctgccactatctatatgacttttagtaagccacctgcaactccttcacctcagtttacccatgtgtaaatcagggaccccaagcaaagccctgcctacctcctaggattcttgttagaatcaaaggctgatgaatgagaaagtacactgtccactgaaagggcctgggattttataaaggcctgtagttggtaacaccaagacttggatctgaaggtctagaaaagcacaacatcctgagactctgtgtggatccctttagcctactgtgagtgcttatgtcatgtcatgaacatgatataccccccatacagccctaaaaagtctttgctactagaagccgcatcctgtatgtgtataaaaatacagaaccaacctcccaggtacacacccgttgcacaggcagtctctgctgagtcattgtgcagacacgtctcttgctgcttctggccatgttgttcccagaaatggctctagagggatttcccgcatggctgaatagatggggagcatacgaggagctcaccttttcagggttccagatatacagctgggccggaggggctgggaggcagaagagtgggtgcagcagagtaggcttgtggaagacaaagccttcagaaaagtttcttgcccgaggcaaatgcagtccatgctagatggtacattcccagccaggaagagagtgcaatgtcctctccaactcaaatggcagtgaccagtgggtctccccaaactctgccataggacattagggctttaccaagcactgtccaggttgcagttttagatgggaaagggcacttggccttgagaaggtacagaagccaactccctggtcaccgcatttgttcatgctttttcccttggccctcagcctctggatgccatcatttggcctggagataggaaaagtgttgcctacatctgcctctggtactagcaaagggcatggtacagtgtggtgcagaccagcagcaggaacagaaaggtgcttctctaaggaagctgcagagatttctctgccagtctggagatcagctttgggtcccagctctccctgctactcttccatatacctccaatgatgcaagtttccaagaagaccaaggctgtgaaaaacagtgtggtggttcctcaagaagttagttcaacataaaattacaccatgacctagcaattccactccttggtatacacccaaaagaactgaaaacaagtgttcaacaaaaacttgtatgcaaatgttcacagcaacactattcacaatagccaaaagacagaaacaacccaaatgtccatcagatgaatggactgaccaagtgtggcacgtccacacaatggaatattatttggccacaaaaggaacggagtactgaggcatgccacaacatggatgagcccagaaaacatgatgccgggtgaaagaagccaggcacaaaacgccacatattgtatgatcccatttatatgaagtattcagaataagcaaattcatagagacagagggtagataaatgtgttgccaggagctgggggtttccatttgggatgatgaaaaagttctggaactagatagtggtgatagttgcacaacattgtgaatgtcctaaatgctaccgaattgtacacttttaaaaagttaatttcatgctatgtctattttacctcaatttaaaaagagaggacctagaccatgggaagagtctttggactgactccttatcccatgttccctccaagtttcagctgctctgatgccaagactctcatggcatcagagctcaccagcctggctctaaatctactaagtggggtcgatatctctgcaggctaaaagttggcactcaggagctaaaatgtgcttattcaataagcatgtgacccctctgctaagctacagaggcatgttctggacataaattgttttaaatgtggccattgatagcagcatctctctttggtgtgtcctagcaggaagaggtcatagacaggatgcccctctagaaggttctgaactaatcaggtgtctctggaatcttctcccacctacatagcagttgaatttctcaagcagggaaatattctgcatggtctgaagcttgttgccattttatttagcctactgttggggcacagagagaggtaaggtcacctctggcctaagcttcaaagttcatccctcaagccttctaagacccggtacctaattttgttttaattttatattctgtttcataaagagggccccagattataaaagcttcagtcccaaaactagagacccaaacacctcactataggaaagaaggctctgattaaccagcagctgttttttttctttctctttattctttccagctctattgaggtataagtgacaaattaaaaatgtatatttaaggtatacagtgtgatgatttgatatacatatatattgtgaaatgattaccacaatcaagttagtcaatgcatccatccataacttcatctagttatatttgtttctgaactcatagaactgttttaaaatcatagaaacagtagaaggctggttaccaagagttgcagggggtggagtgtgaaatggggagatgtcagtcaatgggtacaaattctcagttataggatgcataaatttgggcaatctaatgtacagcactgtggctatatttaataatgctgtattgcatatttgaaatttactgtgagagcagatcttaaatgttcttatagcaactatttttctatttgccccatttaaactactctagttggtgtcctggcaatgaggaggactgtcaccttgtttcctgaccttgccactgcaatccaaatggggtctgtttttatcatgccaggaaaggagggggaggctgcgtgggttcagcaggggtgtctcctgactgtgccttccaggcagtctgtcactgtgtgttcccccaggaggccctggaccaaaggccttttcatctcagtaccccaatttctaacctcataaggttacactgaagatgaaaggaattgatgtagttaacagggctgaagcagaggcttggtaactagttgctcttgttatttcctctgcttgtagaggaagttggtatagtctctctctctctctctctttctctagctctggctctccttcaaccattgccctatcatctgaatggcaccttggcccatttcctccaagccccacttctgcttgaggacagggctctggaggctgacaaacccaagttcactccctggttccaccactttttagccagccaaatgcccttaagcaagtgacactccctgtcttcaactgggcaccctcatctgtacaatgagggtgggggtgatcacattagtactgactttcttgagtcactgggaacattaaggtaaagcctaaaatgcatttggaactgtacctgtcacttagtaagtattccaaagtcactcttgaagtctacttataaatcaggtctcccttactaaaacaaaaggaaatggagaaagagaagaaaggagaaagatgggaataagaaaggaagagagggagggatggagggagggagggagggaggaaggaaggaagacaggcaggcaagactctttaatctttgctccttgttctctctagccactcacactcaagttccagcccccaccaatttggagatgattccctgataaacctctaaactgcaggcatctctgttcttcatttctaagatgaggatgataatgggaatatctttctcatagagttgtgaagataactatgtgaatgcatacaaagtgcttagtaccacaatagtcatttgtgtcttgtgattccaggagttttgggcagaggattgtgtgccctggtcagggtgcccacaggcaaggttgccactgatctgatggggccaatccaacaggcatggagcccagaaacaggcttccatgtccaatcccatgtcctgctcttgggaaggctttcccactccgaaccacaaaaccactgggtttatctgggccactctgatgaaagtcacattcccctgaacaaatatcctcaccacaagggcacctgggtcatcctgctctgtgaagcactgaaagagtgaggcagaaaatggagtgactacttccagaaatggaatcacctcaagtcatatcaattctcttgggaagagccccttgggtttgtatagttctttaaagtctgagggacagtggagaggcaggtcccaaggagtgctaatgcagaagtaacatactatggcagcctggcatgggtcagatcataaggggggccagccagggcgtggaggcaggactggcagggcctggcagtaagaagagatattgctactgcattcacacggtcccaatcagaagtcttagagattatctgtagagagagctgtggctaccccatatagtacgtgacttccacacagcccaaactaccctaattaataatgacccagaagctgattgtttctagctctcagattagcagtggctccttattgccccagcttagctctaccagatgtcctgtccctgaaatgtaccagtagcccctctaaaaacccacttggctcatcagggcccagtccagggccctccccacctatcccattcctaatcccatcagcattagcgagaagcctgccactgcctcagggacctcgcatctggagactcagccaagatggtggcacctgtgagaggatccacaggtagccaagtccaggtagccagaggccaggtggcaatggggaagagcataagtgacccctgtccaatatgccctcatcagccaaatctggggcctcagtttgggctttgtggtgtgaaggtaccacccgccaaatgggcctggagccaccagcatagctgccctccttctccctgggtggccctggaggtgccacacttgcagcattcctgggtggtccttctgtgcatgggctgtaggtggaggtgtggaaagctgaagacagggtcaggcacagcccagggcagcctagagatatttacatcatgatgatgggattagacagcccactcgcttgtgcggtatctggacgccactggcttgcagagcatttgggggttactgcttgagagtgttttccactggtcttgtcactccctaggtgaaggaaagtctggcttttgtaggaactgcctgggtctctggtggagtatttccttcctcacctctggattattctgcctctttagagcattctagaaaaggggtgttttctcggttcattggccacacggcatggctgcatcctggtgacattttcccagcatcagatggttggagactgcaatgaggaggctccacacaattcatagccttcagccaggccccttgctaaagtgctgcatgggacggagaagaccaaaccaattggagagggactcgatggaagccacacatggagttttgtgttgttgtccagtacttactgtggttgccctgctcccattgacctggacgatccatgttaccatctgcccctcctcccaaaaaagggaagcttcctgttcttggagttggcactaggagccaccctcagtggcttaaacagatttcttttaactatgaggtagtgcactagatgaaccagactacaggagatgccagctctgtagccatcatttcacaatgcagccatacctaagagcctaggacaggccatacccggtgggcggagcagggatgggccacagctggaggactgaaagtgggatctcagcctcagttacagaggcactccctgatggccaggcagcaatcctgtggagggctttgtcatcagaaaataggagcccatcatctctggaaggttggaagcaccatggtgagatgggatgtgtgtccaagagttaaactggtctggagttctcttttaacaccatcatcacaccccttcatttaatctatgctggactttgaccataaaaaaccaaacttgaaattgggatccctgcaccgactggtgaggcacataggagagggttggtttgggttccatatgactgacataaagcagagcaaatattggcttgggacccaaaccaaccctctcttaggcttgttaaggccccattcaggatagttccctggaggtggttggagagctggcagcctttctggtgactggtgacctggtagtactctctaatagaatatgtcaataagcacagctcatttgaccagaattgtaggccgcctttctcgatccaacaggtgcagacctgctactctcaggattcactttgctagtctcctgcactccacaccggatcccaaagtctatgttcaagtaatcccctatttaaatgtcatagatatatttggggaggctcataatttgattcaagtaacagtctgatctgtgcctctcactgagctggtgcaggtaatactttctttaagagtgtgtgcaagtggctctcctcagcctactctcacccccagggaaagaagccctcgtggatggaggaagaagatttatcttttctctacaagagcagcccaggaagaaagcatcaggtaagcataagcttaccaaagctgggacccattcactttacagtggggaaactgaggccccgagtgtgaaagggacctacaagaggtcacaccacaaggtcctttaagagaggcagagcccagggagaagtgagaaggttgggcttaaatgatctctgcccggtggccctggtggcctccaacctcggttctgcctccacttctccctttgcctgtgtgattttgggcttgttagccaaatttaggtgaaatgtagattaagcttgtgaacctgggtccagcagaagtggagtcatctggattgggacagggccctctcctttgacctttagcttctattacagctacctcaggcagcacctacttcctctatagatcaacctcaccaaatccatccagatgtttctcttctccccacagtaatcatctctatcccactaatgacagaacctgggaatgtgtttggggaagactgggtgaggatttcttcctgtgaaaacagagtacaggcctcaccaggcttaacatgagtgggtgtgagcagcccgtcttgaagggcccagcagttctgacggtctaggagttagaggctagctctcaacaaatgcttgttcaatggcagaataccttgattcttctcaggagatggtacaatacaaattctgagctcattaaattcatatacatctataggttgaggatcatccttagagctgtcagttcttccaactggcatgtctacactacagaaaaggagaaagtagttctagaacactgcccacccaggtttgctcatctctgcctttgtcagtgcacttccagccactccaggctgctgctcagatagttctggcagaagcctgttgaagccccagccctcaggtcagggtggctaaaggctgatgactgtggcagccttcagagtggcaggtggtggcaagcagcaggaggcaggagtttccaggctcagccaccaagacagcatccctggctgtcaggtcagtgctgtcaggtcagtgctgtcaggactaagctgcttgcctccccctacttccactccatccccctatcctagtgaatgcatccttatttgtaagaaagcaacagaggcccaacacgaagacacagggccttgagaatgatatcagtagtgattactgctccccaagtgctctcctcagtgagtacagtggaacctttcactaatgctgtgaagcacacatggtgggccaagtacccattttacagaagaagaaattgagcttcagggaggggagtggcttgcccacagccacacaacaaacggaggagctaggacttaactgcaggtcttctcatgtgcattccagggccccttcctccaccgcagcctgcatctgcctgcatcgagtgctggttcagggcgaatcagggacaccaataaatccccgatttgtaggtcgaggttcttgctccaaaccacccattatcagagatttgctcctgagacataactgactcctcttgaagccaatcagcattagcattcagggttccctgccattcccaaccaccctggtattctccagagcctcatgtcttgcaattctggaaatgctcaaaatcctgtttgttctacagaaagatcagtttcagtttgctgggacattctgctgaaaataaacatgtaaataacacatccccaaatacaggcattgatactatacacacggatattcctttgatcccatgtgcaaatgcaaacatattcattctgtctttctctcctcctcgctctcactctctctctttctctccatcccccatctctttgtctcttcaaacccattcctgatacattattttcttatctattctacagctacctccatcatgccccacgacatcttcattactttcttctgagatagtctactgggggccatccttgtcctcagagggcttgaagtctaatttagttggccaacatcaggtgcctcaaaattcatagggggaaaatgtaacaatattgaataaagttgttcatggagtatggatgtaagggaagagactaggagaactggctagcaaattggcctgaactgaactggtgaggcactagtgaagaaagagcagactaaataaaccacaggcgattttcacctttttgacaattttgcccagggcctacaagcccagtgccctctggagggaaaataagtctccctgagtttatctttcctggttacctttgacctcctatcttcttgcccaataggaacagtgcataccctttgctgacctttttattggtgtccatgttaaacctccaactacagtgtccaaaatcaagcatttataacagcctgccagacttctttggataagttatattctttattctccttatgctcatttcatggactgtattcgtataatctctaccttctctaagaaatttttccccttttttgtcattctggactagaactatagaaagggaagagttgccatatgtcattgttcagacagaaccagaaataatgttgacttcagagctgaacttgtctctatcagaagagaaacctttgttttctcattatctagggggtggggaggccatcacatgccttgaaatgcattttaatgaatgtttataaggtcatggggatcacattggtggctttgtctgccggattctgaaatgggactctgcaggcatttatgtatggagagaaaggaattcgtttctaaaagatgccagggcactgtcactcactccctcccccttcctcaccaccaaaggccgggcctgtgagggctctggctgggagttgggacgtctggggtccagtgtccttttaactaattgtctgaaagcaaatcgagatatgctctgaggaaatcctgccagtggctactgattgtcacagggagaggcctgaaagaagtaggagctgtgggacagctaggactaataccctgctgtcatcaagaccgcagagactggagaaaagcacatgggtgaagcagggagattcatttagaaagggctgggagcttggttggggaccttccgcccctaccaggattctgggaggggaggtcattccggagcagtgagctatctcctgcccttgatctaaaatggtggctgtgggatttagtcagaaacacccagtctgggcaggcaaaacctcagcggcatcagccacaggcacaggtgacccagtgaaggcacgagtgtggcactgggcacaggggaaagcccagccaacttctcgcagttgagatgagtaacagatcatgggactgtgaaagagaagacacgaaagcaagtctttatctaggggcaaaattaactggataatagatttccacgcctcactgatgtctggtgaaggcagacgctattacagcaaggctgagccttccgtgtaaacacagccgcctctcctcggccttgtttagggttggctggtgttcttgctgttcagccagggcacttcaggctcactgttgaaagctcattccatgaaatccaaaacatggagctgcatggcctctgacaaagtgagttctcactgaagtccattgaaaaatgaaagctcagaagaggcttgcagcttgccactctgccaaaacagcagcctctatcggcaccccaaaccccacccctgagaaaagccaggtgagcctgccccctttattaggcatccttatgaaagtcagtgagtgtacatgccagcagctgtccagccacagacttggcatagcaaaagtggcatccgctccagcagtggcggcctgctgggatctactttgttattgagtagtcagttggtttctagaattggaattgatcagggaccatttgcttgggatgcagttgatgagtgctggaaaaggtgtgtgtatacgggctctcatgtaggagaggtgcagcctccttccctttgccagtggccccagctggtacctttagtgtctggtggtcatgccctgcctcctccatccctgcaccttactcccagcaggttagtggcagaccaacaattaagtgaaagctctgggagcccatagaagctgccagcaaatttcagaggctcacgtggcagggatgccagaccattgcccctcacagccccttccctcccttcctttccccaacccccaccccctccttggcctgcctggttctgcattgcttcgccattgttaaaactgtcttgcagttcgagacatcatggacagcactttgggcctgactgttgccagctcagactccctgcaggggatccttatgtcaaatccacatgcaatcatccctgattgatctatttcatacatttctatttttaacctattggattctttgggagaatgtagaagagacacaatttcagtttgggacccagtggcttgtttgtaggttactccataatggattgagtaaatggctgagctccctgtgtgttgggtaatttatgttcctttgtccattgattcgttcaactgccatttactgagcacctgctgtgggccaaacagttagtgagctgctccatggaccagctcagggacactatgggtgctgtgcccagtcagactcctgggaaagtgggcactgatgactgcatgggcctcagccctcttattgtgcctgctctacacctctccaacccattcctgcctgacccatggtattcaggcctcagatgagtttggtgacagagctgtcccttgaagtgcccttgttcagattgtgggcatctcaaaagaaaagtcaaagaagtgtgcaagtcctctcactcaagttggcaagccccttctgtgggggcgatgcagtgtcctaccaacaacatggcgaaggcagtgggtctggaggcagctgagtggtggtggaggggccctgcatctgacctgggccttgttgccctctggctgagcaactctgggtaaggcctgcccctctctgggtctcagagacctctctgtctttaagaagggtattggactcccagaacccttccatacctgccctttataatgccgggtaccagttagtgaggagctattaggtgtcatacaatgtgccccgtttcacttaatagtcagagcaccttcatgagaaaagaactataattacactcattttacacataaagaaactggggctctgagaggttcagtggcaaggccaaggtcagagccctatgccacgctgcctccacccttgctctgggccagtggttttctgttgagaatcagccatggagctgttggaaaaactcccgatgcctgggccacaccctggatgaagctgtcagtttgtggtgggagggcccaggaatgtggatgtttctaagtgattctgatgtgcaccaaggcctgagacatacagccctggggatctgctttgatgttcacttggccatgacagtcatgcccctcatcgtgctggcaagtggccccatgcatgccttgagctcctagtgggctacaagctcatcaaaccagaagagccaaacttaaggtgacatcagaggatgagcactgtatgtcctagtgaaacttccaaagctggaaaggggttatttggggggtaccgggtgggggaagctttaaaagaattctacctgttcacctatcggcattcaggtgatttccagatccctctcttcctttccttattttgatcattcctgcacatactcctttgcccccacttcctttcccatttacctgctaacatacaggtcatggtcattaacacaacagcgatggatgactgtatgaagccatgaagagtaggaagtctcacattgctagtgactttgctttgttcccaaaggctgtgcttctataaatgatgggcagctcccccaaggttcagatcccagattggggccttttctcattgtttaatatctccccaacctgaggatgcatcttcagaggaaaatttcttatttagataactttatacttttttaaatttttggattatgagtcgttctcgttaaagacaaacaagcagaaatgaagagaatagaaagggaattgccagtcatcccaaataaatgaccactccaaattgttgggtataggttcttccaaattatttttgtgtacacatagcaatgtgtgagagtgtgtgtgtgtgtgtgtgtgtgtgtgtgtgtgtaaaaataaatggaacaatgaatacgatgcctacaatgactgttctgaaacttgtgctttcccaaaaacagtattttaaacagctccccaagaaaacacatccagatctacttctttcctgtaagggctctgttgtattcaattttaccactgcagcctgatgcatttaaccaagactagaaggcagcctaaaagttcaattctatactatggtattccttcgttaaaatctatgtgtctgtagacaggaaagaattaaaactatttagctacttctagttttctctccaatgcctgcctttggcagcatggttcatttagtgacttctgcatagttttgttgaactctccttgaagtgggcagattaccctttgaataacgttctatcccgttttagtatacagacaacataatgccttatttgaaatgtaattagacagtttagatgaaacataataatgaataaataagcactatggttccaaagacaggctgtattttatagttttcacaactataagtctttaaactgagaggtctgttttatcatgcacatttcctgttcattagctttaatgtgccaaacctttataaaaattcctctctctctctctctctctttctctctgtctctctctctctctctctgtgtgtgtgtgtgtgtgtgtgtgtgtgtgtgtcacctctcttcccttctcctctcctctcttctcctcttctcttctcttccattcacagggaactgttaagaggagacaagaagaagaccacttccagtttccagacatggctgatgggggctaccctaataaaattaagaggccttgccttgaagatgtcacccttgcaatgggcccaggtgctcatcctagtactgcttgtgcagaactgcaggtccctccattgacaataaatcctagccctgcggctatgggagtggctggccagtcattactgctggagaataaccctatgaatggcaacatcatgggctcaccatttgtagtaccacagactacagaagtgggactgaaagggcccactgttccttactatgagaaaatcaacagcgtgccggctgtagaccaggagcttcaagagctgctagaggagctcaccaaaattcaagacccttctccaaatgagctagatcttgagaagatactggggacgaagccagaagagccactggttttagatcatccccaggcaaccctaagcacaactcccaagccttcggttcagatgtcacacttggagagcctggcttccagcaaggagtttgcttctagttgcagccaagttactggcatgtcacttcagatcccatcctcctccacagggatcagctattcgattccttccaccagtaagcagatagtgtcaccgagttcttcaatggcacagtccaagagccaggtccaggccatgctccctgtcgctctgccccccttaccagtgcctcagtggcatcacgcccaccagctgaaggcgttggcagccagcaagcaggggtctgctacaaagcagcaagggcccacccccagttggtctggtctgcctcctccaggactctctccaccttaccgcccagtgccatcaccacacccaccaccgctgccactgccaccaccaccacccccattcagcccccagagcctcatggtgtcctgcatgtcgtccaataccttgtcgggtagcactctccgaggctctcccaatgccttactgtcaagcatgacgtccagcagcaatgctgccctggggcccgccatgccctatgctcctgagaagctccccagccctgctctcactcaacagccgcagttcggccctcagagctccattcttgccaacctcatgtcctctaccatcaaaacccctcaaggacacctgatgtctgctctgcctgccagcaaccctgggccgtccccaccctatcgcccagagaagctctctagcccaggcttgccacagcagtccttcaccccacagtgttccctgatccgaagcctcactcccaccagtaatcttctaagccagcaacagcagcagcagcagcagcagcagcaagcaaatgtgatctttaagcccataagcagcaactcatccaaaaccctgagcatgatcatgcagcaggggatggcaagctccagcccaggagccacggagccatttacttttggcaacaccaagcccttgtcccattttgtttctgagccgggtccccagaagatgccctccatgcctaccacctctaggcagccttccctgctccactacctgcagcagccgacaccaacgcaggcctcctcagccactgcctcctccacggccactgccaccttgcagctgcagcagcagcagcagcaacagcagcagcagcctgaccattcttcattccttctgcagcagatgatgcagcaaccccagcgttttcagcgatcagtggcctcagattccatgcctgctctgcccagacaggtaagacaatctcatatctggctgtgttcttttgttttggaagtaacaactgtgtttcatgttgccaatatctggctctggagggtaaatccaggctatagttctctctgagactggaaaagactctgaaaaagtctactgaagtcagctaatcctgtgtggttaaaagcacagtgttaataaggccaaggttatggtttcagtgcctgttcaagtcacctaacttccctagaaggagagctgcacccacaaggtgctcccggtggaaggagccaggtgggacaagtccgaatacagaaatgccttccctgcactgggccatgtagaaagactagtgaatccttcttaagatgtaaggaaattgcactgaagcatttaatcttatccctgctggcagaaggacaaacactgagccttctagaaatgccacagcaaacttttgctgagcaacctcagcatgccatttgtcactgtgctggatactcagtcaggtcgtgaaaggaaaaagacaggtatttgcaaggtagtcactctcatcatctccattttacaaatgaagaaactgaggctcagagagttgaaagacttgcccagagtcacatagttcgcaagggacagagcaggaacttgaagccaggtggtctcactccagagcctgtgctcttcttgaaattacttttgacttctcaccctccctcatctcctccaggcttttcaatcatgaaatgcagctgattccacctgggtcgtgtctatcacagttcccagttttcatttctgtgacccctgcctgtattagttatctgtggctgcataacaaattaccccaagcaccagcttcgaaccatatgcatacgttaccaccacatcctgatttctgggtgttaggaatcctggcatggtttaactgagtcttctggctgagtatctcctaaggctgcagtcatctcaaggctcagtggggaaggatctgcttccaagcccactcatgtggttgctggcaggaagcagttccttgcaggttgttggactgaggcctcggtttctcatgagctattggccagaggcctccctcagttccttgccacacggtctcttcacagagcatctcacaacatggcagctggcttcatctgagtgagcatgagagagtgtgccagtgaagcagggtaatggggagagagggaggagggatagtgccagcaagtcagaagtcacagtctctatgacctggtctagaaagtaacatcccaccacttttgctgtattctattcatgagatgtaagccagaggagattgcatgagggtgtaaataccaggaggcagggttcagtggggccaggtcacacgtgtgcctacacagaatactcagtcaccatctaccatccctccttcccattcctctcatccttgcccaagttcaggtcctcttgattctttatctgaactcatacagttgacccttaactggtctctcccaataaaccatccattgctctgagtcgtcttgctaaaacagtgacctgatcatgttttacacttgctcagaagtccccagaggcccataagctggccccaccagcctcctgggcccttcagcatccatcaggccctgccttgcactttgtttctattacccagaagtgcctgcagcacttggcccacgccatctggtctcagcctttactctggccgttccctgggcctggtcatcccttcccacattttctctcctgtccaacacctgcagctacttagggctcaggcaccatccctccaggaagcttttccatgactgtcctcagtacttccatttcccactgtgcctccctcttctggagagtggtcaaggaggagattataaagtgcttggccagagacctggcccaagggaagcacctgtcaagggctgacctcttatttaagagctctgtatgagcacacctgtggcaacccctagagtacagaggttgtgtcttttccatccaggtttcctggagcataaccatgcagagtgcttgacaccagggagttggtcatttgatagaccatgcggcaagcagagctcccatgggggtggccgggggagcggtgtggagataggcaaagcacataggacacggcaggccacctggggctcgggccctggtctgcagttcaggagcactttggtttgattttattatagggctgttgccatctgtttgcatggacttctgcagctagctcggtgaagccccagcatcaacacgggaactctttcactagcaggcaagatcctcagcctggagacgtgtcaccgtctaacattgtgagcctttctgttttgttttgtcttcaattgggtacatttttgtagactgattgtgttgtcccagagctggatcagctggctcagagggagaattcttaattattggggtcatgcaaatcatacccaaccaattacctaggtggggttggagaaagtgttcaggagaaagaccgaacagtcaagctccctggggctaggagcacaataaagggggcaagcgacttttgccagcagaggcaagaagctgggtccccaaattggaaatgctattgccaccaagagctgcctttccagcccatgctggcctgtgcccaggggccaggcatgggacctggtgcttcacctgcctcttctcattttaatcctcagaggcaggggctgttaccattctcctgagagttggggggaaaggcacagagaagtgaccgaagttgcccacagtcacacagcaagctggggccagagcagacaatctggctacagagcccacactcatactcccatgcatggggcactgcctctgtagccttctgtttccactgtcacctcttaactgtttcctcctctacaaatcaaggtgatgataggttgtctgaggactaagtgtgttaatacatctaaagcactttgaacagggcctggcataaagtatgtgctgagaagggatttgctgtcacgatgactctacctcctgaccctgtgctcccagatctgtttcatgggactaagatgtggttctaaaaaccagtagctgtggcaggacagacacaagccacgttatctccagaccctgtacccaccatgagattgataggagttgtgcagcctctgagccttgtgggctccttttgctctaggccctgcctctcctggacaactcccagcctgatgggaaaggggaaaggggaaaggtccatccctgctttgcagactggggatctcactttgctctttcttgagctctccggcactctcactccgctcctctccctagcactctgttctctacctggtattcttccaggcctccaagctgggggaatctcaacagtccttctgtttcttcttatggcctctccctattaactctaagacctaagaactcagccctggtcattcttccaggggagagaaaaaaataaagaaaaaagcgagtgtttgaggcaagagctgggaccgctgtagaaggacagatggtggccccaatggtggggaagaacatatttcccacttccagcaggctaagcaaacctcccaagttttactgatggccaagctgagcctcaggaacactaattacctatgatatggcatttactagcctgttacatttgccatggacgataatggttaccatggaaaaactggacattcatttgaatctggatctttgaggttttgtgcggggggtgggggcttttttggtttttgtctgttcatttctttagaggcagggtctcactatattgcccagtctggtctcaaactcctgggctcaagtgatcctcccacctcagcctcccaaagcactgagattacaggcaggaaccaccgcacctggtctagatcttagttttctaaaggagttatttttaaatgtgagatgagacacaaacgcttgagtaagctgaaaagccaaatccagccttctatagaggagctcatttttatgtacagaccagcatctctctatttggaggattttgctttaccagttgagtgaactattcaatttcaatgcaccattcatgtccacgtaaggtaaaaggcaaatgccacatgactttggggcagctgtttagcatgggaggttgagcaagcaagggcactggaggcagacagaactgaggctcaagtctggctacagatgctgactgattcaggtcccatgagcaatgttactcaactcctgagcctcagctgaaaatggggaaaggaatagtccccttcacttagggcattgggaaggcaaaggagatgctaacctgaaactgcttagaacggtgcccagcacacactacaggctcaatcagggctagggcagccttgtgggcttggacctgaaacctccggggcctgatgaatttccaaattcagaacatttgggactttgggaaggtaatgtggtgcaaataccaaatgtcacacaaccctccagtgtaatctgaagcagtgtttcattacttttgcagagaaatatgaatatttaaggaagtccagagtcaacttttgcccccacataaaatttggcaccaaatttacaaaagtaaaattggctttcagagcttcttggactttaaattacagataagggatgtggacctggaattattaagggagggatctttaactctttatggagttgcaacacccagcactggtttgtcagattttaatgaccccaaattgcgtcactgaattccccaccctccctccaggctgggtgatatatcttgatgtttaatcagactgaggcaaaatgaattttgtttgcatcatctgatgtcccttctccctgcagattactggagataccttggcgtgttgcaaaaatcgcggttaggacttacttcagtttcactattcacgactgcagaacagatcttacatttactcaaagacacaaacaagtatgtcaaggagatgggagttggactgtggaagactggggatagcaagaggcagcctctggccagagtgccctcagtgcacgtgcatttgagccccactcagatctgcagagctgggagtgtggtttcatggggaggagggatgtggatggaggccagttggaataagaacaaaaaaaagcctggaatctgatccttgaggcaggctgtgcagcacagagggaagagggcagctgtggagaaatagaccaaggaggcacatgatgttgttttgacaaatatggagagggtagagaagggggaatcaaacctgccttggagaaggctggattaagcccctactgggtctgatatgctttctatcttaaggataagctttagcttaggcagtcgtgagcaccaggcaattgcagaggcagtgaactcaccatcttccctttctgaggggttgggcctatgaagaggatctgggcagctccctctaaagtggggccttggggaagcccccactatccccacctgtggcctctctcacccctggtagactgaaccctccgaagtgcagtacttccagcacccagggcctgaagatagatggcacagggcgggggacacaggggccttaccctggggccttggcaggggacaggccctggggctgggctcaaggccaagttcaagaaagctcagactttggatcacttgggtccaaatcccagttctgccaccttttccgcggggcaagcgatttaccctttccaggcttcagtctgtaaaatggagatactagcatacctatctcatggggctgctgtgaggattaaatgagatgaggtaacagcgcttggcatagggcctggtacacaattatgctccattgatattagctgtcactctcaggaaagttcccgaaacccagaacaccagtaacccaatggaatgaatttagtcagcctcggctcagcatccaggctcctctctgacccccaggggtggacggtgacttggagagaaagggcaggggagagctcagtccctctggggctgcgtgctcacggacagtcccttaggggcgttaaggaagacttttgccaggtggctgaggagcagccaaggcagcagacacaggttggtgactccagaaggaagtagagccgccaagccaggctgtggtttcctgagtgcccctgaccgtgggtaggggagaatgttgtcttctcttccctctaagcacggccagctgaacttctaggagttacatggatgctgaataacaaatgcaaccacaggacgactttaggtgggcagagaggagggggaaggaggagctaagttccacctgcagccagcgtggatctgaccccacctgcttgcagcaggctcaggggtgcctgacatttcaagactcaggcagagggcttactgatacacagtgacaatgaacagggcggaaagcgtgtacatgagtggccaggaaggaaagctggtcctgcatagtcatggcgcacagagcacgcatcctgaggggatacctcccctctctcctctcgtttccgtccttcttctgcaccactgactctcactcctaaagcctccaaaaagaatctttgcagaaacccaagattccttttggtttgaacttccaaggctacactagcccactcagtagggcataacctttaattactgctgtctcaattagctctgcaaattaaattctttatatttgaaccatgacttttcatggaaaacaaaaaggaacaaaccaggttagtgaggccaagagaatttccgattctgatcaaagttacatctgctccatttacaactagagtcaggagaggcagagacagcaagtgagccttttcctagtctcagaatcactcattaacattttcaaaaagtaattattatattactaaaatacatgacctccaccccaaaatcagatccaccacatattttcaaggaagggcctgtcaccttggacttacaggtcttctccctcacttccctgcattcctctctcgttttgagagtaaggcttgcgggaaagcaatactgctgtctgtgttctcagagaaattttgtcttttactaattctggcgagaaacatcacagattttatttcaaaggttagtcctgctaaaatgcaagaacagaagcctctagaggaatctctgtgttgtccaccagtcaaatgataagtaaggaagtgcctccacttgccagataaaggactggggaccaggcagatttcaaagagcccgtgggtcagagccggggcctgccctgtgcgtattctctggcagacaaggaaatgttttcctgaatgagcattcttattttgtatttaaacatgatggtacatacaagcttagttttaccattctttctaaattaagctgcaaagagctgtttggtttcgggaaactttttcttagctgttttgtgtggaactatgattagacaccgtgtaacatgcattttgaaaattcggggaccgatatctcagtgttgaaaatgttttgttttaacctctctaaattgccaggaaatgaaaccacatgggctgttgaatttgggaaacacaggcttagaacttggtattaatcttaccaagaatcaaaaaaaagtttttttttcagtttctttttcggtttctaagggccattagtgatcctccacctcaaagctatttttctttttcaaaaagcggaaatttaaaatgagctgcttgttaaatgctaaccttttaaatgtcaacattttttttctattaaaagttaaagaataagtgagacgacactttcaaatgaaggtgactttacattgttcccctggaggaatgagccatcagttagtgtggtcaaccccaaaacttacggggatgcacaaggccgcctacttaagatgcatcagtagtagagatcaatagatacaatttttttcattgcttagtaactggcttatgaaagctgaagaggcaatcattttcagaaacctcctgtcaagttttttgttttgttttttgtttgttttgtcttaacatatctgaagagaaacaaggaaacttgctgaagttaggacacccaaaatgagcccttttaaaaatgaagtgcacaaattattttatgctaagttaattaagacaacctacttatttgtcactgtaaagcaaggcaaggaatctcattgcgcttttcaaagaacgtaagaggacagaaataaatcattgtgtcgtgctgctttaagctgtatctccttatgaatacctacaaacccaaaacacagaacaccatatggagcgagcagtccagttttgcgcacacaacaaacatgaaagagaagtgctgtcgctctactactactatgtccccaggtgaaaagttcgcaaaatgtaaacaagatctagagcagatgaaactcacggtagacttgctccattcagctgtggccctaacacctacagccagcactgtcactgagtgcaggagtggatggtgcagagcgccaaggggaatcaaagacgtgacccttccatccaggtgagcaaaggatgagtactcagagggctggactgcaccctcccctccccatcctgtgcttctgactctcagatccacttctgactctcacttccagcttctgactctcagatccactcatggtcccatatcgtggatttatggaatcctttcccgagtctatttgtacttttagcctgttctgtcccttagggattgacaaatcccacgatctgggcctgccctgtaaaacaactatgtggggcctgacctggctgctttttagcttgaaggggatagcagagggtagaatgctggttacatttaaagcaccctgctcccagatccaaaagaaagtttctgctttttcctaaggagttgaaacagtctgggattttatctgattttgttattttgcctacaatgacaaacactgcttttgtttgttttatcatgttgtgttttttgctagatgagtgtttatcatgccggctgcacccatccaaagcagtaaggttgttgaaagccaaaagcagcagaaaggcccaaagagatcaccccacctcacccacaggctcacctctgcaggtgtcttcagacagctgactcttaactctcatctcagcaacagtttctaagatagagagtggaataaagagtcagcattcatccatttcttcgatgttttctcctttaccccatgtgaaccaagtttcttggtaacgtgcagctaggactcacacagacgaaaagcacagagccacaggccttggctgggttattggagctaggtgcacaggaaaaataaaagtgggtgctccaggacattatatatatagtcctgggctaaaggtggccttcagggcctgaaagatggatagctgtacctcactaggaattatcccacctcttgctttgcttgtgggagctttcagtttgcagctaaaggctcaggttccggccagctttttcccctgtagcatgctaccaaatccggccatcttccagttttgagcagaggaggtgagcgtagctgtggagacacatattcttctgcaggcccatgtcggggtggcccatgaagagaatttgccaaagccagctggctcagcagaccaacagatgaaggtggactactcatttgcaattgtgattaatgatcatttatttccatgtgacaaagctttgaacgatgtgggaggccctcacccatccctgagtgggaataactgggaatgattccatgaccctttccctttatctggcaatcctttcaaagatgagctctggaaaatgtgaacagacaatgcactccactatagctttctagtttcacatcttcaaacaccaaaatgttgacacccattgggatggttattataaacacatacacacagagagagaaaataacaagtgatggtgaggatgtggagaaattggaacccttgtgcattgttggtgggaatgtgaaatagtgcagccactgtggaaaaaagtacggcagttcctcaaaaaattacacagagaaataccgtatgatccagtgattccacttctgggtatatgcctaaaagaatcgaaagcaaggctggacacagtggctcacacctgtaatcgcagcactttgagaagccgaggtgggaggatcgcttgaggccaggagttcaatgccagcctgggcaacatagtgagatcccacctttacaaaaaattacaaaaattaaccaggcatggtggcgttgcctgcagtttcagctactccggaggctgaggtgggaggattgcttgagaccaggaggttgaagctgcagtgagctgtgatcactgccctgcactccagcctgggtgacatagagagaccccatctcaaaaaataaaaaaaaagaaagaaagaaagagagaaagaaagaaagaaaaagaaagagagaaagaaagaaagaaagagagacagagacagagacagagaaagtaagaaagaaagaaaaaagaaagaaagaaagaaaaaagaaagaaagaaagaaagaaagaaagaaagaaagaaagaaagaaagaaagaaagaaagaattgaaagcaggggctcaaccagttatctgttcatagcagttttgttcacaatagtcaaaagagagagacaacccaaatgtccatcagctggtaaataaatttaaaaaatgcagcatgcccatacaatagaatattattcagccttaaaaaggaaggaaattctgacatgtgctataacatggatgatcactgaaggcattaagctaagtgaaacaagccagccaccaaaggacaaatattgtatcattccactcatgtgaggtccctagagtagtccaattcatggagaaaggcagatagaactgtgagtgacaggggctaggggagggaggaaattaggagtgcatgtttaatggggacagagtttcagtacaggaaaatgaaaaagttctggagatggatggtggtgatagttgcacaacactgtgagtgcacttaatgccactgaattgcacacttaaaaattgttaaaatggtacattttatacatatttttaccacaatgaaaaagtaaaggctgcaattttaaaacacttgctagtcctctcctaatcaaaagcagtcttttcttttgcaataatattagtgtacaatctaaaagaagcagcaagctgaactgctcattttccatccctggtaagagcagtatttactgcacatccactcatcatgttgtatgggccatctgggttttttgtatgtcttactgaggtgcatgtttgttaaatgcacaggcataaccagaaataactttcctggaaaattgagcataatggctgtccctctcttgacattttggagaaatgataatacgtaggtgggggaaacaaagaagtgactgtaaacaagaacggacattatctctgcttctgaatgagatgagaaacccacttgcttcattagctctctggtatatctgcaagtctggaaacaccgggatgactcacagtttgctgagtaatacaggagccgacagaatgctgctagtgactcgccatctctgactggctttctgtgcaaactgtcactctagagcaagtgctaggccttggaatagagttctgaaaaaggttacggttctcaactacagggagaaccagctcctaaggccttgacactggtacacaaagtaggacacctctgaccaatgccaaaatgacttttagaaagttcacacctggtcattgtgtccctgctcatgctccagctcacaagatctctggtttctgcctttcagggtgtggtgatgtccacttcttcatcagagttctttgtgacttgtctgcttctccacttggtagtaaactcctcaggcataggaagacgtcttcgctagctctgtaatgtaagctgaatgatccttggaatgaatgagtagaatatagaggggaatgaaccaatgaatgagctgtatctgctagccattgcggaatgctaagttttggaaactgttttgagcattttagaggaagtattgatagacactctcagtcttcaaggcttggaggccgatgaacccatattcttgcactgggcagaaaggagaactttgcatctgcatgtagggcccatttacccactgaccatgatgcatttctctggtccagttaagctccttatccttctatagcacttgtgcaatgtctgaaaacatgtgatttcttcaacttccaacaagtacacaattttataccgccagtggtaatttgtcctggtggttctgttgtttctgctgttgttgttgttgtcgtcatttaatgcaatttacaaggacaaaacaaaacttctggctgccatttcacataccacagtgacagcttcacatggtaagaaaagccaaaaacagctagtttcgaaattcaggccactcattttattacttttccctgattaagattcattcataccactttggggtggtgctgatattcctaacataagccaatcgattttggtcagttctgagagcagtgagtggtcttcacttacacacagtgtgtttgtaactctgctatttctttatgactagcacagtataaagtgaacgtttttggaaggctgttaagcatatgttctcctggtaggcttaaatgtgacttataaaaatacttgatagtatatgaacaagctcccactactggtttaaaccaaaaaaaagaggtttattttactagctcataagcacagattctacattctttgtgagaattatctttttaggtttttgtttttatttgttcttatcattttgatagccattttaatcatttcttttattcttttgtttgctttgttgacttttaatttggaaatgtctgctttggcagaataattacatcacaaggaggccctttccccacccacctacccagaaaggtctcctgactcccttatgctctatgaattgccctagttcaagattgatacagatcaaagcagcagaatggggttgaaagagcagcctctggcaatggccttgaccatgtcaattccctgtgcattcatatagatctggaatcatgtagatctattctgcccagcttgttccacagcagctggtgggcagaaccactcttccaagccgtgtagttattctgcactgcaagaggcaagattacaaccgaggactcattcattaataaaattgtttaagttggctttctgaatgacaacgtggtctcaggaacttaaaagacttcaccaagtccctgctgcaaacaaaaagtctgcattgtgatttgtcagagctagattgacatccagtttagagtttagaatccttctccatgccccacttttgagacaaattacaaatcttgaggttcatcaacattctagtacaatatgaccccccaaggtttaagagccctttagagatttgaagacaactgtgatgttcccactaactctccctccttcccccagttctttgcccctatcttggctgctggcctctgaactcatcacagagcactggagtgagggcctctgggtaagtaaggctctgctaaactgatcaaatgctccacgtacatttgtcccagtagagaggaaagctcctcttttccaaacaatctactttattcctgctcccctacatcccacttgcaagggtagcagccacatcccccatctgtcctgcccgagctcattgtccaagccaactccagctcagaaatttcccccagagaagaggttcctgaaggctaagcattgctctgtaaccctgaacttgatttgtgtctatttctcactctctcattatataaagtttttcaaataatattagactaggaattgagaaagagaatgagcgctcacaattgtttctagagccatcacaatcctacccagcaacaccttttacgggcttttaatttttttgtttacagttattacctttgaaaccaaatcttgactttctggtatgctcttggactttttaagggatttaaaaattcaggagtttgatgccaataattgcttttatgagctagcattgcttcttttctatagatgaatcccattttaaatcatcaattattttcttcacagaaacccacaaagtacatattctagtttgcatcagaattgaatatgacccagaaattcttaatgttattaagctagactattgtatctaaaatgtgtatcacattcaactaatgcatattgaagatcttgagtaccacacttgagatctgaatgaagagcccaggattgtgatatttgatccatactgaatgtatttgctagagtgcattgtacagatggttcaggtgtgttagatttgtctctgtaaatgaattggtcagtagataaaagaacatgactcaaggctgagcagggttcagcaggccccaagcttcatcattaaaaatcgggtgttttttaatatgaggctggctgtgtaaagcagacctcatgaactcaggggtctgagaggccaggccagattatcagttgggatgttttcagtcccaattagcagacagcgcagttcacactggcttaaacaataaaggggacttactgattcctgaaagttaaagtccagcggttgggtggacttcagggttggtttgaatcaacagttcctcagtgtcatcaaagatgctgtttctttctggctgtctactctgccttcagtggcatgagcctcatcctaaggctggctcccccttgtgggcacaagatagtgccagcaactccagaggctacaaatttcctcctgccccattcagagagcaggagaatggcttctagaatctctgtcagaagagccaggaagcttctttcccagaagcccccccagatttcatgctttttagtctgaatggatccaacgcctactagcctactgtgctgcttcatgtcagctgtgtcccccgctagaaccttgtgtggagccaggttcctcctaagcacagaggtggtatgggccaaacgaagctgcctaaatgaaaatggggaaaggtgtcaagagaaggaagacttagtgctggcaaccaacagtatttgttgcaatcaatctcttggccatcctcattcatacacaccttccttcccacgcatacacctcccaaaatgcccacacttagggaaaacctatttacccctttcccaaagggatccaactccaatccggaaaccctaggtgatgtgtcatcctctgaatttggtcagtatatagctcttcatgtttcagggaccactggtcaccatgctcaccttggcatagaaagtaagagtgcaataaaaagaaaaaaaaatttcaattgggaaagaggaagttggaaagcagcacacggtggtcactgatccatcatccatatcacatcctgctggacagcagtagcaaggcttgaccaggggtcagactcagtttcctattctgtataatgagaggattggattaaattagtggttctcacattggaatgtggcctggagagcttgttaaaatgcagattactgggttccatccccagagtttctgactccacagatacaggtggggccctggaatttgcatttgtaatagatttccaggggctgctgctgctgctgctgctgctagtacaaggacacccctgcccttccactttgagaacctctgatttagattatccttatgggcccttctgattctgacatttaggactcagggatttttcttagctatctcttctgctctatactgacttatgatggattgttttataaatgggacacacccaactctactgtgtgaacaacttaaaaacatatcatggaattcctgctttggtttgtaatctaattttcaacaattgaggctgaaaatgaaggacaccttacagcttcaggaaagtaaattttctggaattgaagaaattagaaacagaaagataaaggctttcccatcctccccaaccccatctactacagcacagcggtctgtgggatgattccacgtgactgcagaaagcagctcttttcccaaggacatccaacattttgcaagcattctccctatgtgacccgggtattcattgggtcttagaataggagtagcactgggtgaagctgtgacatagatcaagttggtttaggaattttgccaactttcttccccagggcccctcacctggccaacatctattcatcctcaggtcacagcttaaacctcatgtcctccaaggagcctcctctaaccaacgccccaccccagcctaagtcaggttctcctgttctttgttctctagtgtcctacaatgttcctttatagcacttaccagcctttgttaaaaatcctcactgacgtgctccaccatctgccttgtccatcaatgttttcacaacacaggtcctggatcactgtaaatgctcagtaaatgtgtgttgcacaagtgctatcaaaggcagactgggagcagattccagtcacagtattttattacagtggtgaactatcaagcaatctatataacacatcccacagtgtatgattatgcatgctccaaaggaatgaaacataagtcttcagaagacacaaacacacagctggagagtcccagtgtccctggcatctacagccaactttttcatggccctcccccttctctctgggaagctggtgccttccagtgcccaaggtatctctctaccaggcaccctgggcattggcccagctccctcttcccccatgcccatttgggttgttgattgacacttaggtgaagacaatagaagaccctccagcttacagagtgcccaactcagcagggcctggagagctaatctgggtcaacaccacatttttcccctgagaaagtgggagtccagcaaggctgtaaaatgatgagctccaaataacagcctgagtctcctgacttctggctgcatcttgaatgcatctgcaggcagcttcaaatgtgagaataagatatgaacttatgacactctatagtttatcaccattgctataattctctgccactaaatataattttaccattaaatcaaaccaaaccaaacacttaaaataatttctttagagaagccagattatttattacaaataacgtctacaaactgactaaaagtatatcccacatatattgaatttgaagactgtgcctaagtttaaggtaattgatggattccattctcattagatattcacacatcaaaaaagttgtctgctttcccaggcacagtggtaggttatgcttatgctcatcgtttttcttcccagagctggctcttcctttgaaacagacccatataagccacccatttgctgggtcgcaagcccttcatgagggagagagaagtatggtgggacaccagcaccttctctacagaaacgagcagcatgtttgctaagggctgctggactttggcaggtagagaccatcagaggactcaactgaatccccttttatcaggaaccctaggagagtagagttgtcaggagtttccccatgacttacattgtcttttttaaaacaaccaattcatgactgaggtgaagaaggaaaataacagaaaaatatatctagcccaagaaatctacagaataacaataaaactcaggcagaaatgaacccactgatctgtgagccaagtgcttaagggaggggttggggcacttctcatgtggctcactgtcttagtcagttcaggctgctatgacaaaataccataggctgggtggcttagagacaatggaaatgcattatgcatagttctggaggctgggaacttcaagatcaagacactggcagattcagtgtctggtgagagctctcttcctgattagtagatggtgccttcttgctgcattctcatgtgatggaagagtcaaggtagcttccttgggcttcttcttataagggcactaatctcattcaggagagctccaccccatcatctaatcacctcctcaaggtcttgcctcctaatgacatcatattgtgggttaggtttcaacatatgaatttggggggacacaaatactaggtaggtgcaaaagtaattgcggtttttaccattaaaagtaatggcaaaaaccgcaattacttttgcaccagcctaatattataccacagctctctctgtggttgttcactggggcagtgggggtgtggcagaggggtgagggaaaaagggttccctcgatgtttgtggtagaaagaagagctaggtaaccaagtactcctttttgtctgcttaggtctgccaaaagtcaggcacccgtatcgggttagacattcaaggaatgtactgggggaaatgcctgtgaaagataaacagggaagagcaagagaaggtggggagagactcagaccacaatgcaggtggtctgtgacaattggggcgagaaagaggattgggtaagaagagtctcagacagtagcacagttcaggaaaagttcaaccaggccaatagagagtccttgagccaaagtcacctactggaggagtcctgctcctcacagaaatgggcctgcattactatgctcaccatgttcagtcattggccgggagtacagcccaggccaagtgcagcaaaaatgatggatctaagggggaggctgctggaggcaattatgtttcccatggcaggagatgtcagcagccactggtatggtcaccacatccttccattggtagttgtgggtgggaaggcagagtccctggcaggcagtagacagctacaggaacagaaactggtggtagaattagactgactactttggataacaaagccaaggctggcttgactggctgatagctagactatttctttgttactttgtcactcagtgtttagattgttgtttttccccctttccattgtttgtcaaattccccatctgaacccaggtctggaaaaataaaaccctatgcatttggaagaactttaaaatgaattagcttttaggctttagttgccatcataagcatctagagatattcaggcctcggagttggggcagactggagaaactaaggttatttgagaaataagcacactgaatatttggcttcctaattattctacaaggagtctaagttttgcctgcctggtgcctatgaatcactatttcttaattttcttagtttcacagaatcagaggacatgaatactgaaagatattggaggttgtctagttcgactacatcattgtagggaaactgtggccataaaaggggaaggtacaccaatattccttatgaatcaagacataaaaatcttcaacaaaatactagcaaactcaacccagcaacatttgtataaaggattatacaccatgaccaagtgagatttatccctggaatacaaggctggttcagtctatgaaaagcaatcaatgtaacacactatattaacagaataaaggacaaaaaatgcatgatcatctcaatagatgtaaaaaggaaagggactttctcaagttcacacggctaatggcaaagctgagattaaaactcaggtcatctgacttgtaggccagagttctttatactggtgagggtaggggtggagggctgaaccggaccttgcaagactgtccactgcactgaatcctgtactgagggatttctgtttgttttttcatcctgtcctcacaacacccccaagcagtgggctccgttgttattccccctccttttgcatgaggaaactgaggcttagagaggtaacactggttgtctgaggtcatacagctgccaagtatatgaggagctaagcctagatttcaggtctcctgccttgtctctgatattttccagtgcccgccactgctctcctcactcaacagtgccacaggattaacctggttccattggttctcagatcacctactgccaagcacagtggatgggctttttgttgtaagtggatgggagtgccctccaaattctctggaagaatagcctcctctcttgtgccagtgtgtgacaattctcagagccccagctgttgacctcactgtaatctgggctaagtggccatttatatacactaatgactagaaggtcttttcaaggaatggaggaccacaaagaagcaggcagctctggggaagccagaagctgaatggctgggaggtggggcaggggcaggggacagtggggataagatagaaacaaggctgttctttgctccttgagaagctgggtaacaagctggcttggcttctggtggagtctggcccagtgatagctcttgcctcctgatgggacaaaaaaggggagacaggcatctcagagaatgaggtggagagagacacaactgggccaggacccagaaaagagagttacctttttcgtctcagacctgggcatcccagatggaaccgtgctgagcttctggttagtctagcttcctccaggtgtgcaacacaggggtcctgctagggagccttcccagttgagattaaggaggttgctttcaaaatggccagctgcccaagattgcacctctgtcactgttgaggacagtgggggtaaacatgcctgatgttctgccctggaagggctccagagcctttggattgaagccacaaaggaggcctggcatttggctaccattccttcatctggttcactatcaaggatccctcatctcacccattctgctcccccgttctaatgtgggcttccataagcctctgtcccatcttccaaaatgcagtctggagagcgaggcaccaaggctgcaggccatttgcagggcacagccctggaggctaaagtggaggtgcagtggctttcctaacactggtctgcatgttgaactcagaaatacacggtacccttttcagcaagaatcaaagcaaggttgaaacaggccagcaacgtatgggacactttcttctcttccctttcgtgaaatttgcttctcggatagatctgttttcaccaggaaatgaatcaaagccgcatactctgccttccatccttctcttctcttctctcttcaggtctttcagaccagggaaagtggctgcctttgggatagtcacaacaaggtgccctggactgaaaattgagagtgatgagttacactctgccctggcttggggcaaggccctttcctgccatgagtttcagtgtccccacctaccaagtggggagttggtgtcagacaatgtttcttagtgggtggcattccaggagtccacacacaaaggctaagtccctgcaaaacagtgcagatagatgctttctgtaggtcttgctgactctcatactctctgtctttaactcgcttggcaattcttgagcaaaccattgggcctcttcatctacagagaatgatgacctgactaggtgatctctcatttctcctcaagttacaaaagcgttagggtggtaaggagaggaggtggccccaggaaaaccagatgggtcagaagaagacagaaggtggagccttcagtgacaggagagcagagaatgatgtccccctcccataaatgtagggaaggaaggataccagaaaggttaccatgaaagagaggagtaataggaaagtacaggtcatttgtagttgaaatacatacttgagtgtctgtgtggaccaaatctggggtgggaaggcaggcttcaaatcctgaacctcggaagggtcggcattcctgacaagagctcagagagccaacaccagacaaactctaagtcccctgaagagagtgtgctgagctaggtacttgcagccttgaacccaccctaatcccctctgcctggagcacgtccagaaggagcgtggtttgctgcagaaaagacaagtcagttagaccaaaattccaaagcaactttttaagcctataaatgatgatgattttatataaacttgagttgttccttcaacatagcaccatattttctacttatgtgattctggttttctctaaaggaaatctttttttggaatccacaccatacatacggaagagtatataaaacatataataataaaaccaacagtcatgtacccaccaaccaggttcagaaatagaacattcagaatgttttagaagccccttgtgtgcccctccctcttcccagagataacaactatcctggcttccaagagccaaccctagaaatagaccctaggctctggcaagctttgtgctcatcctagtgagatcatgcacgtcaccaatctctttaggtagtattctgtgcggatttccacagatggctcatctgttttgtgttgatccttattagtttcaattttgtctttttaaatatattttatgactttctgattataagagtaatatgtgctctttgtagtaaacttggaaaatgcagaaaagtggagagaaaacacaaacctcatggcataatacaatatataaacatttaatatataaataatccagaaacaactactgtgtgaacacattggagtgcagtatttcagtcatttttttttctatgtagaaatatatgtttcacattactggtatcaagttgtgtatataccttttccctttattgtggaatataacattgatgcagaaaagtgtgcaaggcctatatgtacagtttaataaggaagtaaaaaatgggccgggcgcggtggctcaagcctgtaatcccagcactttgggaggccaaggagggcggatcacgagatcagaagttcgagaccagcctggccaagatggtgaaacccagtctctactaaaaatacaaaaattagctggtcgtggtggtgcctgcctgtaatcccagctactggggaggctgaggcaggagaacagcttgaacccaggaggcggaggttgcagtgagccgagatcataccactgcactccagcctgggagacagagcaagactccgtctcaaaaacaaacaaacaaaaagaagtaaaaaattaaaacctgctgtcaacactgatcaggtcaagaaatagaatattgacaacccccaagtagatcctcatgtgaccttcctgatccaagataattattctgcttttctacatagcttcatcacttattaatagacttaaacttgtaattgcttcattttcaaaaccttagtggcggggccgggtacggtggcttacacctgtaatcccagcactttgggaggctgaggcaggcagatcgcttgagcccagagtttgagaccaacctgggcaacatggggaaaccctgtctctactaaaaacgcaaaaattagctgggagtggtggtacaagcctgtagtcccagctacctgggaagctgaggtggcaggatcacctgagcccgccagggaggtggaggtttcagtgagccgtgattgcactactgcactccagcctgggtgaccagagtgataccctgcctcaatacaaaacaaacaaacaaacaaacaaacaaaaaccttggccgggtgtggtggctcacaccagtaatcccagcactttgggagaccaaggtaggcagatcacctgaggtcaggagttcaagaccagcctggccaacatggcgaaatcctgtctctactaaaaatacaaaaattagccaggcatggtggcatgtgcctgtaatcctagctactcaggaggctgaggcaggagaatcccttcaacctaggaggtgaaggttgtggtgagctgagattgtgccactacactccagcctgggcgacagagtgagattccgtctcaaaacaaacaaacaaacaaacaaacaaacaaacaacagcaacagcaaaaaaccttagtggaagacacaatctaagcatttaagggaagagtcccaggccattagtagatgaaggctttcagaagaagagaggttgacctgtcctggtcattatctgccttcagcttcccgggaatgtgtagagcccaccaccatcaggacactagcagagttgtggacatggtattggatatgcagaagaaatatggccaaagagattggactgccctctgtgttttgctttcaagctcaccacagcctgcctccagtacctccagttcccaggtgtagggcaacacagaacatccctgtggggtgaagtgagtggcctccactgatctggccagcaggaccaggaaagcagagcaggaaattcaccagacaaagggtcaagccagacctcttccagggtgggggacaggcagatgcctggggacacagagtcagagaggggattcagagatctgcctgctccttaaccagcttccagcccaaccccattacgctgaccatgtccccccattccactttacctcccagatctgggaacatctagagctcctcctcctgaggcttgggaagattctgccgtatagaccacgatcctttccagttttctcctctgctgtcttgtgattcagcttccttggtgctgtgtagtcagttaatcctggtctatctgcattttagtttcataaattatgatgctgttatctcctctcctattctctctatcctggtgggattttgtctttaaaaacaaaacaaaacacaaactcttactgtagttttaatgagactctgggaggaagagaatttagatgcttgcattaaactgctgtctaattccagaagtctccaaaggaaatcctgccactcccttcttcggttgcccgaacatgacggttagttggatggctcccttggaagcccaaggtgccatcagggagatactgagagaatttgaggctgggaaggcaggtgggggttggggtgagggttatgttttgaatattgcttcatattgaagcatttgtagtatttgcggttaagagcctggattttcatgtaagtcaactccaggttcagcttccagctctgccagttacatatggtgtgactttgagcaagttactttgcttttctgaaccttattttccccacctgttaagtggggatcataatggtacccatctttcaggcttgccatgggtattgaatgtttcacttagtaaacatttacagcgtttcactcagtgcctggcacattgtatgtgttcaatacatggtagctattgtcatcatcattatcgtcatcatcatgagaaaatagaaaccttccagaaactgtcagggcaacgattgccacaggccgttgttggctactaaaactctagactctggagagccttgatgcccttcctcttttaccccgtccctgatgctcccccaagtagcatgatgcccagtggcccaccaacctcattatccagcattgctgacaacaggcacagccttggtcactgtgaaaatgccccacagcctcaacctcagaagtgggaagtatactgcagattcactctatgccaagcactatgggatatccacaggaatgtgccacagtgaggtaactgcccaggggatagtaattccttcatttctttatacattatggattctaccattttgttattgggttatttttccccttgtcaaagtagcaatttatcagttgaacttaattctctaattaaatttcaaatctgagaatttacatgatgaagtgaatttgattttggacccagtcaatttcagtcagccctaaacatattttgaaatgttaaagttaaattatatacgtttgtggaggaaaaactccaggaaagcctaaatttttccaggtcttgcttaggggataccctgctccaagaaaacttttacaaaatgcaaatttacagaacagatccaccaaatgggtgggattggtgctaccctagagttttctgtagaatttcttttttaaaaaatttttttcttttttttcttttttttttttttttttgagatggagtctcactttgtcgcccaggctggagtgcagtggcgtgatcttggctcattgcaaactccacctcctgggttcaagtgattctcgtgcctcagcctcccaagtagctgggactacaggcacgcaccaccatgcccggctaactttttgtatttttagtagagacggggtttcaccatgtcagccaggctggtctcgaactcctgtcttcaggtgatccacccacctcagcctcccaaaatgctgggattacaggtatgagccactgcgcccagccagaatttctttagtgagacttatctacccccctccacccaccataccacacgtatcataacagaggtcccccaacttggagttctcctcatttcaaggtacagttattataaaaagaagaggacacctgggtctcacagcagccagctctgcggccattgcacagtagaacctcagtggccttacaaaatattcttgctgttagtctacttactgcaataacaaaagtttcacttgggcactttgatcacacaaagcttggcacaggctttgaaatcagacaatacctaggttctagtctaggctctggcacttaactaatgggtgatcatgggcaggtcgcttaacctttttgtgcctcagtttccttatctttacaatgggattataatagtacctccttcataggattgtcctgaggattcattaattgaaatgaccctaggaaagggtcagtgccttacactgagtaagttctcagtaaatatttataatatcatcatcatcatcaattattattattattaatttactttaccaaaacacaggtcctgctgagccatgttggccagaccacacctagaacagcatgtccagttttaggctaatctgtgtaaaattcagtgcctggaccattgaaaggggctcgatatatggtggaggtattattgttaattaatgctgctgctaaccttcctggagtgcatacaacatgccaggcactgcatacgtgctaattctattagtcctcttaacctttaccactctatgaataatatacaattattaatcccttttgcagatgagaaaattaaggcacagaaacgttaagtaactctcccacaattacaaagcatggaagtggcaaacccataattcaagtctagactctctttttccagagcctggactcttagccaccatgccaaagagctgtgctgtccactgctgtagccagcagtcacatgtaactatttaaattaataaaaaatttaaaaaacaagaattcagttcttcatttttactagccacatttcaagtgctacacacttcatgtggccagtggctaccatattgaacagcacagctctagagcattctattctttctgggatgattcagcatcaactcaggaagttctgttggatggtgatgcttacagagattctgtttcttacaaaatctcagacttcagttgtacagctttcttgcattgttattaatagatgcatacttatgatatattgaaatcccatttgcacttggccaagtagggtaatggcaagaaaaaagccaagaagcgtgacttacattacgttttcctgtttccccggtgcattatttcaaattcacaaagttgtctcctatcacctctctttgatatggggcaggaggcattcatcaacttgcccaaaaatccaggttcttccacatgtctgccttcacctctttgggctatctggataatatttagtgctctagcatagtaacctcacaagtgacttgaacaacggaggttggcttctgaagtcagtgagccacagaggaccttggactctgagcatctttgacacactcatcaagtctccagttcgctttcttgggttttctctgctcatttctgttacatggttagtaaaggccagggaaagaaaaggtgttgaggatccattaccttaattccagaatgattaagtcaagaaacctacaagctctcagaagccagtggaattagagtgcactactataaccttgcaaatgtgcatatgcctccttccgaatcaccagagtggagattgggccaatatccaatctagtcaataatttataaagccagagcattcatccacttcttgcaaagcagctgaatatctatgggggttagtcataatctgagctccttgcaccagagccatttgagctacagaatagcacagagtgtcacagaatagccaaaagtgcagagttatttcagtatgagagaaggaggagcacctgactgctcctcgccatgtgcagaggaggagcccatgcatttccaaacccaggggttgcttggtttctagcttggtttctgtctgtaccccatcttgctattgtgtgacttgagtaagcccatctccacttcctcatcttattagctaggaacaatctatctcaaattcacatgtgcacagagttcagtgcccagcacactaaagcatgttcagtaaatatgttagctgatgttattttcaccatatgattatgatcactctctgttctactgatgggttttataaacccaccagcattgaaaagagatgagtagatgtgctaaaatgagagtaaaggctcagtttatcattggtgtttatcccaaaaaaaagactagcacaatgctcaccagattataatctcccaagtgcctagaacatcatgccaagctagtaacatagtaaagtttattgaattttgcaagtatttgctgagccctttgcctgggctagatactgtcggggcaccagagggatttagagatgattaagacttggcccagcaagaatgttcagtcagccaagggtattcagccacaggagctggacctggaaagagaggcagaatttccagggtggaggagcttcatctcgaaagacacacagaattcccagagtacaatcatggagaaagggcattccaggcttggcaaaccaaggagcacaagcacagagggccgaccacacatggcagcctgtctggagagctccaaggagattggtatgactgggggtacgtgacattatggaacgcaaaacctggctgctgagagggtggatgtgcttgcacttgcatctctagtcttggtgcgagccattggaggatttttcaggggaagggaaactgggctgacctggttccagcaaactctctgacaatcatgagaagcccagggtccagggggatgagtaagtgtgacctccaggaaacggggcaccactatcagactctatctgtcccatggcttacttctgtgagattcgaaatagtgtagaccttgtcagtccatgagctagtaattatgcccaccaattactgatttatttgcctttctgagatgtgcagtgatcccaaggacaaagatggatttaccttatgtttagaaacttctagaagttgaaatgttcctaacaacctttcctgtggaggttgtacctcacacgtagagtgtgtgataagcatttcttttcctaattaaataaaatggagaaaagacacaagcatcagctataaagctcccagtcagtcacagtcaagagactgaatctcatctcttttatttattttttgtgttaactggggattgcattggtctgcacagtgcttgctcccatcctgctccacttgattgagtggctccaggccccctcttgattgctgctgaaatagaactgcccacactgtcggggtatcttccgccgctggtcatttccatgtgccatctgcagttttttctgcctgatggactactgaggcactgcgtatgttatgctgatggggggtcctgtttcttgacccatcactaatatcttgcaagtcacaggaagctaccagggattcctgagcaaaagcttaaaatgcttcagttctctacaaataagccccattcattgcttttagagtgtgttatcatggagcagacaagtaatcagaacctgagtaatatttgcatattgaggtcttcaaaactccagtgtggctataaaatggtatttaaagttatcaaggagctaggtatgcaggcagaaagaactgtccattgcagaaagcaatgcctctgctcatgtcccagataaccttgctccaaggacaaactggagcttgataacatgaagctgcagatggccggtgagctcagctctgtactcactaaccaccccatgggaggggcactgagccctctatggttggcataaatcccattagaatggtaaagaaatccttttcacaagtacatagaaatcgcttgctaagatttcatgggttttcttgactttgttgtttttgtttgggttttagagggtgggcatgagtcatctctaaaactgttcaggtagttaggttgtcttcttattcccatttttaagtatttataattagttcttaaaaatttgtccggaggtccacacctccccttggaaaaccttgcctgtacttttcttaatggcacattttaagtttctatgtttcaaaacttgcttatcatataacatgctaatgactaaacacatgcacacctccacaccaatgcaaacgacatgtgggcttgggaacgaggcaagcctgggtttgcatcctgctctgccactagtgggctgtatgattttgggcaacttagttaacctctctgggcctcattggcctcatttgtaaaataagggcaataatagtccctttctcatagatggctatttatacagatcgaataagaccaaatatttaaagaacctgggttagtgcctaaagcacagcaaatgctcaataaattcagtggtggcaatttttattgttatttcaaatattacatcaaaatatctactgaactattatccattgcaaagacttgcccacaataggtgcttagtaagtgtttattgcaataagttgaagtgattccaactatgtagcttagatttcgggtatgagtgtttccttctccactgggatgtttgctaatggacatagatgatcactcacagctcaggtattaaaagcaggagagtagaggtgttccttcatgtagaaagaagagcaacttctcatcaaggcaggcttccagctggtcctttggacaccactgttgctaagcacttggtgtgctcgtcagggtaccagggctcttagcagccacccatttgcgttttgcagcttttgctgacatggatatcaagtatgaagttattttaattgcctttggctgaaaaaaatgggtcatatgttcaatatgttcaattctggtgaaatccctgtcttctaaagcatgatagaaaggggaggtcccacccacacacaagtcctaaaatcttggggccctagtggggtatagttcaacaagggctgcagctcaggacgtggttgttgtgagatttactcgtgactgtttggttttgcactcaccatttggttttgcagattcctcagcgtgttcacacacacatacctacaaaccagtttagagttgtgtgctccattgtggggggtggtcactggggtggggtggggtagggtgggatcaggcttggtcaaagtcattgctgatgaaccagctatctgacttagctttgttcccattttcaacaagacagtgatttctcaagccaggggagtcttcacatgagatccatggatgggtattaagtggtccagaaaacccccccaaattagatgtaaaatgttggtgggctggaaagggggagacaccataagtgctttttctgtggagagaaaccatagcttataactggttctcaaagaagtctatgacccaagacaagctaagatcacaaagctgtttggtttcgttccaccaaagcagttggtgggtataaccacaacacccagatgacccagctagacactcagggcagtgacaagatcagtcagaaccattttgtggccaagcagctgatggattgttcaatcggttgttgtagactcatgtagacaaagcctgcaagcttggggaagccaggcacccccaggtcagcctcgggcgacagcccccgtcctgccaggccctggggagtgagtccttcctgcccggcagctcctttgctcatgagctggcccgagtcacctcctcgtacagcacctcagaggcagcgccctggggcagctgggatccgaaggcctggaggcaggtgcccgctccactactgcctagctgcgacgccacaggtaagtcacttccccctgagcctcgctttcctcatctgtcaacggggcacagtcccctgctcagcctgcccgcctgcctcacagggttgttgggaggaacacaggaggtgacagctccgaaggtaaagctctgtccacccatgagggacttctagtgcttcctgggcctgcttgttctctactttctgcccggcattctttggcaaagggacaacccaagcaagcagagtgctccaggtgcctcagccccacctccagggaaatgagtgggggattgaccagggtgcagctgctctctccctcagctgtatgccttccagtaccccgtttccatacctacctgcctgtctgtccctgaggccagactgggaacctgagggggacaggggctgtgcttctgcacctccgaagccctgcacctgatacctgcctgcttggcacctagtgggtgctcgggaactgcctctcctgccagccatctgctgtggattccaaaccccgcccaggactcccacaccctagaggcaggaagttggattgccctgctggaggactggcagtctgggtagtacaggcagaaggaatccaaagcaagcttgtccaagaggcctgtgagttgggatcatcctctagattctagagtctagaaggaatggcttgacttgcccccagagtcgcatcagtggtcatgagagcaagcggatggacaccagccagaggggacctttgcagagaattgcatctggtgcataaaatatcaatgtgcacaggatgtctgcactatctgcagagaaaactggagacatgaacattttctaagtgatagtgatcagaagatggtcattaagctgaaagggcctcccaggattctggcctttaatggaaattcggctttggtatgtacagccttgttctctttatcctgcctgccctggcctggaagaacaagcagtgctttcctttcaagggctattgatttctctctctctcagagtcacagagctcctcagctgttcactcttcagctgaaaccagagaaatcttgtccagcacaaagctgccagggaaacagaattagcaaaacggacgtcgtcccctcaggatgtcgctgtttccaccctggtctgccttgcctttccctgtctttggaagccacaaatgaaaggatatcagctagcttgccttgagaattattgtccctcacctattctctctcttctcaagccaacagctttcacccagcagtgaagtggcagagcagatttgtggccccaaatcttctctaagaaccttggaaattggccccacctgagggcctttgagggtcaggcctggcatccactaaatcctccctgtcaacacagccactttgtcagtccagcctgtgagtcagtgcgagacagaggatgcaggcaccacaggggaagaagaaaagcaagctggaaatatatttgtttcctttgcccgggatcattcccagcatctaaaccaagttcttcccagaccggccaagactgaggaggagtcagaatagagtttgcagcagtcatagatcatgtgggaagacagaaaacaaagggtaaaaagaatttcatatacagatctctgccgtttgctttcagtggcattcattttgtgaagcccccagtgacagcttcagaccagttcaaacctgagggcagcatcattaccatgggtgaggtctctagaagggcaaggaaagacccctaacatagaaaatggtgtggcagtttccagttccccattggggtcccatgacttgaccttaggtttctgccagcacctgcccaccctccatcccttcaccctactgggtggtcattagaacattatctgctttgattgatttacttgtgtccataagagtagagacacacggtgttatccccatgcccggaacagagcctggcccatagtagacccatgaccatgtttgttaactgagtgacagagggactgactggactgtcatgtaagcaataccttcccgtcagggtcttgggaaggtaggttcaggggccccagagttactgtggcccgtatccctctggctgcattctgggcaacgcaaaagggcaggtgttcagtgggttccaccccagatctcggcgttaacagtccactgggagaagtggcccaattcgtgctcattactcccagtggtcctgcctccctgcaggcattctggagaagctgagtcacaggctctgagagttagggggaacttaggaaacaatcaaaacttgcctgccattcattttaggaagccgttgtagtttctgagggacgactaaagggaattttttcctaaaagcatccatccgtcctccaactaggcttcagatagcagtgtgtatgttgtcactatctatgggccatggccagtcagagcccacgggtctcagggggctccacccatgtgggggtgggggtccccacaactcagatcttgaatgtgtggtggtcccatgcagtatactatcttcctgtcattgcaaagggaaagtcagaagggtgaacgagttgtttctaattctggcttccaaacagtacaaaagaaggtttttttccttgtggaatacactagtgctcaacctttgggacagatagctgagcaccttctgctgtgtggcaggctggctctctgtgggggcactcatggagcagtgtctgctggaaaaggagacaggagttccctagcatggaggggtagataatctccccgctccctcccctcttctgtcctcccttccccttctccctcctcctctaccctcccctttttcctctcccctccccttcctcctcctcctcttccttctcttcctcttctttattctctctccctctcagtctccccttccctcccttccttcctcccttcctccacattctttataaaacaaggctttggatccattcactgccatcccccagaagtcttgtcatttgaattcttgtctgagtcaggatgctctcctccaagggctcatagggcaaggaacttcagcccgaatccggctaaaatccaggaacattttgtgggcatctgtctcagtccccgaatcgtttgtcctctgcctttcccccgttggagtccttttgcctgcttaagtggttgaattggtaatgagatcattcttcccatgcagtggtgagaaagcagcactcaggtgattgcacctgggtaaacaggagacattagcatgtggtagctggtgagtgaagctggtgcagtgcctggcgtgggctcagttgtgccagcaggcagtggtggagtttgggctctttcccctctctcctgcccagcacacaacccccagggacaggtgggggctttacagctccctggcgtcagcctaaagcttctagaaaggcatccccaggacttccaaggttgccatcttggctgagactgtctgtgaatgtggtcccttgtctgacagtgggggctgggaggggtgtgacagaggaagagctgggccttagttctctgggggtcaccatgagagaagcacacctgggcttgcatagaactcagtgctgcttgtcagtgtcacctggcacaacaggacgtagtgccacagttgcagccctagaaaatttgacgaccccttcatagctttgtttataaaaggccacacggcctaggctgtccttcataagagagcagaaagcgagtgtcccagtcactaagcagcaactttcaggcacggtttcctcctggtcactgaaaccatttgccatttcctgttttctccattttccaacgattctaattgtcagtgtcaaaaggcaacaactgttttcttggggcttatctttggagcacattgattcagaacaaaggatgggagcctccatctgcaaaacaaaggaagcagcctcctcgggaggcctggagagaatgctctggctcctttggccagggacagcaggaccagcataggagcagaggactggcggtgcctctggacactgccgtaaggtgaagagcccatggaggaccgtcgcttgctggtggcaccccagacttgaagatcctgcagagctggccaccggcacccaggctgggtgtcagcagcgctgtgtggccttggcagtttccatagtgataggctggccagcttttccattagactccggggtcctctggaatgtgtgcttcccgggatgaagacgccccagcacccgctgaagcctgccctgccccggcgtggcctttccttttgtctggcacgcccctgggcttggctttctctttccgtccctcccttcggactttaccgcacttcccctgctgtttccttagtcacactctccagcctccatctgcccctgcccctgaacccctacctctgtacaactgtgttatttgatgaaactaatgcagcaaccggtggggatggagttaaggaccgtttagacctagccagccacgcaggaatctgtccccagaagcagcagaagcacctggtctgcagttaggagatactgtacttcttagccgtgtcaccttgggcaagtcatttaacctctctgagcctctgctgtcacatcagtaagctggggactgtagatcttctgccctgatgtcctgagactggtacaagaagagccaaagcgaaaggactgccttcagaaatggctgccaaccctgaccatctcaggcagatccggatggtgtggccttgggcagtggtcatgtgacccccatgctcctcagtgtccacatggggtgttgctagatgacataaaataatgggtgagacgtgctcagtataatgagagcttgagaaggcagatcccaccccccatccccacccccaccccttgccgccttgccaatgctttggcagggagagggcagctccatagggcagctgagaaacagcccctcactgcccacacggcagctccagtggagggggaggcagggaccaggacaggaagcaggctaagggcgggatagaaaagcaaaccccagtctggtggaatcgcttctggtgtagtcttcccggtgccatgtgtttgtcctctctgccttggcaggaaccaaggccaggaactgctgccaggcctgagagctgggcacagtcccaagcactgggtcgctaccccgccccactcccaccagccccactgagtgcagagaagggttcccagaagccctttgctggaaaagcaggcactgcacgggcagcccgtgttgtagaggcaagtcctctggcatcttgggggggacacagaccagaaagtggacttggagcttgtgctcccagacagagctgccttggtggttgagaaggggagagagatggcagcagttgagcagagatggccgggctcccctcactgtgtggggtgaggcttcaagcactggactgggagtcagacctggatccgagtcacaacctgacaccaaccggctgagggtctcagagcaagtcatgccttttctgggtctgggggccttcatgttattccctcctggctatgttcttcccctttgctccttgagccgatcccagactgagtgctgaaactgcggccttgaaacttggctcgctcctccccctgcccacccagccagctttcagatggagacaggaagctcctcccaattgcctatgctgcaactagtcaggagaagggcgggaggttggcagtaagtgtttggctactcccagtgttggagactgtgtccacctgaccatgtgatcatctggccgttcatgccaggaccaccaggaacaagcctcagtcctcttctcaatgtcctttccctatgacagccctgcagaggctaggtatccaccactacatagcccacagtctgctctgccccagccacagcatccttggcttgctcagccattctttgtctgggtagtttgaagtccaatccccactctcattacttaccatcctctgaatgcagccagtctgtctgggtctccctgagactggcatgcccagactcctgtgggtatagtctggccaaggcagagttagcataggactgtcacctccctccttctacatactctgcttctattaatgcagcctaatgttacatttgttcttttggtgaccgcatctcactgctgacccatcctgagcagatggacatccaaaatgcctaaaacttttttctgtgtgctcttgctattaagttctgtctctcctgccccattctatgctgttgcagttgtgtttttaacccaggtgcagaatcttactttatttatacctgtggaattttgctcgagagggtggggcatgcatgcgagtgtatgctggtgtgtttattcatgctttctgctgcaccaaagccaagtcctaggtccccacgcagcgatcctaaggctaattattaattggtagctgtaatctaatttgtctttttcatcttctgtttagcaagaggaacagagatcaggtcttatggcaatgacccctgaacggcagaatgcatatatctcccaacagatgagtccatttgaaggtaagcagttaaggccagtgttcccaaaggggtgggcaaggggtgcatatgtggaagtggggtgagaattcatttcagagtaagcagttactgtgcttctgaaagcattgagaaagaggagatctgaaaatcagttaaataattcatccaactctaagagcaggatcccaattgaaggcctggtctaaatgactccaaaatcaccacttaattcaagagactgatttccctgagtcaggccccttaaagcagctatttcaatgggacagggaaacaaccctaggatctggattagaatcacttgggggctgccacacccccagggctctgatcctgcccttctcccacacgcacattcacatactgctgcagtgaccttccatttctaatgggttcctgggccatctgtcaggtatagggaatggaaaaggggttggggaggctctgcttcagaaagtttgtgtcaggggctcccagagcctccacagatagatagcaggggtccccaccctaccatggcagctataaatgtgatcaacatttattggcctaggatacagcagttagcaaaatgcctgatgtagttcccactccgtggaggttgcaggctagccaagaagtcatgagttcagcaacccttacgcaccagtgggatgagattggaccaggccgagggtagtcttgggaacactcagcatttgtctgagggccagaagaggctgcttgccctcagacaggaggtcagcatctttattgtagcccatgacacctctacaccattgctcttctggtcttatggaagacatctttgggcctgataacagcggagtctgtgtcccacttgtccaggctggagtgccacatcaggcacactccagttgcagggacagcacagacaagtttcaggaaggctggtggcctccaggaggttaaccttataaggccagattgtaacctagttgaaaaacatacacatgccatgataataaaagaacctaggcaccattacaagagaaaaaatcatttttgtagatacgagcatggattcttgggtgggtcagacacactgggcttgtgctctgactgcactgtctcccctacctgaccttgggtaaaccataagactgctgcatgactcagtgtccaccccaaaaaagtaccggtagatattggccacagtagatatcagctagagtggactctcatgacaatgaggggagatgtattccccatcttaggcacctgggactctaccttccatcttctgctccgtgtctctccatccccaggctcttcagaactcagggagtccagaatgtcagctcccagatttcagccttcagaaaggaaacccattaccgttcagttgaacaaatgttgtctgagccccagatctgggctcagaggccatctaggctatgagacaagaggggaacaaagcaccgtctgcactcactcaccacactcacttgctgtcccaggtcacatccatcgggtagagaatctaagaggctgagctagctcccgccaccagcccagcccaccccacctggccccttccttccttctacaaaatatgcaccacctgtcaaagggtgggcagtgccaggcctgcatacagagcactgagtgtaaaagcagacatggaccctgacctccaggagcttccaattttcttgaagagacaaatcagctggcatttcagtccagtgtgatctgctcttggtgagcacagacctagggagttggggcagcttcccagaagaactgcagtccaggctgagggcagagaaatgaggggaatggcgaggaattggggagcaggggggagctcagtagagagccaagggcgggaggtgagaagtccgtgttgggccaggagctaccctccggtggccacagccgaagtcgaggatgcctttggaactcatccccacttctctctttctgtatgtagccgtccaagaacaagtcacctccaagtgtagccggatcaaggcaagccccccatctagcaagcacttgatgccacccagaactgggcttcttcagaacaatctgagtccaggaatgatcccactcaccaggcaccagagctgcgagggcatgggagtgatctcaccaactctggggaagcggcaaggaattttcacctccagcccccagtgtcccatcctctcacactca

SEQ ID NO: 3938 - DNA, 150897 bp, human
gcgcggagccgggcggtgggaatggagcgagcagattgaggccgccactgcagcgccgccagcatgaacttggccgcgagctgaagcggccggcggcgggcgggcgcgggggcaccggccgctagccagggggtgatctgcaacagggctgggttccttggcggccgcctgagtccaggctgcccgcgccggcggccgcccgcccctcggacactgcccccgccgccgccggagctctgcagcacggtaaggctgagggcgggtgcaggaagtctgactgttctgggggttccggggtacacttgtagcccccagttatggtccccatcgctgaggatcggggtcccaggggtgcttcgagtcggtagaccctaaagtttgctctgagcacacggcccacctggcgctgcgggcggccacccccttctcgaaccagcccggctgggctgggcgcagctcgaaacgccggagaccacggcctttggctcggcgcccgtcgggcgtctgaaatccggcggggacagccacgtaccggggaggaaaggtagaagggcgcaagctcctcgggctacgctgggctactgggaggctcccactctgtcccagcacccccgggtcgcttgcagcctgggtgtcaccggcgacggtgccttcacatgccagctgcctgagcccaggccagtaggcagtgggcgctggatgaaggatttccccaccccaacgctgtttgccgcctctgagcgagagtgtggagtgtgcgcgccgaatccgctgccctgcactccctcccctgccaactcctgggaagcgcagcccggagctgagctggtgttcagggcagcccggactgggttcctgcggagcagccccggcgcccctgcgtcagagtccgcgcttcaggttccccagcatccgcgcgacgacagagctgggcgcccggcgccggctagcgcgggcgggaagccccccggagcgccgccaaatacttttctcggccagttggcttggccaggctccgtcccaatgcagtgtgtccgaagcctcctggaaagctggagatgtcgtctgattctgatccgtgattaaattcggactgagcagacactaataggattagcctgccagaaagctcggccctgaagccatcggaacctgtgcaaacacgcgcctcgggctggagcattcactcccgccccgccgcgcttctgcagctgggtgcggctgacctgggcacccggagtgtgggtgtgtgtgagcgggcgggagcacagcgtggctgggggacgtggggagaaggggctgcttttgctggggtggcttgtcgttgttgtttggcaccacggtgccccccgggggcgcggtccccacggtgaacgtgctgctcacgggtaggcaaacccaggccggctccgggacattgtctgcaagggcgagcgagccgagcttactagaggcggctgcgctggaacaaaggcgcaaagtctccctgagaccaagcaattttgaaagagttggctagggagagggcctgggtctcccggggtagacccccgcgggaattgcgccgcccccagcggccccggcccgcgcctggggaattgtgttccctggttgcggtgagccggcgagcgacatcgcagcggcgcggcccagctcttggcaggcgtgggttgccgcccgagtgcccaccggccgggcggggtcgaccgtgcacccgccggggcttcccggccgccaccgcagctctgggcccctggaggccgcgcagcttctttccttccctccctcccacctcttcttgtctttatagatcccccctccctcccacccccgccgccgccgccgccaacaatccgctttataaaaagcccctttgtttcccaggaggctggagagagggaaggggaaaagggacgcagaggcagagggcgggggcggctgtctccaagtggtttcgagccgctcgggacaggagggcaagtgtaggcgatgggggagggggctgtgtttcgaggaccctctgtgggaacccacgaaggcgcacggagcctcagccccggccctcgctgcacgcccggcctgccagccctggacaccctaaatcctggcggccgggacggccgagtggactgcactgcgagctggcgggcgcgcgcagaggccctaggctgcaagcgctccgcggggtgggcagacgcgactcgccgatgcgctcgccgggctcgggcatagggggcgccctttccttggtttcgctttgcagcgggcgcccctcgccgccggagctcagggcagctgtcgcgcccgccggtggctaagacggaggcggcagctcggaggcttaggccacccgcgtctggctacacgcctcatttcttcccgcgccctcctgccacaccctccgccccaccacacacaagggctcaaactctccgagcgccctttgtttggaggcgcggaggcagtgggagccgccacctccggggttcgtgtagcctaggcgggcagtgaggatgagcgtgctactctggactgcgcgctggcctgctgcctctgcacctaacccagcgcctgacactaaagctgccagctttagttagattgaccatttagcgggtccttgtcccttataactgcccccctaaaactttcgagaaccagggcttgcactgaggaatgtcaaatataatgttagaagtaacctttcgccattctgttggcctgctccgcccctgtgccccaaagtggtcggtgtctctcatagagtttgttcgggaagggaatactgaaaagaaaaaagtgacaaataaggaaagtgggcggggcccaggctcaggctggtgggtctcccaagcgaagtcagattccacccgctctctggccgcctccgcccctcctacttccatttaatctgatgtcgacgttttatttgtgcctttttgcatatctttctcctactcccctcccctcccatctctggaggttattgataagtgctgctcaaacatttgttttctgcgtctttggagtagaagatgaagcgttaacacccccaacgcgcatacacacatcccaaatgcgcgcatacacacatcccaactgcatctaaaaccacaagaaagtaatcaaagggtaaactactggttctgccttctcctccctcctttgtgcttctcttctggagcaagatcattggaaaataaagctgctgatgtgcgagatggaacatatggtgcctccataagagagaagctgaaatggccttgaacctgccggacagaccagctgtttgctgccagccagagcagctaatcagcttcttccccttaaagtaacagccctcttttcacttcatgaccagtttgcatattaaataggatattctccagaggggaaaagtgatgggctcctatactgctttgtgcttggtggttctccaatgcctgctccctgctctgggggccgccctgccctctcccggtgcctgcctgcgatgtgcgagtgtttctttcagtactgaagtaagaatgttgctcaaagtggaacttgggacagacgaggcaggaaaaaagaaagaaagaggtggggctgagagatttccagatgcctgggaggaaatctctctgttttgttcagcttcggaaaaaactagcattctttcccccctttccccctttaaaaatatcacaaagagctgaagcttttccttacaagatctccttaaaaatcatcctcttccggctgtgaccattttcagtttttcttcagtacaatgtgttggggtggggggtggggaagagtttggcgttggaagaagaaagcctttaggagatacaaggaaattccatgttaggaaatcattagcaaagggtgacttcgtctgttttcctgccactgacgctgacagtgacacagatgtgtgggttgaaataggaacgtcattgaatttttacactccaccaggaaataccctgtttctggggtgggggtggggtctacagattcactgcaacttaaggtaggagattcactactgtcaatcctttttactaaggaaagggatttttttagcttagccagcatgtttaatgtattttcttcccttttaaattgatcacctaaaggcataaaatgcacctgttaatggatggtccctaggaaactcaattactatttggggttatgaaagggaataaactggtcttagacaagtggctcttctgaaaatagctggactatgcctcttctttaaaggagcctcaatatacagtaaaacctttttttattattgcactttaagttctagggtacatgtgcacaacgtgcaggtttgttacatatgtatacatgtgccatgttggtgtgctgcacccattaactcgtcatttaacattaggtatatctcctaatgctgtccctccctcctccccccaccccacgacaggccccggtgtgtgatgttccccttcctgtgtccatgtgttctcattgttcaattcccacctatgagtgagaacatgcggtgtttggttttttgtccttgcgatagtttgctgagaatgatggtttctagcttcatccatgtccctacaaaggacatgaactcatccttttttatggctgcgtagtattccatggtgtatatgtgccacattttcttaagccagtctatcattgatggacatttgggttggttccaagtctttgctattgtgaatagtgccacaataaacatacgtgtgcatgtgtctttatagcagcatgatttataatcctttgggtatatacccagtaatgggatggctgggtcaaatggtatttctacttctagatccttgaggaattgccacactgtcttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgctggctgcgtaaatgtcttcttttgagaagtgtctgttcatatccttcgcccaatttttgatggggttgttttttttttttcttgtaaatttgtttgagttctttgtagattctgtatattagccctttgtcagatgagtagattgcaaaaattttctcccgttctgtaggttgcccgttcactctgatggtagtttcttttgctgtgcagaagctctttagtttaattagatcccatttgtcaattttggcttttgttgccattgcttttggtgttttagacatgaagtccttgcccatgcctatgtcctgaatggcattgcctaggttttcttctagggtttttatggttttaggtctcacatttaagtctttaatccatcttgaattaatttttgtataaggtataaggaagggatccagtttcagctttctacatatggctagccagttttcccagcatcttttattaaatagggaatcctttccccatttcttgtttttgtcaggtttgtcaaagatcagatggttgtagatgtgtggtattatttctgagggctctgttctgttccattggtctatatctctgctttggtaccagtaccatgctgttttggttactgtagccttgtagtatagtttgaagtcaggtagcatgatgcctccagctttgttcttttggcttaggattgtcttggcaatgcaggctcttttttggttccatatgaactttaaagtagttttttccaattctgtgaagaaagtcattggtagcttgatggggatggcattgaataaaccctttttttttaagattctgattttttttttttctgcaacagtgcattgcacagatcattagcctaggagctgggaaacttgtgttctagaaagttctgcccactaattaacagagtgatcttggacaagtccatcctttctctcccccaatcccatgacctctgagtctgagtcccttccagttctaaaacactatggtttgtgaatgaaatagtcattttctgggaaagtgaaacatcaagttcaaccttgtcattgggaaacagctagacagataataaaaaggggctgatattttgaagggcaaggataaaaaggaggagtaaaaaaatggcagaaggccaatcaaaacaatacaaaagtgtgaagtgttcacctttttgtgtcttttgcaagtgtgaacttctaacccagaatcagagacagcagacatcagaaatcaacccaaagtttctcttgtccagtactcctattgatggcaggcctcctaatcattgggttggtatacagataacgggatctaaactctttagagtagactggcatatttccaaaggactcatctaatgtagagcagatttgctgctttgcagttatttagtgaaggtttcaaagacaaaaaggccttccatccacacacacgtgcaccactggggtgtgggttctgaacccattgttgaaccttttcttttcttcctaatccagctgtttttttttttaatcacatttccaactttggggatacagcagccatgtaagaacctgctgctgtcctacttgatgttaatattgattttttaaaggggcaggggtgaacattatgaagaaggactctttatcctctgagttctttggcaattatcttgctgccataaatgttgatacacatataatggatgtaactaaaaaactccttatccaagcagaaaaggctgagtgtttgttggagcagatagaatgctgagagtgtgaatagaccaacccagatgtcactggggagggagataaatgatggaggaacaggagccggttactatggatcagcacaataaaccaattcccatcatacacctctcacaacgccaccgaggggtaacctaggcagcaccagtcaactgtatggcaggaaaaaagcattgcaaagctcaattggaactggcctggttttgtaggcattgggtccttaaacatcttcagtacttcgaggaggaaaatttcataaatccgaatgaacctgaagagactgtgttgcaaatacttattacttcttatttttgttgtgtcattgttgttctttagtctgtaaaggtgtcaaaggaagaagaaaaggccccatggagctgtcaggacagttagtcagggggttctccatggaggtaagaaacagtagcttgtgttataggatatttacatgccaagattggaggtgcatagtcctgtggggtcctgctcccaaattaccagcccagggctgctgaagccccaagagcattttcttccagaggtggagacagaagcaaaagagttgggttaccttatttccctgcctccacccccccagctctggttgctttctttctccccttcacagagcctccctggtttccttcaaacctcgagttttctcctaaaatctgacatctttataacatccaaagcaatcagatatgaaacagttcaaaaatattccccccgggggagggaatagcaaggggcctccctggctgtaggcactgagctcccagagtaaaggcttccagagacagggcctaaggagggtttgggagcaagaagcaaaaagctctttgcaaagtttaggagagctttccttgcccagattggctatcttgagcctccctgaggccccagcttcagactactccctcccttcctcggcctgcaagagggtgggctcttcatacccctggaggaggaccccccacccacccaccaaggcaactcagtcctgcccggctgccctctgacctggacacagccagtgcccctttctgcacagcccagttggagcctcccagacccccatttccttggtgggcaggtggggtaagctaccttaccctcccatgtgccctgctgcttgttctgccaagtaaataaccagtaagtggattttgggaaaggccattttcttaaggctgagaattgttccctgaggttcagagaaggatggagtggaccaggtgatatcatcttgttggaagagggcctagcaggccagccgttgattttttcccctttcttccacctgtgcgagtacctagacactagaccacagggacagttttctgctgattttggaagagatcattggaggccacagcacctgagctagttaatggcatccaggtcaaaaaggcctggtggccccagcttgtgttcacctgtgagaggaaagtgtgggtctttggagcataaagacaggaaaaaaacaaagtcaagtaattctgaacacattgaggaattccaagttcttggtccaattgtcccagctccaccctcaccccacaagtaatgcatttctattttttcctgcatttgaatccgaaattccactctcagcttcggcagcgtgctgtgacagagtggggaggaggaagacaggacccagctctgccttcctttctgtggctatgccagtcagttgaccattgcacctgtacatagttagcacaggtgcaccacctcacctgcaaactcagatgttgaaagatggagaatcttacagctggaagagtaaaaccccatgattttacagaagaggaaactgaggcccagagaagcgtctgactttcctatggggacatagtaaagggagcccaaagttgacagaaccctggtctctagttctcagtcaagtgtagaacatccattttgcacccatgtgtgagcagacaggctttccttttgaggcagagcaaatgtggtaaaaagaaatgcagccaatggagggggagcgcttgtaactgtggcgtaatataatctaccctgtatcaacgtgtgctttgctcagcattgttaggacagcaaaggggcatattagaatctgaactcgaagtctggaagtagctggagaatggagattgtaaattaagaattagaaggtagtgtgtgtctcgttttcgagttgctgtcagagagtcaggcagccagccctgtggagggcttggctgggtgggctcctctggcaatggtgggaggttgtttgggtttggctcttaatgagatctcagtgttaatatctgcctctggaagttccagcaccagcctcggaattttaagtgggacagtagttttggtgcagttgccaacgtcacatggtttgcgtgtctaattctgaaagactggcatgctttatgctaggcttcgggaggagggcacagcgtttctaagctgcttgtctgtcaaggattaatttaacctctaattactacattttcttcgcagtttgctgcacgaacatgttgtaacaaagctcaaagaagtatgccattttatttccctgccactctaaaattaatttccggaatacggagtcaaacctgacacacttggtgttaaaataattgtgctgacattcgagctaaagtgaacaatctggttgtttctagtgatcccccagccatggggtaaagagcattatcatgttagttgccatgacagttctcgaaatgagccctgaaaatatcaaggagtgtcactgcactaatcccaccaggggagcaccagacacaaaggtaacacccgagcacatggctggggtgttagttttggagtatgactgatgccctgtgcaatagggcagccagggagtcctttctcacccactaatagggctcgtggtgaggtcttgtcccacagcacgaggtgagcacattatcaaatcggaggctcccaagagcctgcccctggggccaaacctgttctgagtggctgtgacaatgaaatcacaagatgaagttaatggggattctccaggcaggcttttctccctcctcctgcctgctcttcctgggcgtcccgcaccagcaatccccaagagtaacagccctttggcagtcccacatatctcttttatccccaccttcccaaacagcagcagtggatcccagagtgggaggcccgttccccattctgggtgcttgagaagactgcattctcaggccctggttggggagacttagcagcattgttggttgcctagtttgggtccaccgaagctgatttgtgggatttgagagttggccaggttagccatttgagttctcatctccttgctcaggtggttgtgaagagctctctctctctctctcacacacacacacacacacaggtacacacacacagacacactcacacactcaccctctctcaggagtagaactttgccaagatagcaaaggctaggtctgaagccctattctgcatatggctggggacaggctcactggcattttcagccatgcctttggctgccaaatcccgagcaaatcgagtttaggttcagtacccctacattttccttaccggtttctagacttgcctcctgcttctcacaccccctctccaccttacctagaaagatgccatcctcagcccgctgtaccttagtgggattcccttcctctggagaatctggagcctctaacttgaattaaaagatgcaagagttaccatgccttggagagaatctgctgtttagggcacaggtaaggaggtattcagggcttagggaagccctctaatccacaccccaccctccaccccaccaaatggtaccatgcctggcataaagctggtcctatttatgagttagagaactgcctggttgccaaggtttttctgagcttgccctcagggaagctaaccccagttggtctcttgaacctcaaatcataacaaaaatgactccctatcctctgaagcaggagtggctgtttgcctcttagggatcacagacttctttgtgaatctgatgaaaactctgggtcttctccttagacaattgaaaaataacacgcaatgttgcatctaatttagggtactactaggccttaagcccactcatggttctctcgaggatcttttgtcacaggttaagaaagcctcaatatgagctttcggcaggagacattgaccaactgtgggattttaggcaagtctgtgaacctgccaagtctcagtgccctcagttgtcagatggaaatatcagaatgtcagttccaccaagtttggagcattgtgggagattcaaaagagacggtgttggtgagatggtcctgtaaatatcaggctcagggcacactcatgggttgctctctttagtgtcagtgtttactatttattttgcatttccatttgatgtgagaaatttaacaagagaaaatcaggcttcttttgacttgaaaagtcattttgtccctttctttgatactgcataagttacgcccaggcaaactggcattaaagagactctggcttgggagggacctcaaagagcatgcagtgtgtccaggatctagacagttttagagatcccaattacccagccctcggcagttccagaatgggtcaaggatgtgtgtagccagtccagtgccttgaggaggttccacatttgcctgctgcagaagtgagaaaatgggatctgaggaggcagatagttgtttggtttttcacatttcagtacggtcacaccgggcatgagaaggtaaagtggatcctgggtgtctctctcatagtcactgaaagggcctagccagaccctcatgaaaactgggaagtagtctcaccccaggatctgtccagggccccatcctgaggaagtggggtcgtgtccttttggagaggagcctcaggttgggcctgctggtgtgtggggggtctgcttaggagggaagaggatggctggactccattcaaataagacttccacaaccttccccgtctaaccctggaagtgtggaaagtcttctcatggcaaggccacgagggctcatatatcaaagatggggaaactgaggcccagagaggagcaggtgctggccctgggtctcatgacaagtcatgaagacatttccttggcccttgttgatcctgtgcaccttccaagttctctgtctggctcctcacaatagtgtattttcaattctcctagaaacacaagcccatcatcatattaacctggccctgatgaatgctcaggtcctcaaagtcagccctagaaagtaaatagcaggtttggaaagccctttgaaccctcagagggagatcctggccttgctcagcctgttgctatgcagttccaaagtggaggctgccacgcatttgcagagcttttaagtcccttcccccaccccatgtgcattttaggaaccttttggaaagaaatgtgttgctaggagcttgggctttccctctcctttagaaagagagaactgtttttgctttgaattgccttgcaaacagattgaggtgtctccctacccattctttcttttgttaaaccaacccgatttgccacgggtagttaagtggagatcatgttgaaaaagagtgcttagcacagggtcactacgcagagtggctcccattcccatccttggcagagcatctcacccttaatttcattattaatctggagggagaggaatcgtgcaagtcagttgaaagcagatgccacctaggaattttaggtccatcacgtcatcaaacaaaatgagagtagtttgtaaattggaaagtttggcagtgggtggttgccctttggaagattcactgtttcagaccagctttctgagtctgggaggagtccctggtgctacagtgggaagaatacccacctgagggccaccgacatgtggtctggcttcagctttgataccaactagccatggcacttggggcaagctatttcctcagactgggcatcattttctccatctgtacaatgaaggaatggtgtaggggcatccaaagggctcctccagctctggcatttctgaattctccagtagcaagttaaactctaagttacttaaaatatttgaaaaggataagtaataatttgttctttttgaaattaccagagacttgaaagcatggggttgtatttttgtttgggtaggtggggactgtgactgttacataagtgataacagttttagaagttttagctaaagacaaagttgacatgtatttatgtaggaccaaataatagaaaaaaattcctttagagaccccttgttttatgcttgaggatgctgcagctgaagaaaaatatcatgcttgcccaggcttccctggcaagctgctaggagctgaggtggtccaggacccaggaggcccagcttgcaacccactgcttgccccacaccgcacttcctaggatcttacagaagaagcctccaggccctcaactccaaatgggacctgcagtcagcagaatatagggctgagtgattctgatttctagctatcagatactagcttatcagaatggaatttttattctccacccctgcccccaacatccaagggttctctgttaacagtaaatatttaattttcttggttttgtaccaatgcctaatttaaaataaaacagattttttgaatattggggggtggtccttaggggcttgttatttggatttattttatttcaaacagatgggctgttttaggtttgacttcatatttgctaattttcattatggaaaaaaaaaaaaaacaatcccaagccaccccacccttatttttgtactgagtaacagtttgtcttgtctaaaagaagcttttattttctcaactgtttgcacccagcgtattcagccttattttgtatttttaatcacataaatgtgttggccacctatagcttatgggatgttcacaaaatgcgccccactcattcccgaacagccaccaactttgggactgtatctctcagctccagcccagctacctcttgtctagttcccagccatccactcctctggcctgaagccagactgtatggaggtgcagagtcagagaggccttggccttggagggaggcaccctggtgcctggcccagctctactgccttgctgtgtgaccttgggcaagtcccttcccctctctgggcctcacggttcccactgttacaaagaggaggctgacctaaaggggctttgtggaattttcctcttattatgttagattgttatatttggaagatgtgacttgaccagtacagtacatgacctttaaatcctttctagaagcaatatttagtgatgtttctgaaagagttaggaggtctatatctctgagatgaactagtactttctgaaatttatgaaaacaacagttaccactctttgaatacccactgtgcctggagactcttgtcctgctgtttcttagaaactcacccatcagctgtgagcattttctaatggtttcccctcaggcctttaatctttgatctcaataccttctccctaggagattaattgatcacttctaactctttttttaatttaatttttcacttgacataaattcagactctcagaatatttgcaagaataatacaaataatgtttaaatacctttcacttgattccccaaatgttaacattttaccacattctatgttatatctaccaccccctcacacacacacacacacacacacacacacacacacacacaattttattctgaactttatgagaacaaattgtaggtatgatgctcttttatctccaaatactgcattatatatttcctaacatttcctaaaacgttctcctgcataagcacatattgatcaaaatcaggaagctaatagtggtactaatctatctaaagactttaatctaaaggctttattcagattttgccaattgtcctaataatgtcctttatagcaaaagaaaatccaggatcatgcagtgcattcagtcgttttgtctctttagtgtcctttaatgttgaatggttcctcaatctgtcttagtgttttgtagcattgacatttctgaagagtacacgccagttattttgcataaagtccctcagtttgagtttgttgcctgatgtttcctcatagttagatcagggttatgtactattggcagaaataccacagaagtgatgttgtccatcagtgtatcatatcaggaggtccacgatgttagttccattcatcctattcctggtgattgtcactttgatcacttggttaaggtgatgtctgccagatatctccactgtccagttcctatttcttcccgttgcaattaatgagtatcttggggaaataaatatattttgaggctgttagtatcctagtacacctcaaactttcactcactagtttagcatttattgatggtctgtgcctggggcaagatggtcagtgcattatgctggttgccaaataatgaatttctgattccatcatccattctacatttattagttgactttctactataagaaagaacttttctttcactcccatttatttacttatgcttttatttatattaggttgacttgtgcatttttactttgagttataatcctttcctatcattatttattttgatgctcaaattgcctgaggtttgtcccgtgggaactccttcaaactagttcctatgtctttctgacatgcccctaatcatcctctgagcgcgcccttaatttctggcacatctgctccaggctcatcttgtgctttccctgccttagccttaatatcagccattttcccatggaatcttaacttcttttagtgaagaatggtatttaaaaactaagatctgggtactaaaagcatgcgcatttctacagatgtggcattgttactaaaccctctcagtccacaaagctaggaaaataattaactcacatctatatctattcctttttatttattattttggtaatatctatttctctatctatctatctacctgcctacctacttacccataaaccatgagttcacactgataacctccaaattccaatacaacagcaaagttcattctatcttcccccttcccatatttgtagtttccttgcaaaacagtgagaaatctctctgccattaccataatatatttactcacttaatcctagaatatatagaagctagtttcagagttgctaacccatgactctatgaagaagccaattgacaagagtacaatatttgttcagaattatttttgtcttttcgtaagagtgaatccttcaagcactgttaaaaagttacctgggctagttcatctcccgggccccactgaggtcatttgaatatggtttagttcacttgtttctgtttagattcctttttgtctgccccccacccctgaaccatctttctttgttaattttaattatttttctgtgagcatgtgaaataataacatagtttcaaaagttagaactgtacaaaaagaaatcctcagaaaagtgacatctcccattacttctgtcctttccacctcattccactcatttcctgtaagtaaccaacttcattagcttttctgtgtttccttttgcacaaatgaacagatatctgtgtattttcccataccccttccttacataagggtggcttaatagacatactcttttgagctttgcttgttcactcaaacgcatgtcccagaaatcactccatatagagatcttcttcattctttcattacagctgcatagtactgcattgtgtagatgtaccatagattattcaaccaacctcctatgtgtagccatttagattgtttccaatattttgcaattaaaaataaaacaaacaacccagtacatatgtattttcatattgttagaggtatatcttaaagagtacatttctataagtgggattaatgtgtcaaaatgtaaaaacaaatgtagttttgttaggtattgccaaattcccctccagaaagattgtaccaatttgcattcccattagcaatgtatgagagtgtttttttccccaaagcctcaccaacaaagtatttgctttactttttaatttttacaaatctgataggtgagaaatggtatctcagtgtagtttaattagcatttttctaattaggagtggcttggaacatcttttcatatgcttaagagcccttttgatatttttatgtgtgtgaattatctgttcatgtcttttctccctttttctattgggtttttagtcttttaccctcaattttaagagtatttttctgtgttaggtatattagctttttttatttgtgatatatgttgcaagtaatttcacttaattggtttgtggtttttttcaatgtttgttttgttttgccatgcaaaaaatttttttatgtcgtcaagtatcagtcttttcttttatcatatccggatttgaatcacagttagaaagcctttcctcacatccagtttaaagagaaattcaccaaattttcttccagtatttgtatggtttcatgttttacatttagattcctaatccatttggagtttattcttatgaatggtatatgggagggatcttactttacctctttccttttttctttttgtttctcttttttattcttttttagagacagggtgtcactctttcacccagtccggagtgcagtggcatagtcatagtcagtggtggggtggtgtgccacaaccacacttggctaaatttttttttttttaatgttttgtagagagtggatattgctatgttgctcaggctggtctcaaactcctgggcttaggcgttcctcctgtctcagccttccaaaatgctgggattataggcatgagccacagcacccatccccttcccttttttcaagagactacccagctatcgcagccccattttacaaatgttcatcttgctccagtgatttgaaaagtcaccattattatatattcagtctccacatatacttgggtctatttctacatgcatattttattccactggtcaatttgcctattcttcttccagtaccacactgttttaattatagaggctttattgtgatttttaacagccttttattttgagataattgtagagtcacatacagttttaggaaacaatactagaaagatcctatttacccttcacccagttcacagccaggacagtcacattgatacactccatccaccttattcagagtttaccagttatacatgcacttatttgtgtacatgtgtgagtatttaattcaaagcagttttatcaaatgtgtagagtcatgtgaccacagtcaagaaaaagaaatagtgccatcaccacaaggatatgcaatcctttgtgttgctgttttataccaaacccacttccctcctgatctgctctaccccaacttctgaacccatggcaactaaccagtaatctgttctccattcctatagttttgttatttcaagaatgttatgtaaattcaatcatatagcatgtgatctcttgagattggcttttttccctcagcataattctgatagtggtgtagtgcaatacaggagtagtccattctcacaggtgtgtagagatatctcattgtcatattaatttgcatttccctaacgcctaatgagattgaacatattttctggagtttatttttcatccatataacttcacggaatgtctgttcatgactttggcccattttctagttggattatttgcattttttctcttttttttcactgttgagttttgcaagttctttatatattctagatacttgtattttgtccaatatgtaatttgaaaatactttctctcagtctgtatcttatctttccctccttttaataggttctttcacaaaaagactattttgggggtcagatttttgtggttgagtctaagaactctaccccaagtcttaggtcctgaaaattttctctaatattttttaagtttgatggttacacatttaaggccataatcgattttgagttgatttttgtataaggtgtgaggtttaggttgatgtttattatttttttgcctatggatgctcaatggctctagtagcatttgttgaaaaggctatccccacctcactgaactgcttttacacctttgtcaaaaattcgtgggaaatatttttatgggtctatttctgggctccttattctgctccactgatctatgtgtctatccctctgccaataccacacagtcttgactaatgtagccatataaaaatgttaatactgggtaaaagtactcctcccattgtataattgtttctcaaaattgttttaacctaggacttgtgcctttccatatattttagaataaccttgtctacgtctacaaaaaactttgctgagattttgatgagaactgcattaaacctacaggtcaattcaagaattgacatctttactatgttgagtcttctaggcagtaaacatagtatgtctcctcttttatttaggtctttattcttttatgagcacaaaaaaggtgtttattattatttctatttgatgttcaactctttttttctgaattctttttattaaaattcaaaaatgtcaatattttcaagggaaatacaataagtgaaaatattttaaatatattcttataaatgtattcatacttgttgatgtagtataagactgcagcaatagagtacaaaatttgaaacacttcagattacaaatattttgtcccattttatttttttttttttttttttttttttttattttttttttttttgagacggagtctcgctctgtcgcccaggctggactgcagtggcgcgatctcggctcactgcaagctccgcctcccgggttcacgccattctcctgcctcagcctcccgagtagctgggactacaggcgcccgccaccacgcccggctaatttcttgtatttttagtagagacggggtttcaccgtgttagccaggatggtctcgatctcctgacctcgtgatccgcccgcctcggcctcccaaagtgctgggattacaggcgtgagccaccgcgcccggccctgtcccattttagagtagagttttaaaaaatcactattttcataaagaaaatatagagtttttttaaagagagaaaagaaattgcttataaatgtcagttgcaagtataatttattgtgattggaactactatcaagatttacttcgtatgtaaatttctttgataaattttatggattttaataggtcacaggaaatctcattgtgctcctctttgattttttatattttattttattttaagttccaggatacatgcacaggagtctttatttcttacaaaagcattttgtaactttctggatgcagatcctatacacattatattatattaaatatctaagtattgcattttctatgcagcagttgtaaatggtatgtgttctcttaacacagttttattgataccattcacataccaccgaattcacccatttaaaatattcagttcagtggcttttagtatattcatagttgtaccatcatcaccagtatctaatttcagaatattttagttaccctgaaaaggaaccacatatccattagcaaacatcctcaattaccccctgcccaagcccttagtaactattaatatgctttcggtctatatggatttacttattctaggtatttcctataaataaaaccataagataaatagccttttgtgactgacttctttcccttagcataatgttttcaagcttcatccatgttgtagcttgtattagtacttcattccttttctttgccaaataatattccacatattatttgtgatacaccatatgttgtttctccattcatcagttgatagaaatttgagctgttatcactttttgattcttatgaataatgctgttgttaacattcatgtacaagtttttgtgtggacatatgctttcatttctcttgggcatatacctaggaatggaatttttgcatcatatggtaactctatgtttagcattttgaggaactgccaaactgttccaaagtagttgtgccatttaacaatctcaccaacaatatataagagttccagtttctccacatccttgccaacacttgtaaatttctgtcttttttattatggctgttctagtgagcataaagtggtatttcattatgattgtgatttgcatttccctgttggctatgattttgagcatcttttcacgtgctttattggccatttgtatatcttctttggagaagtgtttatgcagagcctttgcccatttttatattggattatttgtctttctattgttgaactgtaagcattgtttatatattctgaattctagaccttcatcagatataagagttgcaaatatttgctcccattctgtgggtcatatttacacttccttgatggtattattcgcagcacaaaaattttaattttgatgaaagctaatttatttagtttttcttttctcacttgtgctttttgtatcatatctaagaaactatttcttaacccaaagtcaaagatatatttctatgtttcttccaagagttttatagttttagttcttacatttagatttatcttccattttgagtttttaaattttaaaatgtttagttaataaaaattgtgtatattcaaggtgtacatgattcgatatatgtatatattgtgtaatgattaccacaatcaaattaattaacacatccattacctctcataattaccatttttttgtgtatatatgtgtgtggtgaggacacttaaaatctgccctcttagcaagtttcaagggaacaatgcagtactactaactatagtcaccatgctgtacattagattcccagaacttattcatcttataactgaaggtttgcacactttcaccaagatcttcccatttcccccacctctaagacattaacaaccactattctactctctgcttctaggagttcagcattttaaatttctacatataagtgagaccatatattatttgtcttctttgtctggcttatttccacttcaggtcatgcaggttcatccatgttgttgaaaatggcaggatttcttctttatgcctgaacaatactacacacacacacacacacacacacacacacacacacagagtttatgcttgaacaacatagtggtttggggtaccaaccccctgcacaggcacaaatccacttataacttttgacttcccaaaaacttaactaccaatagcctactgttgcctggaagcctcaccaataacataaacaacacatatttcatatgttatatgtattatatactgtgttcttacaattaagtaagttagagaaaagaagaggttattaagtaaatcatatggaagagtaaacatatttactattcactaaatgaaatggaatcatcataaaggtcttcatccttattatcttcatattgagtagactgaggagaaggaggaagaggaagggttgctcttgctgtcttggggatgacagaggcagaagtgaaggaggtggaagaggaggcaggagaggcaggcccacccagtgcaaatttatggaaatacatcataatttctctctaactttttgcttttttatttctctaaaaaatgtttctatataataccaatccttcttccaccatttgctttagcttcaggtcctgtatcatagaagggttcatgctgtaaaggaagtcagaagctgtcttgagtaatcagaacccttctgttcaattgtctaatgtcaatttgtttcccagcactgcttcttttatgtctttgtcctcatggtccagcactagttaggaagcactcatctccataaagttgtcttctgttatttcctctggcatggtgtctattagctctataatttctccaagatccatatcttgaaatccttcaacacccatcttttttttttttgccatatccacaacctctttcatgatttccctgtttattgtcataaattctgtaaagtcatgcacaacatctggacacagttgctttttccagcagtaatttactgtttcaggcttgatggctttcacaggtttttctaaacaattatggcatattcaatagtgtaatccttccagactttcatgatgttctttctattgaggttctcttccaaaacattgacaatctttctatacagtaacctgtgtggtgagtcttagaagtccttatgaccccctgatctaaggctgaattagaattgtgtttgggggcaagtagaccacttcaacaccttcagtgttgaacccatggagttctgggtggccaggagcattgtccaatatcaaaagaactttaaaaggcagtctcttactgacaaggtacttcctgtcttcagggacaaaggatcgatggaaccaatccagaaaaaaatttttttattgtccaggccttcttgctgtgcaacaaaaagatcggcagctggtgtttatcttttcccttcaaggctcaggggttagcacctttatagataagggcagccctgatcatgaacctggactgcctttgcccgaaattgcaaagttagactatcccttcctgccttaaatcctggtgctcgcttctcttccttactactaaatgtcctttatgacatttttttttttccagtataaggcactttcatctgcattaaatcctgttcaggcagatatcctttcttatcaatgattttcttttttctttctttctttctgttttttggataacaaaggatctccaaattatattgaaaaataaatcataattaatattactcaaaaattttcagcatacttttcaaaaatgatttatgtaaaagagaagaaaatacacataattttaaaatatcttaaactcttttattccttactatagacattaattttgtcttttgttttctttcaattttctacaattttcaacttgtacctgtgtttaataggtaagacattaactgattgcttttctcaatctaaggattatatagttttagtataaatatatatcacatattttggtaaaattttgacaaaactgaataatcatgccttgttttaagtccatactccttccactgtttatcaaatctgatttaatggtcaaaaaattcttggttgtcattcttcttttacaagtcttcctgctaaactgccaaccagtttttacgtagtaataaaaagcagtaagaaagccaaagaaatggtgtctgggaacatctctgctacctcttagtcaacagaagctgcttctcctgttattttgatattttttaagccaaactgctttctaaaatttgtgaaaatacagtatttgtgggatgcgtatacagagggctgactttgctcacacataggttctgaagggctgactgtaggactgtagtatgtgtggattttgatatatgagtggggtcctggaaccaacccttcatgtataccaagggaggattgtaaaatattatctgtaaagtttctgtagatgcttgttatcaagttcaggatgttctcgtttgttcctagctttctgagattttttttattattataaatggatgttaaatttgctaaatgctttttctgcatcaactgttatgatcctgtgatttttcttttttaaactgttaatattgtggataacatggagtgtttccaaatggtgaaccagccttgcaatcccgagataaactccacttggtcatggtgtattattctttttatatattcctgaattttatttgtaaatcttttgctgatttttaaaatttaagttcataaaagatatttatttataattgtctttttctgtactgtctttgtcttgttttggtatcagagttataaaatgagttgggaattcttcctttctcttctactttctagaagacattatgtaaaagtggcactaattcttctttaaacatctgggaaaattctccagtgaaaccatctaggtatggatatttccttttcaagagtgtttaactacaaattcatttccttaaggtatatagggcaatttagattatatatttcatgttgtttaagttgtgacagttagctaataatttcttataaatttttgcatctatattcatgaggggttttggtctgtagttttcttttttgtactctttttgattttcatatcagggtaatactaacttcataaaatggattgggaagtaagtattccctgctcttctgtttttcagaagagaatgtgcagaattggtttggttttactttttcaatgtttaataaaattctccaatgaagccatctaggtctggagatttttggagggagttttacaattatgaattcaacttccttaacagtgatagtgctattcaaattgtttattttggtagtttgtgctgtgcaaggaattggtccattttatctaagttgtcaaatttctgtgtagagtttttggtaatattcccctatttttcttttgatttctgtcagatctgtgatattctctgcttcatttctgatagtagtgatttgtatcttctctcttttcaatcttgctagaggtcaattgtattgaccttttaaaaaaactagctttttgcttcattgattttctcttgcttttctattttcaaatccattgatttttatcttatctttattatttcttaccttctgctgctttgagtatattttgcacttcttagattcttgaagtataagcttacatgattgatttagcttacatattaatttgatacctttcgtttttcctaatgtacatatgcttttagtgctatacatttccctcccaactctgcgttagccatgtcccacatgtctttataactgctgttttcattttcattcatttcaatgcattttttttttgagacagaatctcactctgtcgcccaggctgaagtgcaatggcatgatctcggctcactgcaacctctgcctccagggttcaagtgattctcatgcttcagcctcctgagtagctgggattacaggcacacactgccacgcctgactaattttttgtacttttagtaaagatgggtttcgccatgttgcccaggctggtctcgaactcctgagctcaggcaatccgcccaccctggcctcccgaagtgctaggattacaggcgtgaaccactgtacccggcccatttcaatgcatttttaaattttcttggagacttcctctttgactgatggtttattacgaagtgtgttgtttaatttccaagtatttggcgattttcttgatttctttctgttattgatttctagtttgattccattgatcacattagagaatgctgtgatttcaattattttaaatttgttgaggtgtgttttagggcccaggatgtggcctatctcagtatatgttctatgaacacttgaaacaaatgcgtaatatgctgttgctggatggagtgttccataaatgtcatctagaacctttcagttgacgatgtattgttgagttcttcatctttgcagattctgtctagcagttgtatctgttgttgagagtggagtgctgaagtacccagctataattgtagatttgtccatttctccttttagctctctcagtttctacttcatgtgttttgagactccattgtttggtacatacacatctaggaccattatgttttcctagtgcattattattttatcattatgtaatgtctgcctgtctccaataattttctttgctctgaagtcttttttgatgataatgtagccactaatgcttttgtaaaattaatatttgcatggtatgttttctccattgttttactgtcaacttacctatgatgttgtatttagagtaatagaatagagtttggccatgttttcgtttgtttgtctgtttttgtttttgtttttttgagacaaatttgctgtgttaccaggctggagtgcagtggtgcaatcgttgctcactgtgtcctcaaactcctgggctcaagtgatcctcccacctcagtctcccaagtgtctgggactacagacatgcgccaccatgcctggttaattttcgtatgctttgtactctgccaacctctgtctttaattagtgttttagaccatataaataagaggtattgttcacatgttctggcttaagtctgctactttattatttgtttaccctttgcttcctctggttcttgtcctccatttgtttcttctttgtattctcatgctttacttaaatctattttaggattccatcttggtttatgttttatggtttttagcatattacattgtataattttcttagcatttactctagatattacagaatatgtattaatttatcatagtttacagtctacattttataagttcgagtgaagtgtggaaattttacttccatttaggtccttctacccttcctacttttaaaatgtaattatcttaaatatttcctctatacacattcagtatcaaataagatggcattataacttttgcttcattcatccaagatgatttaataaactcgtgagaaaaatagtttattatacttatcactatgtttgcctattctgaatttcttcttttctttatgtagtttcaagcctttttctgttatcatttcctgtctgtttgagaacttcctttaggcattcattaagggtgggattcttagcaacaacatcttttagtttttcttcatctgaaaatacctttatttccccttcattattgaaggatatttttgccagatacataatttggggttgacagttcttttctttcagcacttgaaaaatgtaccacttccttctgtactccatggttcctgaagaaaaatccactgtcatttgaattagtgttcctctttaagtaatgtgccattattctctgattgctcataagggtttttttctgcttcttttagttttcagaatgttaaatgcaatgtgccttggcatggatttctttgggtttattatgtttagatccctcagattctttaatctgtaggtttatgtttttcataaattttgaaaattttcagccattatttctttgactaatttttcttactctctccgctcttcctctctttctgggtttccaatgatagaaacgtttggatcttttgttattgcccacagatccctgagccccctcttcttcttcttcttttttttgttttgtattgttttgttttgttttctttagattactttctctttgttgttcaggttgggtgaattatactgatgtgtcctcaagctcattaactctatcttctttcatctttacactactaattaacccatccagtgagttattttatttttgttattgtatttttcagttctttaatatccatttgtttcttttttataatctcaatttctttgctgagattttctatttcattaatttgtttgaagtgtatttgtgattgctggttgagcatttttatgatgatttatttaacattcttgttaaataattctaatatctgaatcaccttggtgttgacatctgttgatcatctttactcattcattgttgtgattttcttggttctgggtatgattaatgattttattatcataccctagacaatttgcatattatattttgagactttggatggtattcaattttactttttagcgggcagtctttgtgttaaagtgtaatgtaagggccaggtggacatattgttcattttcttgctaggccccactaacaccactctggcaaaatagagcgctgactgacaaagccttattgctgataggtggagtggaagttcagcttaccctgggccctgctggggaaagtggggtactaaattgccctgccttgttgccactgagtaggatgtaagcccagcttcccaccagcccatgctagggaagagggaaatagagactgatccatattgcctttttgctgcaaggtgaaagagaaatctcaaatccctgctgggtccatctgataccaagttgaaagggaggaacaaaagtgcagtctagagctgcctattcttccttattcagtcttgttgctgctaggcaagggtatggaggttcagctccccactagtctttgctgataccagtgattgggtggaaaatggactgctggccatccctgacttgcaggactgagtaggggtggaagtaaaggtttccaatccacctcactaatacctgaggtgggggttacttggtaaagtctagtgctgatttagccccatctcgtaccacctcattaagtctgccaggtgggagtggagactcaactcccctcctgaccttccttacactaccctgatggggaagtggtagcatgcttgggcccctgacacctctgggcaggggaatcagaggaccgacatctgcttacatgagaattggggatggggtggagtggaatatcaacttcccactttgctaggctgaaaccacaggagagggatggtttttctgttggtgttgactaaagtagggtgggtaatttcagaaaggttttctgttatttaggccaccttttccacagtccttttactaggggaaaaggcttttcctggaggagttttttaattaaaaaaaaaatactttttttaacagcagctttaatattacagcaaaattaaaagaaagacagagttccaatatacctcttgccccttcatgtgcatagcctcccccctcccccattacctgcatcctgtatcagaataacacatttgctacaattgatgaacctacatggacacatcattgtcacccaaagtccatagtctacgttagggttcacttttgatgctgtacattctataagtttgaacaaatatatgatgacatgtatccatcattacaatacacagatcactttcattgccttaaaaatcctctgtgctctgcctatttatccctcccttccaatccctggcaaccactgatcttttactaccttcatagttttccttttccagaatgtcatatagtcagaatcatacggtatgtagccttttcagattggcatctttcacttagcaatatacatgtgaaattcctctgtgtcttttcatggctcaataactcatttatttttagtgctgaataatattccattgcctggatgtgtcacagtttatccattcacctactgaagaacatctgggttgcttccaagttttggcaattataaataaagctactataaatatccatgtgcaggcttttgtgctgacataggttttcaactcctttggataaatgtcaaggagcatgattgtcagatcatatggtaagagtatgtttcgttttgtaagaatgccaaactgttttccaagtgtctgtaccacttcgcattcccaccagcaatgaatgagagctcctactgctccacatcttcaccagtatttgttgttgccagttttccagattctaataggtgtgtagccgttatctcattgttgttttaatttgcatttccttaaagaaataagatgtggagcatcttctcacattcttatttgccatttgtgtatcttctttgatgagatgtctgttcaagcctttggcccattgtttaatcaggttgtttgttttcttatattgttgagttttaagagttctttgtctattttggacagcagtcccttatctgatgtgtcttttgtaaatgttttctcccactctatggcttgtcttttcattctctttgcagagctgaagttttccattttaatgaagtccaggttattaattctttctttcatggtttgtgccgttagtgttgtatctaaaagtcattgccacatccggggtgatttaagttttttcttatgttatgctccaggagttttataattttttcttttgcatttatgtctatgattcattttgagttaatttttgtgaggggtgtaaggtctatatctacatccttttttttttttttttttttttttttgcttatcaatgtccagttgttctagcactatttgttgaacagactatctttgctccattttactgcctttgctcctttgtcaaagaacagttgagtatattcctgtgggtctatttctgggttctccattctgctgcattgatctatttgtatattcttttaccagtagcacactgtcttgattattctatctttatagtaagtcttgaggtcaggtagtgtcagtcctttgactttgttcttctctgtcaatattttactaactattctggatcttttgcctctccacataaactttaaaataagtttgttggtgtccacaaaagaatgtgctggagtattgattgggattgcactgaatctatagatcaaattgggaaaaactggcatcttaacaatattgagtcttcctattcatgaacatggaatctctttccatttatttagttctttgattttttcatcagattttttgttttccttatatagatcttgtgcgtattttcttagatttatatgtaagtatttcattttgggggtgctgatataaacagtaatatggttttttttaattttaaattccacttgttattgctggtatgtaagaatgtgattgaccttgtgtcctgtaaccttgctataatgacttattggttccaatggttttgttgctgttgttgttgattctttcagattttctacatagaggatcatgtcatctgcaaacaaaggcagttttatttctgcgttcccaatgggtgtaccttttgtttcctttttttgtcttattgctttagctaagacttccagaacaatgttgaaaaggaatgatgagagtggacatacttgccttgttcccaatcttagtaggaaagcttctagtctcttaccattaagtatgatagtagcagtttttttttgtaaatattctttttcaagttgaggaagttctcaattctgagtttaatgagagtttttatcatgaatgggtgttggattttgttaaatggcttttctgcatctattgatatgatcatgtgatttttcctctatagcctgctgatgtgatggatgacgttaattggtttttaaatgtataatcagtcttgcatacctaggataaattccatttggtcatagtatataattgtttttatacattattggatttgactcatcagtatttcattgaacatttttccatctatgttcatgacagataggaatctgtagttttctttccttgtaatgtctttgtctggtttttgtattagggtgttgctggcctcattaaattgagttataacatattctctctgcttctattctctgcaagataatgtagagaatttgtgtcatttcttccttaagtgttatgtagaactcaccagtgaacccatccaggcctggcgccttctgtttggaaaggttattaactattgattcaatttctttaatagatacaggtttgttttgattgtatatttctgcttgtgtgaggtttggcagattgtgtctttcaagaaattggctcattttatctaggttatcaaactggtgagcctagggttgttcacagtattattttattatgctttgaatgtccatggggtctgtaatgatgtccccactttcatttataatattaataggtcatgttctctttttttccttagctttgtccagaggcttatcaactttattgatctttttaataaactagcttttggtttcaatgatttttctctattgatttcctgtttttaatttctgctctaatttgtattatatattttattctgcttacttagggtttaatgtgcttttttttttcttttttcttttttgagactgggtctcagtttttgcccaggctggagtgcaatggtgcgatcatagctcactgtaatctcaaacttgtgcactcaagcaatcctcccacctcagcctcctgagtagttgggactacaggcatgcaccaccatacctggctaattttttttttttttttttttttttttttgtggaggcttgtcttgctatgctgcccacactggtcttgaactcctgacctcaagtgatcttcccagctcaacctcccaaagtgatgggattacaggtgtgagccaccatgcctacctagcctcttcttttctaatatttacattcaaagctataaatttcttctttatcactgattttgctgcagtacacaaagtttgataagttgtgttttcattttcttcaaaatatattttcaacttctcctgagatttttgacccatgtgttatttagaaatgtgttgtttaatctccatgagttttggcgttttcccattatctttctattcttgatctctagtttaattccatcgtggtctgagagcagacattgtatgaattctgttcttctaaatttggaaaagtttattttatggcccagaatgagatccatcttggtgaatgttccatatgagcttaagaagtatgtgtatctactgttgtttggtaaatgtcagttatatccagtcgatggtgttggtgttgagctcagctacgtcctacctgtgtggggtttttatttctttgttttgttttttgttgtttttcttttgcctgtgcctgttgacagttccatgttggaagcttctgtagtgtcctgtccagaatatatgggagtcaatatggaaacctatggaactcattgctatgttatttcccaagtctaggactctaggttggtcaccttttctttctactttctagaggctttttatgcttttttattatgttatgcccagatttttgtttgtttctgtagtttgctttttaaaacactttaaattgtggtaaaatgcatatgacataaaatttactatcttaatcatttgcaagtgtatagttcagtattgttaagtatattcacattgtcgtgcaatgtctccaggtttgtttagttgtaaggagagagacatgggagaagtaaggctacttcatattggtcagaaccagaagtgacctatagtatgttttcctggctcttcttttatgttttatttttttccatatggaatttagtatcaaattgtctagcaaaattaaaaaacttgttggtattttaaaaattgagatttcatcttatatgtataaattgttaaacagaactgacatctttatgatgttgagtcctcctattcaagagcaaggtgtgtctttccattcattcatgtctacttttgcatctttcaggagtgttttagaatgtcctttgtagaggttttgtacactgcatgtcacgtttatttctaaggatgattttttttgtagataaggttttatttcctattgtgtattcccctttcatggttgtttgggaatatggaataaactagtgactttcaaatctggatcttagccctatcacctgagcccagacccagatttgtgacagttcatcccacctacccatttagctagtcctctcataccttcaactcaatgtgtgcaaaggtcaacttgtgttcttccctgatcactccaaccctcacttggacactcaccagacactgaatttatttctgactcatccctctacacccccttaccagctaattggtcattcagtcctaataattctctagcattctggaagctatggtcatgaaatctatgtgttagatggaaccatcaagtcatctatcataacctcatttctgatgcctaaattcactattcaacatccccattaagaagtttcatggcatatgcttggacatatatttccagggacaggtaacttactaccttatgaggcagcccattttatttctggccattttgatcatcacatacttttccatgtatatgtcagtcaaatccatccccttctttctaaaattatcaccccgtgcttgctcagcacccactccacccacagtgacccttctgcaacagttctgccaggttccagcacacacagactgaagggtaaaatttttcacctaatatccatcgcattttgtgatgctggccccagcctacatctaccacttcatggcttaccacagagagaggagaagaaggagaaggaggagaaggagaagaagaagaagaagaagaagaagaagaagaagaagaagaagaagaagaagaagaagaagaagaagaagaagaagaagaagaagaagaggaagaggaagaggaagaggaagaggaagaggaagaagaagaggaagaagaagaagaagaagacagggaacgaaggagcaaaaatacactagctttccaaaggtccatacgaacattagttgtggatattccttctttcctgctgtatcagtgggggttgcagggaactgggagcactggtattttcagtaggaaggctgtcagtgatagtaattaccctggggtactctcagtgtggactcaataatggatgctactaagcacttgacacaattgggatatagagatatacacactgctatcagaccaataactcaatataacaccaatgactataaatacaaagcagactatagattactacctcctccgtgaactctcataggacatttctatgtcctatgacatagaaggtacagagtgcttgcagccttatggtgtaattatttatagaaggttagttcctgtagggcagttcttttttatccatgtctgcatctcccactctgtcttcttcccttatcagaatctcatgcactctttagggtcccactcagatgtcacttctgctggaaatctttctctggtctctttagccagaagtcagtctacaaacacttccctaagcaccctctctgtgctaggtactgtgctaagcactgagtatgacatgctggtaaacctttggaactttccctggagaaagtgggaagccaccatattttcaagcaaggaagatggtcagagcagtgttgtggaaaggtttctctaccacagtatggaggacaaatgggaaagccaagactggaggcaggggaagccccctgggaggtggctgtggcaggagtccagggaagagatgatgaggataaaccggggcagtggaaggacacagacctggcagacggttgagaggcagaattaacagatggctattactccaaagacagatttgaatgatgtgtcactcatacagagatgcgggctggaatctgtgatagaaatattatcatcggcaactgtggatggtattcaacacaaggacttgaattgggctgtgagttgaattgtgtcccccaaaacaatacattgaaatcttaacccttagaacccgtgaatgtgagtttactgggaaataggatctttgcagatgtaatcaagttaagaagaggccattagggtaaaccttaatccaatatgactagtgtagttataaaaagagggaaatttggagacagagaaggacacagagacatacagggaagagaaagccatatgaagacagagggagagataggagtgatgcatctttaaggaacaccaagaactcttggaagccaccagaagctaggagagggcaatggggcatggaggcctcagagcctccagaaggaatcagccctgctaacatctggatttcagacttctggcttccagaactgtgaaagaatgaattgctgttgttttaagccccacagtttatggtcatttgttatggcagccccagcaaatgcatacaaatggtgcgaaagaacaattgagcaggctttcagaggctattgaggggctgatgaggagacattcattttgtaaaactctggcattggtggtactcaatcatcttatatttaggacccagcctgccctgttttcttgcagggaggttcgctcattagaataaaaagttgtcacatgctgttgtcagagaaacaagacggtggcctaagagatctacaaattcactctgctctagggctgaagtagctccctcttggtcacagactggaagggttcagcactcttttgtgcagaatggaagttccctggggaggtcagaactcagaacttccagaggaatgtacttcttgctctatctcagcatcccttatctcatctcttattgtgacagctacagagacttcaactaatttgagttatagtgagaggattttgatctagaaagtggagaaaaggcaaagatgttaaaagtcattgtggtttaaggagattttgggctgagacaatggggttttctagatatacaatcatatcgtctgcaaacagggacaatttgacttcctcttttcctaattgaataccctttatttccttctcctgcctcattgccctggccagaacttccaacactatgttgaataggagtggtgagagaaggcatccctgtcttgtgccagttttcaaagggaatgcttccagtatttgcccattcagtacgatattggctgtgggtttgtcatagatagctcttattattttgaaatacgtcccatcaatacctaatttattgagagtttttagcatgaagcgttgttgaattttgtcaaaggccttttctgcatctattgagataatcatgtggtttttgtctttggttctgtttatatgctggattacgtttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattatcttttttggttgtgtctctgcctggctttggtatcaggatgatgctggcctcataaaacgagttagggaggattccctctttttctattgattggaatagtttcagaaggaatggaaccagttcctccttgtacctctggtagaattcagctgtgaatccatctggtcctggactctttttggttggtaagctattgattattgccacaatttcagctcctgttattggtctattcagagattcaacttcttcctggtttagtcttgggagggtgtatgtgtcgaggagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacacattcaatgccatccccatcaagctaccaatgactttcttcacagaattggaaaaaactactttaaagttcatatggaaccaaaaaagagcctgcatcgccaagtcaatcctaagccaaaagaacaaagctggagacatcacagtacctgacttcaaactatactacaaggctacagtaaccaaaacagcatggtactggtaccaaaacggagatatagatcaatggaacagaacagagccctcagaaataatgctgcatatctacaactatctgatctttgacaaatctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacattagacctaaaaccataaaaaccctagaagaaaacctaggcattaccattcaggacaaaggcatggacaaggacttcatgtctaaaacaccaaaagtaatggcaacaaaagccaaaattgacaaatgggatctaattaaactaaagagcttctgcacagcaaaagaaactaccatcagagtgaacaggcaacctacaaaatgggagaaaagtttcacaacctactcatctgacaaagggctaatatccagaatctacaatgaactcaaacaaatttacaagaagaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacacttttacactgttgctgggactgtaaactcgttcaaccattgtggaagtcagtgtggcgattcctcagggatctagaactagaaataccgtttgacccagctatcccattactgggtatatacccaaaggactataaatcatgctgctataaagacacatgcacacatatgtttattgcggcattattcaaaatagcaaagacttggaaccaacccaaatgtccaacagtgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacactgcatattctcactcataggtgggaattgaacaatgagatcacatggacacaggaaggggaatatcacactctggggactgttgtggggtggggtaggggggagggatagcattgggagatatacctcatgctagatgacgagttagtgggtgcagcacaccagcatggcacatgtatacatatgtaactaacctgcacaatgtgaacatgtaccctaaaacttaaagtataataaaaaaaaagaaagaaagaaagaaaaaagactatgtgaggcaagaaaagatttgtgaagagttcacatttaagttgtcttccttaatacattccactctttagatggatttagaataataggaaaaaaaccgtagtgttgcgcttagagacttcatgtgaaatcccatctcatgtgaagaaaatgtgctttcattacttataatgatgaaataaattatctccattcttggaaccacttctttgcaaatattttagatattatttcacaaatgaaagaaaacagagaaggctgctaccaccagctttggagggaacaatttaattttcaagatatgtatctattgtgagttggcaacaatggctctggtttccaaagacagtgggaaaattgctgcgcatttcggaaatggttcccagacacttcccttcgaaaacgtaagcaaccaaacgcatacaagcaggcattaaagacaaatgcaattttataggcagccattctgttgcatggcatgataaatagacaagacgagtgttttgcagccagccagcttttggcttctaagagagctggaagggaaaactgacatgaacactttcaacaggctaccctggttgaaattaggaagagtttatttccacagttaaaacaatatgattctatttctattgcctgtgttacgtcgagttcccctatttatcaaacacaaagttccattgttgtgatctatggtgagcaaaggagaacctgccgagtcccaagcagatcttagatgtaaatcatttgatccgttgctcaaaactattctatcccataagcccaagagctcatatcagggtgaacaagacatttgaaaaaaaccaaaactctcctcctggagtcaacaggaaaacatgcccctggacaaagcttataactgttgaggccacatgtgcaatgtgctagttaactaggaggaggaagttccaggaaaacgaccaacatctggtttcaggcttattccattcttctcaggggcccccagtcaactgtgctcacctgaagagacatcttgagccagccagagagtaagcagctctagtttctcctgagcttgactttgtccattgtatttatttcttctgaactgatttctccaaaatcgaaatctgtagcacctccacaactttgatagccttttttgctccaattccttcaaggataaatatttaactccattttgggtcaaatacaaacttatatttctggggtttaaggattcacacagctagagcttgaaaggcatgttactttaacatgtttcagacccacagagctgtccagtggaatgtcatccactaccattcctcgactgtaagcatagttgattatcaattcagaaacactccgaataagcagttgtgtgccaagactttgcagttcattcatccaattagccatttgtttattcatctaatcaagctgcctatgtcatactgattccagtactcatccttcctctttttgcttatgcaaagcaagtatgagagaattgtagaaaaggtatagaaaagagacaaacttttcattctgtattgtattctgtattcaaagttaaggtacagtaaagtcctgttaacgatgtaaccttaatgcatctgaaaggtattgttttaatgacgcttaccttttaaatgatgaagatgcctctggcggtttatggaattcattttatattcgtttaagaaattgctttttatgagagagtatttctgctgagtttctcttgggcattggaagttagagggggtagcccacacatctgcgaaggtcaatagggtctttgctttccattaaaatgttttccaattctcacagcatttgtcaatatacccagaagaatcagaataaaatgaatccatggcttggtatccagtatgcagcagacatgctgcctgctgagtcttgcacaggtgttctctaaaaagcgctgaagttggaactgggagccctgggttcaagtctcagcccagggagatcattcactggctgcatgcatgcatgcagttataagcctcctcatcaccctggtgtctcaagagcctggatacctctacttgtctatatgactgatatgaactgagctccatgcttaagggttgtcaaaaagcagcaccttcaccctgatgcctacaggtcatagtttgtagagcagcctgagatgatggtactggattgctggcaggcccagctcactgctgaattataccaagatgactgcaattaacagtccctagtttttttctcaagccacatttcctccacactatacttcagcagataacccaaatgtagaacttgccatttatccctgttaaatttcccatgaccatcttgagctcgtcaagatctttttggatctcaatttcatgctacagagaactcatcaccttctggcactatctcaggggcaaatgtggtaagagtgaattctcaatcctcctccagatcattgagaaaaagtgaaggaagccgggaggcagccctgggacttgcctccaggtccctctctgtaagggagggtgttaatccattatccatggcctttagattcagtcttttaattggttacgcaatcacataactgggctgtaaatgaagattttacaacagatgctgcctagtgctttgctgaggttcaaaaacacttgcctgcttttctgtgatccacctgcctggtgagctcttccaacaaaaaaggtaagctattctaacacagcaagctactcctaatgagctcttttttgcttttgtcttaaacacactttgcgctggcttccttttctaagcactcactcactattcttttaatagtatgttcctgaatttttccaggggggccacatcaagcaaaccatagctacataagatattcagttaaaggaattttccttcggaaatttggaagtacatgcccatctagtagtttatggctcttttttttttttttttttttttttttttgcagttttctgtggttccttaatgctccatgataaaagctcacagtcttgttagcaagtgctctctctctctctccctcagcaccctagcatgtcgtttgccctggccatcgatgaccaggcagttctctcacaatcacttcctccatcacagacttcaaggccaactgaggagttctatcctttgtacattaaagatcattctcctattctatgaagaagcctgaaacttttctccaaagactctggtttctccttctgtggggtatgacagtctctttgctattcagggactccaggggtgtggtgtctctttatctcttttctctttcaggggtacattcttgtagctcctcccaccccttccccctttccccctgactctggttgtgattcatatagataggttgcattcatcaggtgctgctgcctctcctgaagaagctgctacctctcccctttcctcttcttggtgtgatgagccttcaactgtttgtttctttttagtggaacagggtttcttctcttctcccctgcctcgtgcttctctttgcattcctgattcagtcttttgttctcaaacagtgttcctgggtagcgtggaaagggagaagctgcacctccgtagcaaactcatcaatgtccaggcttatgaattgccctgggcccacagatttccagtgatggctgagcttccatcattgcatttccaaaacagcgaccatatgacacttacacagaagggaaggattcaagaaatactgtggaagagaagtcaagtaagggcaactgagtggtctgtaagcaaaaagacatctcagatgatctctcaagatccatgaataagtaggagcggtgatctgatcacccacagtaacaagaaatacagataccagcaagtgaacaccccaaaaatgtccaagtcaggtttgcaatgcctcaggtagctaaaggagagttgtgataggagtaaaattaatagtacttaccttaacttaaaagcaggccagacacagtggtctaggcatgtaatcccagccctttaggaggctgaggcaggcagatcacttgagcccaagggttccaagaccagcctgggcaacatagggaaatcccacctctacaaaaaatacacaaaaaacatattagctgggcatggtggtgggcgcctctagtcccagctatgtgggaggctgaggtgggaggatgacctgagcccaggaggtcgagtttgcactgagctgtgagtgtgccactgcactccagcctaaataacagcagaatgagaccctgtttcattaaaaaaaacaaacaaacaaaaaaacaaacaaaaactcgtaaggctgtttatggatggggcggggaagagagggcgaggaaataaagggtagccgtgaaatcaagttagtgggggaagttgtaacaactctgtaagggcttaaggcaaactccatcagtccacatggagtctatggggttgagcttgagatgccagtgagaagtatggctggaccagtggaagaactggcaagaagcacctaaaaggtttcagctggtggagagccagctaagatgtagagtccatcttgagggatgcaagaagggaaagagcctgatgatggagctgaagaggtagatttgcagggagtgcaggtggtttctccgtctgtgtcagtgcttgaagcttaggggaagcctggaggggtgggggtacaatgcaaggaagactggggagagcttcacatgttgttcccagttagttaggtatgagatttcagggagaactgaaatctttccctctcacactcctaattgttttgatgtgtttggatgtcaagtcacgagtctcagagccttcacattgttgtttgtagccaaaagtacaaaatagaatcccagtattgtcaacatgctgacacatggacttctctcttcttaataagtgtttgattatgtttccttctatgaaaatctgtatccccacacaaacaccattttagttttagaacattttgtgggggcactttaaatcattaacttttaaaaatatggttctcgatcatatggttttaattattaaatttttattccctaaatttgactaaaaatcatgtgatttgcacagcaaacaggccagttaaatgaagtgaattccattcactggcagcctgcctgctgttcctgtcaataagtaagtttagtttctgcttctggggctcacaactcctgacaggtggcttgctgggaccggggaagcaaggaaatcagccagagaaagtgtccttggcagcaaagggtctcactgggcaggtttttagggaaatcttgagattggggcaatgtgggatgtggtggcagcatcctagacatgacagacagcctctgagcaacctctggtcctacttgtacatatcccctctgttcattaaagcggcctcagctagagcttttccaggtggttggaggccaagaggcattgtgcataccaaaggctgaactggacttgctgctggcaagactgctccaaagcacagggagcagtggcaaagaactcatcaagcaaggcaacaatctatcatcctctgctaaacctgatgtcccagcttggaatccagagttggggtggggggccatcagtgctggcaaacttgtgggggacaggggctggtgtaattggagccagctccctggagcctcacaaccatcctgtgaagcaaatggggctgtggttcctatcccagaggaaagcactttggctgaggaaggggaacggagcactggtcaggcctggcgatacctagccagtacatggctgcctctgacttccttccagagtgaaggtgcttacccttagtagggaggaccctggcctggctggtatgcctccttggacttagcggggtctgggaatgcaggagaggctttagactctaagccaggggtgtccaattttttacttccctgggccacagtggaagaagaattgtcctgggccgtacataaaatacactaaaactaacaataactgatgagctaaaaaaatcaaaaaaaacttcataatgttttaacaaagtttacaaatttgtgttgggccgcatccaaagccatcctgggctccacacagcccaccggccatgggttggacaagcttgttctaagccatcctgacaggcagtgtagtcaggtggttcaagctgaactctggcacccagtggtctgtgtttgaatcttagctctgccactgatgagctgtgtggccttgcaggaagatattcaacctctctgtgtttatctatttcctcatctgtaaaagagagatgataataatagcatctgccttgtaaggatgtggtgaggatcaaaggcacatctgtaatatgcttagaacagttgttgacatgtggtaagccctaccgatgttagctagtggcactgtcttcctccaagcctccattccagtcctagcagagggaaacctggccactgtgatgatagctgctggatggagtgaaacattgtcatggtgcagaaaacaatgctgattgtttttctgtctgtctctcccctccaaaataggagactcatgctgaatgtccagtccgtagaagccagcctggcatgtggcaggtgcacaatgataaattaatgagtgagtgcaagaattcccccttgtggcaaatggctctggaaagaatgccaaccttaaaaaattactaacttcaatgcaaatgcagttgggtagcagagaacaaagggacctataaaggtgccagacattctactggggtagacttaagagctggcctaggagtcaagaggctggcttttgagaggctttactgcttcgttgctgtggggccttgagccagctcctgacttcttctgagcttcagtgtcctctctgaatgacaaacaatgtaaggtgggaccaaggtctgcgacctccagggagttcctttcctatcagggcccagaacaaacaagagatcaaggaacacacccagttcctaggcctgggctcactactatcaggttcaaggtcctgctcaatttctgacagcaatatccacataccatttctatgtcaattataggagccagtttctccagcttactttataaaatgttaattacttcccccacctccccacaaatgtgaaacttggatttaaaaagacattttggaaaacaggtacattttgacaggaacaatctgaaattgccacaggcataaacacatacaagtggatactgtttggtttgcttctgagagccccgtttagtggagagccggccgagccagtgactatctgaatgaagtataccagccatgccattatcagaggaaaggatgagtgtggactagtcaagtggctggatgctaattttatcacctttgctttcagaaaccagatcccattctggcagcaatggttcacatccctggctccttactgtctttaggtaatcataatattaatgtcccagtgcacccttaagccctttgcatctctcttcaaagcctttttcagacatgcaatacttatctggggtgaggggttgaacttcccactgagagaccagaactgatcagatgggcgggcctccaatcgcgagcttggctttaggcttgtagtcctcacttttctcaagtccagccacggcagcctgccaggcctgcctgccacaggcagccttattcaattgaatggggtcttaacaaggggaaaagccagagacatgaactggcgcatggagcacaatgatgctgactacccagcaaaggtaagcttgagacactctgaagcaccacactgactgtaaccacattgcataaaacccaacacaatccaagagaaatggaatcctcgtggggatagcattgggccaatagctcaacagccacccaaagtctccatggaacaactcaaggccagagcaaatttagtgacatgccttccctgttggagcacctgtatagcagccccgcagaagaggttgtctagtcccttccaggactcatgggagcccacgactctatagccattcttctccgccagattccacatcttcatagctttaagttttttcctttgccactccctatcttatttcctttctccattgtgtgttagcatacttaacagatggagaacagcatatacaagtggcttacaggactgtcaaggtagcagaggcacatttgaaaacagctcatgcaaccaaatgccaatgattgagcaaaccaccactcaggactgactcccccgcgttggccctgaaaatctagctactcagtgcttccatttgcagacataaacatccacttaggagttctgaaaacaccatctaagccaacatttggactcaagtaacaccaacagggctgcataatcagtaaactcacttttctgctctgtgcctttgcaacactctctgggaaagatgcagtagactcttacagataaaagttgacatggaggcaagttactaatatatagaaatgttggattttaagtaaagtatatttcactctgcagataaagggaacagagattctttttttcttatctcaaaacagactctttttgtagaattgatgaaatggaagtaattgtcaagaactgagagcattaatcaagaaaaagatgaaaaaaaaatggagagcaaattaaattaacttggaccacaaagaatatttaatgtttttgcccctgaaatccatttgatgtttcattttccccagatatagtacaggtggcctcaccatcattttgataagagcggcgccccagtcaccctctcccagtgatgcactgtgaagtgtttaacaaggggctctctaggaggaaaaaaaaaaagctctgattaaagtgatagcactgactgccgtgttgtaaatactcttgttgtggccgatttctagctaccaacatgatgtcacccaccttgcaaaattcctgaaaacataacagttggcttttgggagcccgtttgagataactctagcccaccactgtcccctcctctgcctgtatgtttcctatgctctccactctgggatcatagagccagcaaagagagaaatcacataagaataagacagattgttataatgatcaacacacacatgctaccttttggtttataaactctttccccaacattaattattgtggctaaactaacctctatgtgctaacagagtgccagaatgttttacaagcatttcatttaatcaataccaagaagtaggtactattagtatccccatttcacagaggagaaaactgatgttcaaacagattcagcaactcattcaaagtcacacagcttgtaagtgggtgagctaggactagaacctaagctccttggttgtgctttggcagtaagaagaaaacacagtatcagaaaaagtggtaaggacaacagtttggcttagctgaggaatcaggaaaaaaaaagcctaagtaatcaaataggtttcagtgtttctttagcaggtgatcttatcctaggattcaaggatagaattcagggagtctgtaaacttgaatgaggaaaaaattatatttctgttttcactaacctctaattgaaattcagcctttcttcaattatgcatgttggcaacaaaccacagtagtatttacataatctgtgactttgtcgccaagagaaatcatagatattttaatttcacattacagtcatagcaggaatcttcaaatatcactaccttgaaattacagtaattatgagacctactgctaggtcttatttaatgagttaagaagcacataaattaatatatcgcaaatttgttttgttaatatgttaataactattttgatcccattgttttattttatgcttttaaaaacatttatttattattattatttttttcctgagatggggtcattaagtttcaccagaaaatcgagggcatccatgaatctatagcctctctgcttcctcttcaggtataatgaaactttttatggccagttagagaggttctcctgagagctttatgtttgagttccggaatggctgggcccatatggacagaggacacagccgtcgcctgtaatagtcgatgggcactccaccatttttccccactgagagagtttgggagccatgagtcagtccttcctgggaaatggctgagaagaagctttcagagatgaaaatgaagtggagagcgcaaatgaaggaggggcaggggagaagctgagtcagaccctcgaccactcttctaggggtactgtctcatcctcttggggctgaatcataccagggtggctctgctcttctgcctctgcctgaatttcccttggtagggctccaggccttcatttgaggccaaaatgaagggccccaaacccagccaatgtgtgccaaagagaaattctagaacatgtgtgttactatcttgatggaaaaatatcaatggtgggggtcttccaaggactatgggacccacgtctgcttgacttgaccatcagggatcatgagcccagggacacctgtatttcaacagactaacaagctgaagctgcagcttgggatgtggggttacttggttttggtcatttctacctcacaatgaaggctctttgaggtgatggggtctggagcagtgtgcctttcctttctgacttgtacttttagattgcatctgtctgggaaagatttcctttcttttttttttcccagctcttccattacctgctatgtgatgggggtgaggcttttaccctttctgtgccttagtgtcctcctttgtaaaatggaggcaataatagcatctacccatcagatgctgcgagggttaaaaagagacactataaggtcctaagcaccatgttcaatccagagggagaactcagtaaagatcaactgttgtcatagttcttagcatgatgcgaaagacacacagcacatatgcctggccaagagggtaggctgaataaacgttcaagacctttctcttcctcctcatcccaccctctcaccccatcactttaaatccaaggatggtcagagtctgctctcaggagcagaggagctgaaaatggccacgctggggagggttggtgaccttagagtggaagtctcctgactccaggtctggcattctttttgctcccccactttgacagtcctcaggcaccttctgacacacctccagagcctcagaatgcccagcacaaaggcctctgtccagcagggggcctctgtaaggtgaggaattcgctgatattaagcctcgtctactccccactttgcctctctccaactgacctctaaagagatgataagaaaagagaagaagggctgtaaaaaacagtaagtgctcaaagcgtggaaaacatataacatcacaaccaccctctctttctagcttattccaagttataggccaagtatatcctgtcccattgcgatgggttcccagatccaggcaataacatggctgcacaggtgggctccaggatctggaagtgagtgcccagaaaaactgcccattcattcttcagggagttccaattccttaggcaggcaatcaggggctctgaacacttggctgtcccctcccttccttcatccacctgcagctgtcagccttcccctcaaaggacctagtttgactccttttgatggccccctattcccaatgcagccctattccccacatccagttttcccttcaccacttgaccctcctcccaatcatgtgtaataatatagcctccagaatcaggtcacaggttatttctggatccagcccaatgtctaatttgctgcagaacatgtgtgaaaaatcatgaacctctgccaactccatagagagccatggatttttaaacaattacaccagtgctggaatgtaatattgtacaactactttgaaagaaacaatttgggaatttctttaaaagttaaacgtacaccatataacccaagcattctactgctgggtatttgccaaagactaatgaaagtgtatgtccatacaaacacctgtatagctacgttgatagcagctgtatttgtagtcaccccaaaccagaaaacaatccaaatgcccatcaacaggtaaatagataaataaattgtggtataattcatataatagaatactattcagtaatttgtagaaaggaatgaatgatgaatatgcatgcaacaacctgaatgggtctcagtcattatgctgaatgaaagaaaccaggcataaaggattccctattctatggttgcatttatacaaaactctagaaaatgcaaactacagatcagtggttgcctgcagatgatggagaggggccagagggagggactacaaagggccacaaggaaactttggggactgatgaatatattcatcatcttgactggggtgatggtgtacacatatgcaaaactgatcaaattgtactttagatattttcagtttactgtacatcaattacacctcaacaaagctgtagaataatcaccccagcagctcatcttgcagttgttggtgacatccctgagcctcagaaaatgggaatgtgtgcaatgttttcatatataatgtactaacatgctttgttcattgctctgatggccctgtgctttcttagctttctgggtgagaatctccaatatattttcacttgtactttctgaagggctctcaggaagccacagcctagagagaagctgtttatgaaggaaattgttctttaaaataacaatcatttgtgatacctttagtagagatccaatgaatacagtggaccttgcctccttacccttcagtttttacctttttccattacagggtgcagttgatccattcagaagtaagatgtcctgtgaaatgttttgccatgtgggctgcctgtggtggctctcagaagggctgatctgccttgcccttcctaccttttcctccctccctcctttccttccttcctttccttccttcctttcctcccttccttcctcccttcttctttcttccttcctttcttctttctttcttcctttctttctttctttctttctttctttctttctttcttttctttctttctctgtctttctttctttttctttcttctttctttttctttcttctttctttcctttctttcttctttctttctttccttctctttctctctctctctctctctttctttctttcttcctttcttcctttctttctctcagtctgtcaccccaggctggagtgcagtggcactatcacaactcactgcaacctcagactcctcggttcaagcgatcctcctgcctctgcctcccaaagtgctgagactacaggcatgagccacagtgactggccttgctcatctttccatgttggcaaatgggagttaatgttggctcacttgggctgtctgtgctgcccactgcttagctgaaagtgagaagactgccctgccctccttagggccacaaatttgaccttcaatttccataaactgagtacaaaaatatgatttcaagcctgcaatgacttttttgttgaggtaaaatctacataacataaaattggccattttaatgtttacaattcagtgccatttagtacattcacactgctgtgcaactatactttctagctagttccaaaacatttatgtcaccccaaaagaaaactctctagtcactaccagtcactcatcatcccccacaccccacctcagtccctggcaactactaacttgttttttgttcttatgatttactgatttgccacattccatgtaaatggaatcatacagtatgtgacttcttgtgtctgggttcttaaactcagtatcatgttttggggattcctccatgatgtagcatggatcagtactttatttcctttgggggctgaatcatatttcagtgtatggaccacaatgacttttttttttattactatactttaagttttagggtacatgtgcacaatgtgcaggttagttacatatgtatacatgtgccgtgctggtgtgctgcaccagtaactcgtcatctagcattaggtatatctcccaatgccatccctccttcctccccccaccccacaacagtccccagagtgtgatgttccccttcctgtgtccatgtgttctcattgttcaattcccacctatgagtgagaacatacggtgtttggttttttgttcttgcgatagtttactgagaatgatgatttccagtttcatccatgtccctacaaaggacatgaactcatcattgtttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttattgtcctttgggcatatacccagtaatgggatggctgggtcaaatggtatttccagttctagatccctgaggaatctccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgctttttggctgcataaatgtcttcttttgagaagtgtctgttcatgtccttcgcccactttttgatggggttgtttgtttttttcttgtaaatttgtttgagttcattgtagattctggatattagcactttgtcagatgagtagtatctgaatgatgctggcctcataaaatgagttagggaggattccctctttttctattgattggaatagtttcagaaggaatggtaccagttcctccttgtacctctggtagaattcggctgtgaatccatctggtcctggactctttttggttggtaggctattgattattgccacaatttcagctcctgttattggtctattcagagattcaacttcttcctggtttactcttgggagagtgtatgtgtccaggaatttatccatttcttctagattttctagtttatttgcatagaggtgtttgtagtattctctgatggtagtttgtatttctgtgggatcggtggtgatatcccttttatcattttttattgcgtctatttgattcttctctcttttcttctttattagtcttgctagcggtctatcaattttgttgatcctttcagaaaaccagctcctggattcattaattttttgaagggtttttgtgtctctatttccttcagttctgctctgattttagttatttcttgccttctgctagcttttgaatgtgtttgctcttgcttttctagttcttttaattgtgatgttagggtgtcaattttggatctttcctgctttctgttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagacagtttgttataatttctgttcttttacatttgctgaggagagctttacttccaactatgtggtcaattttggaataggtgtggtgtggtgctgaaaagaatgtatattctgttgatttggggtggagagttctgtagatgtctattaggtccgcttggtgcagagctgagttcaattcctgggtatccttgttgactttctgtcttgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttcttgaattgatccctttaccattatgtaaccgccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtctttttattggagcatttagtccatttacatttaaagttaatattgttatgtttgaatttgatcctgtcattatgatgttagctggttattttgcttgttagttgatgcagtttcttcctagtctcgatggtctttacattttggcatgattttgcagcggctggtaccagttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttccaacttggttccattctccccatcactttcaggtacatcaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagctcagagtaatttgatcgtctaaagccttcttctctcagctcgtcaaagtcattctccatccagctttgttccgttgctggtgaggaactgcgttcctttggaggaggagaggtgctctgctttttagagtttccagtttttctgttctgttttttccacatctttgttgttttatctacttttggtctttgatgatggtgatgtacagatgggtttttggtgtggatgtactttctgtttgttagttttccttctaacagagaggaccctcagctacaggtctgttggagtaccctgccatgtgaggtgtcagtgtgcccctgctgggggtgcctcccagttaggctgctcgggggtcaggggtcagggacccacttgaggaggcagtctgcccgttctcagatctccagctgtgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagattcccggctgctttgtttacctaatcaagcctgggcaatggcgggcgcccctcccccagcctcgctgctgccttgcagtttgatctgactgctgtgctagcaatcagcgagactccgtgggcgtaggaccctctgagccaggtgcgggatataatctcgtggtgcgccgtgttttaagcccgtgggaaaagcacagtattcaggtgggagtgacccgattttccaggtgccgtcagtcacccctttctttgactcagaaagggaactccctgaccccttgcgcttcccaggtgaggcaatgcctcgccctgcttcgctcgcgcacggtgcacgcacccactgacctgcacccactgtctggcactccctagtgagatgaacccggtacctcagatggaaatggagaaatcacccgtcttctgcgtcgctcacgctgggagctgtagaccggagctgttcctattcagccatcttgccatttttcttctttctttctttaatggctattctggttcttctcttaactcactgctacttttggccacttgttaaacactctttctctccctacccaccttcttaggtagttttctctgttggacttaccaccagtataattggagacagaggctagacatgtatgcaaacctatagggacatcccctcaaaatgccgagtgacaactgcccacatctctttcttagctgtgagtttgttttctgacactttctttttagaacgtgttgggctctaagtttgctgaataatcttgagcattgtcccaattaatgattcagggcttcaattccccagattgctttgcttgaaatctgggggaagagggatgtctcactagtctttggtttaatgtggaaagaagggaccccaagctccacccaaccccactgggaatctggaggcggtctaagatctttccagcagccactgaagggaagtctgttcgtaccctcctctggctggggaattgtaatcggtggatgaccatagaggaaagctagtcaccaacacagggatgatgccagctggcaagcctcgtagagtcctcctggccaagctctttagtacattgaaagaaagtgcaactcagagaggtgaagctactcgtctgtcagcttgccagggagaggttgaaacctcagtgatgtcggcacttctttaaggagaggcggtcactggacagcctgggaggctgccttgcagatttatgaggcttctatccaggatctttcagaatgtggacccaaggaaatattacatagagcgtctgtctttaagtccggtctgctgggctcatgccctggcttgggattcagggaatctgacttctagagtcatctctcaccatcttttgctagcatatgttcctgggtgagtctcttcctcagtttccctatctgtacaagaaggggattggacctttttggtgtgtgtgacagagactcgctgtgtctcccaagctggagtgcaataatgtgatctgtgctcactgcaacctccacctcccggggttcaagcaattctcctgcctcagcctcccaaatagctgggattagaggtgagcaccaccatgcccagttaattttgtgtgtgtgtatttttagtagaaataggatttcaccatgttggccaggctggtctcgaactcctgacctcaagtgatccacccacctcggcctcacaaagtgctgggattacagacgtgagccactgggcctagcctggactttataatctctagttttccctcctgatattaacattctaggattctaaccaagctttgctataaaaaaggaggagaacaaaaagggattgctgtccttcagctcagttgctgtctccattgcctgcattgaaaaaaaagggctgcccttcccttgtgcctttagtgcacacagcaccaccctgtccaaggggctttctggttcaaggtctcatttgatccttatgtgcaccatgggaggggaggagagtaaagaggatcagccccattttgtagatcaggaacctgagactcaaagaggtcaaatgacctatggatggaagtggaactcaggtctcctggtcctcaaccccatgttcgtttcattatttctcctagaccgccagctaaaaatgctttgcaagcctttgttgggccagctggtatgactggcacctgggcccaagtgtaacatgtttgcaaactgtttctacactctgaggcaactgcctgctgaaattactacaaaaccaaacaatttccaacattttcctcctgcctagtgcaacatttccagttgttcctgtagggtaagtctagggacacattgtttttaaaatcatttccaggggggaaaaacattatactctgtgtgtgtgtgtgtgtgtgtgtgtgtgtgtgtgtgtgtgcacctttggggctacggttgagcagtccataagggcagaaaaggaaaagaccagctgctgcccctgtttcctttgctagtcagctgtagaacaaccggagtagcaatttgagaggaagatagaggaatctatgcctaccagtactgatggggataaccccaagcttaaagagggggcccttttcctccagggcttctagtgccatagtgctttccagaagagagagaaagagagagagagagagagagagagagtataccaactaatgagtggtatgttgtgtccctgcaatggacactggaacagcaccctccaacacacaccaactttggtggtcgactatggaaaagcttaagggaattaagcctgtaggcatttagctcatgagaaaactagcacggagatcacttgaattttcagtttggactgccactttaaatccaaggtatctttgaattctcaaagtgtatgatgtttatagcataggaaaagatgatgcttatagcataggaaaagatgatgctaaacaagttcaacttttctttttcaagaaataaggacttgaaaaaacttggactcacattactttgaaggctagttctgcagtcaatcatgtgacaagatgagcattgctattgttggtgtaagatagtcttgctctgccttcgtttcttgatgtccccaagttccagaaaactctgttctctgccataatgggaggtcactgtgtgctgtttgattttagagtcaaataagttttcagcacatggtcagcttgagagacagtttgccctcaattggcttattggtttgtacaattcttggctccttcaagcagggtcctgccatctgagcccactctgtgggattatgggatacctgtacttgccaggaagtcctggcctcaagctgattcatcactgggtagcacatgacgcccagatgagaggggggcatttttaacctcaatggcatgaaaatttcctgaaatcaaaaggacagagattgggagttcctggggagcagcagcagcagcaatgtcaaaagtaggatcaaccagagcttagaatattcctacaccaactttgcaagttgttcattgatatgtgggttgctggaagaaagtttccagcactgctgggtcagcatataaacaaggaaaaaagggtgtgttgatggcccatttcaaagggaaccagtcttgctaatggtagagggtataaacatttttctccttcaaaacttaaaagattttgttgtatcttttctctaaaagaaacatctttctaaaatgtcaaattagagcaaagagtgataacaatttggactagaaaaagcagcctcattaagatataattcatataccattcaattaatccattgaaagtttacaattcaatgtgttttagtgttttcacagagatgtgcaaccatcaccacaattaattcaagaacattttcatcaccctcaaaagaaaccctgtacccattagtagtcagtccacattctcccttccttcccctagccctaggcaaccactaagctactttcagcctctatggacttgcctattctggatatttcgcataaattgaatcatacaatatgtagttttctgtatctggcttctttcacttagcacgatgtttaaacggttcatccatgttataacatggatcagtacttcattcttttttatggatgataatattatactgtacagctagaccacattttacttatccacttacctgatgatagacatttgggttgtttctactttgggctactactatgagtagtgtttctatgaacattcctgttcaagattttgtacgaatctctgttttcaatcctcttgcgcatatatctaggagtggaattgtaggatcatatagctactctatgttagtttttcataacaacttcactgttttacattcccaccaacaatgtatgagggccccaatttctccacatcactttgagctttttaaagtcaacttttcaaagctaaaagtgatgttttagaatattgatatatctattagcacaaggctataattatatgcctcacagctcttgtatagtgtcaaaacagtcctttaaaattcacagaaatattaagcaatgtgttatgcattgctaagctcacttgtgctccagcacaccaagtcatccaggctctaggttgggtgatgccttcagagagttctagtccagccctccacccaagcttgaatccaccctgcagatccattcgggagatcattcccgagaccctactattctctgaacactctggggctacagccacataaaagacatgtttccttctctcacaagaatttacagtctagaggaggaatcaaatgctagacaaatacttcctgccaaggacctggggaacacagagggagcacctgtacagaaggctcttcctatgtaccttgtggggttgttggagcgagccagtgaaatgctctgtgtaaattgtcaagcccagtgtctggatcatagcaggcacccaaagatagctgttatattcctgtatagaactttgcattttacctatgaggaaactgagtcctaaagtttaaacagctttcccagagccctgtaactcatgactgagaagccaacctttctgtttcaggtcctgcttgttgggctccaaagccttggctatactgacatctaggaggccagccttattaaccttgccctgcctgtctccagactgggctcttctgcttctcccaggtctggtttcctggatcaaggcatcctactttattcatgtcctagcataacactaagattgttagtggtatacagtaactagtaacagttagctagtccctagtacagcagggtgatctgctctaattgcagccagaagtggtcatgactgatgacagtggcttgaggagtctattgctggtgcagcattctctgcctatcagcagccccacatttcttcccaacatccaggccggaagtctggaaagtaggaatggccttagcctcctggtctgtattcagctggccatcaagccatgcaaaatttccatgaagatgctgccttccgattgcttcttctccattcccatatggcccctgtaccacagttttgtctacagaagtttataagcatttgccatgagcaaagtattttgttgggttttctggttgagagccacctgagataaatgatccctggtttcaggctcatagggatagcagaataataagaatccagagctaggtgtcctctaaatgccaagagccaaggactgctctgggctcaggatctcaggatgttccagctcttattcatcataatgagagatgatcagtccctcaccacagaagactaagcaggcccagaagctcaaagtaaccagcaagtatggtctgctgtggaaatgggccagtctccactggcatcttcaccttgcctgcagaaacatttttatccccaatgtattagtttgctagggctgtcataacaaaatattaaaactagatgacttaagcatcagaattgattgtctcacagttctggaggcagaagtccaagatcaaggtgtgtcagcagggccacacttcctctgacagctctagggaaagacctgttctaggcctctttccttggcttgaggcagcagagctccaatctttacatagtgttctctctgtgtgcatgtttctgtgtccaaatttcccctttttatacagacaccaatcatattggattaagggcccaccctactccagtaagacttcatcttacctcattatatctgcaatggccctatttccaaataagatcacattatgaagtactgggagttagaatgacaacatattaatttggaggacataattcaatccataacatcaacatgcatgtttgaagatagacttgaattactctgccatcaacattatcttcacccaagtagatgtgttccattcttctgcaagctcatttgaaagcaggagttcttttggcttttcttttctttgagggccaaatttcacccttgaaaaatgatggctctaatattcaatgtcttctgccttaaccccaaatctgcccaatagtctggagactccaggtaggacatgatggcctcacctcagaacttttcttgggaatgcctgaaccacacctcaccctatccaggcaacagaggaagaagctattaggatgagggacagactcaggcatgtccagcaacttacctggagtcactaagagtacagctcagaaacaggcacagagcttgacttcacaatgcagctcacctttggacgttccaggctgaagcccaaagttgtttctgccccttagttcatttttcctctgatttggtgagggttgtgggactcagacacctttgagcttctaaagatttcagccttttggggttgctcaatcaatatccacatactcctcttcctttcttgccaggtgcctttgatttggttcctcatttacttcctgtcatgcctagagtcaggtggcagcaaggtagatctagctccaactggcactttgagatgggcattagggatccagcagggtccatggtctgggagctaaaggtcccagataagcaagaggtcgtagataatgtaaggaggggtaaaccagtgataactctggggttactggggtgccttcagagcccagcacagagggtctttgctctctttcatatcttcttctgggtatgggtggctaagggctcccaggtgtgtacttagagcctgatgtgggaaaagagactgcccacaggcctctgtttctgtgactaaggtgtgagtacagtactcactccactccacttcctgggtccacaagtaacaaagccatagagcaacacatgtccctggaacaaccatttacttgaggacgcaggcattttttcctatattaaagcaaacatggatgtaatataaaatcgaaagttgaagacccacagatttatttgactaaactccaaattgcatgtggcagatggctttggagttcctctttatccctggattgttcatgagtgagaaacattgctgaggatttggtttctttctatcagaggcataggcttcctgggcaggtgctcatgaacattgccatgggaagatggtacacagccaggcatttggatgcaaaaggtggcttactcctgctttggacagaaaggtctgcttaagggctatttcataggcttggattcatgtagagggaaagaagaaacaaagctgtgtccacaggctaatgtgctgaggttgtgagatacctttcaacttggaccaaagtcaatgtacaggcagtgatccctctccagtgtcccttccattggccctgcttcctgggtccagccagtacctgatgaagattgtggtggtgagggagtaggcagctactgcacaccagagaattgagcctttgtgtaggaagttttggccactacctcaccagtcccctttacattggctctgggtgtcacaaagggggaaggcataaaatcaatagagtggagtctttgaaagccaaagcagcattttaaaccttttttctttagggctgaatgggcagcttgcttgaagttgataggttttgtgttgccagtcctataatgagatctgagcttccatcctccagagaagctggagatgctgggcctatctggatgagggagttagtgatggcctcagcagtatcagaggcctcttttttttcttcttcatttgggtgcattgtatatcatgccattttatctttactgggatgtctctagaccctcacatttgtatgaggtcactcctgaggcctcaggcttggcccctgaagcacccaagaaatatttgggtgggaattggtttttttttaaataagaaagtctgtacaaacatcaaaagttgattgaaaaaaatagtgctatgtaggaaaggtcccaaaagcagtaagaagaattgatgtccccctgcatctggaccctgaagtccttttggaatagcagttagtttcttacttgggaaaaattagattcacaggaagttgcaaacacagtaaagaggcccccctgtaccttacatctagttttccccagtggttacaactcatataacaatagtgcaatatcaaaacttggaaattgatattgctacaggtttccgtataaaaattttaaaaatttataagaaccattttctattctaaaatataaatttttatatataaatttttgatataaactttcatgtctctgggataaatgcccaggagtacagttgctgagtcatatggaagttgcatgttgagttgtgtaagacactgtcaaactgatttccaccagcagtaaatgagtgatccagtttctccacttcctcaccagcatttgatgttgtcattgttttttagcttagccactctgttaagtaggtagtggtatctcattgtggttttaaattgcatttccctaatagctaatgatgttgaacgtctttgcatgtgtttacttgccatctgtatatcctcttcagtgaaattcagtgaaatgcctcttcatatcttttgcccattttcttttctttctttcttttctttttttttttttttttttttttttgacagtctcactcctttgcccaggctggagtgcagtggtgtgatcttggctcactgcaacctccacctcatgggttcaagcgattctcctgcctcatgagtagctggaattacaggtgcacaccaccacacccggctaatttttgtatttttaatagaaatggggtttcgccatgttggccaggctggtcttgaactcctgacctcaggtgatccactcaccttggcccccaaaatggcttctgcccgttttctaattggatggtttgtcttcttactgttaagttttgatattctttatacactctagatacaagtcctttgttaaacataaggtttgcaaatattttctcccagtctacagcttgacttttcattctattcacagggtctttcacagggtctttcacagagcgaaagattttatttttgatgaagtctagtttatgaatttttccttttatgggttatgcttttggtgtcacgtctaagaaagaactctttgcctagctctaaatccagaagattttctcctatttttcctaaaacttttatagttttatattttaaatttagctcagtgatcactttgagtgaatttttgtgtaaggtataaggtatagattgaagttcatgttttgcctatagatattccagaaccatgtgttgaaaaggctattattcctccactgaattgcttttgcacttttgtcaaaaatcagtttggcgtatctacgtgagtctatttctaggttctctgtccagttccaattatctgtctgtccctctgccattactgcacagtcttgattaatgtagccctataataagtctttaaatcaggtacactggttattcttctttttcacaattgtttcagcccctctacttcctttccataaaattttggaaaaatcttttttatatctacaaaaaatcttacttgaattttgataagaattggttaaacctggatgtctatttgggagaagtcaatgtctttactatgttgagttttccaatctatgaacatggtatattactccatttctttaattctttgatttctttcatcagtgttgtgtaattttcagtttatacgtcctgtacatgttttccttgatttacacgtaagtgttttttgagcaatagtatatggtattgtgttttcattccgatgtctgtgtgttcattgctagtatacaggaatgcaattaatttttatatgttgatcttgtatcctgagaatttgctgaactcatgtatgagttctagcagtttctctgtagatactttgagatttttcagatagacaatcatgtcaactgcaatcgttttacttcttcttcttccttgttttttttttctactttttaaaaaaaaattaggtcaaggggtacatgtgcgggtttgatatataggtaaattgcatgtcacaggggtctggtgtacaggttattttgccacccacgtaataagcatagtacctgataggtagttttttgattctcaccctcttccctccgtccaccctcaagtaggcctcagtgtctgtcgttcccctctttatgtccatatgtactcgatgtttacctctgacttgtaagtgagaacatgcagtttgtggacttttgttcttttcacttaggataatgtccaccagctccatccacatttatgcaaagggccaaaggacatgatctccttttttttttttacagctgcatggtatttcacagtgtatatatacaacattttctttatccagtctacttttgatgggcatttaggttgattccatgtatatgctattgtgaatagtgctgtgatgaacacatgcgtgtgtgtgtctttatggtagaatgatttatattcccttgggtatatacatgataatgggatggctgggtcaagtgttaattctgctttgagttctttgagaaatcactaaactgtttttgttctgtagatgtctattagttcagttagttatatattcccactagtagtgtataactatcccctttctccacaacctctgttttttttttatgttttagtaatagccattaaatgtctggggtgagatggtatctcattgtgatattgatttgcatttctctaatgattagtgatgttgagcattttctcatatgcttgtttgccacatgtatgacttcttttaaaaagtatctattcgtgtgctctgccactttttaatggggttatttttgcttgttgatttaagttccttatagattctagatattagacctttgttggatgcatagtttgagaatattttgtcccatttcgtaggttatctgttcacactgttgatagtttcttttgctgtgcagaagttccttagtttaaataggtcttatttgtcaatttttgggtttttttgcaattgcttttggcatctttgtcataaaatctttgccagagcctatatgcagaatgatatttcctaagttatcttccaggatttttatagtttgaagtattacatttaagtctttaaacctcctggagttgatttttctatatggtgtaaggaaggggtcaagtttcaatcttctgcatatggctagccacttatcccagcaccatgtactgaatatggagttctttcttcattacttgttgtcaactttgttgaagatcagatggttgtaagtgtgcaacattatttccgggctctctattatgtttcactggtctatgtgcctgttattgtaccagcatcatgctgttttgggtactgtagcattgtagtacagtttgaagtttggtaacatgatgcctccagctttgctctttttccttaggattgccttgactatttcagtttcttttaggttccatatgaattttatttttttttctaattctctgaagaatgtcattgttagtttgataggaataatattgaatctgtagattgtttcaggcagtatggccattttaacaatattgattctttctatccatcagcatggaatgtttttccatttgtttgtgtcatttctgatttatttgagcagttttttttagctcttgttctagagatctttcacctccttggttagccatattcccaggaatttttctctttttgtagctattgtgaatgggattacatccttaattggctctcagcttggatgttgttggtgtataggaatgctactgatttttgaacattgattttatattccgaaactttgctgaagttgtttatcagatcaggtaacttttaggcaagaatatggcattttctaggaatagaataatatcgtctgcaaatggataatttggtttcctctttccctatttggatgccctttatgtatttctcttgcctgattgctcctgataggacttccaatactatgttgaatagaagtggtgagagagagcatctttgtcttgtcccagttttcaaggggaatacttccagcttctgcccatttagtatgatgttggctgtaggcttatcatagatggctcttattattttgaagtatgtcccttcaatgcctagtttgttgagattttttaacatgaaaggatattgaattttattgaaagcctttttatatctattgagatgatcatgtgggttttgtttttagttctgtttatgggatgaatcacatttattgatttgcatatgttgaaccgaccttgcatcacaaggataaagcctacttgatcatgatgaattagctttttgatgtgctgccggattcagtttgctagtattttgttgaagatttttgtatctatattcatcaagaatattggccgtaagttttcttttttgttgtgtctctgccaggttttggtatcaggatgatgttggcctcacagaatgagttatagaggattctttcctccgcagttttttgaaatgatttcagaaggagtggtaccaggaattacacatctggtggaatttgactgtgaatccatctggtcctgggcttttttctggttggtaggatttttattactgattgtatttcagaactcattattggtctgttcagggattcaatttcttcctggttcaatcttgggaggttgtatgttatcagcaatttatccatttcttctaggtttactagcttttgtgcatagaggtgttggtgtagtctcaggggattttttgtatttctgttgggtcagtgataacatgccttttgtcattttttattatatttatttggatcctctctctttttttctttattaatctatctagtggtctatctgtcttattaattctctgaaataaccaacttctggatttttcaatcttttgtatgtttttcacatcttttccctcaattcagctttgattttggctatttcttgtcttctgctagttttggggctcatttgctcttgtttctctagttactctacatctcctgtagtggcgatgttaggttgttaatttaagatctttctaactttttgatgtggacacttagtgctatgaaattccctcttaacactggtttagctgtgtcccagggattctggtatgttgtatctttgttctccttagtttcaaataatttgttgatttctcccttaatttcattatttactcagaagtcattcaggaggacgttgtttaatttccatgtaatcatatgattttgagaaatttttagcattgatttctttttttattgcactgtgatccaggaatatggttggcatgatttcagtttttttgaatgtgctgaggattgttttatgtctgattgtgtggtggattttagagtatgtgccatttgcagatgagaggaatgtatattatgttgttttggggtggagagttctgtggatatctgttaggtccatttggtcaagttctgagttcaggtcctaaatatctttgttagttttctgcctcgatgatctgtctaatactgcctgtggagagttgaagtctcccactattattgtgtggttatctaagtctctttggaggtccctaagaacttgctttatgaatctgatgctcctgtgttgggtgcatatgtatttaggatagttaggtcttcttgttgaattgaggcctttaccattatataatgctcttcttgtcttttcttatctttgttggtttaaagtctgttttgtctgaaataagaatagcaacccctggccaggcacggtggctcacatctgtaatcccagcactttgggaggccaaggcgggtggatcatgaggtcaggagttcaagaccagcctagccaagatggtgaaaccccatctctactaaaaatacaaaaaattagctgggcatggtggcaggcacctgtaatcccagctactcgggaggctgaggcaaagaattgcttgaacctgggaggtggaggttgcaatgagttgaggttgtgccacttcactccagcctgggcaacagagcgagactctgtctcaaaaaaaataaaagaatagcaacccctgcttttttgtgttttttgtttgcttggtagatttttctctatcactttactttgagcctatgggtgtcgttgcatgtgatatgggtctcatgaagacagcataccattgggtctcacttctttactcaacttggcactctgtgcctttcaattggggcatgtagcctatttacattcaaggctagtattgatatgtgtgcatttgatcctgtcatcatgttgtttactggttattatacaggattttttgtgtggttgctttatagtgtcactggtctatgtacttaagagtgcttttgtaatgggtggtaacaacctttcctttccatatttagcactcccttcaggatctcttgtaaggcaagtctgctgttaatgaattcccttcacatttgctagtctgaaaaggatcttatttctccttcacttatgaagcttagtttggctataaataaaattattggttgtaaattattttctttaagaatgccgaatataggcccccaatcttttctagcatgtagggtttctgccgaatggtctgctgttagcctgatggggtttcctttgtaggtgacctgccccttttctttatctgcctttaacatgatttttttttttttcatttcgatcttggagaatgtgatgactgtgcatcttggggatggtcttcttgtgtagtattttcaggggttctctgtatttcctgaatttgaatgctggcctgtctaggtaggttggggaaattcttgtggacaatatcctgaaatatgttttccaaattgtttgctttctctccttctctttcagggatgccaatgagtcatagatgtgatctttttgtataatcctatatttctcagaggtattggtcattcttctttattgcttcctctttatttttgtctgagttatttcaaagagccagtcttcaagctctgagattctttcctgagcttggtcagtcctgctgttaatacattcagttgtatcctgaaattcattaagtgagtttttcaactctctcagatcagtttggctcttgcttaagatggccatttcgtctctcatttcctgtattgttttattgtattcctcagaatccttggattgagttttgactttttcctgaatcttgatgatcatcatttctatccatattctgaattctatttctgtcatttcagccatttcagccatttcagcctggtaaagaaccattatggggaagtagtgtggtcacttggaggtaacaagacactctggctttttgagttgccagagttcttggcctggttctttctcatctttgtgggctgaaattctttcagtctttgaagttgcattcctttgcatgttttttttttcttttttgatgtccttgggggtttgattgtgatataaggtgagttcagttggctggttttgtttctgggagattttagtggggcaaagctcagctcaggacttctgggctgtgtgttctaactctgaggggctggtatcaagtcctcagttttgttctctggcccttcaaggttagaaacctgctgtgctgaaggggctgaggtgttcctggactgctggtcacaacactgcaatggatggtgccagccaaagcactccatcggacagtagcagcaggatccatgctcattcacatgtgccagcagcagtagcagaacggcagggtgcactttctttggttggggtgggtgccggtaggtgcaggggttgccagcctccatgcagatgttcacagtgtcagcgatggcaatgtggcatggaggcagctacttcttcttttttaaaatgtgtgcattttatttcattttcttgccttattggactagctagagcttccggtattatgttgaatatcagtgtcaagagcagatagccttgccttgttgccactcttagaaggaaagcagtcagtctttaaccatgaagtgtgatgttaactgtagatttactgtaaatattctttatcaagttaaggacattcccctctgtgcctggtttttatcatgaatgagtgttgaattttgttgaaggctttttctgcatcacataataggatactatgattttaattatttttttgagatgatgtagattcaaatgaagttgtaagaactaatacagatagatgctatgtactcttcagccatattcccctaatgataacatctggtgaaatgatcatacaatatcacaaatgggatattgacattgacacagtcaaaatacagaacatttcaatcaccatgggtagctctcattttgctcacatatagacatatctacttcccttccatacccactctctccttaatctctggaaaccactaatcagttctccatttctatagttttgttattttaagaatgttacataaatagaataatatagtatggaacctttggggatggtcttttttttttcacttacaatcattctctacagattcatccaggccgttgcttgtatcaactgtgtatttctttgtatcgctgagtagtcttccatagtatacatgtaccatcattgaagcattactgagttgtttccagttttttactattatgaatagtgctaccacaaacacttatgtgcaagttttgtgtcaacacaagtctttattcctctgggataaatgcccaggagtgcaattactgggtcatatagttgctggatatttagtttttaaggaaactgccaaactgttttccaatgtggcaataccattttacattcccaccagcaatgttatgagtgattcagtttctccacattcttaccagcatttggtgttgtcactatatttttacaaagatgaaattcacataacaatctgtgatatttagtacattcacaatgttatgcaaccatcacctctatctaatttctaaacatttgcatcaccataaaataaaacctcatactcattcggcagttagtcctcattcttcccctcccctcagttcgtggcaaccaccaatctgctttctgtctctatggatttacctattccagacattttatgaagatggaatcatacagtatgtaacctattatgattggcttctttcagttagcttaatgttttcaaggttcattcatgtttcagcatgttatcagtacttcgttccctttatggctgaataatattccactgtgtggatataccaaaattttgtttatctgtttattaattgatgtacattcggtatgtttccacttttggtgctgctaagaacatttgtgcaaaagtatttgtttgagtccttattttcaattcctttgggtatataccgaggagtggaattgtggggtcaaatggtaattctatgtttaactttttgagagaccgccaaactgtttttgatagcaggtgcaacattttaaattcccaccagcaatgtatgagggttccaatttcttcaccttctcaccaacacttgttattttcttcttttttaattatagccattctagtgggtgggaagtggtatgctgtggtttcggttgtcatttttctgatgactaataatgttgaacatcattacatatgcttgttggccatttatatatcttctttgggaataaatctatttaagtcctttgcctgttttttattgtgttgtcttttttattgttgcattttaggtgttatgtgtatattctagagactaggttttaattagccatatgatttgcaaatgttttctcccattccgtaggtcttttcattttcttgataacgtcctttgatgcccaaaagtttttatgaagtccaatttatctattttgttgttgttgttcatgttcttagggtcataaagttccattgcgaaattcaaggtcatgaagatttacttctatgttttcttttaagagttttacagttttaactcctatgtttaggttgttgatcagttttgagctgaattttgtatatgatataaggtaggagtccaacttcattcttttctctgtggatatccagttgtcacactaccatttgttgaagactaatctttgcctcattgagtggtgttggcaccctggttgaaaatcaattggccatagattaatgggtttaggggccaggcatggtggctcacgcctgtaatcccagcactttgggaggctgaggctagcgaatcacttgaggtcaggagttccagaccaacctggccaatgtggcaaaacaccgtctctaccaaaaatacaaaaattagccgggcatggtgtagtctcagctacctgggtgcctgtaatcccagctccccaggaagctgaggcaggagaatcgcttgacctgggaggtggaggttgcagtgagcctagatcgaaccactgctctccagcctgggagacagagcaagactctgtcttaaaaaaaaaaaatggatttatttctgaattctcaagcctatttcattggtctatatgtctatacttataccagtgctacattgttttgattactattgctttgtggtaagtcttaaaatcaggacgtgagtcttcttgtttttcaataatgttttgaggtgatcacatgatttttagtctttgcctgttaacatagcatattatggtaatatggtggtatgtatgattaacatggattgacttttgcatattgaactacccttgcacaccaagaataaactcaacttgatcatggtatataaaacttttttataaattgctgaaactttcttaaggatttttgtgtctatattcatgggaaatattggtctgcagggttttttttttttcttgcttgtacagtgtttgtctttgctgtcaaggtaatacaatgagttgggaggtgtttcctcttctcttttctgtaggatattatgtagaattggtgctaattcttctttaaacaactaatataattctttagtgaggtcatctgggcttaaagttttcatttcagatttttaaattatgaatttgatttctttcataattatatagccattcagattatttcatattgggtaaattttggcagtttgtgcttttataatgattggtccattttatctaagtttccaaatttatatgtgtattcatagtagtagtcccttattatccttttcatgtctgcagtctatagtaacatctcccttttcaatcagagtattggtaatttgcatcttccctttttcctttgtcagtcttgctagagattggtacattttattaattttatgaaagaactagatttgtattgggtttctctattgtttttctctctttaatattattattaatattaaattattatttatttaataattaataatatttaatatttaatataatatttattaaatttaaaatattatttattaaatataatattattatttattattaaaataatttaataaaaattattaaatataaaataatataatataatatttaatataaatattaatatttaataatttaataattaataataataaaaatattattaatattacgtttattgatacaaatatttgtacatcttcatgcggtacatatgatattttgttaaatgcatagactgtgaaagtatcaagttagggtacttggggtgtccattatcgctaatatttatcatttctatgtgttgggaacattgcaagtcctctctcctagctatttagaaatatacaatacattgttgttagctatggtcaccatatactctgctatcaaactgtcttcagtattattgatttttattattattttcttccttctgcttgctttgggtttattttattcttattcttgtaggttccttaagtggaagcttatattattaattttagattttccctcatttctaacacaaaaatttagttttatacattatcatctcagcacagctttacctgtgtcccacaaattttgatacattgtattttcactttaattcagttcaatgtaatttttatttcttttaagacctcgttaacccatgaatttgtttcaaagtatgctttttaatttctaagtgtttgtagattttcaagttgtctctctgttattgttttccaatttgattccatcatagagaaaacatcatttattatttgaattcttttaatattttgtggattgttttatcaccaaaaatatgtctatattggtatatatttcttgggtgtttgaagtaatgtaaattatattcttttcaggtggagcaatctatacattttatttaggccttattgaaacctgttgttgggctcttatacatcttgctgattttctgtgtagttgttctatcagttgttgagagagggtgttgaagtccccatctataaaggtgaatttttctatttctccgttcagttctaaaaacgtttgcttcctatatttgcaggtcttctgtttaaagcatacacatttaaaagtactatgtcttgttggtggattgacactttcagcattatgtaatgtccctatctgtcgctggtatttttttttttttttgctctgaagtctactttatctaatatcactagagccacctctgttactttttaaaattaatatttgcatggtgtatctttttccattattttactttcagcctttctaaatcattatatctgaggtgagcatcttgcaacagcatatcattggatcatgttatcttctttgccaatctctgtcttttaattggtatgtttagaccattttcatttattgtatttattgataaattagtgcttagttctgccaatttatttttgttttctgtttgttctctggttttttgtttttctattttcttttttctgacttcctgtgggttactcaaacaatgtttagaattccatttggttcatgtatagcatttttgaatctatctttttgtatagcatttttagggatcactctaggtattacattatatatatgcataacataataatctactggtgtcaacattttgccagtttcagtgaagtatagaaaccctacctctcctttcacccctttactttcctctatttataatgtaattgtgttaaatattccttccacatacatttacagacacatcagacaatgttataatcgatgatttaaccttcaaacataatttggaaaactcaagaggagaaggaaagtccattatatttacccataattttttctctttccattggtctttattcccttctaatgttcaatatcctttcttttatcatttcctttctgcttagagaattttctttagatattctctttgtagaggcatattgttgactaattttgttagtgtctcttgatctgagaatgtcttgatctccctttcatatctgaagcatattttcactgagtatagggttctgggttgacagttctctttattcagcatttgaaaaatattatgctacttccttctggaatccatggtttatgaacaaaaattcactctcattcaagttatttttcttctataggtatcatttctctttcactgtattcaaggcttttctcttcatgtttcagaagttttgttgttacaggtcttggagtggatttctttatatttatactgtttgaggttcactcagcttcttaaatttccagatgtatgtcttttgtcaaatttggggagttttcagcaattatgtctttgaatacttttttttttttttttttggtctcattctctttctcatctccttctggaattccagtgacatgaaagttagatcttttgtttgtaattctgtatgtccctgagtctatgtttacttttttttccaggatatcttctctctgttgttcagattgatcatttctttttattttattttattttattttattttattattattatactttaagttttagggtacatgtgcacaatgtgcaggttagttacatatgtatacatgtgccatgctggtgtgctgcacccattaactcgtcatttagcattaggtatatctcctaatgctatccctcctccctcccccctccccccaccccacaacagtccccagagtgtgatgtttctattgttctatcttaattctttcctctgttcttaccattatcctcttgatttgattcactgaatttatttccattattgtatttttcatttctaaaatttccatttggttcttttttatatgttctgtttctctgctgagaattctgattactttgctgagactttctatatttttttcatttgcttccaagcatggttgtaattgttggttgaagcactttaatgattacttctttaaaatccttgtcaggcagttctgacatctgtgtcatcttgctgttggcatctgccgataatattttccattccatttgatatcttactggttcttggtctgacaagtgctttgctactgaaacttgggcattttggatattgcattataagactggatcttatttaaattttctgttttagctgacttcctctgacactgctctggcagggaaggcgggcaccatcttattcttcattgacatcagggaggatggagctcctcattactgctggacaggggtgaggattccaactccctactaggcttttactgatactactctagtgcggatagggaagggcacctcattactgctatgtgggggtggagtctaggctcctcatttggcttttgttgatggaatataatgggactgcattttcttctatggtgtttggctggagtagagcagttattgtctaaaagttttctgtcttgctaggttacctctttcctggtcttttggctagaaagagcaggcttttgttggggcttctttgttagtgcccattggcattctgggtttctggcttcttcagctccaagtctggtatatatgaggcagaaacaaaatccagagaactcgccactgcatcattgctcaggtcccaaggtccctaaccagtatacttttttctttccaccttttaatgtcttattatgtttgttttatatataatgcccagaggttttagtgatactcagtgagagaatggggaaaagtacttctccatatttccagaggcagaggtttagacttgagattttagaggctgatgctgtactgccaaggaggtttatgggaagtagagctgtccttatatattaatgtcttagtggagctcttatttcatgtctacatcatgaaaaacaaaaagaaatgaaactttacctgggtttgcatatgtctgcttatctgtcactggaggagtagccatgatcataacctgctcagtcagtttcctttacatcagtgcaccagggtttcatgagccccctttcaatatctgttgctcccttcctgtgtctgtcaggctttgaactgttagctcacttggctgtatcctaacagtgccacagtgggtgtctgcttcttctatgaaccataaagcttactctagtagagctgagaaggccctaagccatcacctaattgagccaccatgtttgcatataaggaaattgcatctcagagaacagaggaagttttcctgaatctcactgcatatcacacaaaagcaaatccagacgtaggacccagatatcatacttgtaggcccagtgttattttagtcacatgaagctgctcctccatccacccctctaccttccagtgaactttgtcctttcctctggtcaaggactgtcattttatcccagccaactgtctcacaaaaatgcccctcattcttgggggtgggggtgctcaatgagggtggtgggtgggaggaagggaaaaggaatgtggttgactccacacaaacctgtcttcagagtgaaagtctgtgattcacggggtcagtggtctcatcttcatatctgaaagacagtgtactttttgtctccctaagccctgtgtctaggtcgtttgggaaacgccttggagagtcaagaataaatttgcaggtcaaacaatggatgactggaaaagtcggcttgtaatcaagagcatgcttccccatttcgccatggtgggaaatcgtcaggagcccagaaagctccaggaatcggtcagacaatgggccatggggggaggggggtatttaatgcttctaatcttaaacttgaacgtaagatgtgttattgaaattttctgtgcaaacttggtggcagggatccaactcaaaatataaggaattcaaatgtgatctagaagagatctaggagatgagctgatcccaccccttgtgggtttctagaagagctggaaatatagtctaaggttccatatagcctcccagtctagtagtgatcactgcattgcacccattcaataagaaaaatgaggaaggatgagagagggaagacgagtttactttttctcttaatagaagccagtcagaatggcaagcactagatatattgcatgagcttcctagtatgactgagaacaaaaagctagtgagtaggcacagagaggtcttcccattcaactttctggccctgttgtccttttagaaactcatctgacacacttctactttcctccctgggaactcagacatcatccaagtgttctgaacctcaggattagggattccagtggtagttctaggagcaggatgatgatagaagggactatgagagccattgactagtttaatttgacaataaaagcctgcaacaccaccaatctaccaagattagctctgttagcaggaattgcagcaaacacaatagctgttatctcagggtattagggccacagaggagtggcttgcttaatctctggaattaatagagcagagaggaaatggctcttatagagccgtgggtcggcttccttccttttcatagaactggaagccctgggctctgaggtaatgccatttcacataactagagggcctgtcttctccaattcccagggcaatccactttcagcaagtcagctttcaatttattttaaaattctgatatgtgcacagatgtggatggaggtgattgaaatcttgttttctctttgtttcctcattgtcaaccaccaacaatgtattgagaatgtgctatcaagttgagcatgtagacatttacaaaactgtttactgcactccccagctctcacagagattgcagtcaggtgggatggcagagatggagacattacttggccagcagcctgtccaaattgccaggccttaggcctcttctagaaagaaatctctaacctccatcctaattaccctttatatttcatgcttctcttttatgatcaacaattgagtcagtaaagaaaaacctgataatgctcccagagtccgtgatcagttttagcatgactttaaatttctcttttatttcccacttgtttccattcacttgggccaaattgtagaagaaagtgttgatggattgtggatgcaggggtcctcttccccttctccccaactccatcaacactcttaaaaagtgtggccagtaagtaactgctttggttttgatcagtgtacagttgaatgcacagattccagtgggggttgtccttagaataggtccttggagtggccatctgtgcatttactctggaaaagttgtcattgcttacgtcatttccaggcttggcttctctttgcagatggcctttagagccctttgtaagctttgccaaaaattcacattcattgctttagagtcacactttggatttgatcaagatcagccctctgcctcctctatgccacaccttgttctctgaaagagttctctgttggttctgagtggcttgactctttctaaaacttcaagctgtcctagaagaccaagaattcaccccagttgaggagaacaaagaattttaaaaatttgcctcagcctccaaaagcaactctctcagatggtcttcttcacagttgaaacagcattggatgacattgagagagcccactcctttggctggacgtgacaggtgctgctgtacggtatccctgtagcctcagaaaggtacccagtgctaatatgaaactctgctgcacatgctgaggatctcagcatctgggtgcttgtgaactgaggttgaccaaataaaagcagaatggcctgtgagtccaccaagaaacctgcagtccaaacaagttattgtaaggcctggaaggtgagtggccaaaggaggtcctttgcaagagctgggcttgcatttccagggtgtagccttagctggatctcagatgtttcccttgtttgctctccttctgacacttaataacacccagggatgacaccctgaaccctagtcccaggaaaccatgtgcatctggaagcacgtttcttgcaccactctccctcatcctgaaaacatcgctaacagagatttgcttcaggcattcagcttgactggttctcttgttctttcctagaaaacaaacaaacaaacaaaaaacatgtttcaaatcaatcttgaaataaaatgatatcagtcccagaggagagttctcttttagcagtccttgaatttacatggaaataattgtgagctcccttgaaggaaaacgtgcatctcacgtaacagttgttcttggcctaagactagggctcagaacacctgggttctagtcttgcagctactcctcactagctatggggctttgtctatcctttgccctccctgagaacaaagttcaaatgaacgaaaagtaagaataaccacctttaattcagcattgactaggtgctaggcactttactaagcatttttggggcattatctcctgtaatcctcatgataaccctgggaagaagaagctattattatctccaggaaaccgagactcagagagattaagcaatttgaccaaagtcacagatataagaagtggcaaactcagaggccaatgtcatcaccactatactctaatgcacattgaaaactacaaaatgctgaatacatatcaggcaggggccatcaccataagaaatctcagtaatgcaagtaccttttcagcatctgttcattcatttaatagtgtgactggttaatgactctggcgatctggggaacagaagagtttgaccttttgaacatttgggcatctacccaaggttaataaggcatccagtctctgcacttagtgtatggagttttaacaggaggcagaacattttgtccttccctttgaagttaagatcacgattctttccctagatccctagatcagtaggtcaaaggattgctagtgtgagaatttaaaaggcattagtactccaatttgagagtgctccagagcctgcatggagttgagactcagtgcgcatgtcacatgccatctctgtctcagtccataccccaccataagtggcaaagattcctccagctcggagcaggtacctattcccttcataaggcagctcctagacaaaatgagggtgcaaagggcatgaaatgttcagttggaggaggaaggggacacagtactttttgcacatcttctgtgttcagccatttaatattaagaagcgactcactctatagattacaatgggatgccgtgcccagtatttcttctgagcttcccaaccagtcagtggttgggcagggtggggggattattattattctccttctttatggataaagagaataaagtctgagaaattcagtgactttcagaaggatggccatccagaaggtggggtgctacatcaaggtccacatttggatggccccaagggcagtgtgctttccatctacaatacgatgaaaaacaacccctcagcccatatctttctcacctctaaatgcaagtagggctgaagacgggggagagaggagccctcagtgtaacagcgtatgtggacatttggatggctgcaaaaatactggcctcattctatccatcccttttctttagactggtgaccttagacatatccagtaggaggagctctagtcacctcctccctttgtgtttatgtgacggggttcaagatttgcgcccatcagctttggaggcatatacttcttgcagaaaaagtgctggactcaggaaggagtcctcagactcgattcagggttggaacaagctctttgtgagattttgagcaggtttctttcttcttgaggtcagagggcatgggtatgagctctaagggcctgtctatctctggcctcctgccacatttccagggtcccttctgtgtgcctggccctgtgctcgatcttgagccccaggaattcatagtctaggggcaaattattcccaggcttcctccactgggaacaaatctatcttactctgtagttctcggtgaaacctggaggcaagtgtttgagcgtctctcttgtgcaaggtactttgtgcacattcgctcatttgcttctgtgtcacagagattgatatttccacttccccagggtggagactgaggctcagaaaggatggagactttcccaatgtcacacaggcaggaagttgtagatctcaaactcaggtgccctgcctccaaagctcttcctactcctattcccagattaggagctcaggtatttccagggccttctgcaggccaggcactgttctcagtgcctttcattccagtggcagagacagcccataaacaggtaaagagtagaagcaaacttacttcattctggtagctctctgggatgttctgaccagcgttgtccactgccaagcctggcagaaagctaggctgctttaaaaccctatgcaggggcagccagctgggaacagagtgagttgtcgaaacagctcccttagaagcctcaagagaaaacccagatttacagctttgagtctttgccagcagcccctgcttcatgcaggctgaaggcgcggcacaggtgcaaatctggccccaagagaggggagctcatgtttatgggtccccttccaagacccaggtgatcctaggggctagttaatctagaggcaactgtccctgccacttattgataacttgcatgagcctctgggcctcagtatccacatcagtaaagtagggttaataactctgctctttgcctgcgtcagggtttctgggatggtgatgaacaaggtgtggttgtgcacgtgttccaaaccacacagggcatgatcctaaaccacacactgctgtgagcacttttttttaatgatcagaggttggcattggctcagaggttttttgccatcagaagagtgatggaaaatgtgtgtcctgacccctgaggatgccacagtctcatcagcagccccactacactgaggagacctgaatctgtaatgtagctgtgagcattctgggtcaagggctgcagtgtgtatgcgcctttctactttggggatcctccccatggagcacgcagctgttcgctccctttgctccctcctcctttttctgcagtaagggctccttcctgttccagacacccaactggggtgagaagccaggcagaggccttgccttcacacagacctttttttgcaagaactgagcactgctcagcttgcaggacaccactgggcttggcatctgggtcctgcctgggtagcctggcttggtaaaccagtgacctgcaaatcacagtctgtttgaagggagagtgctggtgaggggagctccatttttcagctggtttatgcaggcacctgggagcatgacactgcctatttctaaacttttaggagcccatgctggcctcatctgcattcctgcctagctctttcccacagtttccttgacataaggcccaaggtaacaggtttctggaggtggaactgccccaggaaggagagggatgctgttagactccaggacagagttgaggctcagaagtgtgcacatttctagggagtatgcagacccaggggccagccctgtgggtgtgggcctggggttcctcaaactctgggctggcctgtgtaggctgaggcctcttgcttttactgagaatccacagctcgaaagcccaatgtttctctttttacagatagatatttgggttataagctacccctggagtgctgcattccagacttctggggaggagggacatgagcttctaagatttgggcaacaaattttgatttccgcagttgatatagaataatttgttggaaaccttcctcctccccttttgcttttcctttccctccccttccttcctgcctttcccttctcctcctcatctccctcctaccttctcaccagatctccaacccctaaattccaaagttagaaaggcaagcatcagccacagggaagtggatttgaccactgggcactcaaacccaaggcgcaggcatgtctctgctgtcattgcctccctctctcttgctccgggccccctcagcacaggcctgtctttgtctgcctccctccagtgctgcaggcttccatcaccctctcaagtccccatccagaggcagggctggcataggtgctcgcttgctcactcactgccctgaccctgagagctcctgcttctatgcccctagagctgtggctgagtatatggcacatagtaaatgctcagtaagatgcagctgctgttcatcttggccagaagtcccttagaaatcatctaggccacccacattgctggacacaagagaaggccagtgtcatacagaggggaaggggtgcaattaaaaagtcattgtctctaggccttacacaggaaatgggaaaataacagagttatttgcagagtaccattttctccaatggttcattcacatccgcagatgccagctgagccctgtcacgaggctttggggttaccaagatgaataggaaactacctggccttcagagagttatgtggtggaggtgggaaatgcatagacctaacatggcagcctcaaggttggccatagcacctaggatggtgatggaaagggtagaaggtgagactgtattatcatagagacccttgagggcctgagggtggagggtgtgctttaatccactagcccatgcaaattgttcaacaatgtacaagactataagaacaaggcccaagggtatcctggaggggatgatgtttctctcctctcttttttttttcttttattattatactttaagttttagggtacatgtgcacattgtgcaggttagttacatatgtatacatgtgccacactggtgcgctgcacccactaacttgtcatctagcattaggtatatctcccaatgctatccctcccccctccccccaccccacaacagtccccagaatgtgatgttccccttcccgtgtccatgtgatctcattgttcaattcccacctatgagtgagaatatgcggtgtttggttttttgttcttgcgatagtttactgagaatgatgatttccaatttcatccatgtccctacaaaggactggaagcttcggagcacctgagaacgggcgcacaatgagaagtgaaacaacttttgggactgctggatcacttgcacggtttagaaatggtcaccttacttgcactacggaagaaatctttacgtttttctgctccagaaaggttgcccacccactcttctgtgaataatgggcctacatggccccctgcaatgtgaggagggcaacttggaaagaacttatttccctccaagaagatgctcagttcatgctctaggtcagaggttggcaaactacagcctgtgagctaaatccagcccacgggctgtttttgtaaataaacttttattagcacacagtcacgcccagtcattaacatattgtctactacacagagcttcaacagagaccacatggcctgcgaagcctgagacatttactacctgggccatcacagaagaagtttgccaacacttggtctgtatcactgggcatttggttcatttgtttaccctaacaaatggtacccatttcaggtagaattacaggccctcatgcggccacgtgtttagcttcccctcctgtgccaaagctggccccaactccacactcccaattccacccttctcaaaagttcttgcccctaaaagtgtttcttttccttccatttctcctcccatcagcatccagagagaactttttcaaagagatgaagccaatccttcctctgcttaagtcccccgatggcttccctacaaacaaaatacaatccaatccctttcccatagcctgcaagaccctctgcaaattcacgactacttccctggtgcattgtgtgacaggcacactggctgcctgcccgtcactggaacagtccaaaagccccaccccagggccttcccacttgctgccctcctgcctgggatgctctgcccccagtccttctcctggcctgctcagagccacctgccattctatcacatcactattttttcagtctttgaaagaatactgcacacactcttaacttgttcttgttgttcacttaccgtttgtcctactagaattccagctccttctctctggttccccacttctctccctggcctgtgctcattctaatggaagtgtcagttctgggccccctaggcagccctgcctgccctttactgtcatatgacttcatctctatagtggaggggagcccagtgccactctgtaggtgcttctttcctagaataagcttcaggccctaaagttgtctagccttagggctgcccatgtgatgctgtcagcaaaactaaacatgttcttgcctcttttcctccctcaagtcaagcccttagagtttagaacaatgaacttggcctatataaaatacctccaggaaatcagtcctcaaacaccaactcccaacatctgctttctgaatatatggcttcaaacagctaagtgtacagtatctaactgctgtccatccttttgttttttttagccacatgacatctaaggaacttagaaaatgccttgccctttcctgtagttaaatttgacataaaattactttattggcagcatattaacaaacaaaaatctcctgtgtttttcccggtaattcagtttcagttttccaggtaagaaaaagataattttgaatgactacaaggagacagactgttttgaggtttctgttaataacacattcagagtgtgccttcttcctctgtcccagtcagtggtgctgttgacagagtggtacaacaagaatgaaatatactgtgggaactcaccctgatcccaacaccctcatcaacaccatcaccaccatcactattgctaccagcaccaccacctccaccaccactaccctcaccttcactaccaccaccctttaaatcaacaccattaccaccatcaccatggctaccaccatcccaccatcccaattgccaccaccacatccaccaccattaccaccaccaccatcatcactaccacccttacctccgtcattaccacctccatcacctctaccattaccatgattactatcgccatcccctctaccaccaccaccctaccacttctctctctatctctctctcatgtacacgtacatggttatatgacacttcatgatgcaatcatagacactgtccacatacacacatacagtgaaataagtacatgtttttaaattgtcattattttcaatatagaacctactcttgttgctatgtgctttggggtggggaacatcaacgtgtgtttatggccaaaattgaattaggattcataagaaagggctatatctccaaatgcgcacttttaaaaaagttaagtttggatgagggatctttcatttcataaaaggatatactgaggatttcctttcagtgacaaatttttgctgcattttattttgatttggtttacaaaagttagcctttcacacagctgttcaggagcgcagccaatgactaaaggcagatctgccttgaatagcaaatgctgctgagtaaaccatgttacaggctattttaggaccaccaagaatgtgtttgcattttcaagagtagaaggagagatcatatttatttggtatctacactatgccacacactatgctaattacatttctaagctcatgtaatccttacaacaaatttacgaaggctttactttccccattttgtaggtaagaaaacaggctcacagagggaaaaatgacttgcccaaggtgaccaccaattagagacaaggtttaaacagaccatgagggctcagggcctacctcaagccctctaatcaccctacactgctaagttcttctattagaatttgttgtgcagaaggttttcttcttcttcttcttcttttttttttttttgtataatcagattatccatttgcctacaaagcctatagtgtgcaaggagtgtgtagtggtccagtcagtgtaccctggcacttgagagctcattaagggcccaggagaatcagcaaattctcagcagccaagctaccctaacgtatatcatagaaactacaataggagatttcttctctgaggtcactgctatctggcactatcctgtgatgtatggtttggaaaaccgtgggtcaaatacaaccgtccctacaggcaagtcaaaatatcgtggctgaaactaaaagtgattttttatcctcagtctaagtgtgaagagctgaagtgatctgcctttcctttagcaccccagaattacctctgggttcattcggggaaggctggcttactgctgaggtgtccacacatctaccactatacatgcctggggttcttgggggttctgttacctgggctgaactctggagtcctgagtgccaagctcttctctgccactatctatatgacttttagtaagccacctgcaactccttcacctcagtttacccatgtgtaaatcagggaccccaagcaaagccctgcctacctcctaggattcttgttagaatcaaaggctgatgaatgagaaagtacactgtccactgaaagggcctgggattttataaaggcctgtagttggtaacaccaagacttggatctgaaggtctagaaaagcacaacatcctgagactctgtgtggatccctttagcctactgtgagtgcttatgtcatgtcatgaacatgatataccccccatacagccctaaaaagtctttgctactagaagccgcatcctgtatgtgtataaaaatacagaaccaacctcccaggtacacacccgttgcacaggcagtctctgctgagtcattgtgcagacacgtctcttgctgcttctggccatgttgttcccagaaatggctctagagggatttcccgcatggctgaatagatggggagcatacgaggagctcaccttttcagggttccagatatacagctgggccggaggggctgggaggcagaagagtgggtgcagcagagtaggcttgtggaagacaaagccttcagaaaagtttcttgcccgaggcaaatgcagtccatgctagatggtacattcccagccaggaagagagtgcaatgtcctctccaactcaaatggcagtgaccagtgggtctccccaaactctgccataggacattagggctttaccaagcactgtccaggttgcagttttagatgggaaagggcacttggccttgagaaggtacagaagccaactccctggtcaccgcatttgttcatgctttttcccttggccctcagcctctggatgccatcatttggcctggagataggaaaagtgttgcctacatctgcctctggtactagcaaagggcatggtacagtgtggtgcagaccagcagcaggaacagaaaggtgcttctctaaggaagctgcagagatttctctgccagtctggagatcagctttgggtcccagctctccctgctactcttccatatacctccaatgatgcaagtttccaagaagaccaaggctgtgaaaaacagtgtggtggttcctcaagaagttagttcaacataaaattacaccatgacctagcaattccactccttggtatacacccaaaagaactgaaaacaagtgttcaacaaaaacttgtatgcaaatgttcacagcaacactattcacaatagccaaaagacagaaacaacccaaatgtccatcagatgaatggactgaccaagtgtggcacgtccacacaatggaatattatttggccacaaaaggaacggagtactgaggcatgccacaacatggatgagcccagaaaacatgatgccgggtgaaagaagccaggcacaaaacgccacatattgtatgatcccatttatatgaagtattcagaataagcaaattcatagagacagagggtagataaatgtgttgccaggagctgggggtttccatttgggatgatgaaaaagttctggaactagatagtggtgatagttgcacaacattgtgaatgtcctaaatgctaccgaattgtacacttttaaaaagttaatttcatgctatgtctattttacctcaatttaaaaagagaggacctagaccatgggaagagtctttggactgactccttatcccatgttccctccaagtttcagctgctctgatgccaagactctcatggcatcagagctcaccagcctggctctaaatctactaagtggggtcgatatctctgcaggctaaaagttggcactcaggagctaaaatgtgcttattcaataagcatgtgacccctctgctaagctacagaggcatgttctggacataaattgttttaaatgtggccattgatagcagcatctctctttggtgtgtcctagcaggaagaggtcatagacaggatgcccctctagaaggttctgaactaatcaggtgtctctggaatcttctcccacctacatagcagttgaatttctcaagcagggaaatattctgcatggtctgaagcttgttgccattttatttagcctactgttggggcacagagagaggtaaggtcacctctggcctaagcttcaaagttcatccctcaagccttctaagacccggtacctaattttgttttaattttatattctgtttcataaagagggccccagattataaaagcttcagtcccaaaactagagacccaaacacctcactataggaaagaaggctctgattaaccagcagctgttttttttctttctctttattctttccagctctattgaggtataagtgacaaattaaaaatgtatatttaaggtatacagtgtgatgatttgatatacatatatattgtgaaatgattaccacaatcaagttagtcaatgcatccatccataacttcatctagttatatttgtttctgaactcatagaactgttttaaaatcatagaaacagtagaaggctggttaccaagagttgcagggggtggagtgtgaaatggggagatgtcagtcaatgggtacaaattctcagttataggatgcataaatttgggcaatctaatgtacagcactgtggctatatttaataatgctgtattgcatatttgaaatttactgtgagagcagatcttaaatgttcttatagcaactatttttctatttgccccatttaaactactctagttggtgtcctggcaatgaggaggactgtcaccttgtttcctgaccttgccactgcaatccaaatggggtctgtttttatcatgccaggaaaggagggggaggctgcgtgggttcagcaggggtgtctcctgactgtgccttccaggcagtctgtcactgtgtgttcccccaggaggccctggaccaaaggccttttcatctcagtaccccaatttctaacctcataaggttacactgaagatgaaaggaattgatgtagttaacagggctgaagcagaggcttggtaactagttgctcttgttatttcctctgcttgtagaggaagttggtatagtctctctctctctctctctttctctagctctggctctccttcaaccattgccctatcatctgaatggcaccttggcccatttcctccaagccccacttctgcttgaggacagggctctggaggctgacaaacccaagttcactccctggttccaccactttttagccagccaaatgcccttaagcaagtgacactccctgtcttcaactgggcaccctcatctgtacaatgagggtgggggtgatcacattagtactgactttcttgagtcactgggaacattaaggtaaagcctaaaatgcatttggaactgtacctgtcacttagtaagtattccaaagtcactcttgaagtctacttataaatcaggtctcccttactaaaacaaaaggaaatggagaaagagaagaaaggagaaagatgggaataagaaaggaagagagggagggatggagggagggagggagggaggaaggaaggaagacaggcaggcaagactctttaatctttgctccttgttctctctagccactcacactcaagttccagcccccaccaatttggagatgattccctgataaacctctaaactgcaggcatctctgttcttcatttctaagatgaggatgataatgggaatatctttctcatagagttgtgaagataactatgtgaatgcatacaaagtgcttagtaccacaatagtcatttgtgtcttgtgattccaggagttttgggcagaggattgtgtgccctggtcagggtgcccacaggcaaggttgccactgatctgatggggccaatccaacaggcatggagcccagaaacaggcttccatgtccaatcccatgtcctgctcttgggaaggctttcccactccgaaccacaaaaccactgggtttatctgggccactctgatgaaagtcacattcccctgaacaaatatcctcaccacaagggcacctgggtcatcctgctctgtgaagcactgaaagagtgaggcagaaaatggagtgactacttccagaaatggaatcacctcaagtcatatcaattctcttgggaagagccccttgggtttgtatagttctttaaagtctgagggacagtggagaggcaggtcccaaggagtgctaatgcagaagtaacatactatggcagcctggcatgggtcagatcataaggggggccagccagggcgtggaggcaggactggcagggcctggcagtaagaagagatattgctactgcattcacacggtcccaatcagaagtcttagagattatctgtagagagagctgtggctaccccatatagtacgtgacttccacacagcccaaactaccctaattaataatgacccagaagctgattgtttctagctctcagattagcagtggctccttattgccccagcttagctctaccagatgtcctgtccctgaaatgtaccagtagcccctctaaaaacccacttggctcatcagggcccagtccagggccctccccacctatcccattcctaatcccatcagcattagcgagaagcctgccactgcctcagggacctcgcatctggagactcagccaagatggtggcacctgtgagaggatccacaggtagccaagtccaggtagccagaggccaggtggcaatggggaagagcataagtgacccctgtccaatatgccctcatcagccaaatctggggcctcagtttgggctttgtggtgtgaaggtaccacccgccaaatgggcctggagccaccagcatagctgccctccttctccctgggtggccctggaggtgccacacttgcagcattcctgggtggtccttctgtgcatgggctgtaggtggaggtgtggaaagctgaagacagggtcaggcacagcccagggcagcctagagatatttacatcatgatgatgggattagacagcccactcgcttgtgcggtatctggacgccactggcttgcagagcatttgggggttactgcttgagagtgttttccactggtcttgtcactccctaggtgaaggaaagtctggcttttgtaggaactgcctgggtctctggtggagtatttccttcctcacctctggattattctgcctctttagagcattctagaaaaggggtgttttctcggttcattggccacacggcatggctgcatcctggtgacattttcccagcatcagatggttggagactgcaatgaggaggctccacacaattcatagccttcagccaggccccttgctaaagtgctgcatgggacggagaagaccaaaccaattggagagggactcgatggaagccacacatggagttttgtgttgttgtccagtacttactgtggttgccctgctcccattgacctggacgatccatgttaccatctgcccctcctcccaaaaaagggaagcttcctgttcttggagttggcactaggagccaccctcagtggcttaaacagatttcttttaactatgaggtagtgcactagatgaaccagactacaggagatgccagctctgtagccatcatttcacaatgcagccatacctaagagcctaggacaggccatacccggtgggcggagcagggatgggccacagctggaggactgaaagtgggatctcagcctcagttacagaggcactccctgatggccaggcagcaatcctgtggagggctttgtcatcagaaaataggagcccatcatctctggaaggttggaagcaccatggtgagatgggatgtgtgtccaagagttaaactggtctggagttctcttttaacaccatcatcacaccccttcatttaatctatgctggactttgaccataaaaaaccaaacttgaaattgggatccctgcaccgactggtgaggcacataggagagggttggtttgggttccatatgactgacataaagcagagcaaatattggcttgggacccaaaccaaccctctcttaggcttgttaaggccccattcaggatagttccctggaggtggttggagagctggcagcctttctggtgactggtgacctggtagtactctctaatagaatatgtcaataagcacagctcatttgaccagaattgtaggccgcctttctcgatccaacaggtgcagacctgctactctcaggattcactttgctagtctcctgcactccacaccggatcccaaagtctatgttcaagtaatcccctatttaaatgtcatagatatatttggggaggctcataatttgattcaagtaacagtctgatctgtgcctctcactgagctggtgcaggtaatactttctttaagagtgtgtgcaagtggctctcctcagcctactctcacccccagggaaagaagccctcgtggatggaggaagaagatttatcttttctctacaagagcagcccaggaagaaagcatcaggtaagcataagcttaccaaagctgggacccattcactttacagtggggaaactgaggccccgagtgtgaaagggacctacaagaggtcacaccacaaggtcctttaagagaggcagagcccagggagaagtgagaaggttgggcttaaatgatctctgcccggtggccctggtggcctccaacctcggttctgcctccacttctccctttgcctgtgtgattttgggcttgttagccaaatttaggtgaaatgtagattaagcttgtgaacctgggtccagcagaagtggagtcatctggattgggacagggccctctcctttgacctttagcttctattacagctacctcaggcagcacctacttcctctatagatcaacctcaccaaatccatccagatgtttctcttctccccacagtaatcatctctatcccactaatgacagaacctgggaatgtgtttggggaagactgggtgaggatttcttcctgtgaaaacagagtacaggcctcaccaggcttaacatgagtgggtgtgagcagcccgtcttgaagggcccagcagttctgacggtctaggagttagaggctagctctcaacaaatgcttgttcaatggcagaataccttgattcttctcaggagatggtacaatacaaattctgagctcattaaattcatatacatctataggttgaggatcatccttagagctgtcagttcttccaactggcatgtctacactacagaaaaggagaaagtagttctagaacactgcccacccaggtttgctcatctctgcctttgtcagtgcacttccagccactccaggctgctgctcagatagttctggcagaagcctgttgaagccccagccctcaggtcagggtggctaaaggctgatgactgtggcagccttcagagtggcaggtggtggcaagcagcaggaggcaggagtttccaggctcagccaccaagacagcatccctggctgtcaggtcagtgctgtcaggtcagtgctgtcaggactaagctgcttgcctccccctacttccactccatccccctatcctagtgaatgcatccttatttgtaagaaagcaacagaggcccaacacgaagacacagggccttgagaatgatatcagtagtgattactgctccccaagtgctctcctcagtgagtacagtggaacctttcactaatgctgtgaagcacacatggtgggccaagtacccattttacagaagaagaaattgagcttcagggaggggagtggcttgcccacagccacacaacaaacggaggagctaggacttaactgcaggtcttctcatgtgcattccagggccccttcctccaccgcagcctgcatctgcctgcatcgagtgctggttcagggcgaatcagggacaccaataaatccccgatttgtaggtcgaggttcttgctccaaaccacccattatcagagatttgctcctgagacataactgactcctcttgaagccaatcagcattagcattcagggttccctgccattcccaaccaccctggtattctccagagcctcatgtcttgcaattctggaaatgctcaaaatcctgtttgttctacagaaagatcagtttcagtttgctgggacattctgctgaaaataaacatgtaaataacacatccccaaatacaggcattgatactatacacacggatattcctttgatcccatgtgcaaatgcaaacatattcattctgtctttctctcctcctcgctctcactctctctctttctctccatcccccatctctttgtctcttcaaacccattcctgatacattattttcttatctattctacagctacctccatcatgccccacgacatcttcattactttcttctgagatagtctactgggggccatccttgtcctcagagggcttgaagtctaatttagttggccaacatcaggtgcctcaaaattcatagggggaaaatgtaacaatattgaataaagttgttcatggagtatggatgtaagggaagagactaggagaactggctagcaaattggcctgaactgaactggtgaggcactagtgaagaaagagcagactaaataaaccacaggcgattttcacctttttgacaattttgcccagggcctacaagcccagtgccctctggagggaaaataagtctccctgagtttatctttcctggttacctttgacctcctatcttcttgcccaataggaacagtgcataccctttgctgacctttttattggtgtccatgttaaacctccaactacagtgtccaaaatcaagcatttataacagcctgccagacttctttggataagttatattctttattctccttatgctcatttcatggactgtattcgtataatctctaccttctctaagaaatttttccccttttttgtcattctggactagaactatagaaagggaagagttgccatatgtcattgttcagacagaaccagaaataatgttgacttcagagctgaacttgtctctatcagaagagaaacctttgttttctcattatctagggggtggggaggccatcacatgccttgaaatgcattttaatgaatgtttataaggtcatggggatcacattggtggctttgtctgccggattctgaaatgggactctgcaggcatttatgtatggagagaaaggaattcgtttctaaaagatgccagggcactgtcactcactccctcccccttcctcaccaccaaaggccgggcctgtgagggctctggctgggagttgggacgtctggggtccagtgtccttttaactaattgtctgaaagcaaatcgagatatgctctgaggaaatcctgccagtggctactgattgtcacagggagaggcctgaaagaagtaggagctgtgggacagctaggactaataccctgctgtcatcaagaccgcagagactggagaaaagcacatgggtgaagcagggagattcatttagaaagggctgggagcttggttggggaccttccgcccctaccaggattctgggaggggaggtcattccggagcagtgagctatctcctgcccttgatctaaaatggtggctgtgggatttagtcagaaacacccagtctgggcaggcaaaacctcagcggcatcagccacaggcacaggtgacccagtgaaggcacgagtgtggcactgggcacaggggaaagcccagccaacttctcgcagttgagatgagtaacagatcatgggactgtgaaagagaagacacgaaagcaagtctttatctaggggcaaaattaactggataatagatttccacgcctcactgatgtctggtgaaggcagacgctattacagcaaggctgagccttccgtgtaaacacagccgcctctcctcggccttgtttagggttggctggtgttcttgctgttcagccagggcacttcaggctcactgttgaaagctcattccatgaaatccaaaacatggagctgcatggcctctgacaaagtgagttctcactgaagtccattgaaaaatgaaagctcagaagaggcttgcagcttgccactctgccaaaacagcagcctctatcggcaccccaaaccccacccctgagaaaagccaggtgagcctgccccctttattaggcatccttatgaaagtcagtgagtgtacatgccagcagctgtccagccacagacttggcatagcaaaagtggcatccgctccagcagtggcggcctgctgggatctactttgttattgagtagtcagttggtttctagaattggaattgatcagggaccatttgcttgggatgcagttgatgagtgctggaaaaggtgtgtgtatacgggctctcatgtaggagaggtgcagcctccttccctttgccagtggccccagctggtacctttagtgtctggtggtcatgccctgcctcctccatccctgcaccttactcccagcaggttagtggcagaccaacaattaagtgaaagctctgggagcccatagaagctgccagcaaatttcagaggctcacgtggcagggatgccagaccattgcccctcacagccccttccctcccttcctttccccaacccccaccccctccttggcctgcctggttctgcattgcttcgccattgttaaaactgtcttgcagttcgagacatcatggacagcactttgggcctgactgttgccagctcagactccctgcaggggatccttatgtcaaatccacatgcaatcatccctgattgatctatttcatacatttctatttttaacctattggattctttgggagaatgtagaagagacacaatttcagtttgggacccagtggcttgtttgtaggttactccataatggattgagtaaatggctgagctccctgtgtgttgggtaatttatgttcctttgtccattgattcgttcaactgccatttactgagcacctgctgtgggccaaacagttagtgagctgctccatggaccagctcagggacactatgggtgctgtgcccagtcagactcctgggaaagtgggcactgatgactgcatgggcctcagccctcttattgtgcctgctctacacctctccaacccattcctgcctgacccatggtattcaggcctcagatgagtttggtgacagagctgtcccttgaagtgcccttgttcagattgtgggcatctcaaaagaaaagtcaaagaagtgtgcaagtcctctcactcaagttggcaagccccttctgtgggggcgatgcagtgtcctaccaacaacatggcgaaggcagtgggtctggaggcagctgagtggtggtggaggggccctgcatctgacctgggccttgttgccctctggctgagcaactctgggtaaggcctgcccctctctgggtctcagagacctctctgtctttaagaagggtattggactcccagaacccttccatacctgccctttataatgccgggtaccagttagtgaggagctattaggtgtcatacaatgtgccccgtttcacttaatagtcagagcaccttcatgagaaaagaactataattacactcattttacacataaagaaactggggctctgagaggttcagtggcaaggccaaggtcagagccctatgccacgctgcctccacccttgctctgggccagtggttttctgttgagaatcagccatggagctgttggaaaaactcccgatgcctgggccacaccctggatgaagctgtcagtttgtggtgggagggcccaggaatgtggatgtttctaagtgattctgatgtgcaccaaggcctgagacatacagccctggggatctgctttgatgttcacttggccatgacagtcatgcccctcatcgtgctggcaagtggccccatgcatgccttgagctcctagtgggctacaagctcatcaaaccagaagagccaaacttaaggtgacatcagaggatgagcactgtatgtcctagtgaaacttccaaagctggaaaggggttatttggggggtaccgggtgggggaagctttaaaagaattctacctgttcacctatcggcattcaggtgatttccagatccctctcttcctttccttattttgatcattcctgcacatactcctttgcccccacttcctttcccatttacctgctaacatacaggtcatggtcattaacacaacagcgatggatgactgtatgaagccatgaagagtaggaagtctcacattgctagtgactttgctttgttcccaaaggctgtgcttctataaatgatgggcagctcccccaaggttcagatcccagattggggccttttctcattgtttaatatctccccaacctgaggatgcatcttcagaggaaaatttcttatttagataactttatacttttttaaatttttggattatgagtcgttctcgttaaagacaaacaagcagaaatgaagagaatagaaagggaattgccagtcatcccaaataaatgaccactccaaattgttgggtataggttcttccaaattatttttgtgtacacatagcaatgtgtgagagtgtgtgtgtgtgtgtgtgtgtgtgtgtgtgtgtaaaaataaatggaacaatgaatacgatgcctacaatgactgttctgaaacttgtgctttcccaaaaacagtattttaaacagctccccaagaaaacacatccagatctacttctttcctgtaagggctctgttgtattcaattttaccactgcagcctgatgcatttaaccaagactagaaggcagcctaaaagttcaattctatactatggtattccttcgttaaaatctatgtgtctgtagacaggaaagaattaaaactatttagctacttctagttttctctccaatgcctgcctttggcagcatggttcatttagtgacttctgcatagttttgttgaactctccttgaagtgggcagattaccctttgaataacgttctatcccgttttagtatacagacaacataatgccttatttgaaatgtaattagacagtttagatgaaacataataatgaataaataagcactatggttccaaagacaggctgtattttatagttttcacaactataagtctttaaactgagaggtctgttttatcatgcacatttcctgttcattagctttaatgtgccaaacctttataaaaattcctctctctctctctctctctttctctctgtctctctctctctctctctgtgtgtgtgtgtgtgtgtgtgtgtgtgtgtgtcacctctcttcccttctcctctcctctcttctcctcttctcttctcttccattcacagggaactgttaagaggagacaagaagaagaccacttccagtttccagacatggctgatgggggctaccctaataaaattaagaggccttgccttgaagatgtcacccttgcaatgggcccaggtgctcatcctagtactgcttgtgcagaactgcaggtccctccattgacaataaatcctagccctgcggctatgggagtggctggccagtcattactgctggagaataaccctatgaatggcaacatcatgggctcaccatttgtagtaccacagactacagaagtgggactgaaagggcccactgttccttactatgagaaaatcaacagcgtgccggctgtagaccaggagcttcaagagctgctagaggagctcaccaaaattcaagacccttctccaaatgagctagatcttgagaagatactggggacgaagccagaagagccactggttttagatcatccccaggcaaccctaagcacaactcccaagccttcggttcagatgtcacacttggagagcctggcttccagcaaggagtttgcttctagttgcagccaagttactggcatgtcacttcagatcccatcctcctccacagggatcagctattcgattccttccaccagtaagcagatagtgtcaccgagttcttcaatggcacagtccaagagccaggtccaggccatgctccctgtcgctctgccccccttaccagtgcctcagtggcatcacgcccaccagctgaaggcgttggcagccagcaagcaggggtctgctacaaagcagcaagggcccacccccagttggtctggtctgcctcctccaggactctctccaccttaccgcccagtgccatcaccacacccaccaccgctgccactgccaccaccaccacccccattcagcccccagagcctcatggtgtcctgcatgtcgtccaataccttgtcgggtagcactctccgaggctctcccaatgccttactgtcaagcatgacgtccagcagcaatgctgccctggggcccgccatgccctatgctcctgagaagctccccagccctgctctcactcaacagccgcagttcggccctcagagctccattcttgccaacctcatgtcctctaccatcaaaacccctcaaggacacctgatgtctgctctgcctgccagcaaccctgggccgtccccaccctatcgcccagagaagctctctagcccaggcttgccacagcagtccttcaccccacagtgttccctgatccgaagcctcactcccaccagtaatcttctaagccagcaacagcagcagcagcagcagcagcagcaagcaaatgtgatctttaagcccataagcagcaactcatccaaaaccctgagcatgatcatgcagcaggggatggcaagctccagcccaggagccacggagccatttacttttggcaacaccaagcccttgtcccattttgtttctgagccgggtccccagaagatgccctccatgcctaccacctctaggcagccttccctgctccactacctgcagcagccgacaccaacgcaggcctcctcagccactgcctcctccacggccactgccaccttgcagctgcagcagcagcagcagcaacagcagcagcagcctgaccattcttcattccttctgcagcagatgatgcagcaaccccagcgttttcagcgatcagtggcctcagattccatgcctgctctgcccagacaggtaagacaatctcatatctggctgtgttcttttgttttggaagtaacaactgtgtttcatgttgccaatatctggctctggagggtaaatccaggctatagttctctctgagactggaaaagactctgaaaaagtctactgaagtcagctaatcctgtgtggttaaaagcacagtgttaataaggccaaggttatggtttcagtgcctgttcaagtcacctaacttccctagaaggagagctgcacccacaaggtgctcccggtggaaggagccaggtgggacaagtccgaatacagaaatgccttccctgcactgggccatgtagaaagactagtgaatccttcttaagatgtaaggaaattgcactgaagcatttaatcttatccctgctggcagaaggacaaacactgagccttctagaaatgccacagcaaacttttgctgagcaacctcagcatgccatttgtcactgtgctggatactcagtcaggtcgtgaaaggaaaaagacaggtatttgcaaggtagtcactctcatcatctccattttacaaatgaagaaactgaggctcagagagttgaaagacttgcccagagtcacatagttcgcaagggacagagcaggaacttgaagccaggtggtctcactccagagcctgtgctcttcttgaaattacttttgacttctcaccctccctcatctcctccaggcttttcaatcatgaaatgcagctgattccacctgggtcgtgtctatcacagttcccagttttcatttctgtgacccctgcctgtattagttatctgtggctgcataacaaattaccccaagcaccagcttcgaaccatatgcatacgttaccaccacatcctgatttctgggtgttaggaatcctggcatggtttaactgagtcttctggctgagtatctcctaaggctgcagtcatctcaaggctcagtggggaaggatctgcttccaagcccactcatgtggttgctggcaggaagcagttccttgcaggttgttggactgaggcctcggtttctcatgagctattggccagaggcctccctcagttccttgccacacggtctcttcacagagcatctcacaacatggcagctggcttcatctgagtgagcatgagagagtgtgccagtgaagcagggtaatggggagagagggaggagggatagtgccagcaagtcagaagtcacagtctctatgacctggtctagaaagtaacatcccaccacttttgctgtattctattcatgagatgtaagccagaggagattgcatgagggtgtaaataccaggaggcagggttcagtggggccaggtcacacgtgtgcctacacagaatactcagtcaccatctaccatccctccttcccattcctctcatccttgcccaagttcaggtcctcttgattctttatctgaactcatacagttgacccttaactggtctctcccaataaaccatccattgctctgagtcgtcttgctaaaacagtgacctgatcatgttttacacttgctcagaagtccccagaggcccataagctggccccaccagcctcctgggcccttcagcatccatcaggccctgccttgcactttgtttctattacccagaagtgcctgcagcacttggcccacgccatctggtctcagcctttactctggccgttccctgggcctggtcatcccttcccacattttctctcctgtccaacacctgcagctacttagggctcaggcaccatccctccaggaagcttttccatgactgtcctcagtacttccatttcccactgtgcctccctcttctggagagtggtcaaggaggagattataaagtgcttggccagagacctggcccaagggaagcacctgtcaagggctgacctcttatttaagagctctgtatgagcacacctgtggcaacccctagagtacagaggttgtgtcttttccatccaggtttcctggagcataaccatgcagagtgcttgacaccagggagttggtcatttgatagaccatgcggcaagcagagctcccatgggggtggccgggggagcggtgtggagataggcaaagcacataggacacggcaggccacctggggctcgggccctggtctgcagttcaggagcactttggtttgattttattatagggctgttgccatctgtttgcatggacttctgcagctagctcggtgaagccccagcatcaacacgggaactctttcactagcaggcaagatcctcagcctggagacgtgtcaccgtctaacattgtgagcctttctgttttgttttgtcttcaattgggtacatttttgtagactgattgtgttgtcccagagctggatcagctggctcagagggagaattcttaattattggggtcatgcaaatcatacccaaccaattacctaggtggggttggagaaagtgttcaggagaaagaccgaacagtcaagctccctggggctaggagcacaataaagggggcaagcgacttttgccagcagaggcaagaagctgggtccccaaattggaaatgctattgccaccaagagctgcctttccagcccatgctggcctgtgcccaggggccaggcatgggacctggtgcttcacctgcctcttctcattttaatcctcagaggcaggggctgttaccattctcctgagagttggggggaaaggcacagagaagtgaccgaagttgcccacagtcacacagcaagctggggccagagcagacaatctggctacagagcccacactcatactcccatgcatggggcactgcctctgtagccttctgtttccactgtcacctcttaactgtttcctcctctacaaatcaaggtgatgataggttgtctgaggactaagtgtgttaatacatctaaagcactttgaacagggcctggcataaagtatgtgctgagaagggatttgctgtcacgatgactctacctcctgaccctgtgctcccagatctgtttcatgggactaagatgtggttctaaaaaccagtagctgtggcaggacagacacaagccacgttatctccagaccctgtacccaccatgagattgataggagttgtgcagcctctgagccttgtgggctccttttgctctaggccctgcctctcctggacaactcccagcctgatgggaaaggggaaaggggaaaggtccatccctgctttgcagactggggatctcactttgctctttcttgagctctccggcactctcactccgctcctctccctagcactctgttctctacctggtattcttccaggcctccaagctgggggaatctcaacagtccttctgtttcttcttatggcctctccctattaactctaagacctaagaactcagccctggtcattcttccaggggagagaaaaaaataaagaaaaaagcgagtgtttgaggcaagagctgggaccgctgtagaaggacagatggtggccccaatggtggggaagaacatatttcccacttccagcaggctaagcaaacctcccaagttttactgatggccaagctgagcctcaggaacactaattacctatgatatggcatttactagcctgttacatttgccatggacgataatggttaccatggaaaaactggacattcatttgaatctggatctttgaggttttgtgcggggggtgggggcttttttggtttttgtctgttcatttctttagaggcagggtctcactatattgcccagtctggtctcaaactcctgggctcaagtgatcctcccacctcagcctcccaaagcactgagattacaggcaggaaccaccgcacctggtctagatcttagttttctaaaggagttatttttaaatgtgagatgagacacaaacgcttgagtaagctgaaaagccaaatccagccttctatagaggagctcatttttatgtacagaccagcatctctctatttggaggattttgctttaccagttgagtgaactattcaatttcaatgcaccattcatgtccacgtaaggtaaaaggcaaatgccacatgactttggggcagctgtttagcatgggaggttgagcaagcaagggcactggaggcagacagaactgaggctcaagtctggctacagatgctgactgattcaggtcccatgagcaatgttactcaactcctgagcctcagctgaaaatggggaaaggaatagtccccttcacttagggcattgggaaggcaaaggagatgctaacctgaaactgcttagaacggtgcccagcacacactacaggctcaatcagggctagggcagccttgtgggcttggacctgaaacctccggggcctgatgaatttccaaattcagaacatttgggactttgggaaggtaatgtggtgcaaataccaaatgtcacacaaccctccagtgtaatctgaagcagtgtttcattacttttgcagagaaatatgaatatttaaggaagtccagagtcaacttttgcccccacataaaatttggcaccaaatttacaaaagtaaaattggctttcagagcttcttggactttaaattacagataagggatgtggacctggaattattaagggagggatctttaactctttatggagttgcaacacccagcactggtttgtcagattttaatgaccccaaattgcgtcactgaattccccaccctccctccaggctgggtgatatatcttgatgtttaatcagactgaggcaaaatgaattttgtttgcatcatctgatgtcccttctccctgcagattactggagataccttggcgtgttgcaaaaatcgcggttaggacttacttcagtttcactattcacgactgcagaacagatcttacatttactcaaagacacaaacaagtatgtcaaggagatgggagttggactgtggaagactggggatagcaagaggcagcctctggccagagtgccctcagtgcacgtgcatttgagccccactcagatctgcagagctgggagtgtggtttcatggggaggagggatgtggatggaggccagttggaataagaacaaaaaaaagcctggaatctgatccttgaggcaggctgtgcagcacagagggaagagggcagctgtggagaaatagaccaaggaggcacatgatgttgttttgacaaatatggagagggtagagaagggggaatcaaacctgccttggagaaggctggattaagcccctactgggtctgatatgctttctatcttaaggataagctttagcttaggcagtcgtgagcaccaggcaattgcagaggcagtgaactcaccatcttccctttctgaggggttgggcctatgaagaggatctgggcagctccctctaaagtggggccttggggaagcccccactatccccacctgtggcctctctcacccctggtagactgaaccctccgaagtgcagtacttccagcacccagggcctgaagatagatggcacagggcgggggacacaggggccttaccctggggccttggcaggggacaggccctggggctgggctcaaggccaagttcaagaaagctcagactttggatcacttgggtccaaatcccagttctgccaccttttccgcggggcaagcgatttaccctttccaggcttcagtctgtaaaatggagatactagcatacctatctcatggggctgctgtgaggattaaatgagatgaggtaacagcgcttggcatagggcctggtacacaattatgctccattgatattagctgtcactctcaggaaagttcccgaaacccagaacaccagtaacccaatggaatgaatttagtcagcctcggctcagcatccaggctcctctctgacccccaggggtggacggtgacttggagagaaagggcaggggagagctcagtccctctggggctgcgtgctcacggacagtcccttaggggcgttaaggaagacttttgccaggtggctgaggagcagccaaggcagcagacacaggttggtgactccagaaggaagtagagccgccaagccaggctgtggtttcctgagtgcccctgaccgtgggtaggggagaatgttgtcttctcttccctctaagcacggccagctgaacttctaggagttacatggatgctgaataacaaatgcaaccacaggacgactttaggtgggcagagaggagggggaaggaggagctaagttccacctgcagccagcgtggatctgaccccacctgcttgcagcaggctcaggggtgcctgacatttcaagactcaggcagagggcttactgatacacagtgacaatgaacagggcggaaagcgtgtacatgagtggccaggaaggaaagctggtcctgcatagtcatggcgcacagagcacgcatcctgaggggatacctcccctctctcctctcgtttccgtccttcttctgcaccactgactctcactcctaaagcctccaaaaagaatctttgcagaaacccaagattccttttggtttgaacttccaaggctacactagcccactcagtagggcataacctttaattactgctgtctcaattagctctgcaaattaaattctttatatttgaaccatgacttttcatggaaaacaaaaaggaacaaaccaggttagtgaggccaagagaatttccgattctgatcaaagttacatctgctccatttacaactagagtcaggagaggcagagacagcaagtgagccttttcctagtctcagaatcactcattaacattttcaaaaagtaattattatattactaaaatacatgacctccaccccaaaatcagatccaccacatattttcaaggaagggcctgtcaccttggacttacaggtcttctccctcacttccctgcattcctctctcgttttgagagtaaggcttgcgggaaagcaatactgctgtctgtgttctcagagaaattttgtcttttactaattctggcgagaaacatcacagattttatttcaaaggttagtcctgctaaaatgcaagaacagaagcctctagaggaatctctgtgttgtccaccagtcaaatgataagtaaggaagtgcctccacttgccagataaaggactggggaccaggcagatttcaaagagcccgtgggtcagagccggggcctgccctgtgcgtattctctggcagacaaggaaatgttttcctgaatgagcattcttattttgtatttaaacatgatggtacatacaagcttagttttaccattctttctaaattaagctgcaaagagctgtttggtttcgggaaactttttcttagctgttttgtgtggaactatgattagacaccgtgtaacatgcattttgaaaattcggggaccgatatctcagtgttgaaaatgttttgttttaacctctctaaattgccaggaaatgaaaccacatgggctgttgaatttgggaaacacaggcttagaacttggtattaatcttaccaagaatcaaaaaaaagtttttttttcagtttctttttcggtttctaagggccattagtgatcctccacctcaaagctatttttctttttcaaaaagcggaaatttaaaatgagctgcttgttaaatgctaaccttttaaatgtcaacattttttttctattaaaagttaaagaataagtgagacgacactttcaaatgaaggtgactttacattgttcccctggaggaatgagccatcagttagtgtggtcaaccccaaaacttacggggatgcacaaggccgcctacttaagatgcatcagtagtagagatcaatagatacaatttttttcattgcttagtaactggcttatgaaagctgaagaggcaatcattttcagaaacctcctgtcaagttttttgttttgttttttgtttgttttgtcttaacatatctgaagagaaacaaggaaacttgctgaagttaggacacccaaaatgagcccttttaaaaatgaagtgcacaaattattttatgctaagttaattaagacaacctacttatttgtcactgtaaagcaaggcaaggaatctcattgcgcttttcaaagaacgtaagaggacagaaataaatcattgtgtcgtgctgctttaagctgtatctccttatgaatacctacaaacccaaaacacagaacaccatatggagcgagcagtccagttttgcgcacacaacaaacatgaaagagaagtgctgtcgctctactactactatgtccccaggtgaaaagttcgcaaaatgtaaacaagatctagagcagatgaaactcacggtagacttgctccattcagctgtggccctaacacctacagccagcactgtcactgagtgcaggagtggatggtgcagagcgccaaggggaatcaaagacgtgacccttccatccaggtgagcaaaggatgagtactcagagggctggactgcaccctcccctccccatcctgtgcttctgactctcagatccacttctgactctcacttccagcttctgactctcagatccactcatggtcccatatcgtggatttatggaatcctttcccgagtctatttgtacttttagcctgttctgtcccttagggattgacaaatcccacgatctgggcctgccctgtaaaacaactatgtggggcctgacctggctgctttttagcttgaaggggatagcagagggtagaatgctggttacatttaaagcaccctgctcccagatccaaaagaaagtttctgctttttcctaaggagttgaaacagtctgggattttatctgattttgttattttgcctacaatgacaaacactgcttttgtttgttttatcatgttgtgttttttgctagatgagtgtttatcatgccggctgcacccatccaaagcagtaaggttgttgaaagccaaaagcagcagaaaggcccaaagagatcaccccacctcacccacaggctcacctctgcaggtgtcttcagacagctgactcttaactctcatctcagcaacagtttctaagatagagagtggaataaagagtcagcattcatccatttcttcgatgttttctcctttaccccatgtgaaccaagtttcttggtaacgtgcagctaggactcacacagacgaaaagcacagagccacaggccttggctgggttattggagctaggtgcacaggaaaaataaaagtgggtgctccaggacattatatatatagtcctgggctaaaggtggccttcagggcctgaaagatggatagctgtacctcactaggaattatcccacctcttgctttgcttgtgggagctttcagtttgcagctaaaggctcaggttccggccagctttttcccctgtagcatgctaccaaatccggccatcttccagttttgagcagaggaggtgagcgtagctgtggagacacatattcttctgcaggcccatgtcggggtggcccatgaagagaatttgccaaagccagctggctcagcagaccaacagatgaaggtggactactcatttgcaattgtgattaatgatcatttatttccatgtgacaaagctttgaacgatgtgggaggccctcacccatccctgagtgggaataactgggaatgattccatgaccctttccctttatctggcaatcctttcaaagatgagctctggaaaatgtgaacagacaatgcactccactatagctttctagtttcacatcttcaaacaccaaaatgttgacacccattgggatggttattataaacacatacacacagagagagaaaataacaagtgatggtgaggatgtggagaaattggaacccttgtgcattgttggtgggaatgtgaaatagtgcagccactgtggaaaaaagtacggcagttcctcaaaaaattacacagagaaataccgtatgatccagtgattccacttctgggtatatgcctaaaagaatcgaaagcaaggctggacacagtggctcacacctgtaatcgcagcactttgagaagccgaggtgggaggatcgcttgaggccaggagttcaatgccagcctgggcaacatagtgagatcccacctttacaaaaaattacaaaaattaaccaggcatggtggcgttgcctgcagtttcagctactccggaggctgaggtgggaggattgcttgagaccaggaggttgaagctgcagtgagctgtgatcactgccctgcactccagcctgggtgacatagagagaccccatctcaaaaaataaaaaaaaagaaagaaagaaagagagaaagaaagaaagaaaaagaaagagagaaagaaagaaagaaagagagacagagacagagacagagaaagtaagaaagaaagaaaaaagaaagaaagaaagaaaaaagaaagaaagaaagaaagaaagaaagaaagaaagaaagaaagaaagaaagaaagaaagaattgaaagcaggggctcaaccagttatctgttcatagcagttttgttcacaatagtcaaaagagagagacaacccaaatgtccatcagctggtaaataaatttaaaaaatgcagcatgcccatacaatagaatattattcagccttaaaaaggaaggaaattctgacatgtgctataacatggatgatcactgaaggcattaagctaagtgaaacaagccagccaccaaaggacaaatattgtatcattccactcatgtgaggtccctagagtagtccaattcatggagaaaggcagatagaactgtgagtgacaggggctaggggagggaggaaattaggagtgcatgtttaatggggacagagtttcagtacaggaaaatgaaaaagttctggagatggatggtggtgatagttgcacaacactgtgagtgcacttaatgccactgaattgcacacttaaaaattgttaaaatggtacattttatacatatttttaccacaatgaaaaagtaaaggctgcaattttaaaacacttgctagtcctctcctaatcaaaagcagtcttttcttttgcaataatattagtgtacaatctaaaagaagcagcaagctgaactgctcattttccatccctggtaagagcagtatttactgcacatccactcatcatgttgtatgggccatctgggttttttgtatgtcttactgaggtgcatgtttgttaaatgcacaggcataaccagaaataactttcctggaaaattgagcataatggctgtccctctcttgacattttggagaaatgataatacgtaggtgggggaaacaaagaagtgactgtaaacaagaacggacattatctctgcttctgaatgagatgagaaacccacttgcttcattagctctctggtatatctgcaagtctggaaacaccgggatgactcacagtttgctgagtaatacaggagccgacagaatgctgctagtgactcgccatctctgactggctttctgtgcaaactgtcactctagagcaagtgctaggccttggaatagagttctgaaaaaggttacggttctcaactacagggagaaccagctcctaaggccttgacactggtacacaaagtaggacacctctgaccaatgccaaaatgacttttagaaagttcacacctggtcattgtgtccctgctcatgctccagctcacaagatctctggtttctgcctttcagggtgtggtgatgtccacttcttcatcagagttctttgtgacttgtctgcttctccacttggtagtaaactcctcaggcataggaagacgtcttcgctagctctgtaatgtaagctgaatgatccttggaatgaatgagtagaatatagaggggaatgaaccaatgaatgagctgtatctgctagccattgcggaatgctaagttttggaaactgttttgagcattttagaggaagtattgatagacactctcagtcttcaaggcttggaggccgatgaacccatattcttgcactgggcagaaaggagaactttgcatctgcatgtagggcccatttacccactgaccatgatgcatttctctggtccagttaagctccttatccttctatagcacttgtgcaatgtctgaaaacatgtgatttcttcaacttccaacaagtacacaattttataccgccagtggtaatttgtcctggtggttctgttgtttctgctgttgttgttgttgtcgtcatttaatgcaatttacaaggacaaaacaaaacttctggctgccatttcacataccacagtgacagcttcacatggtaagaaaagccaaaaacagctagtttcgaaattcaggccactcattttattacttttccctgattaagattcattcataccactttggggtggtgctgatattcctaacataagccaatcgattttggtcagttctgagagcagtgagtggtcttcacttacacacagtgtgtttgtaactctgctatttctttatgactagcacagtataaagtgaacgtttttggaaggctgttaagcatatgttctcctggtaggcttaaatgtgacttataaaaatacttgatagtatatgaacaagctcccactactggtttaaaccaaaaaaaagaggtttattttactagctcataagcacagattctacattctttgtgagaattatctttttaggtttttgtttttatttgttcttatcattttgatagccattttaatcatttcttttattcttttgtttgctttgttgacttttaatttggaaatgtctgctttggcagaataattacatcacaaggaggccctttccccacccacctacccagaaaggtctcctgactcccttatgctctatgaattgccctagttcaagattgatacagatcaaagcagcagaatggggttgaaagagcagcctctggcaatggccttgaccatgtcaattccctgtgcattcatatagatctggaatcatgtagatctattctgcccagcttgttccacagcagctggtgggcagaaccactcttccaagccgtgtagttattctgcactgcaagaggcaagattacaaccgaggactcattcattaataaaattgtttaagttggctttctgaatgacaacgtggtctcaggaacttaaaagacttcaccaagtccctgctgcaaacaaaaagtctgcattgtgatttgtcagagctagattgacatccagtttagagtttagaatccttctccatgccccacttttgagacaaattacaaatcttgaggttcatcaacattctagtacaatatgaccccccaaggtttaagagccctttagagatttgaagacaactgtgatgttcccactaactctccctccttcccccagttctttgcccctatcttggctgctggcctctgaactcatcacagagcactggagtgagggcctctgggtaagtaaggctctgctaaactgatcaaatgctccacgtacatttgtcccagtagagaggaaagctcctcttttccaaacaatctactttattcctgctcccctacatcccacttgcaagggtagcagccacatcccccatctgtcctgcccgagctcattgtccaagccaactccagctcagaaatttcccccagagaagaggttcctgaaggctaagcattgctctgtaaccctgaacttgatttgtgtctatttctcactctctcattatataaagtttttcaaataatattagactaggaattgagaaagagaatgagcgctcacaattgtttctagagccatcacaatcctacccagcaacaccttttacgggcttttaatttttttgtttacagttattacctttgaaaccaaatcttgactttctggtatgctcttggactttttaagggatttaaaaattcaggagtttgatgccaataattgcttttatgagctagcattgcttcttttctatagatgaatcccattttaaatcatcaattattttcttcacagaaacccacaaagtacatattctagtttgcatcagaattgaatatgacccagaaattcttaatgttattaagctagactattgtatctaaaatgtgtatcacattcaactaatgcatattgaagatcttgagtaccacacttgagatctgaatgaagagcccaggattgtgatatttgatccatactgaatgtatttgctagagtgcattgtacagatggttcaggtgtgttagatttgtctctgtaaatgaattggtcagtagataaaagaacatgactcaaggctgagcagggttcagcaggccccaagcttcatcattaaaaatcgggtgttttttaatatgaggctggctgtgtaaagcagacctcatgaactcaggggtctgagaggccaggccagattatcagttgggatgttttcagtcccaattagcagacagcgcagttcacactggcttaaacaataaaggggacttactgattcctgaaagttaaagtccagcggttgggtggacttcagggttggtttgaatcaacagttcctcagtgtcatcaaagatgctgtttctttctggctgtctactctgccttcagtggcatgagcctcatcctaaggctggctcccccttgtgggcacaagatagtgccagcaactccagaggctacaaatttcctcctgccccattcagagagcaggagaatggcttctagaatctctgtcagaagagccaggaagcttctttcccagaagcccccccagatttcatgctttttagtctgaatggatccaacgcctactagcctactgtgctgcttcatgtcagctgtgtcccccgctagaaccttgtgtggagccaggttcctcctaagcacagaggtggtatgggccaaacgaagctgcctaaatgaaaatggggaaaggtgtcaagagaaggaagacttagtgctggcaaccaacagtatttgttgcaatcaatctcttggccatcctcattcatacacaccttccttcccacgcatacacctcccaaaatgcccacacttagggaaaacctatttacccctttcccaaagggatccaactccaatccggaaaccctaggtgatgtgtcatcctctgaatttggtcagtatatagctcttcatgtttcagggaccactggtcaccatgctcaccttggcatagaaagtaagagtgcaataaaaagaaaaaaaaatttcaattgggaaagaggaagttggaaagcagcacacggtggtcactgatccatcatccatatcacatcctgctggacagcagtagcaaggcttgaccaggggtcagactcagtttcctattctgtataatgagaggattggattaaattagtggttctcacattggaatgtggcctggagagcttgttaaaatgcagattactgggttccatccccagagtttctgactccacagatacaggtggggccctggaatttgcatttgtaatagatttccaggggctgctgctgctgctgctgctgctagtacaaggacacccctgcccttccactttgagaacctctgatttagattatccttatgggcccttctgattctgacatttaggactcagggatttttcttagctatctcttctgctctatactgacttatgatggattgttttataaatgggacacacccaactctactgtgtgaacaacttaaaaacatatcatggaattcctgctttggtttgtaatctaattttcaacaattgaggctgaaaatgaaggacaccttacagcttcaggaaagtaaattttctggaattgaagaaattagaaacagaaagataaaggctttcccatcctccccaaccccatctactacagcacagcggtctgtgggatgattccacgtgactgcagaaagcagctcttttcccaaggacatccaacattttgcaagcattctccctatgtgacccgggtattcattgggtcttagaataggagtagcactgggtgaagctgtgacatagatcaagttggtttaggaattttgccaactttcttccccagggcccctcacctggccaacatctattcatcctcaggtcacagcttaaacctcatgtcctccaaggagcctcctctaaccaacgccccaccccagcctaagtcaggttctcctgttctttgttctctagtgtcctacaatgttcctttatagcacttaccagcctttgttaaaaatcctcactgacgtgctccaccatctgccttgtccatcaatgttttcacaacacaggtcctggatcactgtaaatgctcagtaaatgtgtgttgcacaagtgctatcaaaggcagactgggagcagattccagtcacagtattttattacagtggtgaactatcaagcaatctatataacacatcccacagtgtatgattatgcatgctccaaaggaatgaaacataagtcttcagaagacacaaacacacagctggagagtcccagtgtccctggcatctacagccaactttttcatggccctcccccttctctctgggaagctggtgccttccagtgcccaaggtatctctctaccaggcaccctgggcattggcccagctccctcttcccccatgcccatttgggttgttgattgacacttaggtgaagacaatagaagaccctccagcttacagagtgcccaactcagcagggcctggagagctaatctgggtcaacaccacatttttcccctgagaaagtgggagtccagcaaggctgtaaaatgatgagctccaaataacagcctgagtctcctgacttctggctgcatcttgaatgcatctgcaggcagcttcaaatgtgagaataagatatgaacttatgacactctatagtttatcaccattgctataattctctgccactaaatataattttaccattaaatcaaaccaaaccaaacacttaaaataatttctttagagaagccagattatttattacaaataacgtctacaaactgactaaaagtatatcccacatatattgaatttgaagactgtgcctaagtttaaggtaattgatggattccattctcattagatattcacacatcaaaaaagttgtctgctttcccaggcacagtggtaggttatgcttatgctcatcgtttttcttcccagagctggctcttcctttgaaacagacccatataagccacccatttgctgggtcgcaagcccttcatgagggagagagaagtatggtgggacaccagcaccttctctacagaaacgagcagcatgtttgctaagggctgctggactttggcaggtagagaccatcagaggactcaactgaatccccttttatcaggaaccctaggagagtagagttgtcaggagtttccccatgacttacattgtcttttttaaaacaaccaattcatgactgaggtgaagaaggaaaataacagaaaaatatatctagcccaagaaatctacagaataacaataaaactcaggcagaaatgaacccactgatctgtgagccaagtgcttaagggaggggttggggcacttctcatgtggctcactgtcttagtcagttcaggctgctatgacaaaataccataggctgggtggcttagagacaatggaaatgcattatgcatagttctggaggctgggaacttcaagatcaagacactggcagattcagtgtctggtgagagctctcttcctgattagtagatggtgccttcttgctgcattctcatgtgatggaagagtcaaggtagcttccttgggcttcttcttataagggcactaatctcattcaggagagctccaccccatcatctaatcacctcctcaaggtcttgcctcctaatgacatcatattgtgggttaggtttcaacatatgaatttggggggacacaaatactaggtaggtgcaaaagtaattgcggtttttaccattaaaagtaatggcaaaaaccgcaattacttttgcaccagcctaatattataccacagctctctctgtggttgttcactggggcagtgggggtgtggcagaggggtgagggaaaaagggttccctcgatgtttgtggtagaaagaagagctaggtaaccaagtactcctttttgtctgcttaggtctgccaaaagtcaggcacccgtatcgggttagacattcaaggaatgtactgggggaaatgcctgtgaaagataaacagggaagagcaagagaaggtggggagagactcagaccacaatgcaggtggtctgtgacaattggggcgagaaagaggattgggtaagaagagtctcagacagtagcacagttcaggaaaagttcaaccaggccaatagagagtccttgagccaaagtcacctactggaggagtcctgctcctcacagaaatgggcctgcattactatgctcaccatgttcagtcattggccgggagtacagcccaggccaagtgcagcaaaaatgatggatctaagggggaggctgctggaggcaattatgtttcccatggcaggagatgtcagcagccactggtatggtcaccacatccttccattggtagttgtgggtgggaaggcagagtccctggcaggcagtagacagctacaggaacagaaactggtggtagaattagactgactactttggataacaaagccaaggctggcttgactggctgatagctagactatttctttgttactttgtcactcagtgtttagattgttgtttttccccctttccattgtttgtcaaattccccatctgaacccaggtctggaaaaataaaaccctatgcatttggaagaactttaaaatgaattagcttttaggctttagttgccatcataagcatctagagatattcaggcctcggagttggggcagactggagaaactaaggttatttgagaaataagcacactgaatatttggcttcctaattattctacaaggagtctaagttttgcctgcctggtgcctatgaatcactatttcttaattttcttagtttcacagaatcagaggacatgaatactgaaagatattggaggttgtctagttcgactacatcattgtagggaaactgtggccataaaaggggaaggtacaccaatattccttatgaatcaagacataaaaatcttcaacaaaatactagcaaactcaacccagcaacatttgtataaaggattatacaccatgaccaagtgagatttatccctggaatacaaggctggttcagtctatgaaaagcaatcaatgtaacacactatattaacagaataaaggacaaaaaatgcatgatcatctcaatagatgtaaaaaggaaagggactttctcaagttcacacggctaatggcaaagctgagattaaaactcaggtcatctgacttgtaggccagagttctttatactggtgagggtaggggtggagggctgaaccggaccttgcaagactgtccactgcactgaatcctgtactgagggatttctgtttgttttttcatcctgtcctcacaacacccccaagcagtgggctccgttgttattccccctccttttgcatgaggaaactgaggcttagagaggtaacactggttgtctgaggtcatacagctgccaagtatatgaggagctaagcctagatttcaggtctcctgccttgtctctgatattttccagtgcccgccactgctctcctcactcaacagtgccacaggattaacctggttccattggttctcagatcacctactgccaagcacagtggatgggctttttgttgtaagtggatgggagtgccctccaaattctctggaagaatagcctcctctcttgtgccagtgtgtgacaattctcagagccccagctgttgacctcactgtaatctgggctaagtggccatttatatacactaatgactagaaggtcttttcaaggaatggaggaccacaaagaagcaggcagctctggggaagccagaagctgaatggctgggaggtggggcaggggcaggggacagtggggataagatagaaacaaggctgttctttgctccttgagaagctgggtaacaagctggcttggcttctggtggagtctggcccagtgatagctcttgcctcctgatgggacaaaaaaggggagacaggcatctcagagaatgaggtggagagagacacaactgggccaggacccagaaaagagagttacctttttcgtctcagacctgggcatcccagatggaaccgtgctgagcttctggttagtctagcttcctccaggtgtgcaacacaggggtcctgctagggagccttcccagttgagattaaggaggttgctttcaaaatggccagctgcccaagattgcacctctgtcactgttgaggacagtgggggtaaacatgcctgatgttctgccctggaagggctccagagcctttggattgaagccacaaaggaggcctggcatttggctaccattccttcatctggttcactatcaaggatccctcatctcacccattctgctcccccgttctaatgtgggcttccataagcctctgtcccatcttccaaaatgcagtctggagagcgaggcaccaaggctgcaggccatttgcagggcacagccctggaggctaaagtggaggtgcagtggctttcctaacactggtctgcatgttgaactcagaaatacacggtacccttttcagcaagaatcaaagcaaggttgaaacaggccagcaacgtatgggacactttcttctcttccctttcgtgaaatttgcttctcggatagatctgttttcaccaggaaatgaatcaaagccgcatactctgccttccatccttctcttctcttctctcttcaggtctttcagaccagggaaagtggctgcctttgggatagtcacaacaaggtgccctggactgaaaattgagagtgatgagttacactctgccctggcttggggcaaggccctttcctgccatgagtttcagtgtccccacctaccaagtggggagttggtgtcagacaatgtttcttagtgggtggcattccaggagtccacacacaaaggctaagtccctgcaaaacagtgcagatagatgctttctgtaggtcttgctgactctcatactctctgtctttaactcgcttggcaattcttgagcaaaccattgggcctcttcatctacagagaatgatgacctgactaggtgatctctcatttctcctcaagttacaaaagcgttagggtggtaaggagaggaggtggccccaggaaaaccagatgggtcagaagaagacagaaggtggagccttcagtgacaggagagcagagaatgatgtccccctcccataaatgtagggaaggaaggataccagaaaggttaccatgaaagagaggagtaataggaaagtacaggtcatttgtagttgaaatacatacttgagtgtctgtgtggaccaaatctggggtgggaaggcaggcttcaaatcctgaacctcggaagggtcggcattcctgacaagagctcagagagccaacaccagacaaactctaagtcccctgaagagagtgtgctgagctaggtacttgcagccttgaacccaccctaatcccctctgcctggagcacgtccagaaggagcgtggtttgctgcagaaaagacaagtcagttagaccaaaattccaaagcaactttttaagcctataaatgatgatgattttatataaacttgagttgttccttcaacatagcaccatattttctacttatgtgattctggttttctctaaaggaaatctttttttggaatccacaccatacatacggaagagtatataaaacatataataataaaaccaacagtcatgtacccaccaaccaggttcagaaatagaacattcagaatgttttagaagccccttgtgtgcccctccctcttcccagagataacaactatcctggcttccaagagccaaccctagaaatagaccctaggctctggcaagctttgtgctcatcctagtgagatcatgcacgtcaccaatctctttaggtagtattctgtgcggatttccacagatggctcatctgttttgtgttgatccttattagtttcaattttgtctttttaaatatattttatgactttctgattataagagtaatatgtgctctttgtagtaaacttggaaaatgcagaaaagtggagagaaaacacaaacctcatggcataatacaatatataaacatttaatatataaataatccagaaacaactactgtgtgaacacattggagtgcagtatttcagtcatttttttttctatgtagaaatatatgtttcacattactggtatcaagttgtgtatataccttttccctttattgtggaatataacattgatgcagaaaagtgtgcaaggcctatatgtacagtttaataaggaagtaaaaaatgggccgggcgcggtggctcaagcctgtaatcccagcactttgggaggccaaggagggcggatcacgagatcagaagttcgagaccagcctggccaagatggtgaaacccagtctctactaaaaatacaaaaattagctggtcgtggtggtgcctgcctgtaatcccagctactggggaggctgaggcaggagaacagcttgaacccaggaggcggaggttgcagtgagccgagatcataccactgcactccagcctgggagacagagcaagactccgtctcaaaaacaaacaaacaaaaagaagtaaaaaattaaaacctgctgtcaacactgatcaggtcaagaaatagaatattgacaacccccaagtagatcctcatgtgaccttcctgatccaagataattattctgcttttctacatagcttcatcacttattaatagacttaaacttgtaattgcttcattttcaaaaccttagtggcggggccgggtacggtggcttacacctgtaatcccagcactttgggaggctgaggcaggcagatcgcttgagcccagagtttgagaccaacctgggcaacatggggaaaccctgtctctactaaaaacgcaaaaattagctgggagtggtggtacaagcctgtagtcccagctacctgggaagctgaggtggcaggatcacctgagcccgccagggaggtggaggtttcagtgagccgtgattgcactactgcactccagcctgggtgaccagagtgataccctgcctcaatacaaaacaaacaaacaaacaaacaaacaaaaaccttggccgggtgtggtggctcacaccagtaatcccagcactttgggagaccaaggtaggcagatcacctgaggtcaggagttcaagaccagcctggccaacatggcgaaatcctgtctctactaaaaatacaaaaattagccaggcatggtggcatgtgcctgtaatcctagctactcaggaggctgaggcaggagaatcccttcaacctaggaggtgaaggttgtggtgagctgagattgtgccactacactccagcctgggcgacagagtgagattccgtctcaaaacaaacaaacaaacaaacaaacaaacaaacaacagcaacagcaaaaaaccttagtggaagacacaatctaagcatttaagggaagagtcccaggccattagtagatgaaggctttcagaagaagagaggttgacctgtcctggtcattatctgccttcagcttcccgggaatgtgtagagcccaccaccatcaggacactagcagagttgtggacatggtattggatatgcagaagaaatatggccaaagagattggactgccctctgtgttttgctttcaagctcaccacagcctgcctccagtacctccagttcccaggtgtagggcaacacagaacatccctgtggggtgaagtgagtggcctccactgatctggccagcaggaccaggaaagcagagcaggaaattcaccagacaaagggtcaagccagacctcttccagggtgggggacaggcagatgcctggggacacagagtcagagaggggattcagagatctgcctgctccttaaccagcttccagcccaaccccattacgctgaccatgtccccccattccactttacctcccagatctgggaacatctagagctcctcctcctgaggcttgggaagattctgccgtatagaccacgatcctttccagttttctcctctgctgtcttgtgattcagcttccttggtgctgtgtagtcagttaatcctggtctatctgcattttagtttcataaattatgatgctgttatctcctctcctattctctctatcctggtgggattttgtctttaaaaacaaaacaaaacacaaactcttactgtagttttaatgagactctgggaggaagagaatttagatgcttgcattaaactgctgtctaattccagaagtctccaaaggaaatcctgccactcccttcttcggttgcccgaacatgacggttagttggatggctcccttggaagcccaaggtgccatcagggagatactgagagaatttgaggctgggaaggcaggtgggggttggggtgagggttatgttttgaatattgcttcatattgaagcatttgtagtatttgcggttaagagcctggattttcatgtaagtcaactccaggttcagcttccagctctgccagttacatatggtgtgactttgagcaagttactttgcttttctgaaccttattttccccacctgttaagtggggatcataatggtacccatctttcaggcttgccatgggtattgaatgtttcacttagtaaacatttacagcgtttcactcagtgcctggcacattgtatgtgttcaatacatggtagctattgtcatcatcattatcgtcatcatcatgagaaaatagaaaccttccagaaactgtcagggcaacgattgccacaggccgttgttggctactaaaactctagactctggagagccttgatgcccttcctcttttaccccgtccctgatgctcccccaagtagcatgatgcccagtggcccaccaacctcattatccagcattgctgacaacaggcacagccttggtcactgtgaaaatgccccacagcctcaacctcagaagtgggaagtatactgcagattcactctatgccaagcactatgggatatccacaggaatgtgccacagtgaggtaactgcccaggggatagtaattccttcatttctttatacattatggattctaccattttgttattgggttatttttccccttgtcaaagtagcaatttatcagttgaacttaattctctaattaaatttcaaatctgagaatttacatgatgaagtgaatttgattttggacccagtcaatttcagtcagccctaaacatattttgaaatgttaaagttaaattatatacgtttgtggaggaaaaactccaggaaagcctaaatttttccaggtcttgcttaggggataccctgctccaagaaaacttttacaaaatgcaaatttacagaacagatccaccaaatgggtgggattggtgctaccctagagttttctgtagaatttcttttttaaaaaatttttttcttttttttcttttttttttttttttttgagatggagtctcactttgtcgcccaggctggagtgcagtggcgtgatcttggctcattgcaaactccacctcctgggttcaagtgattctcgtgcctcagcctcccaagtagctgggactacaggcacgcaccaccatgcccggctaactttttgtatttttagtagagacggggtttcaccatgtcagccaggctggtctcgaactcctgtcttcaggtgatccacccacctcagcctcccaaaatgctgggattacaggtatgagccactgcgcccagccagaatttctttagtgagacttatctacccccctccacccaccataccacacgtatcataacagaggtcccccaacttggagttctcctcatttcaaggtacagttattataaaaagaagaggacacctgggtctcacagcagccagctctgcggccattgcacagtagaacctcagtggccttacaaaatattcttgctgttagtctacttactgcaataacaaaagtttcacttgggcactttgatcacacaaagcttggcacaggctttgaaatcagacaatacctaggttctagtctaggctctggcacttaactaatgggtgatcatgggcaggtcgcttaacctttttgtgcctcagtttccttatctttacaatgggattataatagtacctccttcataggattgtcctgaggattcattaattgaaatgaccctaggaaagggtcagtgccttacactgagtaagttctcagtaaatatttataatatcatcatcatcatcaattattattattattaatttactttaccaaaacacaggtcctgctgagccatgttggccagaccacacctagaacagcatgtccagttttaggctaatctgtgtaaaattcagtgcctggaccattgaaaggggctcgatatatggtggaggtattattgttaattaatgctgctgctaaccttcctggagtgcatacaacatgccaggcactgcatacgtgctaattctattagtcctcttaacctttaccactctatgaataatatacaattattaatcccttttgcagatgagaaaattaaggcacagaaacgttaagtaactctcccacaattacaaagcatggaagtggcaaacccataattcaagtctagactctctttttccagagcctggactcttagccaccatgccaaagagctgtgctgtccactgctgtagccagcagtcacatgtaactatttaaattaataaaaaatttaaaaaacaagaattcagttcttcatttttactagccacatttcaagtgctacacacttcatgtggccagtggctaccatattgaacagcacagctctagagcattctattctttctgggatgattcagcatcaactcaggaagttctgttggatggtgatgcttacagagattctgtttcttacaaaatctcagacttcagttgtacagctttcttgcattgttattaatagatgcatacttatgatatattgaaatcccatttgcacttggccaagtagggtaatggcaagaaaaaagccaagaagcgtgacttacattacgttttcctgtttccccggtgcattatttcaaattcacaaagttgtctcctatcacctctctttgatatggggcaggaggcattcatcaacttgcccaaaaatccaggttcttccacatgtctgccttcacctctttgggctatctggataatatttagtgctctagcatagtaacctcacaagtgacttgaacaacggaggttggcttctgaagtcagtgagccacagaggaccttggactctgagcatctttgacacactcatcaagtctccagttcgctttcttgggttttctctgctcatttctgttacatggttagtaaaggccagggaaagaaaaggtgttgaggatccattaccttaattccagaatgattaagtcaagaaacctacaagctctcagaagccagtggaattagagtgcactactataaccttgcaaatgtgcatatgcctccttccgaatcaccagagtggagattgggccaatatccaatctagtcaataatttataaagccagagcattcatccacttcttgcaaagcagctgaatatctatgggggttagtcataatctgagctccttgcaccagagccatttgagctacagaatagcacagagtgtcacagaatagccaaaagtgcagagttatttcagtatgagagaaggaggagcacctgactgctcctcgccatgtgcagaggaggagcccatgcatttccaaacccaggggttgcttggtttctagcttggtttctgtctgtaccccatcttgctattgtgtgacttgagtaagcccatctccacttcctcatcttattagctaggaacaatctatctcaaattcacatgtgcacagagttcagtgcccagcacactaaagcatgttcagtaaatatgttagctgatgttattttcaccatatgattatgatcactctctgttctactgatgggttttataaacccaccagcattgaaaagagatgagtagatgtgctaaaatgagagtaaaggctcagtttatcattggtgtttatcccaaaaaaaagactagcacaatgctcaccagattataatctcccaagtgcctagaacatcatgccaagctagtaacatagtaaagtttattgaattttgcaagtatttgctgagccctttgcctgggctagatactgtcggggcaccagagggatttagagatgattaagacttggcccagcaagaatgttcagtcagccaagggtattcagccacaggagctggacctggaaagagaggcagaatttccagggtggaggagcttcatctcgaaagacacacagaattcccagagtacaatcatggagaaagggcattccaggcttggcaaaccaaggagcacaagcacagagggccgaccacacatggcagcctgtctggagagctccaaggagattggtatgactgggggtacgtgacattatggaacgcaaaacctggctgctgagagggtggatgtgcttgcacttgcatctctagtcttggtgcgagccattggaggatttttcaggggaagggaaactgggctgacctggttccagcaaactctctgacaatcatgagaagcccagggtccagggggatgagtaagtgtgacctccaggaaacggggcaccactatcagactctatctgtcccatggcttacttctgtgagattcgaaatagtgtagaccttgtcagtccatgagctagtaattatgcccaccaattactgatttatttgcctttctgagatgtgcagtgatcccaaggacaaagatggatttaccttatgtttagaaacttctagaagttgaaatgttcctaacaacctttcctgtggaggttgtacctcacacgtagagtgtgtgataagcatttcttttcctaattaaataaaatggagaaaagacacaagcatcagctataaagctcccagtcagtcacagtcaagagactgaatctcatctcttttatttattttttgtgttaactggggattgcattggtctgcacagtgcttgctcccatcctgctccacttgattgagtggctccaggccccctcttgattgctgctgaaatagaactgcccacactgtcggggtatcttccgccgctggtcatttccatgtgccatctgcagttttttctgcctgatggactactgaggcactgcgtatgttatgctgatggggggtcctgtttcttgacccatcactaatatcttgcaagtcacaggaagctaccagggattcctgagcaaaagcttaaaatgcttcagttctctacaaataagccccattcattgcttttagagtgtgttatcatggagcagacaagtaatcagaacctgagtaatatttgcatattgaggtcttcaaaactccagtgtggctataaaatggtatttaaagttatcaaggagctaggtatgcaggcagaaagaactgtccattgcagaaagcaatgcctctgctcatgtcccagataaccttgctccaaggacaaactggagcttgataacatgaagctgcagatggccggtgagctcagctctgtactcactaaccaccccatgggaggggcactgagccctctatggttggcataaatcccattagaatggtaaagaaatccttttcacaagtacatagaaatcgcttgctaagatttcatgggttttcttgactttgttgtttttgtttgggttttagagggtgggcatgagtcatctctaaaactgttcaggtagttaggttgtcttcttattcccatttttaagtatttataattagttcttaaaaatttgtccggaggtccacacctccccttggaaaaccttgcctgtacttttcttaatggcacattttaagtttctatgtttcaaaacttgcttatcatataacatgctaatgactaaacacatgcacacctccacaccaatgcaaacgacatgtgggcttgggaacgaggcaagcctgggtttgcatcctgctctgccactagtgggctgtatgattttgggcaacttagttaacctctctgggcctcattggcctcatttgtaaaataagggcaataatagtccctttctcatagatggctatttatacagatcgaataagaccaaatatttaaagaacctgggttagtgcctaaagcacagcaaatgctcaataaattcagtggtggcaatttttattgttatttcaaatattacatcaaaatatctactgaactattatccattgcaaagacttgcccacaataggtgcttagtaagtgtttattgcaataagttgaagtgattccaactatgtagcttagatttcgggtatgagtgtttccttctccactgggatgtttgctaatggacatagatgatcactcacagctcaggtattaaaagcaggagagtagaggtgttccttcatgtagaaagaagagcaacttctcatcaaggcaggcttccagctggtcctttggacaccactgttgctaagcacttggtgtgctcgtcagggtaccagggctcttagcagccacccatttgcgttttgcagcttttgctgacatggatatcaagtatgaagttattttaattgcctttggctgaaaaaaatgggtcatatgttcaatatgttcaattctggtgaaatccctgtcttctaaagcatgatagaaaggggaggtcccacccacacacaagtcctaaaatcttggggccctagtggggtatagttcaacaagggctgcagctcaggacgtggttgttgtgagatttactcgtgactgtttggttttgcactcaccatttggttttgcagattcctcagcgtgttcacacacacatacctacaaaccagtttagagttgtgtgctccattgtggggggtggtcactggggtggggtggggtagggtgggatcaggcttggtcaaagtcattgctgatgaaccagctatctgacttagctttgttcccattttcaacaagacagtgatttctcaagccaggggagtcttcacatgagatccatggatgggtattaagtggtccagaaaacccccccaaattagatgtaaaatgttggtgggctggaaagggggagacaccataagtgctttttctgtggagagaaaccatagcttataactggttctcaaagaagtctatgacccaagacaagctaagatcacaaagctgtttggtttcgttccaccaaagcagttggtgggtataaccacaacacccagatgacccagctagacactcagggcagtgacaagatcagtcagaaccattttgtggccaagcagctgatggattgttcaatcggttgttgtagactcatgtagacaaagcctgcaagcttggggaagccaggcacccccaggtcagcctcgggcgacagcccccgtcctgccaggccctggggagtgagtccttcctgcccggcagctcctttgctcatgagctggcccgagtcacctcctcgtacagcacctcagaggcagcgccctggggcagctgggatccgaaggcctggaggcaggtgcccgctccactactgcctagctgcgacgccacaggtaagtcacttccccctgagcctcgctttcctcatctgtcaacggggcacagtcccctgctcagcctgcccgcctgcctcacagggttgttgggaggaacacaggaggtgacagctccgaaggtaaagctctgtccacccatgagggacttctagtgcttcctgggcctgcttgttctctactttctgcccggcattctttggcaaagggacaacccaagcaagcagagtgctccaggtgcctcagccccacctccagggaaatgagtgggggattgaccagggtgcagctgctctctccctcagctgtatgccttccagtaccccgtttccatacctacctgcctgtctgtccctgaggccagactgggaacctgagggggacaggggctgtgcttctgcacctccgaagccctgcacctgatacctgcctgcttggcacctagtgggtgctcgggaactgcctctcctgccagccatctgctgtggattccaaaccccgcccaggactcccacaccctagaggcaggaagttggattgccctgctggaggactggcagtctgggtagtacaggcagaaggaatccaaagcaagcttgtccaagaggcctgtgagttgggatcatcctctagattctagagtctagaaggaatggcttgacttgcccccagagtcgcatcagtggtcatgagagcaagcggatggacaccagccagaggggacctttgcagagaattgcatctggtgcataaaatatcaatgtgcacaggatgtctgcactatctgcagagaaaactggagacatgaacattttctaagtgatagtgatcagaagatggtcattaagctgaaagggcctcccaggattctggcctttaatggaaattcggctttggtatgtacagccttgttctctttatcctgcctgccctggcctggaagaacaagcagtgctttcctttcaagggctattgatttctctctctctcagagtcacagagctcctcagctgttcactcttcagctgaaaccagagaaatcttgtccagcacaaagctgccagggaaacagaattagcaaaacggacgtcgtcccctcaggatgtcgctgtttccaccctggtctgccttgcctttccctgtctttggaagccacaaatgaaaggatatcagctagcttgccttgagaattattgtccctcacctattctctctcttctcaagccaacagctttcacccagcagtgaagtggcagagcagatttgtggccccaaatcttctctaagaaccttggaaattggccccacctgagggcctttgagggtcaggcctggcatccactaaatcctccctgtcaacacagccactttgtcagtccagcctgtgagtcagtgcgagacagaggatgcaggcaccacaggggaagaagaaaagcaagctggaaatatatttgtttcctttgcccgggatcattcccagcatctaaaccaagttcttcccagaccggccaagactgaggaggagtcagaatagagtttgcagcagtcatagatcatgtgggaagacagaaaacaaagggtaaaaagaatttcatatacagatctctgccgtttgctttcagtggcattcattttgtgaagcccccagtgacagcttcagaccagttcaaacctgagggcagcatcattaccatgggtgaggtctctagaagggcaaggaaagacccctaacatagaaaatggtgtggcagtttccagttccccattggggtcccatgacttgaccttaggtttctgccagcacctgcccaccctccatcccttcaccctactgggtggtcattagaacattatctgctttgattgatttacttgtgtccataagagtagagacacacggtgttatccccatgcccggaacagagcctggcccatagtagacccatgaccatgtttgttaactgagtgacagagggactgactggactgtcatgtaagcaataccttcccgtcagggtcttgggaaggtaggttcaggggccccagagttactgtggcccgtatccctctggctgcattctgggcaacgcaaaagggcaggtgttcagtgggttccaccccagatctcggcgttaacagtccactgggagaagtggcccaattcgtgctcattactcccagtggtcctgcctccctgcaggcattctggagaagctgagtcacaggctctgagagttagggggaacttaggaaacaatcaaaacttgcctgccattcattttaggaagccgttgtagtttctgagggacgactaaagggaattttttcctaaaagcatccatccgtcctccaactaggcttcagatagcagtgtgtatgttgtcactatctatgggccatggccagtcagagcccacgggtctcagggggctccacccatgtgggggtgggggtccccacaactcagatcttgaatgtgtggtggtcccatgcagtatactatcttcctgtcattgcaaagggaaagtcagaagggtgaacgagttgtttctaattctggcttccaaacagtacaaaagaaggtttttttccttgtggaatacactagtgctcaacctttgggacagatagctgagcaccttctgctgtgtggcaggctggctctctgtgggggcactcatggagcagtgtctgctggaaaaggagacaggagttccctagcatggaggggtagataatctccccgctccctcccctcttctgtcctcccttccccttctccctcctcctctaccctcccctttttcctctcccctccccttcctcctcctcctcttccttctcttcctcttctttattctctctccctctcagtctccccttccctcccttccttcctcccttcctccacattctttataaaacaaggctttggatccattcactgccatcccccagaagtcttgtcatttgaattcttgtctgagtcaggatgctctcctccaagggctcatagggcaaggaacttcagcccgaatccggctaaaatccaggaacattttgtgggcatctgtctcagtccccgaatcgtttgtcctctgcctttcccccgttggagtccttttgcctgcttaagtggttgaattggtaatgagatcattcttcccatgcagtggtgagaaagcagcactcaggtgattgcacctgggtaaacaggagacattagcatgtggtagctggtgagtgaagctggtgcagtgcctggcgtgggctcagttgtgccagcaggcagtggtggagtttgggctctttcccctctctcctgcccagcacacaacccccagggacaggtgggggctttacagctccctggcgtcagcctaaagcttctagaaaggcatccccaggacttccaaggttgccatcttggctgagactgtctgtgaatgtggtcccttgtctgacagtgggggctgggaggggtgtgacagaggaagagctgggccttagttctctgggggtcaccatgagagaagcacacctgggcttgcatagaactcagtgctgcttgtcagtgtcacctggcacaacaggacgtagtgccacagttgcagccctagaaaatttgacgaccccttcatagctttgtttataaaaggccacacggcctaggctgtccttcataagagagcagaaagcgagtgtcccagtcactaagcagcaactttcaggcacggtttcctcctggtcactgaaaccatttgccatttcctgttttctccattttccaacgattctaattgtcagtgtcaaaaggcaacaactgttttcttggggcttatctttggagcacattgattcagaacaaaggatgggagcctccatctgcaaaacaaaggaagcagcctcctcgggaggcctggagagaatgctctggctcctttggccagggacagcaggaccagcataggagcagaggactggcggtgcctctggacactgccgtaaggtgaagagcccatggaggaccgtcgcttgctggtggcaccccagacttgaagatcctgcagagctggccaccggcacccaggctgggtgtcagcagcgctgtgtggccttggcagtttccatagtgataggctggccagcttttccattagactccggggtcctctggaatgtgtgcttcccgggatgaagacgccccagcacccgctgaagcctgccctgccccggcgtggcctttccttttgtctggcacgcccctgggcttggctttctctttccgtccctcccttcggactttaccgcacttcccctgctgtttccttagtcacactctccagcctccatctgcccctgcccctgaacccctacctctgtacaactgtgttatttgatgaaactaatgcagcaaccggtggggatggagttaaggaccgtttagacctagccagccacgcaggaatctgtccccagaagcagcagaagcacctggtctgcagttaggagatactgtacttcttagccgtgtcaccttgggcaagtcatttaacctctctgagcctctgctgtcacatcagtaagctggggactgtagatcttctgccctgatgtcctgagactggtacaagaagagccaaagcgaaaggactgccttcagaaatggctgccaaccctgaccatctcaggcagatccggatggtgtggccttgggcagtggtcatgtgacccccatgctcctcagtgtccacatggggtgttgctagatgacataaaataatgggtgagacgtgctcagtataatgagagcttgagaaggcagatcccaccccccatccccacccccaccccttgccgccttgccaatgctttggcagggagagggcagctccatagggcagctgagaaacagcccctcactgcccacacggcagctccagtggagggggaggcagggaccaggacaggaagcaggctaagggcgggatagaaaagcaaaccccagtctggtggaatcgcttctggtgtagtcttcccggtgccatgtgtttgtcctctctgccttggcaggaaccaaggccaggaactgctgccaggcctgagagctgggcacagtcccaagcactgggtcgctaccccgccccactcccaccagccccactgagtgcagagaagggttcccagaagccctttgctggaaaagcaggcactgcacgggcagcccgtgttgtagaggcaagtcctctggcatcttgggggggacacagaccagaaagtggacttggagcttgtgctcccagacagagctgccttggtggttgagaaggggagagagatggcagcagttgagcagagatggccgggctcccctcactgtgtggggtgaggcttcaagcactggactgggagtcagacctggatccgagtcacaacctgacaccaaccggctgagggtctcagagcaagtcatgccttttctgggtctgggggccttcatgttattccctcctggctatgttcttcccctttgctccttgagccgatcccagactgagtgctgaaactgcggccttgaaacttggctcgctcctccccctgcccacccagccagctttcagatggagacaggaagctcctcccaattgcctatgctgcaactagtcaggagaagggcgggaggttggcagtaagtgtttggctactcccagtgttggagactgtgtccacctgaccatgtgatcatctggccgttcatgccaggaccaccaggaacaagcctcagtcctcttctcaatgtcctttccctatgacagccctgcagaggctaggtatccaccactacatagcccacagtctgctctgccccagccacagcatccttggcttgctcagccattctttgtctgggtagtttgaagtccaatccccactctcattacttaccatcctctgaatgcagccagtctgtctgggtctccctgagactggcatgcccagactcctgtgggtatagtctggccaaggcagagttagcataggactgtcacctccctccttctacatactctgcttctattaatgcagcctaatgttacatttgttcttttggtgaccgcatctcactgctgacccatcctgagcagatggacatccaaaatgcctaaaacttttttctgtgtgctcttgctattaagttctgtctctcctgccccattctatgctgttgcagttgtgtttttaacccaggtgcagaatcttactttatttatacctgtggaattttgctcgagagggtggggcatgcatgcgagtgtatgctggtgtgtttattcatgctttctgctgcaccaaagccaagtcctaggtccccacgcagcgatcctaaggctaattattaattggtagctgtaatctaatttgtctttttcatcttctgtttagcaagaggaacagagatcaggtcttatggcaatgacccctgaacggcagaatgcatatatctcccaacagatgagtccatttgaaggtaagcagttaaggccagtgttcccaaaggggtgggcaaggggtgcatatgtggaagtggggtgagaattcatttcagagtaagcagttactgtgcttctgaaagcattgagaaagaggagatctgaaaatcagttaaataattcatccaactctaagagcaggatcccaattgaaggcctggtctaaatgactccaaaatcaccacttaattcaagagactgatttccctgagtcaggccccttaaagcagctatttcaatgggacagggaaacaaccctaggatctggattagaatcacttgggggctgccacacccccagggctctgatcctgcccttctcccacacgcacattcacatactgctgcagtgaccttccatttctaatgggttcctgggccatctgtcaggtatagggaatggaaaaggggttggggaggctctgcttcagaaagtttgtgtcaggggctcccagagcctccacagatagatagcaggggtccccaccctaccatggcagctataaatgtgatcaacatttattggcctaggatacagcagttagcaaaatgcctgatgtagttcccactccgtggaggttgcaggctagccaagaagtcatgagttcagcaacccttacgcaccagtgggatgagattggaccaggccgagggtagtcttgggaacactcagcatttgtctgagggccagaagaggctgcttgccctcagacaggaggtcagcatctttattgtagcccatgacacctctacaccattgctcttctggtcttatggaagacatctttgggcctgataacagcggagtctgtgtcccacttgtccaggctggagtgccacatcaggcacactccagttgcagggacagcacagacaagtttcaggaaggctggtggcctccaggaggttaaccttataaggccagattgtaacctagttgaaaaacatacacatgccatgataataaaagaacctaggcaccattacaagagaaaaaatcatttttgtagatacgagcatggattcttgggtgggtcagacacactgggcttgtgctctgactgcactgtctcccctacctgaccttgggtaaaccataagactgctgcatgactcagtgtccaccccaaaaaagtaccggtagatattggccacagtagatatcagctagagtggactctcatgacaatgaggggagatgtattccccatcttaggcacctgggactctaccttccatcttctgctccgtgtctctccatccccaggctcttcagaactcagggagtccagaatgtcagctcccagatttcagccttcagaaaggaaacccattaccgttcagttgaacaaatgttgtctgagccccagatctgggctcagaggccatctaggctatgagacaagaggggaacaaagcaccgtctgcactcactcaccacactcacttgctgtcccaggtcacatccatcgggtagagaatctaagaggctgagctagctcccgccaccagcccagcccaccccacctggccccttccttccttctacaaaatatgcaccacctgtcaaagggtgggcagtgccaggcctgcatacagagcactgagtgtaaaagcagacatggaccctgacctccaggagcttccaattttcttgaagagacaaatcagctggcatttcagtccagtgtgatctgctcttggtgagcacagacctagggagttggggcagcttcccagaagaactgcagtccaggctgagggcagagaaatgaggggaatggcgaggaattggggagcaggggggagctcagtagagagccaagggcgggaggtgagaagtccgtgttgggccaggagctaccctccggtggccacagccgaagtcgaggatgcctttggaactcatccccacttctctctttctgtatgtagccgtccaagaacaagtcacctccaagtgtagccggatcaaggcaagccccccatctagcaagcacttgatgccacccagaactgggcttcttcagaacaatctgagtccaggaatgatcccactcaccaggcaccagagctgcgagggcatgggagtgatctcaccaactctggggaagcggcaaggaattttcacctccagcccccagtgtcccatcctctcacactcaggccagactcccctgggcagacttgactctgtctgccagcatatgcagagccccaaggccaccccaccagaagtgcccctgcctgggttctgtcccagctccctgggcacccagtccttgagtccccaccagctcagacggcctagtgtgccaagaatgcccactgcgttcaacaatgctgcatgggtcacagcggcagcagctgtgaccacagcagtttcggggaaaacacccctcagccaagtggataatagcgttcagcagcactcaccttctggccaggcctgccttcagaggccatctgattgggaggcacaagtgcccgctgcgatgggaacacaagtgcccctggccaacaaccccagcttcagcctgctgggcagccagagcctcaggcagagcccggtacagggcccggtgcctgtagcaaacaccaccaagttcctccagcagggtatggccagctttagtcccctgagccccatacagggcatcgagccaccaagctatgtggctgctgctgccaccgctgctgctgcttctgccgttgctgccagccagttcccaggtccgttcgacagaacggatattccccctgagctgccacctgccgactttttgcgccagccccaacccccactaaatgatctgatttcgtcacctgactgcaatgaggtagatttcattgaagctctcttgaaaggctcctgtgtgagcccagatgaagactgggtgtgcaacttgaggctgatcgacgacattttggaacagcatgctgctgctcaaaatgccacagcccagaattctgggcaagtcacccaggatgctggggcactttaaatctgagcaggatgcccatagaaacccccatggtgacatcactctaggaagtggtgtcgatccatacccgcagttgtctcccgttacaatttgagtggtgttgtcagcccatgcttatccctctctctacctgtgacaaaatggaaagctggtgatttttcaagctacgtgtacatatttgaaaattttgtaaatggttttcctaaacattaatgacagaagtatttatacttcattttgtgactttgtaaataaagcgacggcttttgtttcagtagagttgtgtttactatgcattgttttgtgtttattatacaatgttacaaatatgcagaccgtgttgtttgctccagtgataccttgttaagctaggtggctgagtcgcttatggttttaatgcaatgagcaatgtggatatgaccaagagttgttgtgcaagttgacaaatgccaaatagaaaaccacttggccatttatttctatgttcactaaaaatcctattgccttgtgtgattcttaatctcttttgcgaacctttcagtctccgctagctctttcctaatgagctttacagcagaagctgttttatcgttaagtgccccacagagacactttaccaggaggctgggagagttctccagatttgggagaggcgcagagacagtgtgtgagccgagccctgtctcagcaatccacctggaggagctagagtatcctcctccctttaccattcagaccgagagaaaaagcccagcttgtgtgcaccctcgtggggttaaggcgagctgttcctggtttaaagcctttcagtatttgttttgatgtaaggctctgtggtttgggggggaacatctgtaaacattattagttgatttggggtttgtctttgatggtttctatctgcaattatcgtcatgtatatttaagtgtctgttatagaaaacccacacccactgtcctgtaaacttttctcagtgtccagactttctgtaatcacattttaattgccacctcgtatttcacctctacatttgaaatctggcgtctgtttcaagccagtgtgttttttcttcgttctgtaataaacagccaggagaaaagtgcc

SEQ ID NO: 3939 - DNA, 68728 bp, human
cctgtgtctaggtcgtttgggaaacgccttggagagtcaagaataaatttgcaggtcaaacaatggatgactggaaaagtcggcttgtaatcaagagcatgcttccccatttcgccatggtgggaaatcgtcaggagcccagaaagctccaggaatcggtcagacaatgggccatggggggaggggggtatttaatgcttctaatcttaaacttgaacgtaagatgtgttattgaaattttctgtgcaaacttggtggcagggatccaactcaaaatataaggaattcaaatgtgatctagaagagatctaggagatgagctgatcccaccccttgtgggtttctagaagagctggaaatatagtctaaggttccatatagcctcccagtctagtagtgatcactgcattgcacccattcaataagaaaaatgaggaaggatgagagagggaagacgagtttactttttctcttaatagaagccagtcagaatggcaagcactagatatattgcatgagcttcctagtatgactgagaacaaaaagctagtgagtaggcacagagaggtcttcccattcaactttctggccctgttgtccttttagaaactcatctgacacacttctactttcctccctgggaactcagacatcatccaagtgttctgaacctcaggattagggattccagtggtagttctaggagcaggatgatgatagaagggactatgagagccattgactagtttaatttgacaataaaagcctgcaacaccaccaatctaccaagattagctctgttagcaggaattgcagcaaacacaatagctgttatctcagggtattagggccacagaggagtggcttgcttaatctctggaattaatagagcagagaggaaatggctcttatagagccgtgggtcggcttccttccttttcatagaactggaagccctgggctctgaggtaatgccatttcacataactagagggcctgtcttctccaattcccagggcaatccactttcagcaagtcagctttcaatttattttaaaattctgatatgtgcacagatgtggatggaggtgattgaaatcttgttttctctttgtttcctcattgtcaaccaccaacaatgtattgagaatgtgctatcaagttgagcatgtagacatttacaaaactgtttactgcactccccagctctcacagagattgcagtcaggtgggatggcagagatggagacattacttggccagcagcctgtccaaattgccaggccttaggcctcttctagaaagaaatctctaacctccatcctaattaccctttatatttcatgcttctcttttatgatcaacaattgagtcagtaaagaaaaacctgataatgctcccagagtccgtgatcagttttagcatgactttaaatttctcttttatttcccacttgtttccattcacttgggccaaattgtagaagaaagtgttgatggattgtggatgcaggggtcctcttccccttctccccaactccatcaacactcttaaaaagtgtggccagtaagtaactgctttggttttgatcagtgtacagttgaatgcacagattccagtgggggttgtccttagaataggtccttggagtggccatctgtgcatttactctggaaaagttgtcattgcttacgtcatttccaggcttggcttctctttgcagatggcctttagagccctttgtaagctttgccaaaaattcacattcattgctttagagtcacactttggatttgatcaagatcagccctctgcctcctctatgccacaccttgttctctgaaagagttctctgttggttctgagtggcttgactctttctaaaacttcaagctgtcctagaagaccaagaattcaccccagttgaggagaacaaagaattttaaaaatttgcctcagcctccaaaagcaactctctcagatggtcttcttcacagttgaaacagcattggatgacattgagagagcccactcctttggctggacgtgacaggtgctgctgtacggtatccctgtagcctcagaaaggtacccagtgctaatatgaaactctgctgcacatgctgaggatctcagcatctgggtgcttgtgaactgaggttgaccaaataaaagcagaatggcctgtgagtccaccaagaaacctgcagtccaaacaagttattgtaaggcctggaaggtgagtggccaaaggaggtcctttgcaagagctgggcttgcatttccagggtgtagccttagctggatctcagatgtttcccttgtttgctctccttctgacacttaataacacccagggatgacaccctgaaccctagtcccaggaaaccatgtgcatctggaagcacgtttcttgcaccactctccctcatcctgaaaacatcgctaacagagatttgcttcaggcattcagcttgactggttctcttgttctttcctagaaaacaaacaaacaaacaaaaaacatgtttcaaatcaatcttgaaataaaatgatatcagtcccagaggagagttctcttttagcagtccttgaatttacatggaaataattgtgagctcccttgaaggaaaacgtgcatctcacgtaacagttgttcttggcctaagactagggctcagaacacctgggttctagtcttgcagctactcctcactagctatggggctttgtctatcctttgccctccctgagaacaaagttcaaatgaacgaaaagtaagaataaccacctttaattcagcattgactaggtgctaggcactttactaagcatttttggggcattatctcctgtaatcctcatgataaccctgggaagaagaagctattattatctccaggaaaccgagactcagagagattaagcaatttgaccaaagtcacagatataagaagtggcaaactcagaggccaatgtcatcaccactatactctaatgcacattgaaaactacaaaatgctgaatacatatcaggcaggggccatcaccataagaaatctcagtaatgcaagtaccttttcagcatctgttcattcatttaatagtgtgactggttaatgactctggcgatctggggaacagaagagtttgaccttttgaacatttgggcatctacccaaggttaataaggcatccagtctctgcacttagtgtatggagttttaacaggaggcagaacattttgtccttccctttgaagttaagatcacgattctttccctagatccctagatcagtaggtcaaaggattgctagtgtgagaatttaaaaggcattagtactccaatttgagagtgctccagagcctgcatggagttgagactcagtgcgcatgtcacatgccatctctgtctcagtccataccccaccataagtggcaaagattcctccagctcggagcaggtacctattcccttcataaggcagctcctagacaaaatgagggtgcaaagggcatgaaatgttcagttggaggaggaaggggacacagtactttttgcacatcttctgtgttcagccatttaatattaagaagcgactcactctatagattacaatgggatgccgtgcccagtatttcttctgagcttcccaaccagtcagtggttgggcagggtggggggattattattattctccttctttatggataaagagaataaagtctgagaaattcagtgactttcagaaggatggccatccagaaggtggggtgctacatcaaggtccacatttggatggccccaagggcagtgtgctttccatctacaatacgatgaaaaacaacccctcagcccatatctttctcacctctaaatgcaagtagggctgaagacgggggagagaggagccctcagtgtaacagcgtatgtggacatttggatggctgcaaaaatactggcctcattctatccatcccttttctttagactggtgaccttagacatatccagtaggaggagctctagtcacctcctccctttgtgtttatgtgacggggttcaagatttgcgcccatcagctttggaggcatatacttcttgcagaaaaagtgctggactcaggaaggagtcctcagactcgattcagggttggaacaagctctttgtgagattttgagcaggtttctttcttcttgaggtcagagggcatgggtatgagctctaagggcctgtctatctctggcctcctgccacatttccagggtcccttctgtgtgcctggccctgtgctcgatcttgagccccaggaattcatagtctaggggcaaattattcccaggcttcctccactgggaacaaatctatcttactctgtagttctcggtgaaacctggaggcaagtgtttgagcgtctctcttgtgcaaggtactttgtgcacattcgctcatttgcttctgtgtcacagagattgatatttccacttccccagggtggagactgaggctcagaaaggatggagactttcccaatgtcacacaggcaggaagttgtagatctcaaactcaggtgccctgcctccaaagctcttcctactcctattcccagattaggagctcaggtatttccagggccttctgcaggccaggcactgttctcagtgcctttcattccagtggcagagacagcccataaacaggtaaagagtagaagcaaacttacttcattctggtagctctctgggatgttctgaccagcgttgtccactgccaagcctggcagaaagctaggctgctttaaaaccctatgcaggggcagccagctgggaacagagtgagttgtcgaaacagctcccttagaagcctcaagagaaaacccagatttacagctttgagtctttgccagcagcccctgcttcatgcaggctgaaggcgcggcacaggtgcaaatctggccccaagagaggggagctcatgtttatgggtccccttccaagacccaggtgatcctaggggctagttaatctagaggcaactgtccctgccacttattgataacttgcatgagcctctgggcctcagtatccacatcagtaaagtagggttaataactctgctctttgcctgcgtcagggtttctgggatggtgatgaacaaggtgtggttgtgcacgtgttccaaaccacacagggcatgatcctaaaccacacactgctgtgagcacttttttttaatgatcagaggttggcattggctcagaggttttttgccatcagaagagtgatggaaaatgtgtgtcctgacccctgaggatgccacagtctcatcagcagccccactacactgaggagacctgaatctgtaatgtagctgtgagcattctgggtcaagggctgcagtgtgtatgcgcctttctactttggggatcctccccatggagcacgcagctgttcgctccctttgctccctcctcctttttctgcagtaagggctccttcctgttccagacacccaactggggtgagaagccaggcagaggccttgccttcacacagacctttttttgcaagaactgagcactgctcagcttgcaggacaccactgggcttggcatctgggtcctgcctgggtagcctggcttggtaaaccagtgacctgcaaatcacagtctgtttgaagggagagtgctggtgaggggagctccatttttcagctggtttatgcaggcacctgggagcatgacactgcctatttctaaacttttaggagcccatgctggcctcatctgcattcctgcctagctctttcccacagtttccttgacataaggcccaaggtaacaggtttctggaggtggaactgccccaggaaggagagggatgctgttagactccaggacagagttgaggctcagaagtgtgcacatttctagggagtatgcagacccaggggccagccctgtgggtgtgggcctggggttcctcaaactctgggctggcctgtgtaggctgaggcctcttgcttttactgagaatccacagctcgaaagcccaatgtttctctttttacagatagatatttgggttataagctacccctggagtgctgcattccagacttctggggaggagggacatgagcttctaagatttgggcaacaaattttgatttccgcagttgatatagaataatttgttggaaaccttcctcctccccttttgcttttcctttccctccccttccttcctgcctttcccttctcctcctcatctccctcctaccttctcaccagatctccaacccctaaattccaaagttagaaaggcaagcatcagccacagggaagtggatttgaccactgggcactcaaacccaaggcgcaggcatgtctctgctgtcattgcctccctctctcttgctccgggccccctcagcacaggcctgtctttgtctgcctccctccagtgctgcaggcttccatcaccctctcaagtccccatccagaggcagggctggcataggtgctcgcttgctcactcactgccctgaccctgagagctcctgcttctatgcccctagagctgtggctgagtatatggcacatagtaaatgctcagtaagatgcagctgctgttcatcttggccagaagtcccttagaaatcatctaggccacccacattgctggacacaagagaaggccagtgtcatacagaggggaaggggtgcaattaaaaagtcattgtctctaggccttacacaggaaatgggaaaataacagagttatttgcagagtaccattttctccaatggttcattcacatccgcagatgccagctgagccctgtcacgaggctttggggttaccaagatgaataggaaactacctggccttcagagagttatgtggtggaggtgggaaatgcatagacctaacatggcagcctcaaggttggccatagcacctaggatggtgatggaaagggtagaaggtgagactgtattatcatagagacccttgagggcctgagggtggagggtgtgctttaatccactagcccatgcaaattgttcaacaatgtacaagactataagaacaaggcccaagggtatcctggaggggatgatgtttctctcctctcttttttttttcttttattattatactttaagttttagggtacatgtgcacattgtgcaggttagttacatatgtatacatgtgccacactggtgcgctgcacccactaacttgtcatctagcattaggtatatctcccaatgctatccctcccccctccccccaccccacaacagtccccagaatgtgatgttccccttcccgtgtccatgtgatctcattgttcaattcccacctatgagtgagaatatgcggtgtttggttttttgttcttgcgatagtttactgagaatgatgatttccaatttcatccatgtccctacaaaggactggaagcttcggagcacctgagaacgggcgcacaatgagaagtgaaacaacttttgggactgctggatcacttgcacggtttagaaatggtcaccttacttgcactacggaagaaatctttacgtttttctgctccagaaaggttgcccacccactcttctgtgaataatgggcctacatggccccctgcaatgtgaggagggcaacttggaaagaacttatttccctccaagaagatgctcagttcatgctctaggtcagaggttggcaaactacagcctgtgagctaaatccagcccacgggctgtttttgtaaataaacttttattagcacacagtcacgcccagtcattaacatattgtctactacacagagcttcaacagagaccacatggcctgcgaagcctgagacatttactacctgggccatcacagaagaagtttgccaacacttggtctgtatcactgggcatttggttcatttgtttaccctaacaaatggtacccatttcaggtagaattacaggccctcatgcggccacgtgtttagcttcccctcctgtgccaaagctggccccaactccacactcccaattccacccttctcaaaagttcttgcccctaaaagtgtttcttttccttccatttctcctcccatcagcatccagagagaactttttcaaagagatgaagccaatccttcctctgcttaagtcccccgatggcttccctacaaacaaaatacaatccaatccctttcccatagcctgcaagaccctctgcaaattcacgactacttccctggtgcattgtgtgacaggcacactggctgcctgcccgtcactggaacagtccaaaagccccaccccagggccttcccacttgctgccctcctgcctgggatgctctgcccccagtccttctcctggcctgctcagagccacctgccattctatcacatcactattttttcagtctttgaaagaatactgcacacactcttaacttgttcttgttgttcacttaccgtttgtcctactagaattccagctccttctctctggttccccacttctctccctggcctgtgctcattctaatggaagtgtcagttctgggccccctaggcagccctgcctgccctttactgtcatatgacttcatctctatagtggaggggagcccagtgccactctgtaggtgcttctttcctagaataagcttcaggccctaaagttgtctagccttagggctgcccatgtgatgctgtcagcaaaactaaacatgttcttgcctcttttcctccctcaagtcaagcccttagagtttagaacaatgaacttggcctatataaaatacctccaggaaatcagtcctcaaacaccaactcccaacatctgctttctgaatatatggcttcaaacagctaagtgtacagtatctaactgctgtccatccttttgttttttttagccacatgacatctaaggaacttagaaaatgccttgccctttcctgtagttaaatttgacataaaattactttattggcagcatattaacaaacaaaaatctcctgtgtttttcccggtaattcagtttcagttttccaggtaagaaaaagataattttgaatgactacaaggagacagactgttttgaggtttctgttaataacacattcagagtgtgccttcttcctctgtcccagtcagtggtgctgttgacagagtggtacaacaagaatgaaatatactgtgggaactcaccctgatcccaacaccctcatcaacaccatcaccaccatcactattgctaccagcaccaccacctccaccaccactaccctcaccttcactaccaccaccctttaaatcaacaccattaccaccatcaccatggctaccaccatcccaccatcccaattgccaccaccacatccaccaccattaccaccaccaccatcatcactaccacccttacctccgtcattaccacctccatcacctctaccattaccatgattactatcgccatcccctctaccaccaccaccctaccacttctctctctatctctctctcatgtacacgtacatggttatatgacacttcatgatgcaatcatagacactgtccacatacacacatacagtgaaataagtacatgtttttaaattgtcattattttcaatatagaacctactcttgttgctatgtgctttggggtggggaacatcaacgtgtgtttatggccaaaattgaattaggattcataagaaagggctatatctccaaatgcgcacttttaaaaaagttaagtttggatgagggatctttcatttcataaaaggatatactgaggatttcctttcagtgacaaatttttgctgcattttattttgatttggtttacaaaagttagcctttcacacagctgttcaggagcgcagccaatgactaaaggcagatctgccttgaatagcaaatgctgctgagtaaaccatgttacaggctattttaggaccaccaagaatgtgtttgcattttcaagagtagaaggagagatcatatttatttggtatctacactatgccacacactatgctaattacatttctaagctcatgtaatccttacaacaaatttacgaaggctttactttccccattttgtaggtaagaaaacaggctcacagagggaaaaatgacttgcccaaggtgaccaccaattagagacaaggtttaaacagaccatgagggctcagggcctacctcaagccctctaatcaccctacactgctaagttcttctattagaatttgttgtgcagaaggttttcttcttcttcttcttcttttttttttttttgtataatcagattatccatttgcctacaaagcctatagtgtgcaaggagtgtgtagtggtccagtcagtgtaccctggcacttgagagctcattaagggcccaggagaatcagcaaattctcagcagccaagctaccctaacgtatatcatagaaactacaataggagatttcttctctgaggtcactgctatctggcactatcctgtgatgtatggtttggaaaaccgtgggtcaaatacaaccgtccctacaggcaagtcaaaatatcgtggctgaaactaaaagtgattttttatcctcagtctaagtgtgaagagctgaagtgatctgcctttcctttagcaccccagaattacctctgggttcattcggggaaggctggcttactgctgaggtgtccacacatctaccactatacatgcctggggttcttgggggttctgttacctgggctgaactctggagtcctgagtgccaagctcttctctgccactatctatatgacttttagtaagccacctgcaactccttcacctcagtttacccatgtgtaaatcagggaccccaagcaaagccctgcctacctcctaggattcttgttagaatcaaaggctgatgaatgagaaagtacactgtccactgaaagggcctgggattttataaaggcctgtagttggtaacaccaagacttggatctgaaggtctagaaaagcacaacatcctgagactctgtgtggatccctttagcctactgtgagtgcttatgtcatgtcatgaacatgatataccccccatacagccctaaaaagtctttgctactagaagccgcatcctgtatgtgtataaaaatacagaaccaacctcccaggtacacacccgttgcacaggcagtctctgctgagtcattgtgcagacacgtctcttgctgcttctggccatgttgttcccagaaatggctctagagggatttcccgcatggctgaatagatggggagcatacgaggagctcaccttttcagggttccagatatacagctgggccggaggggctgggaggcagaagagtgggtgcagcagagtaggcttgtggaagacaaagccttcagaaaagtttcttgcccgaggcaaatgcagtccatgctagatggtacattcccagccaggaagagagtgcaatgtcctctccaactcaaatggcagtgaccagtgggtctccccaaactctgccataggacattagggctttaccaagcactgtccaggttgcagttttagatgggaaagggcacttggccttgagaaggtacagaagccaactccctggtcaccgcatttgttcatgctttttcccttggccctcagcctctggatgccatcatttggcctggagataggaaaagtgttgcctacatctgcctctggtactagcaaagggcatggtacagtgtggtgcagaccagcagcaggaacagaaaggtgcttctctaaggaagctgcagagatttctctgccagtctggagatcagctttgggtcccagctctccctgctactcttccatatacctccaatgatgcaagtttccaagaagaccaaggctgtgaaaaacagtgtggtggttcctcaagaagttagttcaacataaaattacaccatgacctagcaattccactccttggtatacacccaaaagaactgaaaacaagtgttcaacaaaaacttgtatgcaaatgttcacagcaacactattcacaatagccaaaagacagaaacaacccaaatgtccatcagatgaatggactgaccaagtgtggcacgtccacacaatggaatattatttggccacaaaaggaacggagtactgaggcatgccacaacatggatgagcccagaaaacatgatgccgggtgaaagaagccaggcacaaaacgccacatattgtatgatcccatttatatgaagtattcagaataagcaaattcatagagacagagggtagataaatgtgttgccaggagctgggggtttccatttgggatgatgaaaaagttctggaactagatagtggtgatagttgcacaacattgtgaatgtcctaaatgctaccgaattgtacacttttaaaaagttaatttcatgctatgtctattttacctcaatttaaaaagagaggacctagaccatgggaagagtctttggactgactccttatcccatgttccctccaagtttcagctgctctgatgccaagactctcatggcatcagagctcaccagcctggctctaaatctactaagtggggtcgatatctctgcaggctaaaagttggcactcaggagctaaaatgtgcttattcaataagcatgtgacccctctgctaagctacagaggcatgttctggacataaattgttttaaatgtggccattgatagcagcatctctctttggtgtgtcctagcaggaagaggtcatagacaggatgcccctctagaaggttctgaactaatcaggtgtctctggaatcttctcccacctacatagcagttgaatttctcaagcagggaaatattctgcatggtctgaagcttgttgccattttatttagcctactgttggggcacagagagaggtaaggtcacctctggcctaagcttcaaagttcatccctcaagccttctaagacccggtacctaattttgttttaattttatattctgtttcataaagagggccccagattataaaagcttcagtcccaaaactagagacccaaacacctcactataggaaagaaggctctgattaaccagcagctgttttttttctttctctttattctttccagctctattgaggtataagtgacaaattaaaaatgtatatttaaggtatacagtgtgatgatttgatatacatatatattgtgaaatgattaccacaatcaagttagtcaatgcatccatccataacttcatctagttatatttgtttctgaactcatagaactgttttaaaatcatagaaacagtagaaggctggttaccaagagttgcagggggtggagtgtgaaatggggagatgtcagtcaatgggtacaaattctcagttataggatgcataaatttgggcaatctaatgtacagcactgtggctatatttaataatgctgtattgcatatttgaaatttactgtgagagcagatcttaaatgttcttatagcaactatttttctatttgccccatttaaactactctagttggtgtcctggcaatgaggaggactgtcaccttgtttcctgaccttgccactgcaatccaaatggggtctgtttttatcatgccaggaaaggagggggaggctgcgtgggttcagcaggggtgtctcctgactgtgccttccaggcagtctgtcactgtgtgttcccccaggaggccctggaccaaaggccttttcatctcagtaccccaatttctaacctcataaggttacactgaagatgaaaggaattgatgtagttaacagggctgaagcagaggcttggtaactagttgctcttgttatttcctctgcttgtagaggaagttggtatagtctctctctctctctctctttctctagctctggctctccttcaaccattgccctatcatctgaatggcaccttggcccatttcctccaagccccacttctgcttgaggacagggctctggaggctgacaaacccaagttcactccctggttccaccactttttagccagccaaatgcccttaagcaagtgacactccctgtcttcaactgggcaccctcatctgtacaatgagggtgggggtgatcacattagtactgactttcttgagtcactgggaacattaaggtaaagcctaaaatgcatttggaactgtacctgtcacttagtaagtattccaaagtcactcttgaagtctacttataaatcaggtctcccttactaaaacaaaaggaaatggagaaagagaagaaaggagaaagatgggaataagaaaggaagagagggagggatggagggagggagggagggaggaaggaaggaagacaggcaggcaagactctttaatctttgctccttgttctctctagccactcacactcaagttccagcccccaccaatttggagatgattccctgataaacctctaaactgcaggcatctctgttcttcatttctaagatgaggatgataatgggaatatctttctcatagagttgtgaagataactatgtgaatgcatacaaagtgcttagtaccacaatagtcatttgtgtcttgtgattccaggagttttgggcagaggattgtgtgccctggtcagggtgcccacaggcaaggttgccactgatctgatggggccaatccaacaggcatggagcccagaaacaggcttccatgtccaatcccatgtcctgctcttgggaaggctttcccactccgaaccacaaaaccactgggtttatctgggccactctgatgaaagtcacattcccctgaacaaatatcctcaccacaagggcacctgggtcatcctgctctgtgaagcactgaaagagtgaggcagaaaatggagtgactacttccagaaatggaatcacctcaagtcatatcaattctcttgggaagagccccttgggtttgtatagttctttaaagtctgagggacagtggagaggcaggtcccaaggagtgctaatgcagaagtaacatactatggcagcctggcatgggtcagatcataaggggggccagccagggcgtggaggcaggactggcagggcctggcagtaagaagagatattgctactgcattcacacggtcccaatcagaagtcttagagattatctgtagagagagctgtggctaccccatatagtacgtgacttccacacagcccaaactaccctaattaataatgacccagaagctgattgtttctagctctcagattagcagtggctccttattgccccagcttagctctaccagatgtcctgtccctgaaatgtaccagtagcccctctaaaaacccacttggctcatcagggcccagtccagggccctccccacctatcccattcctaatcccatcagcattagcgagaagcctgccactgcctcagggacctcgcatctggagactcagccaagatggtggcacctgtgagaggatccacaggtagccaagtccaggtagccagaggccaggtggcaatggggaagagcataagtgacccctgtccaatatgccctcatcagccaaatctggggcctcagtttgggctttgtggtgtgaaggtaccacccgccaaatgggcctggagccaccagcatagctgccctccttctccctgggtggccctggaggtgccacacttgcagcattcctgggtggtccttctgtgcatgggctgtaggtggaggtgtggaaagctgaagacagggtcaggcacagcccagggcagcctagagatatttacatcatgatgatgggattagacagcccactcgcttgtgcggtatctggacgccactggcttgcagagcatttgggggttactgcttgagagtgttttccactggtcttgtcactccctaggtgaaggaaagtctggcttttgtaggaactgcctgggtctctggtggagtatttccttcctcacctctggattattctgcctctttagagcattctagaaaaggggtgttttctcggttcattggccacacggcatggctgcatcctggtgacattttcccagcatcagatggttggagactgcaatgaggaggctccacacaattcatagccttcagccaggccccttgctaaagtgctgcatgggacggagaagaccaaaccaattggagagggactcgatggaagccacacatggagttttgtgttgttgtccagtacttactgtggttgccctgctcccattgacctggacgatccatgttaccatctgcccctcctcccaaaaaagggaagcttcctgttcttggagttggcactaggagccaccctcagtggcttaaacagatttcttttaactatgaggtagtgcactagatgaaccagactacaggagatgccagctctgtagccatcatttcacaatgcagccatacctaagagcctaggacaggccatacccggtgggcggagcagggatgggccacagctggaggactgaaagtgggatctcagcctcagttacagaggcactccctgatggccaggcagcaatcctgtggagggctttgtcatcagaaaataggagcccatcatctctggaaggttggaagcaccatggtgagatgggatgtgtgtccaagagttaaactggtctggagttctcttttaacaccatcatcacaccccttcatttaatctatgctggactttgaccataaaaaaccaaacttgaaattgggatccctgcaccgactggtgaggcacataggagagggttggtttgggttccatatgactgacataaagcagagcaaatattggcttgggacccaaaccaaccctctcttaggcttgttaaggccccattcaggatagttccctggaggtggttggagagctggcagcctttctggtgactggtgacctggtagtactctctaatagaatatgtcaataagcacagctcatttgaccagaattgtaggccgcctttctcgatccaacaggtgcagacctgctactctcaggattcactttgctagtctcctgcactccacaccggatcccaaagtctatgttcaagtaatcccctatttaaatgtcatagatatatttggggaggctcataatttgattcaagtaacagtctgatctgtgcctctcactgagctggtgcaggtaatactttctttaagagtgtgtgcaagtggctctcctcagcctactctcacccccagggaaagaagccctcgtggatggaggaagaagatttatcttttctctacaagagcagcccaggaagaaagcatcaggtaagcataagcttaccaaagctgggacccattcactttacagtggggaaactgaggccccgagtgtgaaagggacctacaagaggtcacaccacaaggtcctttaagagaggcagagcccagggagaagtgagaaggttgggcttaaatgatctctgcccggtggccctggtggcctccaacctcggttctgcctccacttctccctttgcctgtgtgattttgggcttgttagccaaatttaggtgaaatgtagattaagcttgtgaacctgggtccagcagaagtggagtcatctggattgggacagggccctctcctttgacctttagcttctattacagctacctcaggcagcacctacttcctctatagatcaacctcaccaaatccatccagatgtttctcttctccccacagtaatcatctctatcccactaatgacagaacctgggaatgtgtttggggaagactgggtgaggatttcttcctgtgaaaacagagtacaggcctcaccaggcttaacatgagtgggtgtgagcagcccgtcttgaagggcccagcagttctgacggtctaggagttagaggctagctctcaacaaatgcttgttcaatggcagaataccttgattcttctcaggagatggtacaatacaaattctgagctcattaaattcatatacatctataggttgaggatcatccttagagctgtcagttcttccaactggcatgtctacactacagaaaaggagaaagtagttctagaacactgcccacccaggtttgctcatctctgcctttgtcagtgcacttccagccactccaggctgctgctcagatagttctggcagaagcctgttgaagccccagccctcaggtcagggtggctaaaggctgatgactgtggcagccttcagagtggcaggtggtggcaagcagcaggaggcaggagtttccaggctcagccaccaagacagcatccctggctgtcaggtcagtgctgtcaggtcagtgctgtcaggactaagctgcttgcctccccctacttccactccatccccctatcctagtgaatgcatccttatttgtaagaaagcaacagaggcccaacacgaagacacagggccttgagaatgatatcagtagtgattactgctccccaagtgctctcctcagtgagtacagtggaacctttcactaatgctgtgaagcacacatggtgggccaagtacccattttacagaagaagaaattgagcttcagggaggggagtggcttgcccacagccacacaacaaacggaggagctaggacttaactgcaggtcttctcatgtgcattccagggccccttcctccaccgcagcctgcatctgcctgcatcgagtgctggttcagggcgaatcagggacaccaataaatccccgatttgtaggtcgaggttcttgctccaaaccacccattatcagagatttgctcctgagacataactgactcctcttgaagccaatcagcattagcattcagggttccctgccattcccaaccaccctggtattctccagagcctcatgtcttgcaattctggaaatgctcaaaatcctgtttgttctacagaaagatcagtttcagtttgctgggacattctgctgaaaataaacatgtaaataacacatccccaaatacaggcattgatactatacacacggatattcctttgatcccatgtgcaaatgcaaacatattcattctgtctttctctcctcctcgctctcactctctctctttctctccatcccccatctctttgtctcttcaaacccattcctgatacattattttcttatctattctacagctacctccatcatgccccacgacatcttcattactttcttctgagatagtctactgggggccatccttgtcctcagagggcttgaagtctaatttagttggccaacatcaggtgcctcaaaattcatagggggaaaatgtaacaatattgaataaagttgttcatggagtatggatgtaagggaagagactaggagaactggctagcaaattggcctgaactgaactggtgaggcactagtgaagaaagagcagactaaataaaccacaggcgattttcacctttttgacaattttgcccagggcctacaagcccagtgccctctggagggaaaataagtctccctgagtttatctttcctggttacctttgacctcctatcttcttgcccaataggaacagtgcataccctttgctgacctttttattggtgtccatgttaaacctccaactacagtgtccaaaatcaagcatttataacagcctgccagacttctttggataagttatattctttattctccttatgctcatttcatggactgtattcgtataatctctaccttctctaagaaatttttccccttttttgtcattctggactagaactatagaaagggaagagttgccatatgtcattgttcagacagaaccagaaataatgttgacttcagagctgaacttgtctctatcagaagagaaacctttgttttctcattatctagggggtggggaggccatcacatgccttgaaatgcattttaatgaatgtttataaggtcatggggatcacattggtggctttgtctgccggattctgaaatgggactctgcaggcatttatgtatggagagaaaggaattcgtttctaaaagatgccagggcactgtcactcactccctcccccttcctcaccaccaaaggccgggcctgtgagggctctggctgggagttgggacgtctggggtccagtgtccttttaactaattgtctgaaagcaaatcgagatatgctctgaggaaatcctgccagtggctactgattgtcacagggagaggcctgaaagaagtaggagctgtgggacagctaggactaataccctgctgtcatcaagaccgcagagactggagaaaagcacatgggtgaagcagggagattcatttagaaagggctgggagcttggttggggaccttccgcccctaccaggattctgggaggggaggtcattccggagcagtgagctatctcctgcccttgatctaaaatggtggctgtgggatttagtcagaaacacccagtctgggcaggcaaaacctcagcggcatcagccacaggcacaggtgacccagtgaaggcacgagtgtggcactgggcacaggggaaagcccagccaacttctcgcagttgagatgagtaacagatcatgggactgtgaaagagaagacacgaaagcaagtctttatctaggggcaaaattaactggataatagatttccacgcctcactgatgtctggtgaaggcagacgctattacagcaaggctgagccttccgtgtaaacacagccgcctctcctcggccttgtttagggttggctggtgttcttgctgttcagccagggcacttcaggctcactgttgaaagctcattccatgaaatccaaaacatggagctgcatggcctctgacaaagtgagttctcactgaagtccattgaaaaatgaaagctcagaagaggcttgcagcttgccactctgccaaaacagcagcctctatcggcaccccaaaccccacccctgagaaaagccaggtgagcctgccccctttattaggcatccttatgaaagtcagtgagtgtacatgccagcagctgtccagccacagacttggcatagcaaaagtggcatccgctccagcagtggcggcctgctgggatctactttgttattgagtagtcagttggtttctagaattggaattgatcagggaccatttgcttgggatgcagttgatgagtgctggaaaaggtgtgtgtatacgggctctcatgtaggagaggtgcagcctccttccctttgccagtggccccagctggtacctttagtgtctggtggtcatgccctgcctcctccatccctgcaccttactcccagcaggttagtggcagaccaacaattaagtgaaagctctgggagcccatagaagctgccagcaaatttcagaggctcacgtggcagggatgccagaccattgcccctcacagccccttccctcccttcctttccccaacccccaccccctccttggcctgcctggttctgcattgcttcgccattgttaaaactgtcttgcagttcgagacatcatggacagcactttgggcctgactgttgccagctcagactccctgcaggggatccttatgtcaaatccacatgcaatcatccctgattgatctatttcatacatttctatttttaacctattggattctttgggagaatgtagaagagacacaatttcagtttgggacccagtggcttgtttgtaggttactccataatggattgagtaaatggctgagctccctgtgtgttgggtaatttatgttcctttgtccattgattcgttcaactgccatttactgagcacctgctgtgggccaaacagttagtgagctgctccatggaccagctcagggacactatgggtgctgtgcccagtcagactcctgggaaagtgggcactgatgactgcatgggcctcagccctcttattgtgcctgctctacacctctccaacccattcctgcctgacccatggtattcaggcctcagatgagtttggtgacagagctgtcccttgaagtgcccttgttcagattgtgggcatctcaaaagaaaagtcaaagaagtgtgcaagtcctctcactcaagttggcaagccccttctgtgggggcgatgcagtgtcctaccaacaacatggcgaaggcagtgggtctggaggcagctgagtggtggtggaggggccctgcatctgacctgggccttgttgccctctggctgagcaactctgggtaaggcctgcccctctctgggtctcagagacctctctgtctttaagaagggtattggactcccagaacccttccatacctgccctttataatgccgggtaccagttagtgaggagctattaggtgtcatacaatgtgccccgtttcacttaatagtcagagcaccttcatgagaaaagaactataattacactcattttacacataaagaaactggggctctgagaggttcagtggcaaggccaaggtcagagccctatgccacgctgcctccacccttgctctgggccagtggttttctgttgagaatcagccatggagctgttggaaaaactcccgatgcctgggccacaccctggatgaagctgtcagtttgtggtgggagggcccaggaatgtggatgtttctaagtgattctgatgtgcaccaaggcctgagacatacagccctggggatctgctttgatgttcacttggccatgacagtcatgcccctcatcgtgctggcaagtggccccatgcatgccttgagctcctagtgggctacaagctcatcaaaccagaagagccaaacttaaggtgacatcagaggatgagcactgtatgtcctagtgaaacttccaaagctggaaaggggttatttggggggtaccgggtgggggaagctttaaaagaattctacctgttcacctatcggcattcaggtgatttccagatccctctcttcctttccttattttgatcattcctgcacatactcctttgcccccacttcctttcccatttacctgctaacatacaggtcatggtcattaacacaacagcgatggatgactgtatgaagccatgaagagtaggaagtctcacattgctagtgactttgctttgttcccaaaggctgtgcttctataaatgatgggcagctcccccaaggttcagatcccagattggggccttttctcattgtttaatatctccccaacctgaggatgcatcttcagaggaaaatttcttatttagataactttatacttttttaaatttttggattatgagtcgttctcgttaaagacaaacaagcagaaatgaagagaatagaaagggaattgccagtcatcccaaataaatgaccactccaaattgttgggtataggttcttccaaattatttttgtgtacacatagcaatgtgtgagagtgtgtgtgtgtgtgtgtgtgtgtgtgtgtgtgtaaaaataaatggaacaatgaatacgatgcctacaatgactgttctgaaacttgtgctttcccaaaaacagtattttaaacagctccccaagaaaacacatccagatctacttctttcctgtaagggctctgttgtattcaattttaccactgcagcctgatgcatttaaccaagactagaaggcagcctaaaagttcaattctatactatggtattccttcgttaaaatctatgtgtctgtagacaggaaagaattaaaactatttagctacttctagttttctctccaatgcctgcctttggcagcatggttcatttagtgacttctgcatagttttgttgaactctccttgaagtgggcagattaccctttgaataacgttctatcccgttttagtatacagacaacataatgccttatttgaaatgtaattagacagtttagatgaaacataataatgaataaataagcactatggttccaaagacaggctgtattttatagttttcacaactataagtctttaaactgagaggtctgttttatcatgcacatttcctgttcattagctttaatgtgccaaacctttataaaaattcctctctctctctctctctctttctctctgtctctctctctctctctctgtgtgtgtgtgtgtgtgtgtgtgtgtgtgtgtcacctctcttcccttctcctctcctctcttctcctcttctcttctcttccattcacagggaactgttaagaggagacaagaagaagaccacttccagtttccagacatggctgatgggggctaccctaataaaattaagaggccttgccttgaagatgtcacccttgcaatgggcccaggtgctcatcctagtactgcttgtgcagaactgcaggtccctccattgacaataaatcctagccctgcggctatgggagtggctggccagtcattactgctggagaataaccctatgaatggcaacatcatgggctcaccatttgtagtaccacagactacagaagtgggactgaaagggcccactgttccttactatgagaaaatcaacagcgtgccggctgtagaccaggagcttcaagagctgctagaggagctcaccaaaattcaagacccttctccaaatgagctagatcttgagaagatactggggacgaagccagaagagccactggttttagatcatccccaggcaaccctaagcacaactcccaagccttcggttcagatgtcacacttggagagcctggcttccagcaaggagtttgcttctagttgcagccaagttactggcatgtcacttcagatcccatcctcctccacagggatcagctattcgattccttccaccagtaagcagatagtgtcaccgagttcttcaatggcacagtccaagagccaggtccaggccatgctccctgtcgctctgccccccttaccagtgcctcagtggcatcacgcccaccagctgaaggcgttggcagccagcaagcaggggtctgctacaaagcagcaagggcccacccccagttggtctggtctgcctcctccaggactctctccaccttaccgcccagtgccatcaccacacccaccaccgctgccactgccaccaccaccacccccattcagcccccagagcctcatggtgtcctgcatgtcgtccaataccttgtcgggtagcactctccgaggctctcccaatgccttactgtcaagcatgacgtccagcagcaatgctgccctggggcccgccatgccctatgctcctgagaagctccccagccctgctctcactcaacagccgcagttcggccctcagagctccattcttgccaacctcatgtcctctaccatcaaaacccctcaaggacacctgatgtctgctctgcctgccagcaaccctgggccgtccccaccctatcgcccagagaagctctctagcccaggcttgccacagcagtccttcaccccacagtgttccctgatccgaagcctcactcccaccagtaatcttctaagccagcaacagcagcagcagcagcagcagcagcaagcaaatgtgatctttaagcccataagcagcaactcatccaaaaccctgagcatgatcatgcagcaggggatggcaagctccagcccaggagccacggagccatttacttttggcaacaccaagcccttgtcccattttgtttctgagccgggtccccagaagatgccctccatgcctaccacctctaggcagccttccctgctccactacctgcagcagccgacaccaacgcaggcctcctcagccactgcctcctccacggccactgccaccttgcagctgcagcagcagcagcagcaacagcagcagcagcctgaccattcttcattccttctgcagcagatgatgcagcaaccccagcgttttcagcgatcagtggcctcagattccatgcctgctctgcccagacaggtaagacaatctcatatctggctgtgttcttttgttttggaagtaacaactgtgtttcatgttgccaatatctggctctggagggtaaatccaggctatagttctctctgagactggaaaagactctgaaaaagtctactgaagtcagctaatcctgtgtggttaaaagcacagtgttaataaggccaaggttatggtttcagtgcctgttcaagtcacctaacttccctagaaggagagctgcacccacaaggtgctcccggtggaaggagccaggtgggacaagtccgaatacagaaatgccttccctgcactgggccatgtagaaagactagtgaatccttcttaagatgtaaggaaattgcactgaagcatttaatcttatccctgctggcagaaggacaaacactgagccttctagaaatgccacagcaaacttttgctgagcaacctcagcatgccatttgtcactgtgctggatactcagtcaggtcgtgaaaggaaaaagacaggtatttgcaaggtagtcactctcatcatctccattttacaaatgaagaaactgaggctcagagagttgaaagacttgcccagagtcacatagttcgcaagggacagagcaggaacttgaagccaggtggtctcactccagagcctgtgctcttcttgaaattacttttgacttctcaccctccctcatctcctccaggcttttcaatcatgaaatgcagctgattccacctgggtcgtgtctatcacagttcccagttttcatttctgtgacccctgcctgtattagttatctgtggctgcataacaaattaccccaagcaccagcttcgaaccatatgcatacgttaccaccacatcctgatttctgggtgttaggaatcctggcatggtttaactgagtcttctggctgagtatctcctaaggctgcagtcatctcaaggctcagtggggaaggatctgcttccaagcccactcatgtggttgctggcaggaagcagttccttgcaggttgttggactgaggcctcggtttctcatgagctattggccagaggcctccctcagttccttgccacacggtctcttcacagagcatctcacaacatggcagctggcttcatctgagtgagcatgagagagtgtgccagtgaagcagggtaatggggagagagggaggagggatagtgccagcaagtcagaagtcacagtctctatgacctggtctagaaagtaacatcccaccacttttgctgtattctattcatgagatgtaagccagaggagattgcatgagggtgtaaataccaggaggcagggttcagtggggccaggtcacacgtgtgcctacacagaatactcagtcaccatctaccatccctccttcccattcctctcatccttgcccaagttcaggtcctcttgattctttatctgaactcatacagttgacccttaactggtctctcccaataaaccatccattgctctgagtcgtcttgctaaaacagtgacctgatcatgttttacacttgctcagaagtccccagaggcccataagctggccccaccagcctcctgggcccttcagcatccatcaggccctgccttgcactttgtttctattacccagaagtgcctgcagcacttggcccacgccatctggtctcagcctttactctggccgttccctgggcctggtcatcccttcccacattttctctcctgtccaacacctgcagctacttagggctcaggcaccatccctccaggaagcttttccatgactgtcctcagtacttccatttcccactgtgcctccctcttctggagagtggtcaaggaggagattataaagtgcttggccagagacctggcccaagggaagcacctgtcaagggctgacctcttatttaagagctctgtatgagcacacctgtggcaacccctagagtacagaggttgtgtcttttccatccaggtttcctggagcataaccatgcagagtgcttgacaccagggagttggtcatttgatagaccatgcggcaagcagagctcccatgggggtggccgggggagcggtgtggagataggcaaagcacataggacacggcaggccacctggggctcgggccctggtctgcagttcaggagcactttggtttgattttattatagggctgttgccatctgtttgcatggacttctgcagctagctcggtgaagccccagcatcaacacgggaactctttcactagcaggcaagatcctcagcctggagacgtgtcaccgtctaacattgtgagcctttctgttttgttttgtcttcaattgggtacatttttgtagactgattgtgttgtcccagagctggatcagctggctcagagggagaattcttaattattggggtcatgcaaatcatacccaaccaattacctaggtggggttggagaaagtgttcaggagaaagaccgaacagtcaagctccctggggctaggagcacaataaagggggcaagcgacttttgccagcagaggcaagaagctgggtccccaaattggaaatgctattgccaccaagagctgcctttccagcccatgctggcctgtgcccaggggccaggcatgggacctggtgcttcacctgcctcttctcattttaatcctcagaggcaggggctgttaccattctcctgagagttggggggaaaggcacagagaagtgaccgaagttgcccacagtcacacagcaagctggggccagagcagacaatctggctacagagcccacactcatactcccatgcatggggcactgcctctgtagccttctgtttccactgtcacctcttaactgtttcctcctctacaaatcaaggtgatgataggttgtctgaggactaagtgtgttaatacatctaaagcactttgaacagggcctggcataaagtatgtgctgagaagggatttgctgtcacgatgactctacctcctgaccctgtgctcccagatctgtttcatgggactaagatgtggttctaaaaaccagtagctgtggcaggacagacacaagccacgttatctccagaccctgtacccaccatgagattgataggagttgtgcagcctctgagccttgtgggctccttttgctctaggccctgcctctcctggacaactcccagcctgatgggaaaggggaaaggggaaaggtccatccctgctttgcagactggggatctcactttgctctttcttgagctctccggcactctcactccgctcctctccctagcactctgttctctacctggtattcttccaggcctccaagctgggggaatctcaacagtccttctgtttcttcttatggcctctccctattaactctaagacctaagaactcagccctggtcattcttccaggggagagaaaaaaataaagaaaaaagcgagtgtttgaggcaagagctgggaccgctgtagaaggacagatggtggccccaatggtggggaagaacatatttcccacttccagcaggctaagcaaacctcccaagttttactgatggccaagctgagcctcaggaacactaattacctatgatatggcatttactagcctgttacatttgccatggacgataatggttaccatggaaaaactggacattcatttgaatctggatctttgaggttttgtgcggggggtgggggcttttttggtttttgtctgttcatttctttagaggcagggtctcactatattgcccagtctggtctcaaactcctgggctcaagtgatcctcccacctcagcctcccaaagcactgagattacaggcaggaaccaccgcacctggtctagatcttagttttctaaaggagttatttttaaatgtgagatgagacacaaacgcttgagtaagctgaaaagccaaatccagccttctatagaggagctcatttttatgtacagaccagcatctctctatttggaggattttgctttaccagttgagtgaactattcaatttcaatgcaccattcatgtccacgtaaggtaaaaggcaaatgccacatgactttggggcagctgtttagcatgggaggttgagcaagcaagggcactggaggcagacagaactgaggctcaagtctggctacagatgctgactgattcaggtcccatgagcaatgttactcaactcctgagcctcagctgaaaatggggaaaggaatagtccccttcacttagggcattgggaaggcaaaggagatgctaacctgaaactgcttagaacggtgcccagcacacactacaggctcaatcagggctagggcagccttgtgggcttggacctgaaacctccggggcctgatgaatttccaaattcagaacatttgggactttgggaaggtaatgtggtgcaaataccaaatgtcacacaaccctccagtgtaatctgaagcagtgtttcattacttttgcagagaaatatgaatatttaaggaagtccagagtcaacttttgcccccacataaaatttggcaccaaatttacaaaagtaaaattggctttcagagcttcttggactttaaattacagataagggatgtggacctggaattattaagggagggatctttaactctttatggagttgcaacacccagcactggtttgtcagattttaatgaccccaaattgcgtcactgaattccccaccctccctccaggctgggtgatatatcttgatgtttaatcagactgaggcaaaatgaattttgtttgcatcatctgatgtcccttctccctgcagattactggagataccttggcgtgttgcaaaaatcgcggttaggacttacttcagtttcactattcacgactgcagaacagatcttacatttactcaaagacacaaacaagtatgtcaaggagatgggagttggactgtggaagactggggatagcaagaggcagcctctggccagagtgccctcagtgcacgtgcatttgagccccactcagatctgcagagctgggagtgtggtttcatggggaggagggatgtggatggaggccagttggaataagaacaaaaaaaagcctggaatctgatccttgaggcaggctgtgcagcacagagggaagagggcagctgtggagaaatagaccaaggaggcacatgatgttgttttgacaaatatggagagggtagagaagggggaatcaaacctgccttggagaaggctggattaagcccctactgggtctgatatgctttctatcttaaggataagctttagcttaggcagtcgtgagcaccaggcaattgcagaggcagtgaactcaccatcttccctttctgaggggttgggcctatgaagaggatctgggcagctccctctaaagtggggccttggggaagcccccactatccccacctgtggcctctctcacccctggtagactgaaccctccgaagtgcagtacttccagcacccagggcctgaagatagatggcacagggcgggggacacaggggccttaccctggggccttggcaggggacaggccctggggctgggctcaaggccaagttcaagaaagctcagactttggatcacttgggtccaaatcccagttctgccaccttttccgcggggcaagcgatttaccctttccaggcttcagtctgtaaaatggagatactagcatacctatctcatggggctgctgtgaggattaaatgagatgaggtaacagcgcttggcatagggcctggtacacaattatgctccattgatattagctgtcactctcaggaaagttcccgaaacccagaacaccagtaacccaatggaatgaatttagtcagcctcggctcagcatccaggctcctctctgacccccaggggtggacggtgacttggagagaaagggcaggggagagctcagtccctctggggctgcgtgctcacggacagtcccttaggggcgttaaggaagacttttgccaggtggctgaggagcagccaaggcagcagacacaggttggtgactccagaaggaagtagagccgccaagccaggctgtggtttcctgagtgcccctgaccgtgggtaggggagaatgttgtcttctcttccctctaagcacggccagctgaacttctaggagttacatggatgctgaataacaaatgcaaccacaggacgactttaggtgggcagagaggagggggaaggaggagctaagttccacctgcagccagcgtggatctgaccccacctgcttgcagcaggctcaggggtgcctgacatttcaagactcaggcagagggcttactgatacacagtgacaatgaacagggcggaaagcgtgtacatgagtggccaggaaggaaagctggtcctgcatagtcatggcgcacagagcacgcatcctgaggggatacctcccctctctcctctcgtttccgtccttcttctgcaccactgactctcactcctaaagcctccaaaaagaatctttgcagaaacccaagattccttttggtttgaacttccaaggctacactagcccactcagtagggcataacctttaattactgctgtctcaattagctctgcaaattaaattctttatatttgaaccatgacttttcatggaaaacaaaaaggaacaaaccaggttagtgaggccaagagaatttccgattctgatcaaagttacatctgctccatttacaactagagtcaggagaggcagagacagcaagtgagccttttcctagtctcagaatcactcattaacattttcaaaaagtaattattatattactaaaatacatgacctccaccccaaaatcagatccaccacatattttcaaggaagggcctgtcaccttggacttacaggtcttctccctcacttccctgcattcctctctcgttttgagagtaaggcttgcgggaaagcaatactgctgtctgtgttctcagagaaattttgtcttttactaattctggcgagaaacatcacagattttatttcaaaggttagtcctgctaaaatgcaagaacagaagcctctagaggaatctctgtgttgtccaccagtcaaatgataagtaaggaagtgcctccacttgccagataaaggactggggaccaggcagatttcaaagagcccgtgggtcagagccggggcctgccctgtgcgtattctctggcagacaaggaaatgttttcctgaatgagcattcttattttgtatttaaacatgatggtacatacaagcttagttttaccattctttctaaattaagctgcaaagagctgtttggtttcgggaaactttttcttagctgttttgtgtggaactatgattagacaccgtgtaacatgcattttgaaaattcggggaccgatatctcagtgttgaaaatgttttgttttaacctctctaaattgccaggaaatgaaaccacatgggctgttgaatttgggaaacacaggcttagaacttggtattaatcttaccaagaatcaaaaaaaagtttttttttcagtttctttttcggtttctaagggccattagtgatcctccacctcaaagctatttttctttttcaaaaagcggaaatttaaaatgagctgcttgttaaatgctaaccttttaaatgtcaacattttttttctattaaaagttaaagaataagtgagacgacactttcaaatgaaggtgactttacattgttcccctggaggaatgagccatcagttagtgtggtcaaccccaaaacttacggggatgcacaaggccgcctacttaagatgcatcagtagtagagatcaatagatacaatttttttcattgcttagtaactggcttatgaaagctgaagaggcaatcattttcagaaacctcctgtcaagttttttgttttgttttttgtttgttttgtcttaacatatctgaagagaaacaaggaaacttgctgaagttaggacacccaaaatgagcccttttaaaaatgaagtgcacaaattattttatgctaagttaattaagacaacctacttatttgtcactgtaaagcaaggcaaggaatctcattgcgcttttcaaagaacgtaagaggacagaaataaatcattgtgtcgtgctgctttaagctgtatctccttatgaatacctacaaacccaaaacacagaacaccatatggagcgagcagtccagttttgcgcacacaacaaacatgaaagagaagtgctgtcgctctactactactatgtccccaggtgaaaagttcgcaaaatgtaaacaagatctagagcagatgaaactcacggtagacttgctccattcagctgtggccctaacacctacagccagcactgtcactgagtgcaggagtggatggtgcagagcgccaaggggaatcaaagacgtgacccttccatccaggtgagcaaaggatgagtactcagagggctggactgcaccctcccctccccatcctgtgcttctgactctcagatccacttctgactctcacttccagcttctgactctcagatccactcatggtcccatatcgtggatttatggaatcctttcccgagtctatttgtacttttagcctgttctgtcccttagggattgacaaatcccacgatctgggcctgccctgtaaaacaactatgtggggcctgacctggctgctttttagcttgaaggggatagcagagggtagaatgctggttacatttaaagcaccctgctcccagatccaaaagaaagtttctgctttttcctaaggagttgaaacagtctgggattttatctgattttgttattttgcctacaatgacaaacactgcttttgtttgttttatcatgttgtgttttttgctagatgagtgtttatcatgccggctgcacccatccaaagcagtaaggttgttgaaagccaaaagcagcagaaaggcccaaagagatcaccccacctcacccacaggctcacctctgcaggtgtcttcagacagctgactcttaactctcatctcagcaacagtttctaagatagagagtggaataaagagtcagcattcatccatttcttcgatgttttctcctttaccccatgtgaaccaagtttcttggtaacgtgcagctaggactcacacagacgaaaagcacagagccacaggccttggctgggttattggagctaggtgcacaggaaaaataaaagtgggtgctccaggacattatatatatagtcctgggctaaaggtggccttcagggcctgaaagatggatagctgtacctcactaggaattatcccacctcttgctttgcttgtgggagctttcagtttgcagctaaaggctcaggttccggccagctttttcccctgtagcatgctaccaaatccggccatcttccagttttgagcagaggaggtgagcgtagctgtggagacacatattcttctgcaggcccatgtcggggtggcccatgaagagaatttgccaaagccagctggctcagcagaccaacagatgaaggtggactactcatttgcaattgtgattaatgatcatttatttccatgtgacaaagctttgaacgatgtgggaggccctcacccatccctgagtgggaataactgggaatgattccatgaccctttccctttatctggcaatcctttcaaagatgagctctggaaaatgtgaacagacaatgcactccactatagctttctagtttcacatcttcaaacaccaaaatgttgacacccattgggatggttattataaacacatacacacagagagagaaaataacaagtgatggtgaggatgtggagaaattggaacccttgtgcattgttggtgggaatgtgaaatagtgcagccactgtggaaaaaagtacggcagttcctcaaaaaattacacagagaaataccgtatgatccagtgattccacttctgggtatatgcctaaaagaatcgaaagcaaggctggacacagtggctcacacctgtaatcgcagcactttgagaagccgaggtgggaggatcgcttgaggccaggagttcaatgccagcctgggcaacatagtgagatcccacctttacaaaaaattacaaaaattaaccaggcatggtggcgttgcctgcagtttcagctactccggaggctgaggtgggaggattgcttgagaccaggaggttgaagctgcagtgagctgtgatcactgccctgcactccagcctgggtgacatagagagaccccatctcaaaaaataaaaaaaaagaaagaaagaaagagagaaagaaagaaagaaaaagaaagagagaaagaaagaaagaaagagagacagagacagagacagagaaagtaagaaagaaagaaaaaagaaagaaagaaagaaaaaagaaagaaagaaagaaagaaagaaagaaagaaagaaagaaagaaagaaagaaagaaagaattgaaagcaggggctcaaccagttatctgttcatagcagttttgttcacaatagtcaaaagagagagacaacccaaatgtccatcagctggtaaataaatttaaaaaatgcagcatgcccatacaatagaatattattcagccttaaaaaggaaggaaattctgacatgtgctataacatggatgatcactgaaggcattaagctaagtgaaacaagccagccaccaaaggacaaatattgtatcattccactcatgtgaggtccctagagtagtccaattcatggagaaaggcagatagaactgtgagtgacaggggctaggggagggaggaaattaggagtgcatgtttaatggggacagagtttcagtacaggaaaatgaaaaagttctggagatggatggtggtgatagttgcacaacactgtgagtgcacttaatgccactgaattgcacacttaaaaattgttaaaatggtacattttatacatatttttaccacaatgaaaaagtaaaggctgcaattttaaaacacttgctagtcctctcctaatcaaaagcagtcttttcttttgcaataatattagtgtacaatctaaaagaagcagcaagctgaactgctcattttccatccctggtaagagcagtatttactgcacatccactcatcatgttgtatgggccatctgggttttttgtatgtcttactgaggtgcatgtttgttaaatgcacaggcataaccagaaataactttcctggaaaattgagcataatggctgtccctctcttgacattttggagaaatgataatacgtaggtgggggaaacaaagaagtgactgtaaacaagaacggacattatctctgcttctgaatgagatgagaaacccacttgcttcattagctctctggtatatctgcaagtctggaaacaccgggatgactcacagtttgctgagtaatacaggagccgacagaatgctgctagtgactcgccatctctgactggctttctgtgcaaactgtcactctagagcaagtgctaggccttggaatagagttctgaaaaaggttacggttctcaactacagggagaaccagctcctaaggccttgacactggtacacaaagtaggacacctctgaccaatgccaaaatgacttttagaaagttcacacctggtcattgtgtccctgctcatgctccagctcacaagatctctggtttctgcctttcagggtgtggtgatgtccacttcttcatcagagttctttgtgacttgtctgcttctccacttggtagtaaactcctcaggcataggaagacgtcttcgctagctctgtaatgtaagctgaatgatccttggaatgaatgagtagaatatagaggggaatgaaccaatgaatgagctgtatctgctagccattgcggaatgctaagttttggaaactgttttgagcattttagaggaagtattgatagacactctcagtcttcaaggcttggaggccgatgaacccatattcttgcactgggcagaaaggagaactttgcatctgcatgtagggcccatttacccactgaccatgatgcatttctctggtccagttaagctccttatccttctatagcacttgtgcaatgtctgaaaacatgtgatttcttcaacttccaacaagtacacaattttataccgccagtggtaatttgtcctggtggttctgttgtttctgctgttgttgttgttgtcgtcatttaatgcaatttacaaggacaaaacaaaacttctggctgccatttcacataccacagtgacagcttcacatggtaagaaaagccaaaaacagctagtttcgaaattcaggccactcattttattacttttccctgattaagattcattcataccactttggggtggtgctgatattcctaacataagccaatcgattttggtcagttctgagagcagtgagtggtcttcacttacacacagtgtgtttgtaactctgctatttctttatgactagcacagtataaagtgaacgtttttggaaggctgttaagcatatgttctcctggtaggcttaaatgtgacttataaaaatacttgatagtatatgaacaagctcccactactggtttaaaccaaaaaaaagaggtttattttactagctcataagcacagattctacattctttgtgagaattatctttttaggtttttgtttttatttgttcttatcattttgatagccattttaatcatttcttttattcttttgtttgctttgttgacttttaatttggaaatgtctgctttggcagaataattacatcacaaggaggccctttccccacccacctacccagaaaggtctcctgactcccttatgctctatgaattgccctagttcaagattgatacagatcaaagcagcagaatggggttgaaagagcagcctctggcaatggccttgaccatgtcaattccctgtgcattcatatagatctggaatcatgtagatctattctgcccagcttgttccacagcagctggtgggcagaaccactcttccaagccgtgtagttattctgcactgcaagaggcaagattacaaccgaggactcattcattaataaaattgtttaagttggctttctgaatgacaacgtggtctcaggaacttaaaagacttcaccaagtccctgctgcaaacaaaaagtctgcattgtgatttgtcagagctagattgacatccagtttagagtttagaatccttctccatgccccacttttgagacaaattacaaatcttgaggttcatcaacattctagtacaatatgaccccccaaggtttaagagccctttagagatttgaagacaactgtgatgttcccactaactctccctccttcccccagttctttgcccctatcttggctgctggcctctgaactcatcacagagcactggagtgagggcctctgggtaagtaaggctctgctaaactgatcaaatgctccacgtacatttgtcccagtagagaggaaagctcctcttttccaaacaatctactttattcctgctcccctacatcccacttgcaagggtagcagccacatcccccatctgtcctgcccgagctcattgtccaagccaactccagctcagaaatttcccccagagaagaggttcctgaaggctaagcattgctctgtaaccctgaacttgatttgtgtctatttctcactctctcattatataaagtttttcaaataatattagactaggaattgagaaagagaatgagcgctcacaattgtttctagagccatcacaatcctacccagcaacaccttttacgggcttttaatttttttgtttacagttattacctttgaaaccaaatcttgactttctggtatgctcttggactttttaagggatttaaaaattcaggagtttgatgccaataattgcttttatgagctagcattgcttcttttctatagatgaatcccattttaaatcatcaattattttcttcacagaaacccacaaagtacatattctagtttgcatcagaattgaatatgacccagaaattcttaatgttattaagctagactattgtatctaaaatgtgtatcacattcaactaatgcatattgaagatcttgagtaccacacttgagatctgaatgaagagcccaggattgtgatatttgatccatactgaatgtatttgctagagtgcattgtacagatggttcaggtgtgttagatttgtctctgtaaatgaattggtcagtagataaaagaacatgactcaaggctgagcagggttcagcaggccccaagcttcatcattaaaaatcgggtgttttttaatatgaggctggctgtgtaaagcagacctcatgaactcaggggtctgagaggccaggccagattatcagttgggatgttttcagtcccaattagcagacagcgcagttcacactggcttaaacaataaaggggacttactgattcctgaaagttaaagtccagcggttgggtggacttcagggttggtttgaatcaacagttcctcagtgtcatcaaagatgctgtttctttctggctgtctactctgccttcagtggcatgagcctcatcctaaggctggctcccccttgtgggcacaagatagtgccagcaactccagaggctacaaatttcctcctgccccattcagagagcaggagaatggcttctagaatctctgtcagaagagccaggaagcttctttcccagaagcccccccagatttcatgctttttagtctgaatggatccaacgcctactagcctactgtgctgcttcatgtcagctgtgtcccccgctagaaccttgtgtggagccaggttcctcctaagcacagaggtggtatgggccaaacgaagctgcctaaatgaaaatggggaaaggtgtcaagagaaggaagacttagtgctggcaaccaacagtatttgttgcaatcaatctcttggccatcctcattcatacacaccttccttcccacgcatacacctcccaaaatgcccacacttagggaaaacctatttacccctttcccaaagggatccaactccaatccggaaaccctaggtgatgtgtcatcctctgaatttggtcagtatatagctcttcatgtttcagggaccactggtcaccatgctcaccttggcatagaaagtaagagtgcaataaaaagaaaaaaaaatttcaattgggaaagaggaagttggaaagcagcacacggtggtcactgatccatcatccatatcacatcctgctggacagcagtagcaaggcttgaccaggggtcagactcagtttcctattctgtataatgagaggattggattaaattagtggttctcacattggaatgtggcctggagagcttgttaaaatgcagattactgggttccatccccagagtttctgactccacagatacaggtggggccctggaatttgcatttgtaatagatttccaggggctgctgctgctgctgctgctgctagtacaaggacacccctgcccttccactttgagaacctctgatttagattatccttatgggcccttctgattctgacatttaggactcagggatttttcttagctatctcttctgctctatactgacttatgatggattgttttataaatgggacacacccaactctactgtgtgaacaacttaaaaacatatcatggaattcctgctttggtttgtaatctaattttcaacaattgaggctgaaaatgaaggacaccttacagcttcaggaaagtaaattttctggaattgaagaaattagaaacagaaagataaaggctttcccatcctccccaaccccatctactacagcacagcggtctgtgggatgattccacgtgactgcagaaagcagctcttttcccaaggacatccaacattttgcaagcattctccctatgtgacccgggtattcattgggtcttagaataggagtagcactgggtgaagctgtgacatagatcaagttggtttaggaattttgccaactttcttccccagggcccctcacctggccaacatctattcatcctcaggtcacagcttaaacctcatgtcctccaaggagcctcctctaaccaacgccccaccccagcctaagtcaggttctcctgttctttgttctctagtgtcctacaatgttcctttatagcacttaccagcctttgttaaaaatcctcactgacgtgctccaccatctgccttgtccatcaatgttttcacaacacaggtcctggatcactgtaaatgctcagtaaatgtgtgttgcacaagtgctatcaaaggcagactgggagcagattccagtcacagtattttattacagtggtgaactatcaagcaatctatataacacatcccacagtgtatgattatgcatgctccaaaggaatgaaacataagtcttcagaagacacaaacacacagctggagagtcccagtgtccctggcatctacagccaactttttcatggccctcccccttctctctgggaagctggtgccttccagtgcccaaggtatctctctaccaggcaccctgggcattggcccagctccctcttcccccatgcccatttgggttgttgattgacacttaggtgaagacaatagaagaccctccagcttacagagtgcccaactcagcagggcctggagagctaatctgggtcaacaccacatttttcccctgagaaagtgggagtccagcaaggctgtaaaatgatgagctccaaataacagcctgagtctcctgacttctggctgcatcttgaatgcatctgcaggcagcttcaaatgtgagaataagatatgaacttatgacactctatagtttatcaccattgctataattctctgccactaaatataattttaccattaaatcaaaccaaaccaaacacttaaaataatttctttagagaagccagattatttattacaaataacgtctacaaactgactaaaagtatatcccacatatattgaatttgaagactgtgcctaagtttaaggtaattgatggattccattctcattagatattcacacatcaaaaaagttgtctgctttcccaggcacagtggtaggttatgcttatgctcatcgtttttcttcccagagctggctcttcctttgaaacagacccatataagccacccatttgctgggtcgcaagcccttcatgagggagagagaagtatggtgggacaccagcaccttctctacagaaacgagcagcatgtttgctaagggctgctggactttggcaggtagagaccatcagaggactcaactgaatccccttttatcaggaaccctaggagagtagagttgtcaggagtttccccatgacttacattgtcttttttaaaacaaccaattcatgactgaggtgaagaaggaaaataacagaaaaatatatctagcccaagaaatctacagaataacaataaaactcaggcagaaatgaacccactgatctgtgagccaagtgcttaagggaggggttggggcacttctcatgtggctcactgtcttagtcagttcaggctgctatgacaaaataccataggctgggtggcttagagacaatggaaatgcattatgcatagttctggaggctgggaacttcaagatcaagacactggcagattcagtgtctggtgagagctctcttcctgattagtagatggtgccttcttgctgcattctcatgtgatggaagagtcaaggtagcttccttgggcttcttcttataagggcactaatctcattcaggagagctccaccccatcatctaatcacctcctcaaggtcttgcctcctaatgacatcatattgtgggttaggtttcaacatatgaatttggggggacacaaatactaggtaggtgcaaaagtaattgcggtttttaccattaaaagtaatggcaaaaaccgcaattacttttgcaccagcctaatattataccacagctctctctgtggttgttcactggggcagtgggggtgtggcagaggggtgagggaaaaagggttccctcgatgtttgtggtagaaagaagagctaggtaaccaagtactcctttttgtctgcttaggtctgccaaaagtcaggcacccgtatcgggttagacattcaaggaatgtactgggggaaatgcctgtgaaagataaacagggaagagcaagagaaggtggggagagactcagaccacaatgcaggtggtctgtgacaattggggcgagaaagaggattgggtaagaagagtctcagacagtagcacagttcaggaaaagttcaaccaggccaatagagagtccttgagccaaagtcacctactggaggagtcctgctcctcacagaaatgggcctgcattactatgctcaccatgttcagtcattggccgggagtacagcccaggccaagtgcagcaaaaatgatggatctaagggggaggctgctggaggcaattatgtttcccatggcaggagatgtcagcagccactggtatggtcaccacatccttccattggtagttgtgggtgggaaggcagagtccctggcaggcagtagacagctacaggaacagaaactggtggtagaattagactgactactttggataacaaagccaaggctggcttgactggctgatagctagactatttctttgttactttgtcactcagtgtttagattgttgtttttccccctttccattgtttgtcaaattccccatctgaacccaggtctggaaaaataaaaccctatgcatttggaagaactttaaaatgaattagcttttaggctttagttgccatcataagcatctagagatattcaggcctcggagttggggcagactggagaaactaaggttatttgagaaataagcacactgaatatttggcttcctaattattctacaaggagtctaagttttgcctgcctggtgcctatgaatcactatttcttaattttcttagtttcacagaatcagaggacatgaatactgaaagatattggaggttgtctagttcgactacatcattgtagggaaactgtggccataaaaggggaaggtacaccaatattccttatgaatcaagacataaaaatcttcaacaaaatactagcaaactcaacccagcaacatttgtataaaggattatacaccatgaccaagtgagatttatccctggaatacaaggctggttcagtctatgaaaagcaatcaatgtaacacactatattaacagaataaaggacaaaaaatgcatgatcatctcaatagatgtaaaaaggaaagggactttctcaagttcacacggctaatggcaaagctgagattaaaactcaggtcatctgacttgtaggccagagttctttatactggtgagggtaggggtggagggctgaaccggaccttgcaagactgtccactgcactgaatcctgtactgagggatttctgtttgttttttcatcctgtcctcacaacacccccaagcagtgggctccgttgttattccccctccttttgcatgaggaaactgaggcttagagaggtaacactggttgtctgaggtcatacagctgccaagtatatgaggagctaagcctagatttcaggtctcctgccttgtctctgatattttccagtgcccgccactgctctcctcactcaacagtgccacaggattaacctggttccattggttctcagatcacctactgccaagcacagtggatgggctttttgttgtaagtggatgggagtgccctccaaattctctggaagaatagcctcctctcttgtgccagtgtgtgacaattctcagagccccagctgttgacctcactgtaatctgggctaagtggccatttatatacactaatgactagaaggtcttttcaaggaatggaggaccacaaagaagcaggcagctctggggaagccagaagctgaatggctgggaggtggggcaggggcaggggacagtggggataagatagaaacaaggctgttctttgctccttgagaagctgggtaacaagctggcttggcttctggtggagtctggcccagtgatagctcttgcctcctgatgggacaaaaaaggggagacaggcatctcagagaatgaggtggagagagacacaactgggccaggacccagaaaagagagttacctttttcgtctcagacctgggcatcccagatggaaccgtgctgagcttctggttagtctagcttcctccaggtgtgcaacacaggggtcctgctagggagccttcccagttgagattaaggaggttgctttcaaaatggccagctgcccaagattgcacctctgtcactgttgaggacagtgggggtaaacatgcctgatgttctgccctggaagggctccagagcctttggattgaagccacaaaggaggcctggcatttggctaccattccttcatctggttcactatcaaggatccctcatctcacccattctgctcccccgttctaatgtgggcttccataagcctctgtcccatcttccaaaatgcagtctggagagcgaggcaccaaggctgcaggccatttgcagggcacagccctggaggctaaagtggaggtgcagtggctttcctaacactggtctgcatgttgaactcagaaatacacggtacccttttcagcaagaatcaaagcaaggttgaaacaggccagcaacgtatgggacactttcttctcttccctttcgtgaaatttgcttctcggatagatctgttttcaccaggaaatgaatcaaagccgcatactctgccttccatccttctcttctcttctctcttcaggtctttcagaccagggaaagtggctgcctttgggatagtcacaacaaggtgccctggactgaaaattgagagtgatgagttacactctgccctggcttggggcaaggccctttcctgccatgagtttcagtgtccccacctaccaagtggggagttggtgtcagacaatgtttcttagtgggtggcattccaggagtccacacacaaaggctaagtccctgcaaaacagtgcagatagatgctttctgtaggtcttgctgactctcatactctctgtctttaactcgcttggcaattcttgagcaaaccattgggcctcttcatctacagagaatgatgacctgactaggtgatctctcatttctcctcaagttacaaaagcgttagggtggtaaggagaggaggtggccccaggaaaaccagatgggtcagaagaagacagaaggtggagccttcagtgacaggagagcagagaatgatgtccccctcccataaatgtagggaaggaaggataccagaaaggttaccatgaaagagaggagtaataggaaagtacaggtcatttgtagttgaaatacatacttgagtgtctgtgtggaccaaatctggggtgggaaggcaggcttcaaatcctgaacctcggaagggtcggcattcctgacaagagctcagagagccaacaccagacaaactctaagtcccctgaagagagtgtgctgagctaggtacttgcagccttgaacccaccctaatcccctctgcctggagcacgtccagaaggagcgtggtttgctgcagaaaagacaagtcagttagaccaaaattccaaagcaactttttaagcctataaatgatgatgattttatataaacttgagttgttccttcaacatagcaccatattttctacttatgtgattctggttttctctaaaggaaatctttttttggaatccacaccatacatacggaagagtatataaaacatataataataaaaccaacagtcatgtacccaccaaccaggttcagaaatagaacattcagaatgttttagaagccccttgtgtgcccctccctcttcccagagataacaactatcctggcttccaagagccaaccctagaaatagaccctaggctctggcaagctttgtgctcatcctagtgagatcatgcacgtcaccaatctctttaggtagtattctgtgcggatttccacagatggctcatctgttttgtgttgatccttattagtttcaattttgtctttttaaatatattttatgactttctgattataagagtaatatgtgctctttgtagtaaacttggaaaatgcagaaaagtggagagaaaacacaaacctcatggcataatacaatatataaacatttaatatataaataatccagaaacaactactgtgtgaacacattggagtgcagtatttcagtcatttttttttctatgtagaaatatatgtttcacattactggtatcaagttgtgtatataccttttccctttattgtggaatataacattgatgcagaaaagtgtgcaaggcctatatgtacagtttaataaggaagtaaaaaatgggccgggcgcggtggctcaagcctgtaatcccagcactttgggaggccaaggagggcggatcacgagatcagaagttcgagaccagcctggccaagatggtgaaacccagtctctactaaaaatacaaaaattagctggtcgtggtggtgcctgcctgtaatcccagctactggggaggctgaggcaggagaacagcttgaacccaggaggcggaggttgcagtgagccgagatcataccactgcactccagcctgggagacagagcaagactccgtctcaaaaacaaacaaacaaaaagaagtaaaaaattaaaacctgctgtcaacactgatcaggtcaagaaatagaatattgacaacccccaagtagatcctcatgtgaccttcctgatccaagataattattctgcttttctacatagcttcatcacttattaatagacttaaacttgtaattgcttcattttcaaaaccttagtggcggggccgggtacggtggcttacacctgtaatcccagcactttgggaggctgaggcaggcagatcgcttgagcccagagtttgagaccaacctgggcaacatggggaaaccctgtctctactaaaaacgcaaaaattagctgggagtggtggtacaagcctgtagtcccagctacctgggaagctgaggtggcaggatcacctgagcccgccagggaggtggaggtttcagtgagccgtgattgcactactgcactccagcctgggtgaccagagtgataccctgcctcaatacaaaacaaacaaacaaacaaacaaacaaaaaccttggccgggtgtggtggctcacaccagtaatcccagcactttgggagaccaaggtaggcagatcacctgaggtcaggagttcaagaccagcctggccaacatggcgaaatcctgtctctactaaaaatacaaaaattagccaggcatggtggcatgtgcctgtaatcctagctactcaggaggctgaggcaggagaatcccttcaacctaggaggtgaaggttgtggtgagctgagattgtgccactacactccagcctgggcgacagagtgagattccgtctcaaaacaaacaaacaaacaaacaaacaaacaaacaacagcaacagcaaaaaaccttagtggaagacacaatctaagcatttaagggaagagtcccaggccattagtagatgaaggctttcagaagaagagaggttgacctgtcctggtcattatctgccttcagcttcccgggaatgtgtagagcccaccaccatcaggacactagcagagttgtggacatggtattggatatgcagaagaaatatggccaaagagattggactgccctctgtgttttgctttcaagctcaccacagcctgcctccagtacctccagttcccaggtgtagggcaacacagaacatccctgtggggtgaagtgagtggcctccactgatctggccagcaggaccaggaaagcagagcaggaaattcaccagacaaagggtcaagccagacctcttccagggtgggggacaggcagatgcctggggacacagagtcagagaggggattcagagatctgcctgctccttaaccagcttccagcccaaccccattacgctgaccatgtccccccattccactttacctcccagatctgggaacatctagagctcctcctcctgaggcttgggaagattctgccgtatagaccacgatcctttccagttttctcctctgctgtcttgtgattcagcttccttggtgctgtgtagtcagttaatcctggtctatctgcattttagtttcataaattatgatgctgttatctcctctcctattctctctatcctggtgggattttgtctttaaaaacaaaacaaaacacaaactcttactgtagttttaatgagactctgggaggaagagaatttagatgcttgcattaaactgctgtctaattccagaagtctccaaaggaaatcctgccactcccttcttcggttgcccgaacatgacggttagttggatggctcccttggaagcccaaggtgccatcagggagatactgagagaatttgaggctgggaaggcaggtgggggttggggtgagggttatgttttgaatattgcttcatattgaagcatttgtagtatttgcggttaagagcctggattttcatgtaagtcaactccaggttcagcttccagctctgccagttacatatggtgtgactttgagcaagttactttgcttttctgaaccttattttccccacctgttaagtggggatcataatggtacccatctttcaggcttgccatgggtattgaatgtttcacttagtaaacatttacagcgtttcactcagtgcctggcacattgtatgtgttcaatacatggtagctattgtcatcatcattatcgtcatcatcatgagaaaatagaaaccttccagaaactgtcagggcaacgattgccacaggccgttgttggctactaaaactctagactctggagagccttgatgcccttcctcttttaccccgtccctgatgctcccccaagtagcatgatgcccagtggcccaccaacctcattatccagcattgctgacaacaggcacagccttggtcactgtgaaaatgccccacagcctcaacctcagaagtgggaagtatactgcagattcactctatgccaagcactatgggatatccacaggaatgtgccacagtgaggtaactgcccaggggatagtaattccttcatttctttatacattatggattctaccattttgttattgggttatttttccccttgtcaaagtagcaatttatcagttgaacttaattctctaattaaatttcaaatctgagaatttacatgatgaagtgaatttgattttggacccagtcaatttcagtcagccctaaacatattttgaaatgttaaagttaaattatatacgtttgtggaggaaaaactccaggaaagcctaaatttttccaggtcttgcttaggggataccctgctccaagaaaacttttacaaaatgcaaatttacagaacagatccaccaaatgggtgggattggtgctaccctagagttttctgtagaatttcttttttaaaaaatttttttcttttttttcttttttttttttttttttgagatggagtctcactttgtcgcccaggctggagtgcagtggcgtgatcttggctcattgcaaactccacctcctgggttcaagtgattctcgtgcctcagcctcccaagtagctgggactacaggcacgcaccaccatgcccggctaactttttgtatttttagtagagacggggtttcaccatgtcagccaggctggtctcgaactcctgtcttcaggtgatccacccacctcagcctcccaaaatgctgggattacaggtatgagccactgcgcccagccagaatttctttagtgagacttatctacccccctccacccaccataccacacgtatcataacagaggtcccccaacttggagttctcctcatttcaaggtacagttattataaaaagaagaggacacctgggtctcacagcagccagctctgcggccattgcacagtagaacctcagtggccttacaaaatattcttgctgttagtctacttactgcaataacaaaagtttcacttgggcactttgatcacacaaagcttggcacaggctttgaaatcagacaatacctaggttctagtctaggctctggcacttaactaatgggtgatcatgggcaggtcgcttaacctttttgtgcctcagtttccttatctttacaatgggattataatagtacctccttcataggattgtcctgaggattcattaattgaaatgaccctaggaaagggtcagtgccttacactgagtaagttctcagtaaatatttataatatcatcatcatcatcaattattattattattaatttactttaccaaaacacaggtcctgctgagccatgttggccagaccacacctagaacagcatgtccagttttaggctaatctgtgtaaaattcagtgcctggaccattgaaaggggctcgatatatggtggaggtattattgttaattaatgctgctgctaaccttcctggagtgcatacaacatgccaggcactgcatacgtgctaattctattagtcctcttaacctttaccactctatgaataatatacaattattaatcccttttgcagatgagaaaattaaggcacagaaacgttaagtaactctcccacaattacaaagcatggaagtggcaaacccataattcaagtctagactctctttttccagagcctggactcttagccaccatgccaaagagctgtgctgtccactgctgtagccagcagtcacatgtaactatttaaattaataaaaaatttaaaaaacaagaattcagttcttcatttttactagccacatttcaagtgctacacacttcatgtggccagtggctaccatattgaacagcacagctctagagcattctattctttctgggatgattcagcatcaactcaggaagttctgttggatggtgatgcttacagagattctgtttcttacaaaatctcagacttcagttgtacagctttcttgcattgttattaatagatgcatacttatgatatattgaaatcccatttgcacttggccaagtagggtaatggcaagaaaaaagccaagaagcgtgacttacattacgttttcctgtttccccggtgcattatttcaaattcacaaagttgtctcctatcacctctctttgatatggggcaggaggcattcatcaacttgcccaaaaatccaggttcttccacatgtctgccttcacctctttgggctatctggataatatttagtgctctagcatagtaacctcacaagtgacttgaacaacggaggttggcttctgaagtcagtgagccacagaggaccttggactctgagcatctttgacacactcatcaagtctccagttcgctttcttgggttttctctgctcatttctgttacatggttagtaaaggccagggaaagaaaaggtgttgaggatccattaccttaattccagaatgattaagtcaagaaacctacaagctctcagaagccagtggaattagagtgcactactataaccttgcaaatgtgcatatgcctccttccgaatcaccagagtggagattgggccaatatccaatctagtcaataatttataaagccagagcattcatccacttcttgcaaagcagctgaatatctatgggggttagtcataatctgagctccttgcaccagagccatttgagctacagaatagcacagagtgtcacagaatagccaaaagtgcagagttatttcagtatgagagaaggaggagcacctgactgctcctcgccatgtgcagaggaggagcccatgcatttccaaacccaggggttgcttggtttctagcttggtttctgtctgtaccccatcttgctattgtgtgacttgagtaagcccatctccacttcctcatcttattagctaggaacaatctatctcaaattcacatgtgcacagagttcagtgcccagcacactaaagcatgttcagtaaatatgttagctgatgttattttcaccatatgattatgatcactctctgttctactgatgggttttataaacccaccagcattgaaaagagatgagtagatgtgctaaaatgagagtaaaggctcagtttatcattggtgtttatcccaaaaaaaagactagcacaatgctcaccagattataatctcccaagtgcctagaacatcatgccaagctagtaacatagtaaagtttattgaattttgcaagtatttgctgagccctttgcctgggctagatactgtcggggcaccagagggatttagagatgattaagacttggcccagcaagaatgttcagtcagccaagggtattcagccacaggagctggacctggaaagagaggcagaatttccagggtggaggagcttcatctcgaaagacacacagaattcccagagtacaatcatggagaaagggcattccaggcttggcaaaccaaggagcacaagcacagagggccgaccacacatggcagcctgtctggagagctccaaggagattggtatgactgggggtacgtgacattatggaacgcaaaacctggctgctgagagggtggatgtgcttgcacttgcatctctagtcttggtgcgagccattggaggatttttcaggggaagggaaactgggctgacctggttccagcaaactctctgacaatcatgagaagcccagggtccagggggatgagtaagtgtgacctccaggaaacggggcaccactatcagactctatctgtcccatggcttacttctgtgagattcgaaatagtgtagaccttgtcagtccatgagctagtaattatgcccaccaattactgatttatttgcctttctgagatgtgcagtgatcccaaggacaaagatggatttaccttatgtttagaaacttctagaagttgaaatgttcctaacaacctttcctgtggaggttgtacctcacacgtagagtgtgtgataagcatttcttttcctaattaaataaaatggagaaaagacacaagcatcagctataaagctcccagtcagtcacagtcaagagactgaatctcatctcttttatttattttttgtgttaactggggattgcattggtctgcacagtgcttgctcccatcctgctccacttgattgagtggctccaggccccctcttgattgctgctgaaatagaactgcccacactgtcggggtatcttccgccgctggtcatttccatgtgccatctgcagttttttctgcctgatggactactgaggcactgcgtatgttatgctgatggggggtcctgtttcttgacccatcactaatatcttgcaagtcacaggaagctaccagggattcctgagcaaaagcttaaaatgcttcagttctctacaaataagccccattcattgcttttagagtgtgttatcatggagcagacaagtaatcagaacctgagtaatatttgcatattgaggtcttcaaaactccagtgtggctataaaatggtatttaaagttatcaaggagctaggtatgcaggcagaaagaactgtccattgcagaaagcaatgcctctgctcatgtcccagataaccttgctccaaggacaaactggagcttgataacatgaagctgcagatggccggtgagctcagctctgtactcactaaccaccccatgggaggggcactgagccctctatggttggcataaatcccattagaatggtaaagaaatccttttcacaagtacatagaaatcgcttgctaagatttcatgggttttcttgactttgttgtttttgtttgggttttagagggtgggcatgagtcatctctaaaactgttcaggtagttaggttgtcttcttattcccatttttaagtatttataattagttcttaaaaatttgtccggaggtccacacctccccttggaaaaccttgcctgtacttttcttaatggcacattttaagtttctatgtttcaaaacttgcttatcatataacatgctaatgactaaacacatgcacacctccacaccaatgcaaacgacatgtgggcttgggaacgaggcaagcctgggtttgcatcctgctctgccactagtgggctgtatgattttgggcaacttagttaacctctctgggcctcattggcctcatttgtaaaataagggcaataatagtccctttctcatagatggctatttatacagatcgaataagaccaaatatttaaagaacctgggttagtgcctaaagcacagcaaatgctcaataaattcagtggtggcaatttttattgttatttcaaatattacatcaaaatatctactgaactattatccattgcaaagacttgcccacaataggtgcttagtaagtgtttattgcaataagttgaagtgattccaactatgtagcttagatttcgggtatgagtgtttccttctccactgggatgtttgctaatggacatagatgatcactcacagctcaggtattaaaagcaggagagtagaggtgttccttcatgtagaaagaagagcaacttctcatcaaggcaggcttccagctggtcctttggacaccactgttgctaagcacttggtgtgctcgtcagggtaccagggctcttagcagccacccatttgcgttttgcagcttttgctgacatggatatcaagtatgaagttattttaattgcctttggctgaaaaaaatgggtcatatgttcaatatgttcaattctggtgaaatccctgtcttctaaagcatgatagaaaggggaggtcccacccacacacaagtcctaaaatcttggggccctagtggggtatagttcaacaagggctgcagctcaggacgtggttgttgtgagatttactcgtgactgtttggttttgcactcaccatttggttttgcagattcctcagcgtgttcacacacacatacctacaaaccagtttagagttgtgtgctccattgtggggggtggtcactggggtggggtggggtagggtgggatcaggcttggtcaaagtcattgctgatgaaccagctatctgacttagctttgttcccattttcaacaagacagtgatttctcaagccaggggagtcttcacatgagatccatggatgggtattaagtggtccagaaaacccccccaaattagatgtaaaatgttggtgggctggaaagggggagacaccataagtgctttttctgtggagagaaaccatagcttataactggttctcaaagaagtctatgacccaagacaagctaagatcacaaagctgtttggtttcgttccaccaaagcagttggtgggtataaccacaacacccagatgacccagctagacactcagggcagtgacaagatcagtcagaaccattttgtggccaagcagctgatggattgttcaatcggttgttgtagactcatgtagacaaagcctgcaagcttggggaagccaggcacccccaggtcagcctcgggcgacagcccccgtcctgccaggccctggggagtgagtccttcctgcccggcagctcctttgctcatgagctggcccgagtcacctcctcgtacagcacctcagaggcagcgccctggggcagctgggatccgaaggcctggaggcaggtgcccgctccactactgcctagctgcgacgccacaggtaagtcacttccccctgagcctcgctttcctcatctgtcaacggggcacagtcccctgctcagcctgcccgcctgcctcacagggttgttgggaggaacacaggaggtgacagctccgaaggtaaagctctgtccacccatgagggacttctagtgcttcctgggcctgcttgttctctactttctgcccggcattctttggcaaagggacaacccaagcaagcagagtgctccaggtgcctcagccccacctccagggaaatgagtgggggattgaccagggtgcagctgctctctccctcagctgtatgccttccagtaccccgtttccatacctacctgcctgtctgtccctgaggccagactgggaacctgagggggacaggggctgtgcttctgcacctccgaagccctgcacctgatacctgcctgcttggcacctagtgggtgctcgggaactgcctctcctgccagccatctgctgtggattccaaaccccgcccaggactcccacaccctagaggcaggaagttggattgccctgctggaggactggcagtctgggtagtacaggcagaaggaatccaaagcaagcttgtccaagaggcctgtgagttgggatcatcctctagattctagagtctagaaggaatggcttgacttgcccccagagtcgcatcagtggtcatgagagcaagcggatggacaccagccagaggggacctttgcagagaattgcatctggtgcataaaatatcaatgtgcacaggatgtctgcactatctgcagagaaaactggagacatgaacattttctaagtgatagtgatcagaagatggtcattaagctgaaagggcctcccaggattctggcctttaatggaaattcggctttggtatgtacagccttgttctctttatcctgcctgccctggcctggaagaacaagcagtgctttcctttcaagggctattgatttctctctctctcagagtcacagagctcctcagctgttcactcttcagctgaaaccagagaaatcttgtccagcacaaagctgccagggaaacagaattagcaaaacggacgtcgtcccctcaggatgtcgctgtttccaccctggtctgccttgcctttccctgtctttggaagccacaaatgaaaggatatcagctagcttgccttgagaattattgtccctcacctattctctctcttctcaagccaacagctttcacccagcagtgaagtggcagagcagatttgtggccccaaatcttctctaagaaccttggaaattggccccacctgagggcctttgagggtcaggcctggcatccactaaatcctccctgtcaacacagccactttgtcagtccagcctgtgagtcagtgcgagacagaggatgcaggcaccacaggggaagaagaaaagcaagctggaaatatatttgtttcctttgcccgggatcattcccagcatctaaaccaagttcttcccagaccggccaagactgaggaggagtcagaatagagtttgcagcagtcatagatcatgtgggaagacagaaaacaaagggtaaaaagaatttcatatacagatctctgccgtttgctttcagtggcattcattttgtgaagcccccagtgacagcttcagaccagttcaaacctgagggcagcatcattaccatgggtgaggtctctagaagggcaaggaaagacccctaacatagaaaatggtgtggcagtttccagttccccattggggtcccatgacttgaccttaggtttctgccagcacctgcccaccctccatcccttcaccctactgggtggtcattagaacattatctgctttgattgatttacttgtgtccataagagtagagacacacggtgttatccccatgcccggaacagagcctggcccatagtagacccatgaccatgtttgttaactgagtgacagagggactgactggactgtcatgtaagcaataccttcccgtcagggtcttgggaaggtaggttcaggggccccagagttactgtggcccgtatccctctggctgcattctgggcaacgcaaaagggcaggtgttcagtgggttccaccccagatctcggcgttaacagtccactgggagaagtggcccaattcgtgctcattactcccagtggtcctgcctccctgcaggcattctggagaagctgagtcacaggctctgagagttagggggaacttaggaaacaatcaaaacttgcctgccattcattttaggaagccgttgtagtttctgagggacgactaaagggaattttttcctaaaagcatccatccgtcctccaactaggcttcagatagcagtgtgtatgttgtcactatctatgggccatggccagtcagagcccacgggtctcagggggctccacccatgtgggggtgggggtccccacaactcagatcttgaatgtgtggtggtcccatgcagtatactatcttcctgtcattgcaaagggaaagtcagaagggtgaacgagttgtttctaattctggcttccaaacagtacaaaagaaggtttttttccttgtggaatacactagtgctcaacctttgggacagatagctgagcaccttctgctgtgtggcaggctggctctctgtgggggcactcatggagcagtgtctgctggaaaaggagacaggagttccctagcatggaggggtagataatctccccgctccctcccctcttctgtcctcccttccccttctccctcctcctctaccctcccctttttcctctcccctccccttcctcctcctcctcttccttctcttcctcttctttattctctctccctctcagtctccccttccctcccttccttcctcccttcctccacattctttataaaacaaggctttggatccattcactgccatcccccagaagtcttgtcatttgaattcttgtctgagtcaggatgctctcctccaagggctcatagggcaaggaacttcagcccgaatccggctaaaatccaggaacattttgtgggcatctgtctcagtccccgaatcgtttgtcctctgcctttcccccgttggagtccttttgcctgcttaagtggttgaattggtaatgagatcattcttcccatgcagtggtgagaaagcagcactcaggtgattgcacctgggtaaacaggagacattagcatgtggtagctggtgagtgaagctggtgcagtgcctggcgtgggctcagttgtgccagcaggcagtggtggagtttgggctctttcccctctctcctgcccagcacacaacccccagggacaggtgggggctttacagctccctggcgtcagcctaaagcttctagaaaggcatccccaggacttccaaggttgccatcttggctgagactgtctgtgaatgtggtcccttgtctgacagtgggggctgggaggggtgtgacagaggaagagctgggccttagttctctgggggtcaccatgagagaagcacacctgggcttgcatagaactcagtgctgcttgtcagtgtcacctggcacaacaggacgtagtgccacagttgcagccctagaaaatttgacgaccccttcatagctttgtttataaaaggccacacggcctaggctgtccttcataagagagcagaaagcgagtgtcccagtcactaagcagcaactttcaggcacggtttcctcctggtcactgaaaccatttgccatttcctgttttctccattttccaacgattctaattgtcagtgtcaaaaggcaacaactgttttcttggggcttatctttggagcacattgattcagaacaaaggatgggagcctccatctgcaaaacaaaggaagcagcctcctcgggaggcctggagagaatgctctggctcctttggccagggacagcaggaccagcataggagcagaggactggcggtgcctctggacactgccgtaaggtgaagagcccatggaggaccgtcgcttgctggtggcaccccagacttgaagatcctgcagagctggccaccggcacccaggctgggtgtcagcagcgctgtgtggccttggcagtttccatagtgataggctggccagcttttccattagactccggggtcctctggaatgtgtgcttcccgggatgaagacgccccagcacccgctgaagcctgccctgccccggcgtggcctttccttttgtctggcacgcccctgggcttggctttctctttccgtccctcccttcggactttaccgcacttcccctgctgtttccttagtcacactctccagcctccatctgcccctgcccctgaacccctacctctgtacaactgtgttatttgatgaaactaatgcagcaaccggtggggatggagttaaggaccgtttagacctagccagccacgcaggaatctgtccccagaagcagcagaagcacctggtctgcagttaggagatactgtacttcttagccgtgtcaccttgggcaagtcatttaacctctctgagcctctgctgtcacatcagtaagctggggactgtagatcttctgccctgatgtcctgagactggtacaagaagagccaaagcgaaaggactgccttcagaaatggctgccaaccctgaccatctcaggcagatccggatggtgtggccttgggcagtggtcatgtgacccccatgctcctcagtgtccacatggggtgttgctagatgacataaaataatgggtgagacgtgctcagtataatgagagcttgagaaggcagatcccaccccccatccccacccccaccccttgccgccttgccaatgctttggcagggagagggcagctccatagggcagctgagaaacagcccctcactgcccacacggcagctccagtggagggggaggcagggaccaggacaggaagcaggctaagggcgggatagaaaagcaaaccccagtctggtggaatcgcttctggtgtagtcttcccggtgccatgtgtttgtcctctctgccttggcaggaaccaaggccaggaactgctgccaggcctgagagctgggcacagtcccaagcactgggtcgctaccccgccccactcccaccagccccactgagtgcagagaagggttcccagaagccctttgctggaaaagcaggcactgcacgggcagcccgtgttgtagaggcaagtcctctggcatcttgggggggacacagaccagaaagtggacttggagcttgtgctcccagacagagctgccttggtggttgagaaggggagagagatggcagcagttgagcagagatggccgggctcccctcactgtgtggggtgaggcttcaagcactggactgggagtcagacctggatccgagtcacaacctgacaccaaccggctgagggtctcagagcaagtcatgccttttctgggtctgggggccttcatgttattccctcctggctatgttcttcccctttgctccttgagccgatcccagactgagtgctgaaactgcggccttgaaacttggctcgctcctccccctgcccacccagccagctttcagatggagacaggaagctcctcccaattgcctatgctgcaactagtcaggagaagggcgggaggttggcagtaagtgtttggctactcccagtgttggagactgtgtccacctgaccatgtgatcatctggccgttcatgccaggaccaccaggaacaagcctcagtcctcttctcaatgtcctttccctatgacagccctgcagaggctaggtatccaccactacatagcccacagtctgctctgccccagccacagcatccttggcttgctcagccattctttgtctgggtagtttgaagtccaatccccactctcattacttaccatcctctgaatgcagccagtctgtctgggtctccctgagactggcatgcccagactcctgtgggtatagtctggccaaggcagagttagcataggactgtcacctccctccttctacatactctgcttctattaatgcagcctaatgttacatttgttcttttggtgaccgcatctcactgctgacccatcctgagcagatggacatccaaaatgcctaaaacttttttctgtgtgctcttgctattaagttctgtctctcctgccccattctatgctgttgcagttgtgtttttaacccaggtgcagaatcttactttatttatacctgtggaattttgctcgagagggtggggcatgcatgcgagtgtatgctggtgtgtttattcatgctttctgctgcaccaaagccaagtcctaggtccccacgcagcgatcctaaggctaattattaattggtagctgtaatctaatttgtctttttcatcttctgtttagcaagaggaacagagatcaggtcttatggcaatgacccctgaacggcagaatgcatatatctcccaacagatgagtccatttgaaggtaagcagttaaggccagtgttcccaaaggggtgggcaaggggtgcatatgtggaagtggggtgagaattcatttcagagtaagcagttactgtgcttctgaaagcattgagaaagaggagatctgaaaatcagttaaataattcatccaactctaagagcaggatcccaattgaaggcctggtctaaatgactccaaaatcaccacttaattcaagagactgatttccctgagtcaggccccttaaagcagctatttcaatgggacagggaaacaaccctaggatctggattagaatcacttgggggctgccacacccccagggctctgatcctgcccttctcccacacgcacattcacatactgctgcagtgaccttccatttctaatgggttcctgggccatctgtcaggtatagggaatggaaaaggggttggggaggctctgcttcagaaagtttgtgtcaggggctcccagagcctccacagatagatagcaggggtccccaccctaccatggcagctataaatgtgatcaacatttattggcctaggatacagcagttagcaaaatgcctgatgtagttcccactccgtggaggttgcaggctagccaagaagtcatgagttcagcaacccttacgcaccagtgggatgagattggaccaggccgagggtagtcttgggaacactcagcatttgtctgagggccagaagaggctgcttgccctcagacaggaggtcagcatctttattgtagcccatgacacctctacaccattgctcttctggtcttatggaagacatctttgggcctgataacagcggagtctgtgtcccacttgtccaggctggagtgccacatcaggcacactccagttgcagggacagcacagacaagtttcaggaaggctggtggcctccaggaggttaaccttataaggccagattgtaacctagttgaaaaacatacacatgccatgataataaaagaacctaggcaccattacaagagaaaaaatcatttttgtagatacgagcatggattcttgggtgggtcagacacactgggcttgtgctctgactgcactgtctcccctacctgaccttgggtaaaccataagactgctgcatgactcagtgtccaccccaaaaaagtaccggtagatattggccacagtagatatcagctagagtggactctcatgacaatgaggggagatgtattccccatcttaggcacctgggactctaccttccatcttctgctccgtgtctctccatccccaggctcttcagaactcagggagtccagaatgtcagctcccagatttcagccttcagaaaggaaacccattaccgttcagttgaacaaatgttgtctgagccccagatctgggctcagaggccatctaggctatgagacaagaggggaacaaagcaccgtctgcactcactcaccacactcacttgctgtcccaggtcacatccatcgggtagagaatctaagaggctgagctagctcccgccaccagcccagcccaccccacctggccccttccttccttctacaaaatatgcaccacctgtcaaagggtgggcagtgccaggcctgcatacagagcactgagtgtaaaagcagacatggaccctgacctccaggagcttccaattttcttgaagagacaaatcagctggcatttcagtccagtgtgatctgctcttggtgagcacagacctagggagttggggcagcttcccagaagaactgcagtccaggctgagggcagagaaatgaggggaatggcgaggaattggggagcaggggggagctcagtagagagccaagggcgggaggtgagaagtccgtgttgggccaggagctaccctccggtggccacagccgaagtcgaggatgcctttggaactcatccccacttctctctttctgtatgtagccgtccaagaacaagtcacctccaagtgtagccggatcaaggcaagccccccatctagcaagcacttgatgccacccagaactgggcttcttcagaacaatctgagtccaggaatgatcccactcaccaggcaccagagctgcgagggcatgggagtgatctcaccaactctggggaagcggcaaggaattttcacctccagcccccagtgtcccatcctctcacactcaggccagactcccctgggcagacttgactctgtctgccagcatatgcagagccccaaggccaccccaccagaagtgcccctgcctgggttctgtcccagctccctgggcacccagtccttgagtccccaccagctcagacggcctagtgtgccaagaatgcccactgcgttcaacaatgctgcatgggtcacagcggcagcagctgtgaccacagcagtttcggggaaaacacccctcagccaagtggataatagcgttcagcagcactcaccttctggccaggcctgccttcagaggccatctgattgggaggcacaagtgcccgctgcgatgggaacacaagtgcccctggccaacaaccccagcttcagcctgctgggcagccagagcctcaggcagagcccggtacagggcccggtgcctgtagcaaacaccaccaagttcctccagcagggtatggccagctttagtcccctgagccccatacagggcatcgagccaccaagctatgtggctgctgctgccaccgctgctgctgcttctgccgttgctgccagccagttcccaggtccgttcgacagaacggatattccccctgagctgccacctgccgactttttgcgccagccccaacccccactaaatgatctgatttcgtcacctgactgcaatgaggtagatttcattgaagctctcttgaaaggctcctgtgtgagcccagatgaagactgggtgtgcaacttgaggctgatcgacgacattttggaacagcatgctgctgctcaaaatgccacagcccagaattctgggcaagtcacccaggatgctggggcactttaaatctgagcaggatgcccatagaaacccccatggtgacatcactctaggaagtggtgtcgatccatacccgcagttgtctcccgttacaatttgagtggtgttgtcagcccatgcttatccctctctctacctgtgacaaaatggaaagctggtgatttttcaagctacgtgtacatatttgaaaattttgtaaatggttttcctaaacattaatgacagaagtatttatacttcattttgtgactttgtaaataaagcgacggcttttgtttcagtagagttgtgtttactatgcattgttttgtgtttattatacaatgttacaaatatgcagaccgtgttgtttgctccagtgataccttgttaagctaggtggctgagtcgcttatggttttaatgcaatgagcaatgtggatatgaccaagagttgttgtgcaagttgacaaatgccaaatagaaaaccacttggccatttatttctatgttcactaaaaatcctattgccttgtgtgattcttaatctcttttgcgaacctttcagtctccgctagctctttcctaatgagctttacagcagaagctgttttatcgttaagtgccccacagagacactttaccaggaggctgggagagttctccagatttgggagaggcgcagagacagtgtgtgagccgagccctgtctcagcaatccacctggaggagctagagtatcctcctccctttaccattcagaccgagagaaaaagcccagcttgtgtgcaccctcgtggggttaaggcgagctgttcctggtttaaagcctttcagtatttgttttgatgtaaggctctgtggtttgggggggaacatctgtaaacattattagttgatttggggtttgtctttgatggtttctatctgcaattatcgtcatgtatatttaagtgtctgttatagaaaacccacacccactgtcctgtaaacttttctcagtgtccagactttctgtaatcacattttaattgccacctcgtatttcacctctacatttgaaatctggcgtctgtttcaagccagtgtgttttttcttcgttctgtaataaacagccaggagaaaagtgcc

SEQ ID NO: 3940 - DNA, 41232 bp, human
tgatccgaagcctcactcccaccagtaatcttctaagccagcaacagcagcagcagcagcagcagcagcaagcaaatgtgatctttaagcccataagcagcaactcatccaaaaccctgagcatgatcatgcagcaggggatggcaagctccagcccaggagccacggagccatttacttttggcaacaccaagcccttgtcccattttgtttctgagccgggtccccagaagatgccctccatgcctaccacctctaggcagccttccctgctccactacctgcagcagccgacaccaacgcaggcctcctcagccactgcctcctccacggccactgccaccttgcagctgcagcagcagcagcagcaacagcagcagcagcctgaccattcttcattccttctgcagcagatgatgcagcaaccccagcgttttcagcgatcagtggcctcagattccatgcctgctctgcccagacaggtaagacaatctcatatctggctgtgttcttttgttttggaagtaacaactgtgtttcatgttgccaatatctggctctggagggtaaatccaggctatagttctctctgagactggaaaagactctgaaaaagtctactgaagtcagctaatcctgtgtggttaaaagcacagtgttaataaggccaaggttatggtttcagtgcctgttcaagtcacctaacttccctagaaggagagctgcacccacaaggtgctcccggtggaaggagccaggtgggacaagtccgaatacagaaatgccttccctgcactgggccatgtagaaagactagtgaatccttcttaagatgtaaggaaattgcactgaagcatttaatcttatccctgctggcagaaggacaaacactgagccttctagaaatgccacagcaaacttttgctgagcaacctcagcatgccatttgtcactgtgctggatactcagtcaggtcgtgaaaggaaaaagacaggtatttgcaaggtagtcactctcatcatctccattttacaaatgaagaaactgaggctcagagagttgaaagacttgcccagagtcacatagttcgcaagggacagagcaggaacttgaagccaggtggtctcactccagagcctgtgctcttcttgaaattacttttgacttctcaccctccctcatctcctccaggcttttcaatcatgaaatgcagctgattccacctgggtcgtgtctatcacagttcccagttttcatttctgtgacccctgcctgtattagttatctgtggctgcataacaaattaccccaagcaccagcttcgaaccatatgcatacgttaccaccacatcctgatttctgggtgttaggaatcctggcatggtttaactgagtcttctggctgagtatctcctaaggctgcagtcatctcaaggctcagtggggaaggatctgcttccaagcccactcatgtggttgctggcaggaagcagttccttgcaggttgttggactgaggcctcggtttctcatgagctattggccagaggcctccctcagttccttgccacacggtctcttcacagagcatctcacaacatggcagctggcttcatctgagtgagcatgagagagtgtgccagtgaagcagggtaatggggagagagggaggagggatagtgccagcaagtcagaagtcacagtctctatgacctggtctagaaagtaacatcccaccacttttgctgtattctattcatgagatgtaagccagaggagattgcatgagggtgtaaataccaggaggcagggttcagtggggccaggtcacacgtgtgcctacacagaatactcagtcaccatctaccatccctccttcccattcctctcatccttgcccaagttcaggtcctcttgattctttatctgaactcatacagttgacccttaactggtctctcccaataaaccatccattgctctgagtcgtcttgctaaaacagtgacctgatcatgttttacacttgctcagaagtccccagaggcccataagctggccccaccagcctcctgggcccttcagcatccatcaggccctgccttgcactttgtttctattacccagaagtgcctgcagcacttggcccacgccatctggtctcagcctttactctggccgttccctgggcctggtcatcccttcccacattttctctcctgtccaacacctgcagctacttagggctcaggcaccatccctccaggaagcttttccatgactgtcctcagtacttccatttcccactgtgcctccctcttctggagagtggtcaaggaggagattataaagtgcttggccagagacctggcccaagggaagcacctgtcaagggctgacctcttatttaagagctctgtatgagcacacctgtggcaacccctagagtacagaggttgtgtcttttccatccaggtttcctggagcataaccatgcagagtgcttgacaccagggagttggtcatttgatagaccatgcggcaagcagagctcccatgggggtggccgggggagcggtgtggagataggcaaagcacataggacacggcaggccacctggggctcgggccctggtctgcagttcaggagcactttggtttgattttattatagggctgttgccatctgtttgcatggacttctgcagctagctcggtgaagccccagcatcaacacgggaactctttcactagcaggcaagatcctcagcctggagacgtgtcaccgtctaacattgtgagcctttctgttttgttttgtcttcaattgggtacatttttgtagactgattgtgttgtcccagagctggatcagctggctcagagggagaattcttaattattggggtcatgcaaatcatacccaaccaattacctaggtggggttggagaaagtgttcaggagaaagaccgaacagtcaagctccctggggctaggagcacaataaagggggcaagcgacttttgccagcagaggcaagaagctgggtccccaaattggaaatgctattgccaccaagagctgcctttccagcccatgctggcctgtgcccaggggccaggcatgggacctggtgcttcacctgcctcttctcattttaatcctcagaggcaggggctgttaccattctcctgagagttggggggaaaggcacagagaagtgaccgaagttgcccacagtcacacagcaagctggggccagagcagacaatctggctacagagcccacactcatactcccatgcatggggcactgcctctgtagccttctgtttccactgtcacctcttaactgtttcctcctctacaaatcaaggtgatgataggttgtctgaggactaagtgtgttaatacatctaaagcactttgaacagggcctggcataaagtatgtgctgagaagggatttgctgtcacgatgactctacctcctgaccctgtgctcccagatctgtttcatgggactaagatgtggttctaaaaaccagtagctgtggcaggacagacacaagccacgttatctccagaccctgtacccaccatgagattgataggagttgtgcagcctctgagccttgtgggctccttttgctctaggccctgcctctcctggacaactcccagcctgatgggaaaggggaaaggggaaaggtccatccctgctttgcagactggggatctcactttgctctttcttgagctctccggcactctcactccgctcctctccctagcactctgttctctacctggtattcttccaggcctccaagctgggggaatctcaacagtccttctgtttcttcttatggcctctccctattaactctaagacctaagaactcagccctggtcattcttccaggggagagaaaaaaataaagaaaaaagcgagtgtttgaggcaagagctgggaccgctgtagaaggacagatggtggccccaatggtggggaagaacatatttcccacttccagcaggctaagcaaacctcccaagttttactgatggccaagctgagcctcaggaacactaattacctatgatatggcatttactagcctgttacatttgccatggacgataatggttaccatggaaaaactggacattcatttgaatctggatctttgaggttttgtgcggggggtgggggcttttttggtttttgtctgttcatttctttagaggcagggtctcactatattgcccagtctggtctcaaactcctgggctcaagtgatcctcccacctcagcctcccaaagcactgagattacaggcaggaaccaccgcacctggtctagatcttagttttctaaaggagttatttttaaatgtgagatgagacacaaacgcttgagtaagctgaaaagccaaatccagccttctatagaggagctcatttttatgtacagaccagcatctctctatttggaggattttgctttaccagttgagtgaactattcaatttcaatgcaccattcatgtccacgtaaggtaaaaggcaaatgccacatgactttggggcagctgtttagcatgggaggttgagcaagcaagggcactggaggcagacagaactgaggctcaagtctggctacagatgctgactgattcaggtcccatgagcaatgttactcaactcctgagcctcagctgaaaatggggaaaggaatagtccccttcacttagggcattgggaaggcaaaggagatgctaacctgaaactgcttagaacggtgcccagcacacactacaggctcaatcagggctagggcagccttgtgggcttggacctgaaacctccggggcctgatgaatttccaaattcagaacatttgggactttgggaaggtaatgtggtgcaaataccaaatgtcacacaaccctccagtgtaatctgaagcagtgtttcattacttttgcagagaaatatgaatatttaaggaagtccagagtcaacttttgcccccacataaaatttggcaccaaatttacaaaagtaaaattggctttcagagcttcttggactttaaattacagataagggatgtggacctggaattattaagggagggatctttaactctttatggagttgcaacacccagcactggtttgtcagattttaatgaccccaaattgcgtcactgaattccccaccctccctccaggctgggtgatatatcttgatgtttaatcagactgaggcaaaatgaattttgtttgcatcatctgatgtcccttctccctgcagattactggagataccttggcgtgttgcaaaaatcgcggttaggacttacttcagtttcactattcacgactgcagaacagatcttacatttactcaaagacacaaacaagtatgtcaaggagatgggagttggactgtggaagactggggatagcaagaggcagcctctggccagagtgccctcagtgcacgtgcatttgagccccactcagatctgcagagctgggagtgtggtttcatggggaggagggatgtggatggaggccagttggaataagaacaaaaaaaagcctggaatctgatccttgaggcaggctgtgcagcacagagggaagagggcagctgtggagaaatagaccaaggaggcacatgatgttgttttgacaaatatggagagggtagagaagggggaatcaaacctgccttggagaaggctggattaagcccctactgggtctgatatgctttctatcttaaggataagctttagcttaggcagtcgtgagcaccaggcaattgcagaggcagtgaactcaccatcttccctttctgaggggttgggcctatgaagaggatctgggcagctccctctaaagtggggccttggggaagcccccactatccccacctgtggcctctctcacccctggtagactgaaccctccgaagtgcagtacttccagcacccagggcctgaagatagatggcacagggcgggggacacaggggccttaccctggggccttggcaggggacaggccctggggctgggctcaaggccaagttcaagaaagctcagactttggatcacttgggtccaaatcccagttctgccaccttttccgcggggcaagcgatttaccctttccaggcttcagtctgtaaaatggagatactagcatacctatctcatggggctgctgtgaggattaaatgagatgaggtaacagcgcttggcatagggcctggtacacaattatgctccattgatattagctgtcactctcaggaaagttcccgaaacccagaacaccagtaacccaatggaatgaatttagtcagcctcggctcagcatccaggctcctctctgacccccaggggtggacggtgacttggagagaaagggcaggggagagctcagtccctctggggctgcgtgctcacggacagtcccttaggggcgttaaggaagacttttgccaggtggctgaggagcagccaaggcagcagacacaggttggtgactccagaaggaagtagagccgccaagccaggctgtggtttcctgagtgcccctgaccgtgggtaggggagaatgttgtcttctcttccctctaagcacggccagctgaacttctaggagttacatggatgctgaataacaaatgcaaccacaggacgactttaggtgggcagagaggagggggaaggaggagctaagttccacctgcagccagcgtggatctgaccccacctgcttgcagcaggctcaggggtgcctgacatttcaagactcaggcagagggcttactgatacacagtgacaatgaacagggcggaaagcgtgtacatgagtggccaggaaggaaagctggtcctgcatagtcatggcgcacagagcacgcatcctgaggggatacctcccctctctcctctcgtttccgtccttcttctgcaccactgactctcactcctaaagcctccaaaaagaatctttgcagaaacccaagattccttttggtttgaacttccaaggctacactagcccactcagtagggcataacctttaattactgctgtctcaattagctctgcaaattaaattctttatatttgaaccatgacttttcatggaaaacaaaaaggaacaaaccaggttagtgaggccaagagaatttccgattctgatcaaagttacatctgctccatttacaactagagtcaggagaggcagagacagcaagtgagccttttcctagtctcagaatcactcattaacattttcaaaaagtaattattatattactaaaatacatgacctccaccccaaaatcagatccaccacatattttcaaggaagggcctgtcaccttggacttacaggtcttctccctcacttccctgcattcctctctcgttttgagagtaaggcttgcgggaaagcaatactgctgtctgtgttctcagagaaattttgtcttttactaattctggcgagaaacatcacagattttatttcaaaggttagtcctgctaaaatgcaagaacagaagcctctagaggaatctctgtgttgtccaccagtcaaatgataagtaaggaagtgcctccacttgccagataaaggactggggaccaggcagatttcaaagagcccgtgggtcagagccggggcctgccctgtgcgtattctctggcagacaaggaaatgttttcctgaatgagcattcttattttgtatttaaacatgatggtacatacaagcttagttttaccattctttctaaattaagctgcaaagagctgtttggtttcgggaaactttttcttagctgttttgtgtggaactatgattagacaccgtgtaacatgcattttgaaaattcggggaccgatatctcagtgttgaaaatgttttgttttaacctctctaaattgccaggaaatgaaaccacatgggctgttgaatttgggaaacacaggcttagaacttggtattaatcttaccaagaatcaaaaaaaagtttttttttcagtttctttttcggtttctaagggccattagtgatcctccacctcaaagctatttttctttttcaaaaagcggaaatttaaaatgagctgcttgttaaatgctaaccttttaaatgtcaacattttttttctattaaaagttaaagaataagtgagacgacactttcaaatgaaggtgactttacattgttcccctggaggaatgagccatcagttagtgtggtcaaccccaaaacttacggggatgcacaaggccgcctacttaagatgcatcagtagtagagatcaatagatacaatttttttcattgcttagtaactggcttatgaaagctgaagaggcaatcattttcagaaacctcctgtcaagttttttgttttgttttttgtttgttttgtcttaacatatctgaagagaaacaaggaaacttgctgaagttaggacacccaaaatgagcccttttaaaaatgaagtgcacaaattattttatgctaagttaattaagacaacctacttatttgtcactgtaaagcaaggcaaggaatctcattgcgcttttcaaagaacgtaagaggacagaaataaatcattgtgtcgtgctgctttaagctgtatctccttatgaatacctacaaacccaaaacacagaacaccatatggagcgagcagtccagttttgcgcacacaacaaacatgaaagagaagtgctgtcgctctactactactatgtccccaggtgaaaagttcgcaaaatgtaaacaagatctagagcagatgaaactcacggtagacttgctccattcagctgtggccctaacacctacagccagcactgtcactgagtgcaggagtggatggtgcagagcgccaaggggaatcaaagacgtgacccttccatccaggtgagcaaaggatgagtactcagagggctggactgcaccctcccctccccatcctgtgcttctgactctcagatccacttctgactctcacttccagcttctgactctcagatccactcatggtcccatatcgtggatttatggaatcctttcccgagtctatttgtacttttagcctgttctgtcccttagggattgacaaatcccacgatctgggcctgccctgtaaaacaactatgtggggcctgacctggctgctttttagcttgaaggggatagcagagggtagaatgctggttacatttaaagcaccctgctcccagatccaaaagaaagtttctgctttttcctaaggagttgaaacagtctgggattttatctgattttgttattttgcctacaatgacaaacactgcttttgtttgttttatcatgttgtgttttttgctagatgagtgtttatcatgccggctgcacccatccaaagcagtaaggttgttgaaagccaaaagcagcagaaaggcccaaagagatcaccccacctcacccacaggctcacctctgcaggtgtcttcagacagctgactcttaactctcatctcagcaacagtttctaagatagagagtggaataaagagtcagcattcatccatttcttcgatgttttctcctttaccccatgtgaaccaagtttcttggtaacgtgcagctaggactcacacagacgaaaagcacagagccacaggccttggctgggttattggagctaggtgcacaggaaaaataaaagtgggtgctccaggacattatatatatagtcctgggctaaaggtggccttcagggcctgaaagatggatagctgtacctcactaggaattatcccacctcttgctttgcttgtgggagctttcagtttgcagctaaaggctcaggttccggccagctttttcccctgtagcatgctaccaaatccggccatcttccagttttgagcagaggaggtgagcgtagctgtggagacacatattcttctgcaggcccatgtcggggtggcccatgaagagaatttgccaaagccagctggctcagcagaccaacagatgaaggtggactactcatttgcaattgtgattaatgatcatttatttccatgtgacaaagctttgaacgatgtgggaggccctcacccatccctgagtgggaataactgggaatgattccatgaccctttccctttatctggcaatcctttcaaagatgagctctggaaaatgtgaacagacaatgcactccactatagctttctagtttcacatcttcaaacaccaaaatgttgacacccattgggatggttattataaacacatacacacagagagagaaaataacaagtgatggtgaggatgtggagaaattggaacccttgtgcattgttggtgggaatgtgaaatagtgcagccactgtggaaaaaagtacggcagttcctcaaaaaattacacagagaaataccgtatgatccagtgattccacttctgggtatatgcctaaaagaatcgaaagcaaggctggacacagtggctcacacctgtaatcgcagcactttgagaagccgaggtgggaggatcgcttgaggccaggagttcaatgccagcctgggcaacatagtgagatcccacctttacaaaaaattacaaaaattaaccaggcatggtggcgttgcctgcagtttcagctactccggaggctgaggtgggaggattgcttgagaccaggaggttgaagctgcagtgagctgtgatcactgccctgcactccagcctgggtgacatagagagaccccatctcaaaaaataaaaaaaaagaaagaaagaaagagagaaagaaagaaagaaaaagaaagagagaaagaaagaaagaaagagagacagagacagagacagagaaagtaagaaagaaagaaaaaagaaagaaagaaagaaaaaagaaagaaagaaagaaagaaagaaagaaagaaagaaagaaagaaagaaagaaagaaagaattgaaagcaggggctcaaccagttatctgttcatagcagttttgttcacaatagtcaaaagagagagacaacccaaatgtccatcagctggtaaataaatttaaaaaatgcagcatgcccatacaatagaatattattcagccttaaaaaggaaggaaattctgacatgtgctataacatggatgatcactgaaggcattaagctaagtgaaacaagccagccaccaaaggacaaatattgtatcattccactcatgtgaggtccctagagtagtccaattcatggagaaaggcagatagaactgtgagtgacaggggctaggggagggaggaaattaggagtgcatgtttaatggggacagagtttcagtacaggaaaatgaaaaagttctggagatggatggtggtgatagttgcacaacactgtgagtgcacttaatgccactgaattgcacacttaaaaattgttaaaatggtacattttatacatatttttaccacaatgaaaaagtaaaggctgcaattttaaaacacttgctagtcctctcctaatcaaaagcagtcttttcttttgcaataatattagtgtacaatctaaaagaagcagcaagctgaactgctcattttccatccctggtaagagcagtatttactgcacatccactcatcatgttgtatgggccatctgggttttttgtatgtcttactgaggtgcatgtttgttaaatgcacaggcataaccagaaataactttcctggaaaattgagcataatggctgtccctctcttgacattttggagaaatgataatacgtaggtgggggaaacaaagaagtgactgtaaacaagaacggacattatctctgcttctgaatgagatgagaaacccacttgcttcattagctctctggtatatctgcaagtctggaaacaccgggatgactcacagtttgctgagtaatacaggagccgacagaatgctgctagtgactcgccatctctgactggctttctgtgcaaactgtcactctagagcaagtgctaggccttggaatagagttctgaaaaaggttacggttctcaactacagggagaaccagctcctaaggccttgacactggtacacaaagtaggacacctctgaccaatgccaaaatgacttttagaaagttcacacctggtcattgtgtccctgctcatgctccagctcacaagatctctggtttctgcctttcagggtgtggtgatgtccacttcttcatcagagttctttgtgacttgtctgcttctccacttggtagtaaactcctcaggcataggaagacgtcttcgctagctctgtaatgtaagctgaatgatccttggaatgaatgagtagaatatagaggggaatgaaccaatgaatgagctgtatctgctagccattgcggaatgctaagttttggaaactgttttgagcattttagaggaagtattgatagacactctcagtcttcaaggcttggaggccgatgaacccatattcttgcactgggcagaaaggagaactttgcatctgcatgtagggcccatttacccactgaccatgatgcatttctctggtccagttaagctccttatccttctatagcacttgtgcaatgtctgaaaacatgtgatttcttcaacttccaacaagtacacaattttataccgccagtggtaatttgtcctggtggttctgttgtttctgctgttgttgttgttgtcgtcatttaatgcaatttacaaggacaaaacaaaacttctggctgccatttcacataccacagtgacagcttcacatggtaagaaaagccaaaaacagctagtttcgaaattcaggccactcattttattacttttccctgattaagattcattcataccactttggggtggtgctgatattcctaacataagccaatcgattttggtcagttctgagagcagtgagtggtcttcacttacacacagtgtgtttgtaactctgctatttctttatgactagcacagtataaagtgaacgtttttggaaggctgttaagcatatgttctcctggtaggcttaaatgtgacttataaaaatacttgatagtatatgaacaagctcccactactggtttaaaccaaaaaaaagaggtttattttactagctcataagcacagattctacattctttgtgagaattatctttttaggtttttgtttttatttgttcttatcattttgatagccattttaatcatttcttttattcttttgtttgctttgttgacttttaatttggaaatgtctgctttggcagaataattacatcacaaggaggccctttccccacccacctacccagaaaggtctcctgactcccttatgctctatgaattgccctagttcaagattgatacagatcaaagcagcagaatggggttgaaagagcagcctctggcaatggccttgaccatgtcaattccctgtgcattcatatagatctggaatcatgtagatctattctgcccagcttgttccacagcagctggtgggcagaaccactcttccaagccgtgtagttattctgcactgcaagaggcaagattacaaccgaggactcattcattaataaaattgtttaagttggctttctgaatgacaacgtggtctcaggaacttaaaagacttcaccaagtccctgctgcaaacaaaaagtctgcattgtgatttgtcagagctagattgacatccagtttagagtttagaatccttctccatgccccacttttgagacaaattacaaatcttgaggttcatcaacattctagtacaatatgaccccccaaggtttaagagccctttagagatttgaagacaactgtgatgttcccactaactctccctccttcccccagttctttgcccctatcttggctgctggcctctgaactcatcacagagcactggagtgagggcctctgggtaagtaaggctctgctaaactgatcaaatgctccacgtacatttgtcccagtagagaggaaagctcctcttttccaaacaatctactttattcctgctcccctacatcccacttgcaagggtagcagccacatcccccatctgtcctgcccgagctcattgtccaagccaactccagctcagaaatttcccccagagaagaggttcctgaaggctaagcattgctctgtaaccctgaacttgatttgtgtctatttctcactctctcattatataaagtttttcaaataatattagactaggaattgagaaagagaatgagcgctcacaattgtttctagagccatcacaatcctacccagcaacaccttttacgggcttttaatttttttgtttacagttattacctttgaaaccaaatcttgactttctggtatgctcttggactttttaagggatttaaaaattcaggagtttgatgccaataattgcttttatgagctagcattgcttcttttctatagatgaatcccattttaaatcatcaattattttcttcacagaaacccacaaagtacatattctagtttgcatcagaattgaatatgacccagaaattcttaatgttattaagctagactattgtatctaaaatgtgtatcacattcaactaatgcatattgaagatcttgagtaccacacttgagatctgaatgaagagcccaggattgtgatatttgatccatactgaatgtatttgctagagtgcattgtacagatggttcaggtgtgttagatttgtctctgtaaatgaattggtcagtagataaaagaacatgactcaaggctgagcagggttcagcaggccccaagcttcatcattaaaaatcgggtgttttttaatatgaggctggctgtgtaaagcagacctcatgaactcaggggtctgagaggccaggccagattatcagttgggatgttttcagtcccaattagcagacagcgcagttcacactggcttaaacaataaaggggacttactgattcctgaaagttaaagtccagcggttgggtggacttcagggttggtttgaatcaacagttcctcagtgtcatcaaagatgctgtttctttctggctgtctactctgccttcagtggcatgagcctcatcctaaggctggctcccccttgtgggcacaagatagtgccagcaactccagaggctacaaatttcctcctgccccattcagagagcaggagaatggcttctagaatctctgtcagaagagccaggaagcttctttcccagaagcccccccagatttcatgctttttagtctgaatggatccaacgcctactagcctactgtgctgcttcatgtcagctgtgtcccccgctagaaccttgtgtggagccaggttcctcctaagcacagaggtggtatgggccaaacgaagctgcctaaatgaaaatggggaaaggtgtcaagagaaggaagacttagtgctggcaaccaacagtatttgttgcaatcaatctcttggccatcctcattcatacacaccttccttcccacgcatacacctcccaaaatgcccacacttagggaaaacctatttacccctttcccaaagggatccaactccaatccggaaaccctaggtgatgtgtcatcctctgaatttggtcagtatatagctcttcatgtttcagggaccactggtcaccatgctcaccttggcatagaaagtaagagtgcaataaaaagaaaaaaaaatttcaattgggaaagaggaagttggaaagcagcacacggtggtcactgatccatcatccatatcacatcctgctggacagcagtagcaaggcttgaccaggggtcagactcagtttcctattctgtataatgagaggattggattaaattagtggttctcacattggaatgtggcctggagagcttgttaaaatgcagattactgggttccatccccagagtttctgactccacagatacaggtggggccctggaatttgcatttgtaatagatttccaggggctgctgctgctgctgctgctgctagtacaaggacacccctgcccttccactttgagaacctctgatttagattatccttatgggcccttctgattctgacatttaggactcagggatttttcttagctatctcttctgctctatactgacttatgatggattgttttataaatgggacacacccaactctactgtgtgaacaacttaaaaacatatcatggaattcctgctttggtttgtaatctaattttcaacaattgaggctgaaaatgaaggacaccttacagcttcaggaaagtaaattttctggaattgaagaaattagaaacagaaagataaaggctttcccatcctccccaaccccatctactacagcacagcggtctgtgggatgattccacgtgactgcagaaagcagctcttttcccaaggacatccaacattttgcaagcattctccctatgtgacccgggtattcattgggtcttagaataggagtagcactgggtgaagctgtgacatagatcaagttggtttaggaattttgccaactttcttccccagggcccctcacctggccaacatctattcatcctcaggtcacagcttaaacctcatgtcctccaaggagcctcctctaaccaacgccccaccccagcctaagtcaggttctcctgttctttgttctctagtgtcctacaatgttcctttatagcacttaccagcctttgttaaaaatcctcactgacgtgctccaccatctgccttgtccatcaatgttttcacaacacaggtcctggatcactgtaaatgctcagtaaatgtgtgttgcacaagtgctatcaaaggcagactgggagcagattccagtcacagtattttattacagtggtgaactatcaagcaatctatataacacatcccacagtgtatgattatgcatgctccaaaggaatgaaacataagtcttcagaagacacaaacacacagctggagagtcccagtgtccctggcatctacagccaactttttcatggccctcccccttctctctgggaagctggtgccttccagtgcccaaggtatctctctaccaggcaccctgggcattggcccagctccctcttcccccatgcccatttgggttgttgattgacacttaggtgaagacaatagaagaccctccagcttacagagtgcccaactcagcagggcctggagagctaatctgggtcaacaccacatttttcccctgagaaagtgggagtccagcaaggctgtaaaatgatgagctccaaataacagcctgagtctcctgacttctggctgcatcttgaatgcatctgcaggcagcttcaaatgtgagaataagatatgaacttatgacactctatagtttatcaccattgctataattctctgccactaaatataattttaccattaaatcaaaccaaaccaaacacttaaaataatttctttagagaagccagattatttattacaaataacgtctacaaactgactaaaagtatatcccacatatattgaatttgaagactgtgcctaagtttaaggtaattgatggattccattctcattagatattcacacatcaaaaaagttgtctgctttcccaggcacagtggtaggttatgcttatgctcatcgtttttcttcccagagctggctcttcctttgaaacagacccatataagccacccatttgctgggtcgcaagcccttcatgagggagagagaagtatggtgggacaccagcaccttctctacagaaacgagcagcatgtttgctaagggctgctggactttggcaggtagagaccatcagaggactcaactgaatccccttttatcaggaaccctaggagagtagagttgtcaggagtttccccatgacttacattgtcttttttaaaacaaccaattcatgactgaggtgaagaaggaaaataacagaaaaatatatctagcccaagaaatctacagaataacaataaaactcaggcagaaatgaacccactgatctgtgagccaagtgcttaagggaggggttggggcacttctcatgtggctcactgtcttagtcagttcaggctgctatgacaaaataccataggctgggtggcttagagacaatggaaatgcattatgcatagttctggaggctgggaacttcaagatcaagacactggcagattcagtgtctggtgagagctctcttcctgattagtagatggtgccttcttgctgcattctcatgtgatggaagagtcaaggtagcttccttgggcttcttcttataagggcactaatctcattcaggagagctccaccccatcatctaatcacctcctcaaggtcttgcctcctaatgacatcatattgtgggttaggtttcaacatatgaatttggggggacacaaatactaggtaggtgcaaaagtaattgcggtttttaccattaaaagtaatggcaaaaaccgcaattacttttgcaccagcctaatattataccacagctctctctgtggttgttcactggggcagtgggggtgtggcagaggggtgagggaaaaagggttccctcgatgtttgtggtagaaagaagagctaggtaaccaagtactcctttttgtctgcttaggtctgccaaaagtcaggcacccgtatcgggttagacattcaaggaatgtactgggggaaatgcctgtgaaagataaacagggaagagcaagagaaggtggggagagactcagaccacaatgcaggtggtctgtgacaattggggcgagaaagaggattgggtaagaagagtctcagacagtagcacagttcaggaaaagttcaaccaggccaatagagagtccttgagccaaagtcacctactggaggagtcctgctcctcacagaaatgggcctgcattactatgctcaccatgttcagtcattggccgggagtacagcccaggccaagtgcagcaaaaatgatggatctaagggggaggctgctggaggcaattatgtttcccatggcaggagatgtcagcagccactggtatggtcaccacatccttccattggtagttgtgggtgggaaggcagagtccctggcaggcagtagacagctacaggaacagaaactggtggtagaattagactgactactttggataacaaagccaaggctggcttgactggctgatagctagactatttctttgttactttgtcactcagtgtttagattgttgtttttccccctttccattgtttgtcaaattccccatctgaacccaggtctggaaaaataaaaccctatgcatttggaagaactttaaaatgaattagcttttaggctttagttgccatcataagcatctagagatattcaggcctcggagttggggcagactggagaaactaaggttatttgagaaataagcacactgaatatttggcttcctaattattctacaaggagtctaagttttgcctgcctggtgcctatgaatcactatttcttaattttcttagtttcacagaatcagaggacatgaatactgaaagatattggaggttgtctagttcgactacatcattgtagggaaactgtggccataaaaggggaaggtacaccaatattccttatgaatcaagacataaaaatcttcaacaaaatactagcaaactcaacccagcaacatttgtataaaggattatacaccatgaccaagtgagatttatccctggaatacaaggctggttcagtctatgaaaagcaatcaatgtaacacactatattaacagaataaaggacaaaaaatgcatgatcatctcaatagatgtaaaaaggaaagggactttctcaagttcacacggctaatggcaaagctgagattaaaactcaggtcatctgacttgtaggccagagttctttatactggtgagggtaggggtggagggctgaaccggaccttgcaagactgtccactgcactgaatcctgtactgagggatttctgtttgttttttcatcctgtcctcacaacacccccaagcagtgggctccgttgttattccccctccttttgcatgaggaaactgaggcttagagaggtaacactggttgtctgaggtcatacagctgccaagtatatgaggagctaagcctagatttcaggtctcctgccttgtctctgatattttccagtgcccgccactgctctcctcactcaacagtgccacaggattaacctggttccattggttctcagatcacctactgccaagcacagtggatgggctttttgttgtaagtggatgggagtgccctccaaattctctggaagaatagcctcctctcttgtgccagtgtgtgacaattctcagagccccagctgttgacctcactgtaatctgggctaagtggccatttatatacactaatgactagaaggtcttttcaaggaatggaggaccacaaagaagcaggcagctctggggaagccagaagctgaatggctgggaggtggggcaggggcaggggacagtggggataagatagaaacaaggctgttctttgctccttgagaagctgggtaacaagctggcttggcttctggtggagtctggcccagtgatagctcttgcctcctgatgggacaaaaaaggggagacaggcatctcagagaatgaggtggagagagacacaactgggccaggacccagaaaagagagttacctttttcgtctcagacctgggcatcccagatggaaccgtgctgagcttctggttagtctagcttcctccaggtgtgcaacacaggggtcctgctagggagccttcccagttgagattaaggaggttgctttcaaaatggccagctgcccaagattgcacctctgtcactgttgaggacagtgggggtaaacatgcctgatgttctgccctggaagggctccagagcctttggattgaagccacaaaggaggcctggcatttggctaccattccttcatctggttcactatcaaggatccctcatctcacccattctgctcccccgttctaatgtgggcttccataagcctctgtcccatcttccaaaatgcagtctggagagcgaggcaccaaggctgcaggccatttgcagggcacagccctggaggctaaagtggaggtgcagtggctttcctaacactggtctgcatgttgaactcagaaatacacggtacccttttcagcaagaatcaaagcaaggttgaaacaggccagcaacgtatgggacactttcttctcttccctttcgtgaaatttgcttctcggatagatctgttttcaccaggaaatgaatcaaagccgcatactctgccttccatccttctcttctcttctctcttcaggtctttcagaccagggaaagtggctgcctttgggatagtcacaacaaggtgccctggactgaaaattgagagtgatgagttacactctgccctggcttggggcaaggccctttcctgccatgagtttcagtgtccccacctaccaagtggggagttggtgtcagacaatgtttcttagtgggtggcattccaggagtccacacacaaaggctaagtccctgcaaaacagtgcagatagatgctttctgtaggtcttgctgactctcatactctctgtctttaactcgcttggcaattcttgagcaaaccattgggcctcttcatctacagagaatgatgacctgactaggtgatctctcatttctcctcaagttacaaaagcgttagggtggtaaggagaggaggtggccccaggaaaaccagatgggtcagaagaagacagaaggtggagccttcagtgacaggagagcagagaatgatgtccccctcccataaatgtagggaaggaaggataccagaaaggttaccatgaaagagaggagtaataggaaagtacaggtcatttgtagttgaaatacatacttgagtgtctgtgtggaccaaatctggggtgggaaggcaggcttcaaatcctgaacctcggaagggtcggcattcctgacaagagctcagagagccaacaccagacaaactctaagtcccctgaagagagtgtgctgagctaggtacttgcagccttgaacccaccctaatcccctctgcctggagcacgtccagaaggagcgtggtttgctgcagaaaagacaagtcagttagaccaaaattccaaagcaactttttaagcctataaatgatgatgattttatataaacttgagttgttccttcaacatagcaccatattttctacttatgtgattctggttttctctaaaggaaatctttttttggaatccacaccatacatacggaagagtatataaaacatataataataaaaccaacagtcatgtacccaccaaccaggttcagaaatagaacattcagaatgttttagaagccccttgtgtgcccctccctcttcccagagataacaactatcctggcttccaagagccaaccctagaaatagaccctaggctctggcaagctttgtgctcatcctagtgagatcatgcacgtcaccaatctctttaggtagtattctgtgcggatttccacagatggctcatctgttttgtgttgatccttattagtttcaattttgtctttttaaatatattttatgactttctgattataagagtaatatgtgctctttgtagtaaacttggaaaatgcagaaaagtggagagaaaacacaaacctcatggcataatacaatatataaacatttaatatataaataatccagaaacaactactgtgtgaacacattggagtgcagtatttcagtcatttttttttctatgtagaaatatatgtttcacattactggtatcaagttgtgtatataccttttccctttattgtggaatataacattgatgcagaaaagtgtgcaaggcctatatgtacagtttaataaggaagtaaaaaatgggccgggcgcggtggctcaagcctgtaatcccagcactttgggaggccaaggagggcggatcacgagatcagaagttcgagaccagcctggccaagatggtgaaacccagtctctactaaaaatacaaaaattagctggtcgtggtggtgcctgcctgtaatcccagctactggggaggctgaggcaggagaacagcttgaacccaggaggcggaggttgcagtgagccgagatcataccactgcactccagcctgggagacagagcaagactccgtctcaaaaacaaacaaacaaaaagaagtaaaaaattaaaacctgctgtcaacactgatcaggtcaagaaatagaatattgacaacccccaagtagatcctcatgtgaccttcctgatccaagataattattctgcttttctacatagcttcatcacttattaatagacttaaacttgtaattgcttcattttcaaaaccttagtggcggggccgggtacggtggcttacacctgtaatcccagcactttgggaggctgaggcaggcagatcgcttgagcccagagtttgagaccaacctgggcaacatggggaaaccctgtctctactaaaaacgcaaaaattagctgggagtggtggtacaagcctgtagtcccagctacctgggaagctgaggtggcaggatcacctgagcccgccagggaggtggaggtttcagtgagccgtgattgcactactgcactccagcctgggtgaccagagtgataccctgcctcaatacaaaacaaacaaacaaacaaacaaacaaaaaccttggccgggtgtggtggctcacaccagtaatcccagcactttgggagaccaaggtaggcagatcacctgaggtcaggagttcaagaccagcctggccaacatggcgaaatcctgtctctactaaaaatacaaaaattagccaggcatggtggcatgtgcctgtaatcctagctactcaggaggctgaggcaggagaatcccttcaacctaggaggtgaaggttgtggtgagctgagattgtgccactacactccagcctgggcgacagagtgagattccgtctcaaaacaaacaaacaaacaaacaaacaaacaaacaacagcaacagcaaaaaaccttagtggaagacacaatctaagcatttaagggaagagtcccaggccattagtagatgaaggctttcagaagaagagaggttgacctgtcctggtcattatctgccttcagcttcccgggaatgtgtagagcccaccaccatcaggacactagcagagttgtggacatggtattggatatgcagaagaaatatggccaaagagattggactgccctctgtgttttgctttcaagctcaccacagcctgcctccagtacctccagttcccaggtgtagggcaacacagaacatccctgtggggtgaagtgagtggcctccactgatctggccagcaggaccaggaaagcagagcaggaaattcaccagacaaagggtcaagccagacctcttccagggtgggggacaggcagatgcctggggacacagagtcagagaggggattcagagatctgcctgctccttaaccagcttccagcccaaccccattacgctgaccatgtccccccattccactttacctcccagatctgggaacatctagagctcctcctcctgaggcttgggaagattctgccgtatagaccacgatcctttccagttttctcctctgctgtcttgtgattcagcttccttggtgctgtgtagtcagttaatcctggtctatctgcattttagtttcataaattatgatgctgttatctcctctcctattctctctatcctggtgggattttgtctttaaaaacaaaacaaaacacaaactcttactgtagttttaatgagactctgggaggaagagaatttagatgcttgcattaaactgctgtctaattccagaagtctccaaaggaaatcctgccactcccttcttcggttgcccgaacatgacggttagttggatggctcccttggaagcccaaggtgccatcagggagatactgagagaatttgaggctgggaaggcaggtgggggttggggtgagggttatgttttgaatattgcttcatattgaagcatttgtagtatttgcggttaagagcctggattttcatgtaagtcaactccaggttcagcttccagctctgccagttacatatggtgtgactttgagcaagttactttgcttttctgaaccttattttccccacctgttaagtggggatcataatggtacccatctttcaggcttgccatgggtattgaatgtttcacttagtaaacatttacagcgtttcactcagtgcctggcacattgtatgtgttcaatacatggtagctattgtcatcatcattatcgtcatcatcatgagaaaatagaaaccttccagaaactgtcagggcaacgattgccacaggccgttgttggctactaaaactctagactctggagagccttgatgcccttcctcttttaccccgtccctgatgctcccccaagtagcatgatgcccagtggcccaccaacctcattatccagcattgctgacaacaggcacagccttggtcactgtgaaaatgccccacagcctcaacctcagaagtgggaagtatactgcagattcactctatgccaagcactatgggatatccacaggaatgtgccacagtgaggtaactgcccaggggatagtaattccttcatttctttatacattatggattctaccattttgttattgggttatttttccccttgtcaaagtagcaatttatcagttgaacttaattctctaattaaatttcaaatctgagaatttacatgatgaagtgaatttgattttggacccagtcaatttcagtcagccctaaacatattttgaaatgttaaagttaaattatatacgtttgtggaggaaaaactccaggaaagcctaaatttttccaggtcttgcttaggggataccctgctccaagaaaacttttacaaaatgcaaatttacagaacagatccaccaaatgggtgggattggtgctaccctagagttttctgtagaatttcttttttaaaaaatttttttcttttttttcttttttttttttttttttgagatggagtctcactttgtcgcccaggctggagtgcagtggcgtgatcttggctcattgcaaactccacctcctgggttcaagtgattctcgtgcctcagcctcccaagtagctgggactacaggcacgcaccaccatgcccggctaactttttgtatttttagtagagacggggtttcaccatgtcagccaggctggtctcgaactcctgtcttcaggtgatccacccacctcagcctcccaaaatgctgggattacaggtatgagccactgcgcccagccagaatttctttagtgagacttatctacccccctccacccaccataccacacgtatcataacagaggtcccccaacttggagttctcctcatttcaaggtacagttattataaaaagaagaggacacctgggtctcacagcagccagctctgcggccattgcacagtagaacctcagtggccttacaaaatattcttgctgttagtctacttactgcaataacaaaagtttcacttgggcactttgatcacacaaagcttggcacaggctttgaaatcagacaatacctaggttctagtctaggctctggcacttaactaatgggtgatcatgggcaggtcgcttaacctttttgtgcctcagtttccttatctttacaatgggattataatagtacctccttcataggattgtcctgaggattcattaattgaaatgaccctaggaaagggtcagtgccttacactgagtaagttctcagtaaatatttataatatcatcatcatcatcaattattattattattaatttactttaccaaaacacaggtcctgctgagccatgttggccagaccacacctagaacagcatgtccagttttaggctaatctgtgtaaaattcagtgcctggaccattgaaaggggctcgatatatggtggaggtattattgttaattaatgctgctgctaaccttcctggagtgcatacaacatgccaggcactgcatacgtgctaattctattagtcctcttaacctttaccactctatgaataatatacaattattaatcccttttgcagatgagaaaattaaggcacagaaacgttaagtaactctcccacaattacaaagcatggaagtggcaaacccataattcaagtctagactctctttttccagagcctggactcttagccaccatgccaaagagctgtgctgtccactgctgtagccagcagtcacatgtaactatttaaattaataaaaaatttaaaaaacaagaattcagttcttcatttttactagccacatttcaagtgctacacacttcatgtggccagtggctaccatattgaacagcacagctctagagcattctattctttctgggatgattcagcatcaactcaggaagttctgttggatggtgatgcttacagagattctgtttcttacaaaatctcagacttcagttgtacagctttcttgcattgttattaatagatgcatacttatgatatattgaaatcccatttgcacttggccaagtagggtaatggcaagaaaaaagccaagaagcgtgacttacattacgttttcctgtttccccggtgcattatttcaaattcacaaagttgtctcctatcacctctctttgatatggggcaggaggcattcatcaacttgcccaaaaatccaggttcttccacatgtctgccttcacctctttgggctatctggataatatttagtgctctagcatagtaacctcacaagtgacttgaacaacggaggttggcttctgaagtcagtgagccacagaggaccttggactctgagcatctttgacacactcatcaagtctccagttcgctttcttgggttttctctgctcatttctgttacatggttagtaaaggccagggaaagaaaaggtgttgaggatccattaccttaattccagaatgattaagtcaagaaacctacaagctctcagaagccagtggaattagagtgcactactataaccttgcaaatgtgcatatgcctccttccgaatcaccagagtggagattgggccaatatccaatctagtcaataatttataaagccagagcattcatccacttcttgcaaagcagctgaatatctatgggggttagtcataatctgagctccttgcaccagagccatttgagctacagaatagcacagagtgtcacagaatagccaaaagtgcagagttatttcagtatgagagaaggaggagcacctgactgctcctcgccatgtgcagaggaggagcccatgcatttccaaacccaggggttgcttggtttctagcttggtttctgtctgtaccccatcttgctattgtgtgacttgagtaagcccatctccacttcctcatcttattagctaggaacaatctatctcaaattcacatgtgcacagagttcagtgcccagcacactaaagcatgttcagtaaatatgttagctgatgttattttcaccatatgattatgatcactctctgttctactgatgggttttataaacccaccagcattgaaaagagatgagtagatgtgctaaaatgagagtaaaggctcagtttatcattggtgtttatcccaaaaaaaagactagcacaatgctcaccagattataatctcccaagtgcctagaacatcatgccaagctagtaacatagtaaagtttattgaattttgcaagtatttgctgagccctttgcctgggctagatactgtcggggcaccagagggatttagagatgattaagacttggcccagcaagaatgttcagtcagccaagggtattcagccacaggagctggacctggaaagagaggcagaatttccagggtggaggagcttcatctcgaaagacacacagaattcccagagtacaatcatggagaaagggcattccaggcttggcaaaccaaggagcacaagcacagagggccgaccacacatggcagcctgtctggagagctccaaggagattggtatgactgggggtacgtgacattatggaacgcaaaacctggctgctgagagggtggatgtgcttgcacttgcatctctagtcttggtgcgagccattggaggatttttcaggggaagggaaactgggctgacctggttccagcaaactctctgacaatcatgagaagcccagggtccagggggatgagtaagtgtgacctccaggaaacggggcaccactatcagactctatctgtcccatggcttacttctgtgagattcgaaatagtgtagaccttgtcagtccatgagctagtaattatgcccaccaattactgatttatttgcctttctgagatgtgcagtgatcccaaggacaaagatggatttaccttatgtttagaaacttctagaagttgaaatgttcctaacaacctttcctgtggaggttgtacctcacacgtagagtgtgtgataagcatttcttttcctaattaaataaaatggagaaaagacacaagcatcagctataaagctcccagtcagtcacagtcaagagactgaatctcatctcttttatttattttttgtgttaactggggattgcattggtctgcacagtgcttgctcccatcctgctccacttgattgagtggctccaggccccctcttgattgctgctgaaatagaactgcccacactgtcggggtatcttccgccgctggtcatttccatgtgccatctgcagttttttctgcctgatggactactgaggcactgcgtatgttatgctgatggggggtcctgtttcttgacccatcactaatatcttgcaagtcacaggaagctaccagggattcctgagcaaaagcttaaaatgcttcagttctctacaaataagccccattcattgcttttagagtgtgttatcatggagcagacaagtaatcagaacctgagtaatatttgcatattgaggtcttcaaaactccagtgtggctataaaatggtatttaaagttatcaaggagctaggtatgcaggcagaaagaactgtccattgcagaaagcaatgcctctgctcatgtcccagataaccttgctccaaggacaaactggagcttgataacatgaagctgcagatggccggtgagctcagctctgtactcactaaccaccccatgggaggggcactgagccctctatggttggcataaatcccattagaatggtaaagaaatccttttcacaagtacatagaaatcgcttgctaagatttcatgggttttcttgactttgttgtttttgtttgggttttagagggtgggcatgagtcatctctaaaactgttcaggtagttaggttgtcttcttattcccatttttaagtatttataattagttcttaaaaatttgtccggaggtccacacctccccttggaaaaccttgcctgtacttttcttaatggcacattttaagtttctatgtttcaaaacttgcttatcatataacatgctaatgactaaacacatgcacacctccacaccaatgcaaacgacatgtgggcttgggaacgaggcaagcctgggtttgcatcctgctctgccactagtgggctgtatgattttgggcaacttagttaacctctctgggcctcattggcctcatttgtaaaataagggcaataatagtccctttctcatagatggctatttatacagatcgaataagaccaaatatttaaagaacctgggttagtgcctaaagcacagcaaatgctcaataaattcagtggtggcaatttttattgttatttcaaatattacatcaaaatatctactgaactattatccattgcaaagacttgcccacaataggtgcttagtaagtgtttattgcaataagttgaagtgattccaactatgtagcttagatttcgggtatgagtgtttccttctccactgggatgtttgctaatggacatagatgatcactcacagctcaggtattaaaagcaggagagtagaggtgttccttcatgtagaaagaagagcaacttctcatcaaggcaggcttccagctggtcctttggacaccactgttgctaagcacttggtgtgctcgtcagggtaccagggctcttagcagccacccatttgcgttttgcagcttttgctgacatggatatcaagtatgaagttattttaattgcctttggctgaaaaaaatgggtcatatgttcaatatgttcaattctggtgaaatccctgtcttctaaagcatgatagaaaggggaggtcccacccacacacaagtcctaaaatcttggggccctagtggggtatagttcaacaagggctgcagctcaggacgtggttgttgtgagatttactcgtgactgtttggttttgcactcaccatttggttttgcagattcctcagcgtgttcacacacacatacctacaaaccagtttagagttgtgtgctccattgtggggggtggtcactggggtggggtggggtagggtgggatcaggcttggtcaaagtcattgctgatgaaccagctatctgacttagctttgttcccattttcaacaagacagtgatttctcaagccaggggagtcttcacatgagatccatggatgggtattaagtggtccagaaaacccccccaaattagatgtaaaatgttggtgggctggaaagggggagacaccataagtgctttttctgtggagagaaaccatagcttataactggttctcaaagaagtctatgacccaagacaagctaagatcacaaagctgtttggtttcgttccaccaaagcagttggtgggtataaccacaacacccagatgacccagctagacactcagggcagtgacaagatcagtcagaaccattttgtggccaagcagctgatggattgttcaatcggttgttgtagactcatgtagacaaagcctgcaagcttggggaagccaggcacccccaggtcagcctcgggcgacagcccccgtcctgccaggccctggggagtgagtccttcctgcccggcagctcctttgctcatgagctggcccgagtcacctcctcgtacagcacctcagaggcagcgccctggggcagctgggatccgaaggcctggaggcaggtgcccgctccactactgcctagctgcgacgccacaggtaagtcacttccccctgagcctcgctttcctcatctgtcaacggggcacagtcccctgctcagcctgcccgcctgcctcacagggttgttgggaggaacacaggaggtgacagctccgaaggtaaagctctgtccacccatgagggacttctagtgcttcctgggcctgcttgttctctactttctgcccggcattctttggcaaagggacaacccaagcaagcagagtgctccaggtgcctcagccccacctccagggaaatgagtgggggattgaccagggtgcagctgctctctccctcagctgtatgccttccagtaccccgtttccatacctacctgcctgtctgtccctgaggccagactgggaacctgagggggacaggggctgtgcttctgcacctccgaagccctgcacctgatacctgcctgcttggcacctagtgggtgctcgggaactgcctctcctgccagccatctgctgtggattccaaaccccgcccaggactcccacaccctagaggcaggaagttggattgccctgctggaggactggcagtctgggtagtacaggcagaaggaatccaaagcaagcttgtccaagaggcctgtgagttgggatcatcctctagattctagagtctagaaggaatggcttgacttgcccccagagtcgcatcagtggtcatgagagcaagcggatggacaccagccagaggggacctttgcagagaattgcatctggtgcataaaatatcaatgtgcacaggatgtctgcactatctgcagagaaaactggagacatgaacattttctaagtgatagtgatcagaagatggtcattaagctgaaagggcctcccaggattctggcctttaatggaaattcggctttggtatgtacagccttgttctctttatcctgcctgccctggcctggaagaacaagcagtgctttcctttcaagggctattgatttctctctctctcagagtcacagagctcctcagctgttcactcttcagctgaaaccagagaaatcttgtccagcacaaagctgccagggaaacagaattagcaaaacggacgtcgtcccctcaggatgtcgctgtttccaccctggtctgccttgcctttccctgtctttggaagccacaaatgaaaggatatcagctagcttgccttgagaattattgtccctcacctattctctctcttctcaagccaacagctttcacccagcagtgaagtggcagagcagatttgtggccccaaatcttctctaagaaccttggaaattggccccacctgagggcctttgagggtcaggcctggcatccactaaatcctccctgtcaacacagccactttgtcagtccagcctgtgagtcagtgcgagacagaggatgcaggcaccacaggggaagaagaaaagcaagctggaaatatatttgtttcctttgcccgggatcattcccagcatctaaaccaagttcttcccagaccggccaagactgaggaggagtcagaatagagtttgcagcagtcatagatcatgtgggaagacagaaaacaaagggtaaaaagaatttcatatacagatctctgccgtttgctttcagtggcattcattttgtgaagcccccagtgacagcttcagaccagttcaaacctgagggcagcatcattaccatgggtgaggtctctagaagggcaaggaaagacccctaacatagaaaatggtgtggcagtttccagttccccattggggtcccatgacttgaccttaggtttctgccagcacctgcccaccctccatcccttcaccctactgggtggtcattagaacattatctgctttgattgatttacttgtgtccataagagtagagacacacggtgttatccccatgcccggaacagagcctggcccatagtagacccatgaccatgtttgttaactgagtgacagagggactgactggactgtcatgtaagcaataccttcccgtcagggtcttgggaaggtaggttcaggggccccagagttactgtggcccgtatccctctggctgcattctgggcaacgcaaaagggcaggtgttcagtgggttccaccccagatctcggcgttaacagtccactgggagaagtggcccaattcgtgctcattactcccagtggtcctgcctccctgcaggcattctggagaagctgagtcacaggctctgagagttagggggaacttaggaaacaatcaaaacttgcctgccattcattttaggaagccgttgtagtttctgagggacgactaaagggaattttttcctaaaagcatccatccgtcctccaactaggcttcagatagcagtgtgtatgttgtcactatctatgggccatggccagtcagagcccacgggtctcagggggctccacccatgtgggggtgggggtccccacaactcagatcttgaatgtgtggtggtcccatgcagtatactatcttcctgtcattgcaaagggaaagtcagaagggtgaacgagttgtttctaattctggcttccaaacagtacaaaagaaggtttttttccttgtggaatacactagtgctcaacctttgggacagatagctgagcaccttctgctgtgtggcaggctggctctctgtgggggcactcatggagcagtgtctgctggaaaaggagacaggagttccctagcatggaggggtagataatctccccgctccctcccctcttctgtcctcccttccccttctccctcctcctctaccctcccctttttcctctcccctccccttcctcctcctcctcttccttctcttcctcttctttattctctctccctctcagtctccccttccctcccttccttcctcccttcctccacattctttataaaacaaggctttggatccattcactgccatcccccagaagtcttgtcatttgaattcttgtctgagtcaggatgctctcctccaagggctcatagggcaaggaacttcagcccgaatccggctaaaatccaggaacattttgtgggcatctgtctcagtccccgaatcgtttgtcctctgcctttcccccgttggagtccttttgcctgcttaagtggttgaattggtaatgagatcattcttcccatgcagtggtgagaaagcagcactcaggtgattgcacctgggtaaacaggagacattagcatgtggtagctggtgagtgaagctggtgcagtgcctggcgtgggctcagttgtgccagcaggcagtggtggagtttgggctctttcccctctctcctgcccagcacacaacccccagggacaggtgggggctttacagctccctggcgtcagcctaaagcttctagaaaggcatccccaggacttccaaggttgccatcttggctgagactgtctgtgaatgtggtcccttgtctgacagtgggggctgggaggggtgtgacagaggaagagctgggccttagttctctgggggtcaccatgagagaagcacacctgggcttgcatagaactcagtgctgcttgtcagtgtcacctggcacaacaggacgtagtgccacagttgcagccctagaaaatttgacgaccccttcatagctttgtttataaaaggccacacggcctaggctgtccttcataagagagcagaaagcgagtgtcccagtcactaagcagcaactttcaggcacggtttcctcctggtcactgaaaccatttgccatttcctgttttctccattttccaacgattctaattgtcagtgtcaaaaggcaacaactgttttcttggggcttatctttggagcacattgattcagaacaaaggatgggagcctccatctgcaaaacaaaggaagcagcctcctcgggaggcctggagagaatgctctggctcctttggccagggacagcaggaccagcataggagcagaggactggcggtgcctctggacactgccgtaaggtgaagagcccatggaggaccgtcgcttgctggtggcaccccagacttgaagatcctgcagagctggccaccggcacccaggctgggtgtcagcagcgctgtgtggccttggcagtttccatagtgataggctggccagcttttccattagactccggggtcctctggaatgtgtgcttcccgggatgaagacgccccagcacccgctgaagcctgccctgccccggcgtggcctttccttttgtctggcacgcccctgggcttggctttctctttccgtccctcccttcggactttaccgcacttcccctgctgtttccttagtcacactctccagcctccatctgcccctgcccctgaacccctacctctgtacaactgtgttatttgatgaaactaatgcagcaaccggtggggatggagttaaggaccgtttagacctagccagccacgcaggaatctgtccccagaagcagcagaagcacctggtctgcagttaggagatactgtacttcttagccgtgtcaccttgggcaagtcatttaacctctctgagcctctgctgtcacatcagtaagctggggactgtagatcttctgccctgatgtcctgagactggtacaagaagagccaaagcgaaaggactgccttcagaaatggctgccaaccctgaccatctcaggcagatccggatggtgtggccttgggcagtggtcatgtgacccccatgctcctcagtgtccacatggggtgttgctagatgacataaaataatgggtgagacgtgctcagtataatgagagcttgagaaggcagatcccaccccccatccccacccccaccccttgccgccttgccaatgctttggcagggagagggcagctccatagggcagctgagaaacagcccctcactgcccacacggcagctccagtggagggggaggcagggaccaggacaggaagcaggctaagggcgggatagaaaagcaaaccccagtctggtggaatcgcttctggtgtagtcttcccggtgccatgtgtttgtcctctctgccttggcaggaaccaaggccaggaactgctgccaggcctgagagctgggcacagtcccaagcactgggtcgctaccccgccccactcccaccagccccactgagtgcagagaagggttcccagaagccctttgctggaaaagcaggcactgcacgggcagcccgtgttgtagaggcaagtcctctggcatcttgggggggacacagaccagaaagtggacttggagcttgtgctcccagacagagctgccttggtggttgagaaggggagagagatggcagcagttgagcagagatggccgggctcccctcactgtgtggggtgaggcttcaagcactggactgggagtcagacctggatccgagtcacaacctgacaccaaccggctgagggtctcagagcaagtcatgccttttctgggtctgggggccttcatgttattccctcctggctatgttcttcccctttgctccttgagccgatcccagactgagtgctgaaactgcggccttgaaacttggctcgctcctccccctgcccacccagccagctttcagatggagacaggaagctcctcccaattgcctatgctgcaactagtcaggagaagggcgggaggttggcagtaagtgtttggctactcccagtgttggagactgtgtccacctgaccatgtgatcatctggccgttcatgccaggaccaccaggaacaagcctcagtcctcttctcaatgtcctttccctatgacagccctgcagaggctaggtatccaccactacatagcccacagtctgctctgccccagccacagcatccttggcttgctcagccattctttgtctgggtagtttgaagtccaatccccactctcattacttaccatcctctgaatgcagccagtctgtctgggtctccctgagactggcatgcccagactcctgtgggtatagtctggccaaggcagagttagcataggactgtcacctccctccttctacatactctgcttctattaatgcagcctaatgttacatttgttcttttggtgaccgcatctcactgctgacccatcctgagcagatggacatccaaaatgcctaaaacttttttctgtgtgctcttgctattaagttctgtctctcctgccccattctatgctgttgcagttgtgtttttaacccaggtgcagaatcttactttatttatacctgtggaattttgctcgagagggtggggcatgcatgcgagtgtatgctggtgtgtttattcatgctttctgctgcaccaaagccaagtcctaggtccccacgcagcgatcctaaggctaattattaattggtagctgtaatctaatttgtctttttcatcttctgtttagcaagaggaacagagatcaggtcttatggcaatgacccctgaacggcagaatgcatatatctcccaacagatgagtccatttgaaggtaagcagttaaggccagtgttcccaaaggggtgggcaaggggtgcatatgtggaagtggggtgagaattcatttcagagtaagcagttactgtgcttctgaaagcattgagaaagaggagatctgaaaatcagttaaataattcatccaactctaagagcaggatcccaattgaaggcctggtctaaatgactccaaaatcaccacttaattcaagagactgatttccctgagtcaggccccttaaagcagctatttcaatgggacagggaaacaaccctaggatctggattagaatcacttgggggctgccacacccccagggctctgatcctgcccttctcccacacgcacattcacatactgctgcagtgaccttccatttctaatgggttcctgggccatctgtcaggtatagggaatggaaaaggggttggggaggctctgcttcagaaagtttgtgtcaggggctcccagagcctccacagatagatagcaggggtccccaccctaccatggcagctataaatgtgatcaacatttattggcctaggatacagcagttagcaaaatgcctgatgtagttcccactccgtggaggttgcaggctagccaagaagtcatgagttcagcaacccttacgcaccagtgggatgagattggaccaggccgagggtagtcttgggaacactcagcatttgtctgagggccagaagaggctgcttgccctcagacaggaggtcagcatctttattgtagcccatgacacctctacaccattgctcttctggtcttatggaagacatctttgggcctgataacagcggagtctgtgtcccacttgtccaggctggagtgccacatcaggcacactccagttgcagggacagcacagacaagtttcaggaaggctggtggcctccaggaggttaaccttataaggccagattgtaacctagttgaaaaacatacacatgccatgataataaaagaacctaggcaccattacaagagaaaaaatcatttttgtagatacgagcatggattcttgggtgggtcagacacactgggcttgtgctctgactgcactgtctcccctacctgaccttgggtaaaccataagactgctgcatgactcagtgtccaccccaaaaaagtaccggtagatattggccacagtagatatcagctagagtggactctcatgacaatgaggggagatgtattccccatcttaggcacctgggactctaccttccatcttctgctccgtgtctctccatccccaggctcttcagaactcagggagtccagaatgtcagctcccagatttcagccttcagaaaggaaacccattaccgttcagttgaacaaatgttgtctgagccccagatctgggctcagaggccatctaggctatgagacaagaggggaacaaagcaccgtctgcactcactcaccacactcacttgctgtcccaggtcacatccatcgggtagagaatctaagaggctgagctagctcccgccaccagcccagcccaccccacctggccccttccttccttctacaaaatatgcaccacctgtcaaagggtgggcagtgccaggcctgcatacagagcactgagtgtaaaagcagacatggaccctgacctccaggagcttccaattttcttgaagagacaaatcagctggcatttcagtccagtgtgatctgctcttggtgagcacagacctagggagttggggcagcttcccagaagaactgcagtccaggctgagggcagagaaatgaggggaatggcgaggaattggggagcaggggggagctcagtagagagccaagggcgggaggtgagaagtccgtgttgggccaggagctaccctccggtggccacagccgaagtcgaggatgcctttggaactcatccccacttctctctttctgtatgtagccgtccaagaacaagtcacctccaagtgtagccggatcaaggcaagccccccatctagcaagcacttgatgccacccagaactgggcttcttcagaacaatctgagtccaggaatgatcccactcaccaggcaccagagctgcgagggcatgggagtgatctcaccaactctggggaagcggcaaggaattttcacctccagcccccagtgtcccatcctctcacactcaggccagact

SEQ ID NO: 3941 - DNA, 68728 bp, human; identical to SEQ ID NO: 3939

SEQ ID NO: 3942 - DNA, 149709 bp, human; identical to SEQ ID NO: 3936

SEQ ID NO: 3943 - DNA, 150667 bp, human; identical to SEQ ID NO: 3937

SEQ ID NO: 3944 - DNA, 150897 bp, human; identical to SEQ ID NO: 3938

SEQ ID NO: 3945 - DNA, 68728 bp, human; identical to SEQ ID NO: 3939

SEQ ID NO: 3946 - DNA, 41232 bp, human; identical to SEQ ID NO: 3940

SEQ ID NO: 3947 - DNA, 68728 bp, human; identical to SEQ ID NO: 3939

SEQ ID NO: 3948 - DNA, 149709 bp, human; identical to SEQ ID NO: 3936

SEQ ID NO: 3949 - DNA, 150667 bp, human; identical to SEQ ID NO: 3937

SEQ ID NO: 3950 - DNA, 150897 bp, human; identical to SEQ ID NO: 3938

SEQ ID NO: 3951 - DNA, 68728 bp, human; identical to SEQ ID NO: 3939

SEQ ID NO: 3952 - DNA, 41232 bp, human; identical to SEQ ID NO: 3940

SEQ ID NO: 3953 - DNA, 68728 bp, human; identical to SEQ ID NO: 3939

SEQ ID NO: 3954 - DNA, 149709 bp, human; identical to SEQ ID NO: 3936

SEQ ID NO: 3955 - DNA, 150667 bp, human; identical to SEQ ID NO: 3937

SEQ ID NO: 3956 - DNA, 150897 bp, human; identical to SEQ ID NO: 3938

SEQ ID NO: 3957 - DNA, 4844 bp, human
tatgacagccctgcagaggctaggtatccaccactacatagcccacagtctgctctgccccagccacagcatccttggcttgctcagccattctttgtctgggtagtttgaagtccaatccccactctcattacttaccatcctctgaatgcagccagtctgtctgggtctccctgagactggcatgcccagactcctgtgggtatagtctggccaaggcagagttagcataggactgtcacctccctccttctacatactctgcttctattaatgcagcctaatgttacatttgttcttttggtgaccgcatctcactgctgacccatcctgagcagatggacatccaaaatgcctaaaacttttttctgtgtgctcttgctattaagttctgtctctcctgccccattctatgctgttgcagttgtgtttttaacccaggtgcagaatcttactttatttatacctgtggaattttgctcgagagggtggggcatgcatgcgagtgtatgctggtgtgtttattcatgctttctgctgcaccaaagccaagtcctaggtccccacgcagcgatcctaaggctaattattaattggtagctgtaatctaatttgtctttttcatcttctgtttagcaagaggaacagagatcaggtcttatggcaatgacccctgaacggcagaatgcatatatctcccaacagatgagtccatttgaaggtaagcagttaaggccagtgttcccaaaggggtgggcaaggggtgcatatgtggaagtggggtgagaattcatttcagagtaagcagttactgtgcttctgaaagcattgagaaagaggagatctgaaaatcagttaaataattcatccaactctaagagcaggatcccaattgaaggcctggtctaaatgactccaaaatcaccacttaattcaagagactgatttccctgagtcaggccccttaaagcagctatttcaatgggacagggaaacaaccctaggatctggattagaatcacttgggggctgccacacccccagggctctgatcctgcccttctcccacacgcacattcacatactgctgcagtgaccttccatttctaatgggttcctgggccatctgtcaggtatagggaatggaaaaggggttggggaggctctgcttcagaaagtttgtgtcaggggctcccagagcctccacagatagatagcaggggtccccaccctaccatggcagctataaatgtgatcaacatttattggcctaggatacagcagttagcaaaatgcctgatgtagttcccactccgtggaggttgcaggctagccaagaagtcatgagttcagcaacccttacgcaccagtgggatgagattggaccaggccgagggtagtcttgggaacactcagcatttgtctgagggccagaagaggctgcttgccctcagacaggaggtcagcatctttattgtagcccatgacacctctacaccattgctcttctggtcttatggaagacatctttgggcctgataacagcggagtctgtgtcccacttgtccaggctggagtgccacatcaggcacactccagttgcagggacagcacagacaagtttcaggaaggctggtggcctccaggaggttaaccttataaggccagattgtaacctagttgaaaaacatacacatgccatgataataaaagaacctaggcaccattacaagagaaaaaatcatttttgtagatacgagcatggattcttgggtgggtcagacacactgggcttgtgctctgactgcactgtctcccctacctgaccttgggtaaaccataagactgctgcatgactcagtgtccaccccaaaaaagtaccggtagatattggccacagtagatatcagctagagtggactctcatgacaatgaggggagatgtattccccatcttaggcacctgggactctaccttccatcttctgctccgtgtctctccatccccaggctcttcagaactcagggagtccagaatgtcagctcccagatttcagccttcagaaaggaaacccattaccgttcagttgaacaaatgttgtctgagccccagatctgggctcagaggccatctaggctatgagacaagaggggaacaaagcaccgtctgcactcactcaccacactcacttgctgtcccaggtcacatccatcgggtagagaatctaagaggctgagctagctcccgccaccagcccagcccaccccacctggccccttccttccttctacaaaatatgcaccacctgtcaaagggtgggcagtgccaggcctgcatacagagcactgagtgtaaaagcagacatggaccctgacctccaggagcttccaattttcttgaagagacaaatcagctggcatttcagtccagtgtgatctgctcttggtgagcacagacctagggagttggggcagcttcccagaagaactgcagtccaggctgagggcagagaaatgaggggaatggcgaggaattggggagcaggggggagctcagtagagagccaagggcgggaggtgagaagtccgtgttgggccaggagctaccctccggtggccacagccgaagtcgaggatgcctttggaactcatccccacttctctctttctgtatgtagccgtccaagaacaagtcacctccaagtgtagccggatcaaggcaagccccccatctagcaagcacttgatgccacccagaactgggcttcttcagaacaatctgagtccaggaatgatcccactcaccaggcaccagagctgcgagggcatgggagtgatctcaccaactctggggaagcggcaaggaattttcacctccagcccccagtgtcccatcctctcacactcaggccagactcccctgggcagacttgactctgtctgccagcatatgcagagccccaaggccaccccaccagaagtgcccctgcctgggttctgtcccagctccctgggcacccagtccttgagtccccaccagctcagacggcctagtgtgccaagaatgcccactgcgttcaacaatgctgcatgggtcacagcggcagcagctgtgaccacagcagtttcggggaaaacacccctcagccaagtggataatagcgttcagcagcactcaccttctggccaggcctgccttcagaggccatctgattgggaggcacaagtgcccgctgcgatgggaacacaagtgcccctggccaacaaccccagcttcagcctgctgggcagccagagcctcaggcagagcccggtacagggcccggtgcctgtagcaaacaccaccaagttcctccagcagggtatggccagctttagtcccctgagccccatacagggcatcgagccaccaagctatgtggctgctgctgccaccgctgctgctgcttctgccgttgctgccagccagttcccaggtccgttcgacagaacggatattccccctgagctgccacctgccgactttttgcgccagccccaacccccactaaatgatctgatttcgtcacctgactgcaatgaggtagatttcattgaagctctcttgaaaggctcctgtgtgagcccagatgaagactgggtgtgcaacttgaggctgatcgacgacattttggaacagcatgctgctgctcaaaatgccacagcccagaattctgggcaagtcacccaggatgctggggcactttaaatctgagcaggatgcccatagaaacccccatggtgacatcactctaggaagtggtgtcgatccatacccgcagttgtctcccgttacaatttgagtggtgttgtcagcccatgcttatccctctctctacctgtgacaaaatggaaagctggtgatttttcaagctacgtgtacatatttgaaaattttgtaaatggttttcctaaacattaatgacagaagtatttatacttcattttgtgactttgtaaataaagcgacggcttttgtttcagtagagttgtgtttactatgcattgttttgtgtttattatacaatgttacaaatatgcagaccgtgttgtttgctccagtgataccttgttaagctaggtggctgagtcgcttatggttttaatgcaatgagcaatgtggatatgaccaagagttgttgtgcaagttgacaaatgccaaatagaaaaccacttggccatttatttctatgttcactaaaaatcctattgccttgtgtgattcttaatctcttttgcgaacctttcagtctccgctagctctttcctaatgagctttacagcagaagctgttttatcgttaagtgccccacagagacactttaccaggaggctgggagagttctccagatttgggagaggcgcagagacagtgtgtgagccgagccctgtctcagcaatccacctggaggagctagagtatcctcctccctttaccattcagaccgagagaaaaagcccagcttgtgtgcaccctcgtggggttaaggcgagctgttcctggtttaaagcctttcagtatttgttttgatgtaaggctctgtggtttgggggggaacatctgtaaacattattagttgatttggggtttgtctttgatggtttctatctgcaattatcgtcatgtatatttaagtgtctgttatagaaaacccacacccactgtcctgtaaacttttctcagtgtccagactttctgtaatcacattttaattgccacctcgtatttcacctctacatttgaaatctggcgtctgtttcaagccagtgtgttttttcttcgttctgtaataaacagccaggag

SEQ ID NO: 3958 - DNA, 68728 bp, human; identical to SEQ ID NO: 3939

SEQ ID NO: 3959 - DNA, 41232 bp, human; identical to SEQ ID NO: 3940

SEQ ID NO: 3960 - DNA, 68728 bp, human; identical to SEQ ID NO: 3939

SEQ ID NO: 3961 - DNA, 149709 bp, human; identical to SEQ ID NO: 3936

SEQ ID NO: 3962 - DNA, 150667 bp, human; identical to SEQ ID NO: 3937

SEQ ID NO: 3963 - DNA, 150897 bp, human; identical to SEQ ID NO: 3938

SEQ ID NO: 3964 - DNA, 2644 bp, human
gggaagtcccgcctgcggctcccagaccccagccctttgcagcctctctgagtcccccatcgccgcctctgagctctcccgtcgccctcccgccaatccctactcggttttgctgccttctatccctccacccccagcaacgcccagctcccaagcctcttggccggcccgccctgcgaccccccagttccccgcttacggaccttgggatctccgctgccgccgccgtcgctgccaccgcctgctgtgcccgacccgccgcttgcctctctctgccgttcgccctgggacgggcggacggagctcggctccggcgggctcagacctccctgctcgattctcgggcgcgggggtctgtgctccgccgcccgggatctgcccgggagccgtcctggagccccagggccgcggcgagcgggctcttggcccggctagggagaggccactgcgttgcgctctggtaagggccgccgcggccgccgcgaacttaactttcacagagcaggtcgcagccccgctgctccctccgcgtcagttcggtccgcgctgcctcagcgcggccgcccttgcggcgtccggctcggcttgctgtccccgggcgaatcgcctgactctcccgctcgggtgccggctccctccgcatcaggccccgacgggacagggatcctcgggctgccgcgcaccacgggaacgctttgtacttggatgcccaaagctaattctctgtgctctctcggccttgagaacctccacgtttagagggccgggacagaatactaccacccccaggcttgcggggaatttgggagcagggatgttcaatatgagggcactgtccatagattctctattcggggagctcaaaaactaacgccctaggggttgcaagtctctgcacactgggtagggagaagaaggggtggcttaccagaattccggagcttcttgttcttcgtcacagccaaaatgaccatggagttgccgattaggtctacaacgatggtgataaccatcgcgcagaacataaagatgattagagccggtgggtattctggctggggtagcttacagccaatacagccatagggggtgggaaccgctagggtgggccccatgttgctcctggggatcgttaagatctcccagcaggctcaggatcagcagccaggtccagacagcaaacacctgttctgtcaccaggagctccaggaaagcgtgcctccctctctgagagtcagagagcaaatgacagcatcccgcccctctccgatgagcttttaaagcctcaagaggcggctagccccaccccaaatccctccccccgaccaatcagacctccctgaataccccccccttggctaccccctcttattggacaaatccacattgaggtgtcatcttgcttccgactgccttgtatgtacttcctctctagccagcctgccctgcctctcaatctcccaggtaccttgcaagcatcatgactagctcggagtccaccccacaccccctccaccagcccctgtgcattcgtttctagcaagttcttctccctctctcctccagtgcaaacacctggcaaagagatgtagattgcagagccggagcacagagtctttcataggatccagtgctagaccaagccagtccacagcccccagcagggtataggggatagccggtggccccttgaacgctagatgcttgcctctgcaagtatccttgtgaggtccatcccacgccccatgcccttgcctgtctagagccttctgtgtcccgcggggaacaggggactactgctgggagctcccacccccaatctgggtccctaatccctagggaacttaaccccgctccctttctcgccaggagcctcttggctcccttagcggcagctgcgagtagccgctcagtccggtccaggtcttgcactctccataaagagatgtaccctgcgcccgactctggaagtggggagcgggtctgcaccctgggacctagggaaggcattggtggccactcggtcctcagtttgggggcgaacgggagcgggagctcgtctcctttccagctgccggcagccaggcggcggaagccaagggacgctttgggaaaaagtaaaacaggcaataaagctcttctcttgggtccccgcttctcaaggaaactcaggacgagaggctctgacgcctctccctctcgggatgctcggcattctctactgagcggcacggggcagtcaggaaggctgaaggagctgcgccgcagccgcgggaaaggtgcggaggtgtcacgcggctaaaccaagaagcctctggctgaccggcgatccctgcctcagtcaggattcctctcggtctttctcctttcccatgcccttctggggttctcgtttcgaccccatccctctcaggcctcccccctcgccctccacaccgcggatctctgtccccgtgcgtcacagttcccctgcggtgcgcccaggatctcgctccgcggggaccacggaaaattcgaatattcgggcaaaactaaaggggcgtgattcggacactcgttccctcaataaccttggtcacgggaatggatttctgccggctactaaaagttacggctcctgtcgagaagcctttcaaaatctcag

SEQ ID NO: 3965 - DNA, 3876 bp, human
ctgtcatttgctctctgactctcagagagggaggcacgctttcctggagctcctggtgacagaacaggtgtttgctgtctggacctggctgctgatcctgagcctgctgggagatcttaacgatccccaggagcaacatggggcccaccctagcggttcccaccccctatggctgtattggctgtaagctaccccagccagaatacccaccggctctaatcatctttatgttctgcgcgatggttatcaccatcgttgtagacctaatcggcaactccatggtcattttggctgtgacgaagaacaagaagctccggaattctggtaagccaccccttcttctccctacccagtgtgcagagacttgcaacccctagggcgttagtttttgagctccccgaatagagaatctatggacagtgccctcatattgaacatccctgctcccaaattccccgcaagcctgggggtggtagtattctgtcccggccctctaaacgtggaggttctcaaggccgagagagcacagagaattagctttgggcatccaagtacaaagcgttcccgtggtgcgcggcagcccgaggatccctgtcccgtcggggcctgatgcggagggagccggcacccgagcgggagagtcaggcgattcgcccggggacagcaagccgagccggacgccgcaagggcggccgcgctgaggcagcgcggaccgaactgacgcggagggagcagcggggctgcgacctgctctgtgaaagttaagttcgcggcggccgcggcggcccttaccagagcgcaacgcagtggcctctccctagccgggccaagagcccgctcgccgcggccctggggctccaggacggctcccgggcagatcccgggcggcggagcacagacccccgcgcccgagaatcgagcagggaggtctgagcccgccggagccgagctccgtccgcccgtcccagggcgaacggcagagagaggcaagcggcgggtcgggcacagcaggcggtggcagcgacggcggcggcagcggagatcccaaggtccgtaagcggggaactggggggtcgcagggcgggccggccaagaggcttgggagctgggcgttgctgggggtggagggatagaaggcagcaaaaccgagtagggattggcgggagggcgacgggagagctcagaggcggcgatgggggactcagagaggctgcaaagggctggggtctgggagccgcaggcgggacttcccccgctgctagccactgccgagcgggaggaggccgggggccgggggccggcggcgagcagggcaggagggaagcgtgggaggatgccgggcgctgcgacctgtgctgggggtgggggcggcagacactgcagagcagctagtccggcttacaggttgggcgggagagggctctggaagggaggggaaggggcaaaggcgcccaaactccgagttcaggccgggggagggaggggcggcgcctggaatttccaccgccagattctcgatcggctggggctaggagtggggaccgaagggggtctgagagggtggggagaccagctggattctcccgggcagggcgtgggggagaggtggcggccggggtctgggggattactttgcttgggcaaggagtcacgaacactgaacaagtttaaaaacgcactgactggcacacagtcattaaaagttttcttacaaagtctggtgggtgtctccgatttctccttcgtctcctggaatcgtggggccatacactaggtcttcaccttcacccccgcggtgcggtcccgaggtgcaaacccacggaatcctgggggcgacctgcgaagcccattttattccctttagatttcttttctttctttttctccttctccttccttccttctataattcaaataaaggcttttatggttgttgtggttttgtttttaaggctttgccccttctcttttcggctgtatttccctgaattcattactctgccggaaaaccatagaaagaacctcttcggtagaaagtgctgaggccgagtgctgacagcgctggaggaaggaggaagaaggagccatacctttgcccttttcaaaagcgctcattttctcctagtccaagatgaagtgcaatattttgccaaaccaatgctaattagcaacgaggtgtctccaaagaaagagggctctgcgcctgcacctggcctcttccttctcttttttgtgaaaggttttacaaaaaagttcccacctcagccctacaagaccggagtgggggtgacccttcttctctatcctgtttaacctgaaggctccagtaaagttcagtgcccggcgctgggagctctgtgcagggcgctgaatgtgccagtgcgcggctctgcgcgtggacgtggacgcggcatgtaactgaaacaggcacttctgctaatccttgcaggattttttctcctcccccccacccccgcccacctcgcgccacccttcccgcccgccctctcactacttctttggtctcagactaaattttacagggcttccctgcttcccctcagttttcactcttaggttacctcggaacggtaagtatttgacttggcaaggttttaggttactgcttgatcccatcggaaaagactgtttaagaagatggcctctaatgccttttctcagaatcttctctctagtaatgtgtttattataaatgcaatgctaggctataggagggagatggctaatttatctttttctaattatttaattatttttaatttttttagtttgaggcttcctgacatccctccagtgtctctccttgccccccactctccagcctccttcctaaaaacaagtccctctagctcacctctactcccctcctccttctccctccccctcacctccagtgaaggaaacgtttgcattttgtttttctctaagatggtggcagcatgaccctgtctcattgtgaaggctcctggcagggattttgtgctcactgctgtctgtcttatgttcgcttctttctcagagcatttctttaaaagaattctggaattataaaaggtcataatccagctggccttcccctgcaccttaaatgtgtagatttctgtacttaaaccacttattcttctctgtctttcccctttctccctccctcgatatgtttttcaggcaacatcttcgtggtcagtctctctgtggccgatatgctggtggccatctacccataccctttgatgctgcatgccatgtccattgggggctgggatctgagccagttacagtgccagatggtcgggttcatcacagggctgagtgtggtcggctccatcttcaacatcgtggcaatcgctatcaaccgttactgctacatctgccacagcctccagtacgaacggatcttcagtgtgcgcaatacctgcatctacctggtcatcacctggatcatgaccgtcctggctgtcctgcccaacatgtacattggcaccatcgagtacgatcctcgcacctacacctgcatcttcaactatctgaacaaccctgtcttcactgttaccatcgtctgcatccacttcgtcctccctctcctcatcgtgggtttctgctacgtgaggatctggaccaaagtgctggcggcccgtgaccctgcagggcagaatcctgacaaccaacttgctgaggttcgcaattttctaaccatgtttgtgatcttcctcctctttgcagtgtgctggtgccctatcaacgtgctcactgtcttggtggctgtcagtccgaaggagatggcaggcaagatccccaactggctttatcttgcagcctacttcatagcctacttcaacagctgcctcaacgctgtga

SEQ ID NO: 3966 - DNA, 4812 bp, human
gtttgctgtctggacctggctgctgatcctgagcctgctgggagatcttaacgatccccaggagcaacatggggcccaccctagcggttcccaccccctatggctgtattggctgtaagctaccccagccagaatacccaccggctctaatcatctttatgttctgcgcgatggttatcaccatcgttgtagacctaatcggcaactccatggtcattttggctgtgacgaagaacaagaagctccggaattctggtaagccaccccttcttctccctacccagtgtgcagagacttgcaacccctagggcgttagtttttgagctccccgaatagagaatctatggacagtgccctcatattgaacatccctgctcccaaattccccgcaagcctgggggtggtagtattctgtcccggccctctaaacgtggaggttctcaaggccgagagagcacagagaattagctttgggcatccaagtacaaagcgttcccgtggtgcgcggcagcccgaggatccctgtcccgtcggggcctgatgcggagggagccggcacccgagcgggagagtcaggcgattcgcccggggacagcaagccgagccggacgccgcaagggcggccgcgctgaggcagcgcggaccgaactgacgcggagggagcagcggggctgcgacctgctctgtgaaagttaagttcgcggcggccgcggcggcccttaccagagcgcaacgcagtggcctctccctagccgggccaagagcccgctcgccgcggccctggggctccaggacggctcccgggcagatcccgggcggcggagcacagacccccgcgcccgagaatcgagcagggaggtctgagcccgccggagccgagctccgtccgcccgtcccagggcgaacggcagagagaggcaagcggcgggtcgggcacagcaggcggtggcagcgacggcggcggcagcggagatcccaaggtccgtaagcggggaactggggggtcgcagggcgggccggccaagaggcttgggagctgggcgttgctgggggtggagggatagaaggcagcaaaaccgagtagggattggcgggagggcgacgggagagctcagaggcggcgatgggggactcagagaggctgcaaagggctggggtctgggagccgcaggcgggacttcccccgctgctagccactgccgagcgggaggaggccgggggccgggggccggcggcgagcagggcaggagggaagcgtgggaggatgccgggcgctgcgacctgtgctgggggtgggggcggcagacactgcagagcagctagtccggcttacaggttgggcgggagagggctctggaagggaggggaaggggcaaaggcgcccaaactccgagttcaggccgggggagggaggggcggcgcctggaatttccaccgccagattctcgatcggctggggctaggagtggggaccgaagggggtctgagagggtggggagaccagctggattctcccgggcagggcgtgggggagaggtggcggccggggtctgggggattactttgcttgggcaaggagtcacgaacactgaacaagtttaaaaacgcactgactggcacacagtcattaaaagttttcttacaaagtctggtgggtgtctccgatttctccttcgtctcctggaatcgtggggccatacactaggtcttcaccttcacccccgcggtgcggtcccgaggtgcaaacccacggaatcctgggggcgacctgcgaagcccattttattccctttagatttcttttctttctttttctccttctccttccttccttctataattcaaataaaggcttttatggttgttgtggttttgtttttaaggctttgccccttctcttttcggctgtatttccctgaattcattactctgccggaaaaccatagaaagaacctcttcggtagaaagtgctgaggccgagtgctgacagcgctggaggaaggaggaagaaggagccatacctttgcccttttcaaaagcgctcattttctcctagtccaagatgaagtgcaatattttgccaaaccaatgctaattagcaacgaggtgtctccaaagaaagagggctctgcgcctgcacctggcctcttccttctcttttttgtgaaaggttttacaaaaaagttcccacctcagccctacaagaccggagtgggggtgacccttcttctctatcctgtttaacctgaaggctccagtaaagttcagtgcccggcgctgggagctctgtgcagggcgctgaatgtgccagtgcgcggctctgcgcgtggacgtggacgcggcatgtaactgaaacaggcacttctgctaatccttgcaggattttttctcctcccccccacccccgcccacctcgcgccacccttcccgcccgccctctcactacttctttggtctcagactaaattttacagggcttccctgcttcccctcagttttcactcttaggttacctcggaacggtaagtatttgacttggcaaggttttaggttactgcttgatcccatcggaaaagactgtttaagaagatggcctctaatgccttttctcagaatcttctctctagtaatgtgtttattataaatgcaatgctaggctataggagggagatggctaatttatctttttctaattatttaattatttttaatttttttagtttgaggcttcctgacatccctccagtgtctctccttgccccccactctccagcctccttcctaaaaacaagtccctctagctcacctctactcccctcctccttctccctccccctcacctccagtgaaggaaacgtttgcattttgtttttctctaagatggtggcagcatgaccctgtctcattgtgaaggctcctggcagggattttgtgctcactgctgtctgtcttatgttcgcttctttctcagagcatttctttaaaagaattctggaattataaaaggtcataatccagctggccttcccctgcaccttaaatgtgtagatttctgtacttaaaccacttattcttctctgtctttcccctttctccctccctcgatatgtttttcaggcaacatcttcgtggtcagtctctctgtggccgatatgctggtggccatctacccataccctttgatgctgcatgccatgtccattgggggctgggatctgagccagttacagtgccagatggtcgggttcatcacagggctgagtgtggtcggctccatcttcaacatcgtggcaatcgctatcaaccgttactgctacatctgccacagcctccagtacgaacggatcttcagtgtgcgcaatacctgcatctacctggtcatcacctggatcatgaccgtcctggctgtcctgcccaacatgtacattggcaccatcgagtacgatcctcgcacctacacctgcatcttcaactatctgaacaaccctgtcttcactgttaccatcgtctgcatccacttcgtcctccctctcctcatcgtgggtttctgctacgtgaggatctggaccaaagtgctggcggcccgtgaccctgcagggcagaatcctgacaaccaacttgctgaggttcgcaattttctaaccatgtttgtgatcttcctcctctttgcagtgtgctggtgccctatcaacgtgctcactgtcttggtggctgtcagtccgaaggagatggcaggcaagatccccaactggctttatcttgcagcctacttcatagcctacttcaacagctgcctcaacgctgtgatctacgggctcctcaatgagaatttccgaagagaatactggaccatcttccatgctatgcggcaccctatcatattcttctctggcctcatcagtgatattcgtgagatgcaggaggcccgtaccctggcccgcgcccgtgcccatgctcgcgaccaagctcgtgaacaagaccgtgcccatgcctgtcctgctgtggaggaaaccccgatgaatgtccggaatgttccattacctggtgatgctgcagctggccaccccgaccgtgcctctggccaccctaagccccattccagatcctcctctgcctatcgcaaatctgcctctacccaccacaagtctgtctttagccactccaaggctgcctctggtcacctcaagcctgtctctggccactccaagcctgcctctggtcaccccaagtctgccactgtctaccctaagcctgcctctgtccatttcaaggctgactctgtccatttcaagggtgactctgtccatttcaagcctgactctgttcatttcaagcctgcttccagcaaccccaagcccatcactggccaccatgtctctgctggcagccactccaagtctgccttcagtgctgccaccagccaccctaaacccaccactggccacatcaagccagctaccagccatgctgagcccaccactgctgactatcccaagcctgccactaccagccaccctaagcccactgctgctgacaaccctgagctctctgcctcccattgccccgagatccctgccattgcccaccctgtgtctgacgacagtgacctccctgagtcggcctctagccctgccgctgggcccaccaagcctgctgccagccagctggagtctgacaccatcgctgaccttcctgaccctactgtagtcactaccagtaccaatgattaccatgatgtcgtggttattgatgttgaagatgatcctgatgaaatggctgtgtgaaaaatgctctcgtaggtggccaggcagt

SEQ ID NO: 3967 - DNA, 1486 bp, human
atggccgaggccttacccaggaccctgggggagttgcagctgtatacaatattacaaaaagccaatctgctttcttattttgatgcctttatccaacaaggtggtgatgatgtccagcaactctgtgaagcaggaaaagaggagtttttggaaatcatggcactcgtgggcatggctagcaagccgcttcatgttagaaggctacagaaggctttaagagactgggtcacaaaccctgggcttttcaatcggccgctgacttcccttcctgtcagtaacataccgatctataaattaccagagggatcactgacatagctggaaatatcctgcagtagttatgaaaggagtagcaatgcctgggaacctcattttaaaatccccaattttaccacccaacttttttaccacccaatttaccacccaatttccccaattttgccaccacctgtgtgcagagcttgggacaggggaagtcagatgtggtcgggagcctagcactgcagagtgctggtgagtccagactctggcaaggccaccatgccaccaagagcgagcacagcctctccccagcagacctgggctcccacacgtccccaaaggagagcagcgaggcactggatgctgctgctgtgctctctgtggcagagtgtgtggagcggatggcccccacactgccgaaaagtgacttgaacgaagtgaaaaagctgctaaaaaccaacaagacgttggccaaaatgcttggtcacatctttgagatgaacgataatgatccacgcaaagaggaggaaatttggaaatacagtgaatatatggcagatttgactcaaagaggaaggatggaaaacatctcatgcttcatgagctcactgttaatgaagcggctgctcaactctgtgtgaaggataatgctctttgccttggctaggcaggtttctcgagaagtcacctataaatatacttacagaaccaccaagtcaaaatgtgaagaaagagatgaattatccttgtagaggattaaagtggaggatgggtttccagatttccaggattctgtgcaaacgctcttccagctggctagagctaagagtgaagaactcgcagcccttagttcacagcagcccgaaaaggtgatggcaaagcagatggagttcctctgcaaccaagctggctgtgagagactgcagcatgccgagaggaggctgtctgcagggctttacagggagagctcagaagagcacagtcctaaaggcttgacttccgataactcagatggacaaggagaaacacctttgaatctccgaatgcctaatttacagaacagacaaccccatcatattgtggtggatggggagctgagcagactttatcccagtgaggcaaagtcccactcatcagagagccttgggattttaaaagaccagcctcactcagcttttaccttagaaaagaaagtcatcaaaacagaccctgaagattcaagata

SEQ ID NO: 3968 - DNA, 112786 bp, human
agactttccgggcgcccaccaggctcccgggctctcaccggagaccacagggaggagcttcaaggtaccccaagtccctgcggcctccagcagtgaagagttccacaagggtgagtgaagtccgttaatgaaagctactgcaaagtaaaatgccttggggtggcggcggggagccagcccctttgtccctcggtggctgaggagcccaagctactccatcagagacattccctgcaggaccctcgttttcctggtcatcctgggaaggttggttgggatgaggcagaaggagaggggtggcagcgggtagctgggggttacacgaggaagacccccacattctgaacctcctcctgcattgggcaccatcgtaggtgcaccataggaggcacccattgatttttctttggacatttcgagaaattgaagcagagttgggaagaatggaaagcttgcggtgtcgcgaataggccggtctgagcgggcggttcgggtgagaacgccaggctctgtccggcaggtctggggcgcgtctccattaccacagtcggggacggtgtgctggggtgggcgcgtatatcgagaggtttgcctggttttcagcagattgagcagtttgtacacgtgaaatctcagacttcagaattttcagggcagtagcggcttttcaaaggatctgcttgaagtttttgttgtcctttgggtttgttttttgcttttttggatttcaaatgatgaggagtttatgtcaggatgtgtatttgggcacacttacacggagagcacagaagttgtggctaccttagaaaatgtgttttttcaaaatggagtcagattagcgtgaaagtgccagcagccatgtatctgaagaccgataatggaggcgaacgtcggtgcggtggcaggcatcttagtctcagctactggttacggctgagtttgagaccagctagggcggacttagcgagacctgttctctacaaaaattaaaaaaaaaaaaaaaattagctgggcgtgtggtgcccaactagtcaggaggctgaggtgggagggatcgcttgagcctgggagttcgaggttgcagtgagtcatgaatgaaccacggcaccccagcctgaacaacagagcaagaccctgtattttcaatcaaaacttccttcaaaaattacaactcataagacaataatttatcagttactcatccatcttaagggaacataactttccaatgtataaaatcaagaatgtaaattaatctaccctggattatgtaatatgcatgccatacaccacacaatatgccaggaaaggcaggtggcaaagtcatgctccaaaagagatccaggaacagaatcaggcatcctggtttttttgaggtatccctactgactggctgtgcttttctctaaccttagttctttcagtaagttaagctgtatctaaagtagatttgttgtgcttatttctctgccagttctagaacagagagtactgaggggtaaagacactcaggcagcaaaagaaaatcctttccaccaaactaaagagaatgggcagaaagcattggactcatgactttgaaagtattcaggccaatgtagccagtagatgccctccaatctgtcagtacttacttagagagacatctgtctttgagattagcctagcacttccttaggagagttggcagtgatggagggaggatgtgggggcgggaactggacctttcttccatcagcaaagaacaggcgtgagggctgttcctccttttcttttcccagcaagtcaggagccagtgggaagtggctttcttttttctttttccttactttttttttttttttttttgagacggagtctcgctctcaaccaggctggagtgcagtggcgtgatctcggctcactgcaagctccacctgccaggttcacgccattctcctgcctcagcctgccaagtagctgggactataggcgcccgctaccatgcccggctaatttttttgtatttttagtagagacggggtttcaccatgttagccaggatggtctcgatctcctgacctggtgatccgcccgccttcgcctcccaaagtgctgggattgcaggcatgagccaccgcgcccagccagaagtggctttctaatggctggcctttatgggcagatttctttgcaaagtaattcacagatacccagtttcttgggtaataagaattagactagaaatcctcctactcttaactgaaagttgatagggttgataaggtaattaggattatggggagagcatttggttgttggtagtaaaacgaaaatttgtgataaaagtgtagtttaactctcctggttttggtttcaacatttcattcaacacatattcagaagttctgttagaggcacgttttgagctaagatacagggcaaagcaactgagaataaagatgcagcttttagggagtccataggctagtggagcagagaaacgtgcaaacaaattattatatcccattatttgctttgagctataatatgtgaataagaaacccagacactggacttcaaagagaagggagtgatcaatttaccctgggttagggcctcagcccatcttccccaaagaggaggatttagattgggttttaagttatgagattaataactctggaaggagaaggcagagggagacacacatactaacaaaatgatggaggagcaaaaatgcctagcattttccgaagcaggaggtgaccaggtgagggtggctatccttgtgacctttgaaagaggagggatcagtttgaggagttgcctttcatttcttggacattagggagccacggcaggattttaagaaagtgattccctgtacaggttgataccctttatccaaaatgcttgggaccaaaagtgtatcagatttcagattttggaatacatgtaatttgcattatgcttactgggcgagcatccctaatttgaaaatctgaagtccaaaaatgtttcagtgagcatttcctttgagtgtcatatttacacttaaaaagtttcagattttgtccggacgcggtggctcatgcctgtaatcccagcactttgggaggctgaggcaggtggatcacctgaggtcgggagtttgagaccagcctgaccaacatggaaaaaccccgtctctactaagcccggtgcgtgcctgtaatcccagctactcgggatgctgaggcagaagaattgcttgacctgggaggtggaggttgtggtgagccgaaattgcaccactgcattccagcctgggcaacaagagtgaaactccgtctcaaaataaataaataaataaataaataaataaataaataaataaataaataaaataaaataaagtttcagattttggagcatttcagattttggattttcgattttcgagtcagggatgctccgccatacgtaccacacctgatttagaggtggactcatcaggatttgctggactggattgtttggaggcagagtgaaggagagggagctgttagcagtgatcctacaagtttttgttttatgcaactgattccacttactgagatgaggagcaccgggaccaggagaaatttgggtaagtttagttttggacctgagcataaggtgctggtgaagcatctaggaagccactggatatgcttctagagccagagctcaaaggagtagtcacagctggaaataaagatgcagtgtcatcaaggtttctttttggcagaggcttctggggactactagcacctctttatggctctggtgtcagggaaatgagtcaatgcctaccctgctctagccataaaaagctgctgtctctagtcatgctgatgtgacttagactctgtctgaatgttgataggcaaaggtctgtgtgacaaaggcttccactagattttcaaggaggtactccccgaaagtcagtctcttaaaagacgagatctaagcaattgtctttttgttctgttttgttttgtttgtttgagacagggtctttctctgtcacccagtctgtagtacagtggcatgatcttggctcactgcaacctctgcctgccgggctcaagcgatcctctcacctcagcctcctgagtagctgggaccacaggcatatgtcactatgcccggctaatttttgttttttttgtagagattgtagggttttgctatgttgtccaggctggtcttgagctcctgagctcaagtgatctgcccacctcggcctcccaaagttctgggattacaggtgtgagccaccacgcccgaacaattgtcatattttttaatggaaaatacaaactacctttgacgtcccagtttacactgaaactttacatttgccccttgtcctttatcaagggcttaagatgtcggcaaggctttctccaaacactatataaatattaaattgacttccaaatgttgtttatgagaactagaataccgttcttgttatttgatatgtatttatggagtgtgtgtgttctgacttgagtctagctaatgtcccagtagggtaggatgttttggacgttgatgagtttttcttctgattctatttctaacagttaagcacattgtttaggtaactggttgttccttgattatagagtgttcatggccactaataaatgtcccccatatttaaatatacaagttatacctttgggatggcagggagctaagggccatcagctcttttatatgctaatacctgagatcaaggcacacgatattattcaatcaagctaatatttagctttggaaattaaagcataaattcatgaatgtgaatagtgttcttctttctgcattgatatttaaccataatgtatgtatgcacacaatgttccaagatttctctttgtttttatttttttgatgatgtatgtttcacttgctgcaatatttgttgatttcatgaatactactgatatttagggaaaggatccaagaagtgttgaactcctagtgtgtctttctttaagcttgtctccttgttaaggtgaaccttaacattcaaggttatggtgatccttatcatttgagacatttcaccgaatatatgggtgagcaatgcaccttagacttttcggtgaacttctccatccgtgtggtatctgatcctcctgagagtggccatatgcggtagggaggccagggcttagcaccattttgcaggtactcagacaggctaggtgacttgcccaagatcacacagctagtgcagagctgggactagatcccaagaattctgacctcaagaggggtgttgatttccattgattttgcaattccccctacttaagtcactggattaataattttaaagtgtggattaaggcaagtatattttgttggcttgctctcctctaactttaggtctcccagttgggagaatgaacttgtaggttaatagtttcctagtagaaagcaataaatatattccttagtatagacaataaattgtggcagtttcactctcctccttgggctgcgtcaagatcactttgaaacattcctgggtattcttcatacaggacttagggctgtttactcttttccgtctcccatatcagcctcctttgccaatcatcttcagaaatacaggtgtaagctgtgctgtaaggcatgaaccacacagcactttgaaatgagaaagctttaaagtaacaggcaggaatttgagggggaaattgaaaagtctttctgcacaaaatgattgtactttaaggtgaaattcacaaagtcaatcaacatgaagaatctggaaactctcattgagagttctttcatttttttatacattccataagaaacaaggtagagctttcatgtaaagttctaacttgtgattagagaaggcatttgaagtgtatagaacagagagtatattgtagctggcagccagggcatttgcagagcttcacgttaatgggcaagtgtcttaaccatcagcattgcgaaaaggaatggcacaggagtgagggctgagggtggggtggggagaggggctctggcatcaggtagccaagagtcagcaaaaattagagataattttaagtgaggaggtccatagcctttctttcaggaagtggaaggtttccttggcccctttttctaatttgagaacaatgtggctcatacattgtcaaccttttcactcggtggtatatattttttgaccttttatgtgatattgatacttaaattatatatccatcttaaattaattttgttgcatatagatttttatgtgtggacatagccctttttaaaaaattattcaacagcttctaggagacaacttctctgctttttgggacaaggcagccctgcagtaggcagaacagtagggtaggattcaggagaactgggggttaggctggggattacttgaagataagggatttaaaggaagttaggattctgttcctcttctcaaagttgaaataaagtaaaataaattaggagaaacctaattagaaacctaattgctaaagggtttgtttccctactcagacttgccctgatttaaaaactgtatttacagaatgttcacagccatgtaaaatagactggaaagaaatactctaatgtggcaatgtttccctcagagtggtagaattatgcttgtgttgtctctcctttctattttgtaaatttggcactctttaaaaaagaaacctaaaataaatttccttttaaaaaatgaaattctaaaaagaaacaagaagcctggctcgttcccagcattctaaaggggaatgattgtagagctccacaaaactggccaaggagctacatagtgatgaaagggttttgatctctttgggaagtattgtagggaacagctttgctggcactctcacagcccctttcctgtgtggagattgggctgtgggacctttgtcttgagtggtaaatgcccagcatgccgccagaagccctagctgtggtcactccctcatggagcaccttttcggtctgaggctgataattgtcctgcttcttatgtggtaagctgtcaggactgtgggctgccagctgccttagctttactaaaaggaggtggttgattcattcttttactgtggattgtcagctgaataaagcggcccaccacagccttagggacaaaagctctccattaggattacactgccaggttggagaatggccctttaaatgctgtacagcctcaaacaggggctgtattaagctgaccacctttatgcaaatctctctcctttgtccaaaggccccctcatgacagaggccagctaagcctttatggacagataggctttgtgcaaggctgggggatcacccaggttaggtgtttccaggaagaaaagtggattgaggcgattttgtaaatgtcactgctaataaattgaacattggcaaacttgcacttaagacattacttgggaagaacagattattaaaatggaacaaattgaggtgccatagagttctggagtgctgaaattgttgtcctttggcattatgcaaaacaacattatgtctttatctgtcttttccagttcctttctagtttcctccctgatcctgagctgctttgtttttgtccaaagtggagaggctgctcccatctgtgctcatctcctccttagttgctttggctcttttctctctccttggtgctgtgttttccctccacccatctaatagaatatttccaaggtcttatcttcttttcctcatgtcactcccttggggcgctcaagtgacttgtctaatttcaaatattctctgtgaacatgtcttatagagtcatggattccccaagctgaaagagacttccaagtcatctgtccgactcatgtctatgtggtcaaattgacaattcttgtcaaatagaggttggagtttcttccatgtttcattgatgcctaagcatgcaagagaacctaaagttgatgacttttctttcagtacttttccatgattcagtttttctttaagaaaaaacactctccccttttgaccttcagctactttagcctccactgccccaggcccataacagtagcaacacatctaattcttaatctttgttccttctcatattagtctgcctccttcatagcatgtctgggagtcatcctctcttgcaacctttttctcttctttctgcagcagctaacctcgaaccccttctcagcctgtctgcttgagctccccttgcatcacctcttttaaaattagtttgatcttgtgagtcaattctcagaaaatttgagtagtgcccagctacctcacacagtaaataaaaatgttaacatcttcagttagagaatccagcctgacctgacgactttgattttctcatttgatttttcttaacaccttttaacattccagctgctcaatttttagagaattattttgacagttgtaagttataagagctatagctcttctttgaaataataatattttaatttttctttaggtccttttgatttacaaaaaccccccacaacaacaacaataataacaatagcaatgaaaacaccagacacagtgccttgcccatagtatgtttgggggcatgaatgatgaataaataaataaaagtatttgaaatcactgtagataacttgagttgcccagaagccagaaatgtagaacccgctgtcctggaaactgtattctttcttccttggtaaattcctacggcatcaagtagaggaaaccttaataaatacggactgggagtggcctaaaatattccactataatctgtaatactttcagattctttacggtttaaatttttctgttcatttatatatgaaaatctttctgtttaaaaagttctttaatgaagtgttccagtatcattttctctagattgttttactgattggctgtcaatattttaaattgaaaaaggactggagacagagaaaaacttacctatcaaattcttaattaaatgattcatgaagatgtcttttaaatggttcatttgaaatatacctttatacgaacaggaatggctatctccatattaagtcatctgtataagttcgttcttgcattgctacaaagaaatgcctgagactgggtaatttataaagaaaagagatttaattaactaacagttctttaggttttacaggaagcatggtattggcttctggatggagcttttactcatggtggaaagtgaagcgggagcttacacatcatgtggctagagcaaaagggggtgcaggaagatggggtggtgacggggggtgggggaagggcatgctgggggtagaggttgggggtggggggtaaggcaggggaagttttggggtgggggtgggggctgggggtgggattgggggaaggtgccacatacttttaaatgaccaaatctcccaagaactcactcactatggagaagacagcaccaagccatgaaggatccacccccatgatccagtcacctcctaccaggccccacccccaacctcggggattacaattcaacatgagatttggacaaggacagatattcaaactatatcatcatctgtcctgcatgttttcctacattttttctatgtcttaggtcgttctgttcctgcatctcatgatctctggagaagtaacaagttcttgatttttcacaattttcaactagctgaatgttattcttcatagttttacaggctatgtttagatagccttgtgttgctgagagaaacttaccctattcgctgcagtgatcggggagagactgacaatacaggactttgatacagtaccaagtaaggcaggtgccataagggtaaaggcaatgtgctgtggagatggaggacagaggatcagaaaaggcttattggagaagatgctttgggggaagtgctttgaaagatttatattacttcattaagtaaagatatagggaaggacattttaggcaaggagatgatcatgagcaaaggctgggcagtatgaatgaagagtgagtgtctggataatagtgggtagttcctggaattcaggaatgttgtgattggaaaggtgaattgggttgtattgtagagagccttgggtgacaggctgagacagttttattgtggtgatgcttaaaatctccagacaagaacacatgtgattgtaataggagagcacattcaataaatatttgtggagaaatcatatattgaacttcttgtatttcccctttactaacatgttgtctgtaatgaggcaaggtagaaatgaatttaataaaccaaaccaaactcaaacctgtctaactaagtgggttccaaagtccacatgactacttttgcttgcttcacaatggcttcaagtgacaaaccttgtgaggggatcttccttgaggtcacaattgtgccaaacaggtagtcccaagtgccagtcactagtgaagttaagcactgggcataactgccaactgtgggcacctagccaggttcttgccagatgctccttggctgatgtgaatgaaagtcatctgttgaggagtggctccagttcatgtcactggatgattcttgagcttctgccctgtgctgggtgctgcagacagggagaaatcagaccacattctggccttgtgctcatactccactgggggagacagacaaggggtcgaatagtgatcatacctcttagaaagtgacaagtgccctgagacagtagcagacaatgaattctagagggttcagggagaaggaagctgaggaaaacatttgtgagagtgcattctacctgaatctggaaaaacttgaaaaaaatgatgtactttgggattcaagtccatacatccaggttacacttaacctttacacccagtagatgctgtggggatagatatattttgccaaacatcagaaacagattgctcttttgggactacactatttggctttggcattggtatgctccagaggcaaaaatggtgtgtccctcagaaaaggcaagaatactatttgcctaaagtgaagcaagtccatagaatctgttaaaagaagtttttgaacatcaacacttacattttcttctttttttattaaaaaatagagacgaggtctcgttgtgttgcctaggctggtcttgaactcctgggctcaaggaatcctcctgtctcaggcttcccaaagtgttgggattacaggtgtgagccactgctcccagccatcacgcacttttgtatctataaaccaaggtaaagattacaagtaagagtttttacattgcagaaaaaggagaatttccttagaggcagatgtaaacaccatctctagggcttgtatcaaagaccactggacaaaatagcatgagaaagctcagtccctttggtcaagtaaaccatcatggtgattgcagggggctggaattgggaggagactaaagacatttgacttcgtgcaaaagctaaaagcagtttaagaccattttttttttggcgggggtggggggaggtgatgaacattcccagtttctccaatcaatagcatttctgtgagaattgtaacactatgaaaagtcatttctaatctggaaagtcttggtggttgaaaagtttctcttacctttattttcagttatgtgattattgaattccctggtgttgttagatgggctattttttatttaaaaacatctcttttttctaagatgatctggatagactatccagtgcccatacataacactcatcagtttttcaatctctcattctcaggtaagaaaacgatttttgtctttcagactttacttttgtacttacctttttatattttactatgtacttgtaatggaagtaagattcctctgtaatttgaaacggatcatcaagttgtaagtggggaaaatctaagtaatgagctggaattttttttttcttttttgagacgaggtctctctctctctctgtcacccaggctggagtgcagtggcataatcatggctcactacagcctcgacttccagggctcaagcaattattccacctcagcctcctcagtagccagtgaatagctgggactacagacatgtagtgccatgcccagctaatttattttttatttttaaaattatttttatttttatttatttattcttttgagacagagtctcaccctgtcacccaagctggagtgcagtggcacagtcttggctcactgcaacctccacctcccaggttcaagtgattctcctgcctcagcctcccaagtagctgggattacaggcacctgccaccatacctaatttttttttttttgtatttttagaagggatagggtttcaccatgttggccaggctggtttcgaactcctgacctcaagtgatctgcccccctcggcttctcaaagtgctaggattacagatgtgagccatggcgctcagtcctaatttttaaatttttttgtagagacagtgtctccctgtattctccaggctggtcttgaactcctgggctcaagcgatcctcctgcctcaccctccaaaagtgttgggattgtaggcgtgagccaccatgcctagcaataagctgcattttaaaataataacacctgagttagtaattcatacaatgctcagtcaggcttaaagcataggccaagatgtaacatcattcaaatagtcaaaatcaactcttatcctagtgaattgattacatgtgaaattgtgtagcatcaataataaaattatctgtttatggatgttcttgattttcaccaatgacaactacagatttaaagtgcaaatcatattttatcttgagattctacttgatcactttaaatgtagcactcttctaatttccctcagagaattataaaatcaagtgaaggaaagaagatgtcttagttttgataaattggtgattgtagatcaataagaagtgtgtgtgtgtatgtgtgtgtgtgtgcacacgtgtgtatgtgtactcagttgtagaacagttgcaaacagaaatgaactttaatgttaattttcgccaactactgtaattttatgtttatatagatattatatgattgtattctatcaaaacatagcatatatttattgccataaatgtaatttgtttttttacatgatttgccataaatgtaatttgatacttctgtaattaaaaagtaaatagatatagaaaatagatttataaatcttaagatataacaattagagctcattctcacccaactctttcaaatggggcatttttccagctatgcggctcgtcaattctgtaaatatattttttgaaattacatgagacagcccagtgcagtggttgtgcacctgtagtcttagttatacgggaggcttaggtgggaggattgcttgaaccgaggaattattaatagaagccagcctgggcaatatagtgagacctcgtcttgaaagagagagagagagagtgagagaatgagatttacatttctgttatgctaagttgctcatttaataaaaaattctcaatagaaacacaaattatccttgcacagccttgaaattccattttgggaccatttccttagtataggaattctactgtggtggtatatacagtgaacagattttaccttgtttctgtcttcaaagttatttcaatggcagggattaatagcatattaatttatggctcatactgtttgcctgaaggagacttatcttacacagataattctgacagagacatataccataatgcacagtcattgcaattgttttgtaaaagaaaggttaggtgagagtctttatttatttatttatgagatgaagtcttgctctgttgcccaggctggagtgcagtggtgcgatctcgactcaccaaaacctccacctcccgggttcaagtgattctcctgcctcagcctcccgagtagctgggactacaggcatccgccaccacgcccagcaaattttttttgtatttttagtagagacggggtttcaccgtgttagccaggatggtctcgatctcctgacctcgtgatctgcccgcctcagcctcccaaagtgctgtgattataggcgtgagccactgcgcccggccctgagagtcctttattcttcaagttgtttcccaggtatttgggcaggctatgctggggacctttatgggagcactttgaactgcaaccagtaaaccagttaaaaaggatctctgctattaccacattcatctttccctggaccattcataaaccttggaggggatcctaagactagtatttttgtcacagagaccattcaatatttgttaggctttcaaagtttccattttgtcatgtataagccaaaatgcatgcataggtgtttgaggatagaaagtaaaacaagacaaagacacactgaagtcattttggagattctctgtgctcctagatctattaaaagtgctgagatgtcttgtgtcaagaaatctgcttcagtgtatttaaccagcatttttcaaatgttctccgctaaggaacacttaatacctatttttatttttgcttaatcctgttaacatcttttggtattcgtgttctgcaggaccagtgacctttaggaaagttgttgttacctgtatgataccattttatatatatgatcaatggtatttggctcagctatattgaattccccaggaataatattgaccagctatttctgggcaagaagaccatcagctaattgcagtgtcaaacttcttatgacaactggtcatgaatgcttttgtgccaaattctctgatgtgttgactaaggctctggcaggtttgaaggcatcaaaaactcctgaggtatctccagtagattcaaaaactggccttgcaggcttaagaactttctctgctgcagagacaacagaaacaagcctaactccccaaatccagaatgaatctgttgactcagtcccctctgatcttagatgctgttgcttggggatgacatttgccagagatttctcccctctccctctcctctgagtggctttgagatggtgggttttgataactgagttcacctcgttggagagaaagtgtggacaccagcatcacaactgtggtgaacaaaaagtctcctccccttccaaggaagctgggaaggtggattgcttcactgaagagttaaagaaaagagttttagaatatattatttgattttttttcttttttcaggatcatctgttgggcacttaagtcacagaccaaatcccattccatgttcctgagaacccgtcctttaaaatactgcagaaaaatgggtttgcctgtagtttgacaaattaacttttctttaaggaaacagtaaaatgtgattttcccattcagcaaaacttagaaattctttgcatcaaatttcagtgagttttatttttagtgtatatgattggaattctgtttaatacataattttgaaaagtcagcatctgtttatattgtgtataagatagatccagtgtggacaatgtcatataaaatgttaatcttacaaaccggtaaaggcttcaagtttaacttaagcctgttactaactttgcaaaattttttaataaggtgagtgactagaaaaaccctagtttctatagattttaataaactcaagtgaggaaatatatataaaatgaagttttacccttacatgagtaataatagaagttttaaactgttatgcagatctgtagaatccaagtcaaaggataagttgttattcagcttttgtaaggagcaaaggaataactgtaggaagcttaaaagctgtagacattttagggaaagaggcatagtgaaatggacatgagagtaatgtaatcttgactcaattttaactttttaagcaatcatttgcaaaccccaatgctttaactaatattaaaacatgattatttcattcatttatttattcattgaataaaaattattgggagaaagtgaagatgggaggtgtggaggagatgtgcaggaaagaaagagcctctattctgggttgttggaggctgtcatttagtacttcacattatttttcttgttagacaagattacacatgttggattgcctcagtggattgaaatggaaattctattgaaatataatgggtgaaaatagtttttcttctataatggtttgctctctttatctcagtagcagtgcagtctgttttctctgtgagtctaagaatgacagcctgagcttttcattagccagggaaccctgagcttcactctagcagagttcagggcatttaagaaaaagtatgattactttaacccaggtacttccctgctgtccataacaccagatgctgaccctctgtgcttctgtttctgtattccatctgtgctcttcatttttatttctccctcttagcttccagaacactttacgtataactttttaatggaatttataaattttgaccttgtattctagttatctatttacaagtctgatctccaaagagcagaacaaattggcttcatctctttattctccagagtcagccacagagtccacacttagaaaatgtctataaaatgaattaatgttaaatgaataagtggaatttttacagaggactcttccggaaagatgtgttacatgatgtgtgttatctttagttccacaaacgagtctctactttttatataaaagctatctggtaaagagaaccaggatattagaatatgggattttctcctgttgaccttttccttcgaacatgctccctttacatcatttctttttttcttttttttttttttttttggtggaagtagtctatatattattttggatagtgattacacttgtcagaattcatgagactgaaaatatgtgtattgtatattgttatatctcaattaaaatattttagaaaataatacaatataaacatgcaatacaataaatacaataatataatacaatacagtaaacataatgatatatgtctctcttgatatggaaagatgttcatggtataatgttaagtaaattaacttggttaaaaactctggctaccataaccctttgtgcatatatatcaaggtagtgagtttttaaattttattctttaatgtctttcacatttttcaacttattttgaatgagtattttaccaataaagtattgtttactatacagtaaaaaatttaaagtacatcccctgcttattaaaactgcagaaattattgaaccatatgagaagtttatttttatttctattaaattacgaggctgccagatcacttgaggtcaggagttcaagactagcctggccaacatggcgaaaccccatctccacaaaaaatacaaaaattagctgggtgtggtggcacatgcctgtaatcccagctactcgggaggctgaggcacaagaactgcttgaacctgggaggcggaggtggcagcgagccaagactgcaccactgcactccagcctaggcaacagagtaaagctctgtatcaaaaaaaaaaaaaaaaaaaaaaaaaagtaacagaactgtagcttaaaaatagtcatgaaaatttatttaaaaatgtcttggggccaagtgcagtggctcacacctataatccctgtgctttgggagaccaatgcaggaggatcccctcaggccaggggtttgaggaccagcctgggaaatatagtaaaacctatctctacaaaattataaaaattagctaggcatggtggcatgcacctgtaggtcctagctactcaggagtctgaggtagagtatcacttgagcccggagtttgaggttgcagtgagctatgatagcaccactgcactccagcctgagtgacaaaggccctgtctctaaaattaattaattaatttaatttaatagaaatacatcttttcttatagatgaactatcagttacatgttttgagtttctcattcttcatttttggtaaattctctggttgatttcttttggagaggaacccatattagaacttggggacaaaatgatgaaaaaggagagaggaaaagagcaggatacaggaatagtgtccactaatgaaccctagaaagagaggccatgaacagccagctctgtcaactcaattttgcatagctctcagttcaatgagtagctgaaatagataggatagagttacagtgtgtgaagagtagacaggaaaatttctctaggaggtgttcaggggcaatattcccaataatatgtccttgaatcttttttttttctttttccttttttttttttttttttgagaaggagtctcgctctgttgcccaggctggagtgcagtggcacgatctcagctcactgcaacctccgcctcccgggttcacgtgattcacctgcctcagcctcccgaatagctgggattacaggtgtgtgtcaccacgcccggctaattttttgtatttttagtagagacggggtttcaccgtgttagccggggtggtctctctcctgacctcgtgatccaccaccttggccttccaaagtgctgggattacaggcttgagccaccgcacctggcccccgcttttttttgagacaaagtctcactctgtcacctaggctggagtacagtgagtggcacaatcatggctccctgcagccttgacctcccaggctcaagtgatcctcctgcctcagcctcctgagtagctgggactacagacctgtaccaccatgcctggcctgtctttggatcttgagtgtatctaagagtatcagccttggttcagtgtcatggtccactcagatatgacagcaacaaacacccaaaggggctttaggagagctctaggtgggagagagatgtagcaggggcctagaactcaaatactggagggggaagtgatgaggcaaggatggaatgcacttcaagattcttacctcctccgaagcctaaaatgctgctgcacttcagctttgatactgtctagaggtttgaagtgcactggactgtcactccttgctatagaccaggaattctcaaatattcaaatcccgtgtcttagcaatcactgtcaagggactgagctcttaacatgatggaaaccaaactctctctcctatttttttttcaacgaacaacactgatgtgtttacagacactttgtcagcatagttatgattttttgtgagtttcaagagcaagatcaattgctgaaaagttattggacataaatgtaattgctacagaacatcaaagtaatttgttgataggcaagggaaccagaattgggagaaatgtgggatgttcgtgcttagtcctagtgagctgaaggtcacagatggaaattgggggtgggtgtaagcagggtggttgggaaacaacacgtgacacttgcagatgggcaagagtgttgaaaaagggccaatgctaagtaatgaaaaggcagtacactacagcaagtgagtgctcaggcactgccatggactcccaggatggccttgggaaagttagcaaaaatatttggaacccattttcctcatgtgtaaaatggggaacataatgcctgggatgtgtagtaagtgtttaataaatatcacttaatgttattactatctttaattattctaaaatcttatacttttctactgctataaatctaaattcactaactatggttgcatatgagccccattccaagggaggtttattgcttaaatataaaagtaacataaggaggatggtttcatctccaaggaactcttataacaagggacctgaagacagattccctgtcaagtcccagcgtagttttttttgtgtgtgtgctttggaagaagaatgatagtaacatactcttcataattaattaaaaaactggcaatatttttcagttctacctgtcttttagatttcacagactgttttaatcttgatgaaatcctttctaattgtggagttataatgattgacttcaatgcctctccttattgactgtgaactttgtgaggacagagactgtggcatcttcatctctggattctcacacttgatattgctaaggctggctcggagtatgcactttgtgaatgtattgggaataaatgcagtacttcagctttttgacttaaggtgctttcatgtgtcccagtcctagaagaattcaggctaagtctaagggaaatcaaaagaagatctaaaagagataaaaatttactgatagttctatcagttctcagctagatttttataagatgtcaatttggagaagagtatgaatttaatggattaatagaacaacaaggttggtatataggcacattcctagtgagcagaaggtcacaaatggatggaaattgtgacatagctagaaatgtaaggaccattaacaataactttggaattcccctctgaatcccacagtagaccactctcattgggaagtgaaggctagcctttgaaatacagattgaagaaatcaatcagggaaagatagcaccagacaatacatccagaagaaaagcagaagcttttcttttcttcatatcaggggtttattgcttcctatacagattgatttctgtgtttaatattaggacatgctttgggaataatgaaaaacattaagttctacaggctgattgaattccacttaaaatcttacaattcgtgtttgtcacctggatatctataggtcttattcactaggttttattgtccagctactgtaactagccgtgataatgtgtacatttgagtagcagacttcagattaattttcctttttcaggaagtaaagtcctgcaaggatgtcttgttattttactggaaatcaaagggatgatgaactttcctttgcctgttgggggtggaggtagccctggacagttatagatagtgtgagacagcactttaaccactagatgcaagaaacttggaattgatttgtcttgtaaatgcttccacaggccattacccattctctaaccctttgaaacatccttagacatgatggggttggtaaacttcacacagaattcactacggaaattaaatatgctggatttctctggaattatttattctgtaaaatcctaggactcctagggaccacatctctttgattttggtattctaaattctcatttcctctattttgtcatctcattgtataggaccatattctgtcactgcactttgcaaagagaagggtgagctgttaaggaaacatagtttgtaccaagttttctatatcatcttttgtacttacatacatttaatttgattgaacaaatacccaatgctttgtgtctgtggtgcacagttctagatgttttaggatatagaaaatggaataagccttccctgtcctgaggaagcttacattctagtggaagaataagaaaaatgcacataaagggcaaggtttagtaggggtaatccaggaagacttcttggaaacagtggcataggtatataaggaaatccagtgtactttttaattcttataccagactctctggattcaaatctttgatctactacttactagctggttgatcttgggctacctttctgtgactcagttttttcatctataaagtgaagataacatcagatcatacctcaaaaagatctgagaatcaaataaattacttgctgcagagggcttcaagcagggcctttccagtagtctgggataatgggggacccaggggaaggctttaagtggaaggacagatcaagtcagtgtataagatcatattggccgctggttgaggatggactagagggggcaaaaatggagaccatggaggaagaggtggttgcaggaattgaggtgaaagggcctgagcttgaggcctggcattgaggattggtaggagcaggcaagtgtgagtgatagtacagagatgggatccaaggacagacaggctatggttgctggtcagttgggcccaaaccagggcagagaaggaagagatgttatgaaaattgacttggcaaccatcatttgcaagaatagattgatgatattcatgcttgagtattttgtcgtataactgggattttctctgctaatatccaggtaaatatgaatacctggctttctactcctttcagaggattgttatacaataaatgtagaaatttaattctaccgaatttttgttgtttcaaccaaggaaggagaatgttgcattctgttgataaataagggagggaaattaacaaacatttaattacctgcctgatactgatcagcagaattcttacatggcttagggattctggaggaaagggttgtgggaagggcactcagtttgaccatggaagaggaagcagattgctttggggcttcatgtacaacccaggaaaatgctaggggacaggatgtagaagactgcatctgagagggtagctagagagctttcctgggcaagagtgaatgtgaaggctgttacaaaagcttaggtggtgttgtccagagaatgtagtggttataaactgaattctaaagtttcccacttattcatatactcactttcacatcagttgggcctccaaaatagtttagagagcttttagagtaatcacttcagagtttagtaagagagaaagaaagtgggtagcgtagcaagagagagaaagatcaccttccttgagagttgaaaagcactacagaggagatggtgaagcaaatgtttacagactgattttccagtgctgtcaggtactagctatgtaacttcagacaagctacttaaactctgagtctcagtaccctcatgtgggaaatgggagtaacagcacctatcgaacagggctgttgtaaggattaaatggtgactggtgaaatacacaggacctagtatgtatgtagtaatctcagtaaatgttggttattttggctctacctctgctgccactgccctacttcaaggccccaacctctcccagctgaactccctgggtcttctaacttaagtgcttctcaaaggttagtgtgcatagacatggcttagagaacttgatgccgtgatgattctgattgtaaatgtccggggcatccctagaacttgccatcttctgtgaagcttctagttcggtattgattactctcttgccccttgccctgaatcagtggatttatacaggtgccagtcttccccacaagcctgtgtactgccagggtgtggcagggacaggagttgaattgctgagatttcagaactggcaggaacacagaagggttttatggacttaattagaataagactgggattaatcgtttaatggattgctgatctgttttagagcctgcagaaatttttgctggaccatctagaaacttgaaatattctgccggaatgttcagggatgccagaaatcttctgtttctttagtattccttattgtctcagactaagagaacatgacatatgaattcccaaaagggggaaatcagtaagaaacacccttttaaatctgactttgtttctttacagatctgggtttgcctttttttttttttttttgtacctatcttttaggaacaggattaggattagctgggtgagaggaggtgttcagcaaactttgaccatttgcatttttacaggtaagactcagcgttccctcattcatttattcatccaccaaacatttattcaacatgggttttctaccaggcacagtttagggtgctaggaatataataagtgacaaaattggcctgaccctgttctcagaaggggccacaaaatatgcacctgtgctcagaatgcacctcagctttggtctaggaaagactgggcatttttcctatgcaggtatgtgtgtatgtgtgtgtgcgtgcttccgtggaattgagttcattttcttcattgcttggattccctcacaacgttggctcaggtcagggtctatgcttgtgcagtgagagcttactgaaagaactaaggttagagaaaagcacagccagtcagtagggatacctcaaaaacaccaggatgcctgattctgttcctggatctcttttggagcatgactttgccacctgcctttcctggcgtattgtgtggtgtatggcatgcatattacgtaatccagggtagattaatttacattcttgattttatccgttggaaagttatattcccttaagatggatgagtaactgataaaatattgtcttatgagttgtaatttttgaaggaattttgattgaaaataaattggaaatttccactgacttggttgatatgtttatatcatacacatttaacatcattactgtctacttgagaattgtaaatatttcattctttctcactgattaaatgcctttaataaaccttatatgagaagagaagatgacttcactcacattgatgaaatgtgccataatgcattttcccctataaacttaaaacaaattcctggaaccatattgagatttgaaagaccattttcctttgcttgagcaattgtttataaagagtgtgtacgtgtctctctctatagaaagacagagttgatccctgatagtgcgcagcaatttttataactacaaatatatgatgtgattatcttccacaatagcattttcaatactttgaggtttttactttaaaataaacaaatattgtaaccaaagtaatttccaaagatgtagtagtctctgcattctgcttttcttctgaccttctctggttttctttaaaattccatgtaaacatcttaaatgatgtttacatgagtcaaacactttctggccattactgcactgggaggccacagagttttctttctctctgtcagtctggctaagctgactgacagactgggtgagggaggacagactgatctgcagagcacatttctgggtgctgctgaaatagtactcattctgacaaatcgctgattaggcctgccaggaactgcctgtgatttaggcaaccccacagagattcctgggttctagagcactaactagttaactttaacctcttcagatgtggaagagtgaggatatgttctctcttagtctctctttatgaaagatagaatattgttcatgatcatactttttgcaccattagaaattactgctaacatttgcaacttaattctgctcaattaggcccagaaactccaatccttgcattactctttctctgggacttttaatacacctgcccattgcctgctgaagattcattccagccacttggcttctctactttttttctcagtgagctttccccacatccctgccccaacttcttcacttagtcaatctttacatcacagttctacacgtcaagtactgtggctaatattcttagtgtctcttgttctccttggtgctcagaaacactcggagcaaggactgatctgatcaccccctttccccattcctacatgtgggctgctgtgtgttattggggacaatgtcacttctgcgcagatcattaccactacagggttatcctcttctgccacatgttgcacattacgcgggcatacattaggtgccatgataccctgactctgcacctagacctgagacagcacttattcatgacatgttagacttacctggtaggcccactgcatggagattggtctccacacagttctctcattgttgcaacaacaggtgatgtgaagaaacctctctgtattgccaaatttttgccatcactgccccctctgagaagactgcatccttctcacagtcttttagattttatactgctattaacaatcgctaatgaaagccataatttattgggtggttgctatgagtcagtcatagtgctagccacttcatatacattaacttaattctcataaaaaccttggcatgtaggtattataacccccattttaaagttgagataattgagactcatagaagttaaggaccaaaggtcacacatctacaaacaggtagagagttgggatttaaacccaggtccaattgattccagagcccagtctcttcactcttcaacactggtgtccacattatttttgagaggagtttcttaattctgaatggcacacatactaattgtaacaaactttaaaaatataaaaaaaatgtacttgctcattgttctatcactaaaagacaccttgtgaatgctttgcttttatttctcattctgttttctacacaatattgcatttgatcatttgcttaacatgattgggttcatatagcacatacaatcctgtaaccttttccagacaacattataagtatttttcgtaatacagattctctgaaaacatgcttttcactagcctctgcattgattacaaaacatgaaaaatctactggggagtgtcacaaatgagatattccatgaaataagaaatgtaatctggggtgggaggataaagggagcttggactcctagtcctgggcaaatgttactctatttgaaaatgaagaatgccacaaatatagacatttcacatggaactgcactaaaattcaactttaaaaggcagaacaggcaaaggtggatgagtacaagttatttatctgaatttgtgaaggatttgttggaaaggacatcagccctgagatatgtaagtaaactcatgaattacagtgctttagtctttattttaaactctttcctagtcccctaggtttgcattcagaaagtcatgatcttgcaattcttgctcctcagcctggtttctctccttccacggctgtcaggtgtagtaaaaatttggcattgtaaagtagtccatggatggtggaagatttaataccttgaacctaaccccatagtaaatgggtcctggactgattctcaggacatgttccactttcactttttatttttacttttatttttacttttatttgagatggtctcactctgtcgcccaggctggagtgcagtggtgccatgtcatctcactgcaacctccgcctcccaggctcaagcgatcctcccacctcagcctccacagtagctgagtctacaggtgcgcgccatcatgcccagcttatttcttatattttcaccgtgttgcccaggctgggcttgaactcctgggctcaagctatcctcctgccttgacctcccgaagtgccgggattgcaggtgtgagccactgcacccagccaggacatgcttcactttgattctaattcaggattacaactttagtgtcatttagtcctgaaatatttgttctgggagatatggcacatgacatgtatgtcacataggtcccagatagaactcctgcaacatgtttcaggaacattagcaacaggagcccagattttgatcagtaagtcacttgtctctagaaaaggttggtattgctgtggagcttgagctgtaagtctgatatttgggtcttggaagttttgagactgagagagttagactgaggattcttttgactgtgggccttatcccaattagacactgatacatctatattatcatagtagtcatgccggaaagtatatatctaagtgattctcaactacagagagccaatgatgaattaaatccacctattcagtgtgtcttcttgtaaactaaaacaaatatctatgtatgtatagatgtgtgtgtacacacacatctatcatacgtttttccagaaaattaaaaatggatgagaacaacactccccacaaaacctcttagaagaaatgtttgcaagtgtgaccctcctgacctttatattatacttcagtaatacaatttgatgggattttagattatttcccattgattttggaaaaatgtacttatgtaaacagctatttccaaccaattaattattattttgcataggagggctgactattcttggcctgagagcttttaattagccttattctttttcaatctttccatgttctttcaccgacataagtttctgaatctgttgttttagaatgaattactgagtggagaaggtgcaaagtccattagcagttaggtgtttgagcctaccttgcccagtaggtaaggagagtggtcaggtgtttatctgtggattttgagtgtgtgctctgtgtgaagctgtgtgctgttggaggtatcaaagatatgtaaagcatggctcctgtcttcaaagaacttgtaaacaaattttgttgccccaaaacacagaaagggctatattaaacacacacacatactctctctctctctttttttgtctctctccatggtaaaacttcaaaattttaatgcctcttttatcataaatcaaatttcagtttatgttgtctcttctctgctatatgtatgtgtttaccattattgattagcctgaatacagtagctttataataagctttgatgtctagtaggcacaccctttatattgctgttgttcttcaaagttattgtaggtattttggccctttactttccacaggaattttgtaattaacttgtgaagttacatagaaaaacaaagcaaagcaaaacaaaaaaacttactggtctgatcagaattatgttaatttgtacattagttgggaagatctgataaattgatgatattgagacatcccttacacagacttcgcattgtcactgcatttattttatgtgattcaataaagccttattatttctagtgtagtatttctgtgcagttttgttaaattagctactaagcactggatagtttcctttctatatgaaggaacctataaatgttatttaagaacatgaaaaacgggtttgaataattgtagagagagaacttttcttgatggaaatatataccataaagatgtataaatgtaattttaataaattacaattagattattgaagtttttggaatttaaaattaatttttatagtaaatcattttgaaatattttccaattttctttggggtttcttctttgacccacagattgtttagaagtatgacatttaacttccaaatatttgaggggtttccagatatttgtgtgtttagtattactaatttaatcctgttgtggtcagagaacaaaatctgtgtgattttaatgctttaaatttattgaaacagtagatgttgaatcttattgaatgttccatatacagtggaagataatgtacgttccatagctgcctggatgtggtgttctgtaaatattattgctggtaatgttaagtcttcgatatccttacttattttctctttatttattctattgattactaaggggagtatttaaattaccaactcttaattgtggatttatttatttcttctttcatttatgtccgtttttacttcactgtaaagctttgtagttagatgtaaacatatttagggttgttaagttttcttgattgacttcctttatcattatgaaatgtcccttcttttccctagtgatatatttatcctagagtctactttgtgtaatattaatatagtcacccaaatcttttattattagggctgagtggtatatatgtttttatcccacttttttgtagttatttaagtttatttttttattttattttttaaaattttattattatactctaagttctagggtacatgtgcacaatgtgcaggtttgatatataggtatacatgtgtcatattggtttgctgcacccatcaactcgtcatttacattaggtatttctcctaatgctatccctcccccaaccccccacccctgacaggccccagtgtgtgatattccctgccctgtgtccaagtgttctcattgtttgattcccacctgtgagtgagaacatgcggtgtatagttttctgtccttgtgatagtttgctgggaatgatggttcccagcttcttccatgtccccgcaaaggacatgaacccatccttttttatggctgcatactattccatggcgtatatgtgccacattttctgaatccagtctatcattgatggacatttgggttggttccaagtcactactattgtgaatagtgctgcaataaacatatgtgtgcatgtgtctttatagtagcatgatttataatcctttgggtatatacccagtaatgggattgctgggtcaaatggtatttctagttctagatccttgaggaatcatcacactgtcttccacagtggttaatcccacttttaacctgtgtctttataattaaattgagtttcttatagacgatacatatagtttggtcttgctttttaaaaatctaatcaacaatcctaaactacatttgtgtgtttagcccattgataatttatattattattattattttgagacggagtctcactctgtcacccaggctggaatgcagtggcacggtctcggctcactgcaatctcggcctcctggattcatgccattctcctgcctcagcctcctgagcagctgggactacaggtgcccgccaccatgcctggccaatttttcgtatttttagtagagaccgggtttcactgtgttagccaggatggtctcgatctcctgacctcgtgatccacccacctcagcctcccaaagtgctaggattacaggcgtgagccaccgtgcccggctgataatttatattattatgagtatgttttgatttaagtctaccatcttactatatgttttctgtttgtcctatttgattgatgtttccattgtcttcttttttctgctttcttttggattaaatgagcttttagttagtattccattttatctcttttttgatttataatctatatctgtgccttttatttgttgtctaggcagtttgtcatatacatctttaatttattacagtctgccatggattaatattgtgccacttcatgtataatgtaagaagcttacaacagcagatttctattttccaccctcccgtcctttgtgctatcattgtcacgggttttacttcagcatatattataaactttagaatattttgcttttacatcaattatcttttatagaaataaattaaagaagataaacattcttttatatttatgaacatatatattcttgccagtgcttttcattcctttgtgtagatctgagattccacctgggatcattttccttctacctgaagtacttcctttaatatttctattaaagctggtatgcttctcattgacttctttcagattttgttcacctgaaaatatctttagttttctcaaagggtgtatttttgctggatgtagaattctaggttgattttccaacccccccttcccagcactttaaagatgtttcattgtcttttggtttgagttgttctgatgggaagccagagagaaaacattatttttcctcctgtattaaatgtatcttttatttctgtttgctttaagatttctgtttaaaattggttttcagcaatttgttttagtttttctttgtgtttattttattgggttcaccaatattcttggatatatgagtttatatttttcatccagtatggcaaaaaaattggtaattatttttccaaaaaatatttttgcctccctcttctgggaatctagttacttatattttagattgcctgataccatcccacactgagagagactctgctccttttcctctactctggctggatacaactcaaatgtcttccacctaggcatgaactgtggtggttatttagttttgtattcataccatttgttctctccctggtagttttgatctttgactggtcttgtagaatgtcaccttgcaggccgggcgcagtggcttacgcctgtaatcccaggactttgggaggctgaggcgggcggatcacgaggtcaggagatggagaccatcctggctaacatggtgaaaccccgtctctactaaaaatacaaaaaaaaaaaaatgtacccggcgttgtggcaggcccctgtagtcccggctactcgggaagttgaggcaggagaatggcatgaacccgggaggcagagcttgcagtgagccgagatcgtgccactgtactccagccctggcgacagagtgagactctgtctcaaaaaacacaacaaaaaacaaaaaacatgtgtgcagatttctggaactctttttcccccagagctcccttctttctgatactctgctccacaaattgtaaccatctttcttggttttctgaactcttaggtctgtttcctaaaacttaatgagaccactttattctggttgagatccttctccctcaatcatggtctggaagtgccctcaggtagaaatctgggatttctgtggagctcttctcatttttgctcttatctcaaagatcacaggcatgtgctacctgctttccagtgtcttagaacaggcatttcctataatttgtccagtttcctaattgttcatggcagggggactgttcccacatcagttattctagagtgataaacagcaatcctgtcttagtctgttttctgttgttataacagaatacctgagactgggtaatttataaagaaaaggggtttatttaactcaaggttctgcaggatgagaagttcaaggggatggccctagcttctggcaagggattttgcgctacatcacaacatggcagagaaagtctaaggggaaggggacatgtgcaaaaagtgaggcaggcaggaggaggaacttaagcttctaacaacccagtctctcagaaattaatccattcccctgagaagtaatcctgtatcaagagagtgagaactcacgaccaggagaatggcaccaagccattcataacccaaaccttctcactaggctccaccttccagcattgcctctttttaaggatcaaatttcaacatgagttttggtggagacaggaaaccacaaccaagccatagcagacctctgtaactttttgttgctattgtatgttttaaaaatatttcctaattttggttgctggtatgtaggaacaaattaatttttaaatattaatcttgtacacagcaaccttgctggactattttatttctaataatttgcagaatttcttaggttttctatgtagataatcagagtgttcatgaatgcaaccactcttttttttcctgaagctaaaaaattcctttaatgttctacctttaggaggtttgtatgtttctggttgacatattttatcaggttaaggaacttcctgtctattcctagtctgttaagaatattttcaaaaatcatatgtgtgtattaaattacatcaaatgtgtttttctgaatctactgagatgatcacatgctttttctctttttaactgggatgttgaattatatattttttctaatgtgaaagtatcctgatatttctggattaactccactttcttaataccctgctggtttgggtttttacaatttatttagaactttttcatatggatcataaacaaaactgacataaaatttctctttttgatgctgcctttctctggtttggtatgaagaatatactagcattataaaatagattgggtaatttctctttttatgtgttttctagtgtaatctgcatgggataggagatacctatcagttctctaaatgtttagaagcatccatttgcgaaatcatcaggttttgtttagatttgtttaggttattttctgtggatggatttttaactaccaaatttatttatttagatttgtagagtttattcaggttttctttgtatccttaaataggtttgggtaaaattcattttccaaggcagtatcccattttatctgtttctctgttttcaaatttatgggtataacgttgatcatactgctttttactatgttgtatttataatatgccctttcattccaaaatgtgtcctctcccatgtttcttgattaatcttgtataacaatgctttatttatttcactactttttattttaagaaagcattttaagatttctgttttatctttatttttattgcattattttctggtcctatctattattttcttctcctttctttagctttacttttatttttaaattattttgtttactaatttattaattttgtttgtttgtttgtatgaaatggagtctcactcagtcgcctaggctggagtgcagtggtgcgatctcagctcactgcaatctctgcctcccaggttcaagcaattctcctgcctcagcctccagagtagctgggattataggtgcctgccaccacgcccagctatgttttgtattttagtagagagagggttttaccatgttgccgaggctagtctcaaactcctgacttcaggtaatctgcccgcctcggcctcccaaagtgctgagattacaggcgtgagccactgcgcccggccaacttactaattttgtttactaacttgtttactagtttttgtttgctttttttcctaataggcatttaagactaaaagctttggtactactttagctgcattttactttaatatatttgtaatatgtggtatacttgtaatactttagttctgagtattttctgcttttcagagctatttaggaagttttgttattttgaatgttcaaatcgatcaggttttgtattgtctttttattattgatttctaatttaattgtatttgggccagaaaatatggtctatatgataatattctttggtatgtattgatcttttttatggcttagaatggcttagctgttttttgtgctctgagatttcactgtgatatttctaggtgtggttttattttgatttatccagattgggtcacattttccattctggaaaatttaaaattatctccttactgctcatctccccttgctattatgcccatctggaacccctcttagatatatactgtgccttcccattttgtccttcatgtctcataacctcttgtttcatattttctaacccatttctcctactgtatggcaagtttcctcatagctctgttccacttactaatttccctatctgatgtttctaatacattgttcaatccatcttttaaaaattagtttcattgaatatatctatttatataatttctaattcatctttgtccacatctatttgaagttcttgggggattcatactgttggggtatgtgtgtcccttattttggggactgatagattattattattattattttagtatttattgatcattcttgggtgtttcttggagagggggatttggcagggtcataggacaatagtggagggaaggtcagcagataaacatgtgaacaaaggtctctggttttcctaggcagagggccctgccgccttccgcagtgtttgtgtccctgggtacttgagattagggagtggtgatgactcttaaccagtatgctgccttcaagcatctgtttaacaaagcacatcttgcaccgcccttaatccatttaacccttagtggacacagcatatgtttcagagagcatggggttgggggtaaggttatagattaacagcatcccaaggcagaagaatttttcttagtacagaacaaaatggagtctcctatgtctacttctttctacacagacacagtaacaatctgatctctctttcttttccccacatttcccccttttctattcgacaaaaccgccatcgtcatcatggcccgttctcaatgagctgttgggtacacctcccagatggggcagcggccgggcagagggactcctcacttcccagacggggcggcagggcagaggcgccccccacctcccggacggggcggctggccgggcgggggctgcccgccacctcccggactgggcggctgccgggcggagacgctcctcacttcccagacggggcggctgccgggtggaggggctcctcacttctcagacggggcggccggtcagagacgctcctcacctcccagacggggtggcggcggggcagagacactcctcagttcccagatggggtcgcggccgggcagaggcgctcctcacatctcagacggggcagacgggcagaggcgctccccacatcccagacaatgggcggccgggcagagacgctcctcacctcctagatgggatgacggctgggaagaggcgctcctcacttcccagactgggcggccgggcagagggcctcctcacatcccagacgatgggcagccaggcagagacgctcctcacttcctagacggggtggcggccgggcagaggctgcaatcttggcactttgggaggccaaggcaggcggctgggaggtggaggttgtagcgagccgagatcacgccactgcacaccagcctgggcaacattgagcactgagtgagcgagactctgtttgcaatcccggcacctcgggacgccgaggctggcagatcactcgcggtcaggagctggagaccagcccggccaacaaggcgaaaccccgtctccaccaaaaaatacgaaaaccagtcaggcgtggcggcgtgcgcctgcaatcccaggcactcgacaggctgaggcaggagaatcagtcagggaggttgcagtgagtcgagatggtggcagtacagtccagccttagctcggcatcagagggagaccgtgcaaagagagagacgagggagagggagagggagaccgtgcaaagagggagacgggagcgagagagggggagggggagggggagagattatttccttatgtattttctaattttgaatggtgagctcatcttcaacagtgccttatttgtggaaattctgtggaatctgtctttagaaagtatgtctccagaaggggtttatctttgctttttctggaaccccaaggttgattcagtatggtggtgtcttttctcctgtacccagagaacatgctgagacagacaagcttcctgttttcttcttttgttggtaggaggattttttttttcaatgtaatgttagcctctgggagtcctggctacatgtagggagaggtggtgagttttaattccacttcgctgtttgggttattttttatccaatttttcttttcaatgtaatgttagcctctgggagttctggctatacatagggagaggtggtgatttttagtttcacttccctgttcaggttattttttatctaggagagcattaacaccaagcacgggttcatattttgtgctcagtaccgttccagtgtttgactccctgaactttcccttacttagagaacatttaaaggatgtttgctatattttaatcacttttttgtaacacatatgtattgggatgccattgacatctaccttgaggctttggccttgaggtgatgtgtgagtctaattgtatagctcaaagcagaggacttcagtgatttcagggctattgttttatatgtcaaggatttctgtgaacatcaacaataatgcaaatttttcccttttgtggcatgtacacgcttggcatgaagctttcaaactgcatctgtcttcatttccttaaattttctcaaagttagtgaaagttaaatgaatttaagggtatggaattaaaacacaaattaagggtatggaattaaaatacaaatatttggttttttttttggttaagtggtgtaaccacagaatgtttttgtaacttttacaaatatattcatttgtaatgttattatcaaaaatattcattggggattatgcaataaagcaagtcttcaacatctacataacatatgagagtgttattggtacttaatgaaagcctatctttaaaagaagtagacattccttgagggaaaagtgttacacaattgagaattttgattagtcttattgctttactgtgattcaccatagactgatctcttagtaaaatgttgcttcactttgatttcaggagtcttcctacgtcactgaataatgaatgaagatgagaggggaaaagagaagaggtatgcattcataactgactgacatttctgtcaaagccctctccctcgtcctgtgttcccgtttcacatctagcaaaatgctacttcctcagggaagcctgattcactcagagaaatgtggtttctccagtgtttttttttcataactctcagctccagctctattataatacttagcacatcacctgtttacctgacagccctcttcctcaaactgtgtcctccatgccttgcacagtgcctgcccagagctgactctaagggttgtcaaatgactgacaagtatacagtccctgatatttttagaagacagtttttgagccttggcttgcctacagcttaaattcatttgtgtttgagaagataaattaacttacttttccagatcaaacttctaaaataaattcaagtacactgatcaaaaagtttttgtcaaaagtttgcagtatgatctgtggtatccaatggatacatttgatacattgtggaatggctaaatccagctaattgatatatgcattacctcacatacttaactttttctgatgagaccacataaaatctactctcttagcaattctcaagtgtacaatatactgttatttactgtagtcaccatgatgtgcaatagaactcttgaacttactctaactgaaatcttatatcctttgtccaacatctccccactccttcatctcttacttttgatgaaggttcatagctagattctgcctctatctttgctacccactttattctgtttgtaacaaacaaccatagggatcttgtaaaaacctaacatgtcactctcctgcttaaaagcacttcatgggctgggcacgctggctcacacctgtcatcttggcactttgggaggccgaggtgggtggatcacctgaggtcaggagttcaagaccagcctggccaacgtggtgaaaccccgtctctactaaaaatacaaaaaattaactgggtgtgatggcaggtacctgtagtcccggctactcgggaggctgaggcaagacaatggcttgaacctggaaggcggaggttgtagtgagctgagattgcgccactgcactccagcctgggagacagagcaagactccatctcaaaataataataataataagaagaagaagaagaagaattaaaagcacttcatgttttactcagcataaaataccaacttcttaccatataccctacatgatctggcccttcctgtctctcaggcttcacttcctactgctttaacccctggtcatcccactgcagccactctgggatcttgtcatctctttaaataggcaaaatgatttcctgtttcatgttgcacttactgtttcatctccctgagacggtttggtcccgtgtcttcacatggttgctttcttgtcaatcaaatcttagctcagatgttaccttcctaataccttcctagtaaggcttttcttgatcacccgatcttacgaattattgtacttgcagatacctgaaactgtctgttctgttgtctatgtgttgattatctgtctacgctgccccgtcagtctgtaagatacaaaagaacagtcaccttatttttcttgtttatgctatatcctaaacctgtaaagcagaatatgacccatagcaggagctctgtaaacattcgttaaataaatgaataaaagaggttcactttaacaacaggtactgaatccctgccatgacctaagtactatgttagacgttggggatatgatgaagaactggatatgatgcacaccttagagaataaacaaaaacaagttcatgggtaatagtaaagtagaaaagtcctttatgatttatttataaaatacagtggttatcctttcttggcaatatatgaactcccctctcttttttatttctttgaatgaagtctaggagatgaaagttatgagatggaactggaaggcaatggagaaatttcttcagaaattgactatggaagagtgtcatgggttgtttcttgagtttgaagagctatgcctagaattgagtttccaagctgggacagtggtcaggatcactgatcctgactcatttatgcagttggcatggtttacttttcatgttactcctatttcacacccagttacacaccctattttcattccctcatcagtgagggctctaaagctctctttatgcatggcctccctcttacccaactctactcctaggaaagagtcagagactcatgcctgtcaagaaagcaatagccactgtcaacattatccttgtcataggattttacatttttaatagagatcaaagttgtatgctatgggtctcatttttctgtgaggagaaggaactaatgtttattgacatgaagcattaaaatcacttgagattggagggctgtgttagtgaagtccctttgctagtgaagttagtggagtagggtggagttggggaggtagagaggagcacatgttgacagcaaagactaagcacaggagcagaaacacacttctcattgaggaaaccagaaaaccctgaagaatgtgataggacagatgggggagaggacagtaccaggagctttgaagagataaaagataaggcttgaagatattctagttaaggaaccttgtgcaaagcttaaatagatgaagctaaagagtggaatttcataatttagttaggactagggaagggctttgggagtctggatctgcttagaaccccttgacttacctggcagattatggatactgggttttggtagaattcaagaggaaaaaaagaactagaagttgaaaaatcataaaattgttggacaggtcataatgtgtgtggtagaaattgagttggatgatcttcaaagtctttttcaattccaaacacttctgggtttatgatcatttatatacaattagttagccaacatcagatccttcattagcactcagcattttctcataagagtcttttctataaattaagtataactttgaaaaatctaatacccatagctaatcattttaatgtgacactgttctgtactttcttcctttttctaaaaagacaaagtcaatccaaaaagctctcaaaggaaattaaactggattccatcatttcctacctatgattacttcaaccaagtgacgctacaggtaagagggcttttgttctttgattacttcatatgttgaatacatgtaatagaagacaaagaatagtgtttgtcaaagtgtgattaggagatcatatgcattagaatcaaccagggagcttgataacttaaatcgtctgaatcagactctcaaacctgttagggccgggagtttgcatttctctcaagctccctggatgcttcctatgccaactgagttttgagaaccactgattttgagtgacaacaaacacaaacaagtcttcgcataggttagtggcaagttaagtggttatctggtagactagttcaacatagatggttatactctaatgaattagccttcaagtagtttctcccccctcaagaatgtaaggtgtttatagtttctgtctccaagagaactggttagtttcacaagccacaaactgcactctgaagaaccatattcctttgagtgggacagacagggatacagattttgcctttgtcccttacttgctgtatgtcttgactgaattaccatctctgagccttgatttctttctctttaaaatgggtaaaaattatctttatctcattgagatgatgtgagaataaaataaagtgaacatgtgtaaaatatatagtacagcgtttggcaatattagacgcctggaaattatccgtccagtcccttttctccttcagtactggctgaccacccagcactatgaccattagtggtcataaaggtgtgtgagaaaggcattgtgtgagtgaatcttttcaaacctatcccaatgttaggggcaaaattctgactgtgaatgaatggagccatattgtaatattctacttcatttttcttccttttaagaaacagactctcacttttttttgtgacacagggtctcactgtgtcatccaggttggagtgcagttgtgtgattgtggctcactgcagcctcaaacttctgggcccaagcaattcccccaactcagcccccaaagtagctgggaccagaggtgcacactactatgttcagctcattatgtttcattacatctcactctgtcacccaggctggtctcccaagctcctgggctcaagcgatccaccttggcctcccaaagtgctgggattacatgcgtgagccactgcacctgactctctctcaattttattagaggttttgttttaggaatcctatacacaaatatttgctaaatagaggacttaaaatgtgttatgtgaaatcctgttaccaattttatgaaaccagatgcttatttgaaatattttagaagctagacaaggtataaatacaccctagagggataattatgttcacaactacagaacatatggcattcaagtggaaggatcagaatttcttgggtaattccctcctttccacttttttcccctccattaggctttaataacttccctagaaaagtctgttctttattctttattcatgaagttttttcttgaaataaacaagcccagtctggctaatcagagctgacttcaaccagggagatggaaacatcagggaatctgagaagagggacagtagagggctctttctcttcactttccagtttcattacagctttggccattcttttgaagcatgaaagaaagcggggtttggagggcaagagagcaaggtgactttgtttcttatggcttgtatttcagagcagtgacttagctttggatgtttccttcctgtttgccatactgttggtcaaacgtaacagcctcctgacatctgcataacaacctacactgtgctctcatgtagagtagccgatttcatcctcataagaagcctatgattaacttaataatgatgttgatcccttttactgcaggaaagaggagaccaaagctgggagagcttgcaccttgcccaaatccaagacctgttgagtagcacagccgagtagcacaccatgttttctcacttacactccagcccatgggggtccagactaactcagagcaaaccgtctcagtagagaatgtggtaatcaaaatgccaaaagcaagcagacatacagaaaatgagtagagaagcaaagtgccttaccagatctgcctagactcttttctgaacctatgtgtttgggaggtcacttcaggcatgtggcaattttggatgtcatcttttgatgtctaatgggaaatagcaaacacccagttttaaaagtttttacttaaaattttatcttacaaaaatatacataacatatagtaacacttaaaaaaatagtacaggtgacaccgagcttaagaaatagagcattaccagatcctttgaaatccctttgtcgtaatcttcttcttccacaccacttcttccctactatttcctgagttctgtatcaatatttctttgctttgctttgtatttttaggacatgtgtatgcatctctaagtgatatgttgttttcttttgcatgattttcacctttatataaatggaattatattggatgtattcttctctgacttgatatttttgctcaacctttctttttcaattcatccatgatattgcatgtaactctagtgcattcatttttacttctgtattcttgttagaacatactacacaattacttacccattttgctgttgatgggcactagaaatctgttttagctcatgctccttaggaagtagaggctgaagcaaaatttatatgctaaggttttagtgggatatgcaatctcaggatagcgagggtgagggggaaagtaaggcagggaagaagggaactgaaatatagggtagtttattaccaagctggatagagcttcacaagaacacacagcgggttgttcagtcactcttaaaactatgtaaaaggcaccacaccttgaaatagtctgtataggggaggaagggaaaatactgtatctaccagttcctttctttctcctgtcattagtcaaaagtcacacccaggatgttagcaattctgtcctttgggttacctggcttttctggaaacccaatggggaacccagatcccatgctccgaggtggatgaagttactgccttcatgaatccagtccctttggatggatactgaagcacctagtgctggcggagttaggagactaggttgggactgcaaaagcaaagctaacatccctggcttgattgagggtgggatggggtatgaatcttgaggaggcgcataaactgagtctggtatagctgtaggtttttgttattgtgagcaggtttggtttgaacgtttttgttcatatatcctcttccatataagcaagagtgtttctaggtgtatgtctaggagtgagattgctggagggtagggtggagtggtagggtcgctccctctacatgaaaatgacaatgcttttcaagtgactctgtttcactgtgtatttcactgttcttttatattcttagtagtagtggatgaaagttcttattgctccacatccttgctaacaatttattgtctaatttttaaatttttgtcaattgggtgggaatggaatggcgtcttgtttcattacaaatgacaatgagcctcttttcaccaattttgaggccacttgtgtttcctcttctatgagatgcttgtttctagcctttgctcagtttcttatggtattgttctttctaattattcatatgttggagatttttaaaatagattctggaaacgaatcacttgctagttatgtgttgcaaaattcttgttctagtttgtagcttgccttttcacaatttaaggtgacttttgacaaattattaattttaaagtaatcaaatttaccaatcaaagggtgtttactttcctgtttaaaaaatccttacctaccacaaggtaataaatatattctcttatattttattttaaaagctttaacgttttatctattatatttaatgtgttcatactttttgagttatttcttgtgtatgccatgaaggagaaacatcacaaagataagagaatattctaaactagtgatttcattctttaatgatgatgtgattggttatattttttacttcttcccaagtcactttttgcaatttatatgtttttaagacttgctttcaaatttattggcataaagttgttcataatattctcttatcttcataatgtctaaagcttctgtaatgatatccacttttcactcctaatattgtttgtgttttttgccccatgattcatcttaccagaggtttgtcgattttaatgttcttttcaaagaattgacttttaacattcttgattctgtccattgtgtcattattttttgttttattaatttctgctcttatttttattatttacttttttctactttttggggttcattttttgttctctaacaattttagattatttaattcattgatttgtaaccaattttcttttctaatatatacatttaggcgaagattcccaagtgttgttttagctgcttttcacaggtctcaataaatagtgtttaaaaaattattctattataaatactttgtaatctccattattacttattatttggcctatttttttattacggtaaaatgtatataacacgaatttaccgtttaatcacttttaaatgtagaattcagtggcattaagtacattcacattattgtgcaaccatcaccaccatccatttccagctttgaaaatcttgcgtaactgaaactctgtactcaaacaataactccccattctcactttctcccagttcctggtaaccacctttctactttctgcatctatcaatttggctatcctaggaacttcatataaatggaatcatacagtaatgtccttttgtgacatgtttcgcttagtataatatcttcatgtttcatccatgttgtagtatgtggcaaaattctctttccttttaaggctgaataatattttgttgtttgttacgcattttggttatacattcatctgttggacacttagattgtttacaccttttggccattatgaataatgcttctgtgagcataggtgtacacatacctgtttgagtccctgctttcagggtgttttttttttttttcactatacactcagaagtggaaatgctgaatcacatgatagttctatgtttagttatttgagagactgccgtagagttttctatagcagctttgtcattttatactaccatcaatagtgcataggggtttcaatttcttcatatcttgtcccaaaactatttgttttgttttaatcatagcccatcctaatgggtttgaggagttcatgactttatacaaatagagaatcctgcttcaattatttgggcttcctgaatcttaagattggtgtattttattacttctggataattttccacctatatctcactgagtatttcctcttctctgttatattatctccttcaggaacactgatcagacatatgttggactttctgattctcttctccatgaaatgaatttatcttatttttccatttgtatctccttgtgttacattctgagtcatttcctcagctctttccagctcaaaaattttatttctggctgtgttctaacatgctacttaacctatacattaagtttctaattttgatgacaatatcatctatagacattttgtttgattatgttttatatctcacgagtcagttttgagtctcttgtttcttcatatttctagtgccctgtgttatttatttaagcctattaagcatacttattttgtattctgtatctgataattccaataagttatttttaaatatgattctttattttattatgtctgttgcctcttattcgtaatgcttcatctcttcctgtgttttatttttattataagctcatattatttgtaattttatctacatgaattctttgaaccctcactttaaaataattctctagatgtgattttgatttccttttattagacatatggggtcaggatcactttaaactaaatattagactttggttgttgagggccacacaggtagtatatgaattctagctccaagtttgtgtgaaggtgggcttctgcttagtacctcctaaagttgactattttctcttttcctactcttcccaggatggaggctgaggcagacatgcacattccctgtctcctttcactggataagatttttctgttttacctgttgaaagtgtctcccttttggagacctggctttgtactgtggtctttgatttcacctcctaccttgtacaggcctcggctttgcttttgtcccccaagctctaggctatcagtgttggaagatagtctcaaggcaaatacagggtctaatattctccagtgtcttaattctcacaatctagtcatttctgatatcaggttatttcccttactttaccagtagcttggtcctgttttgaaaaataagttttaatctattttattcatcattttagatattctctaccaggaggcatttgtctggctattgaatccatcatacagcaggaaagtgatggcaatatccatatttataaggagatgactaacctaaccacaaatgaaagtgtccttaaaatatttttaacatttttgaaattaagtgttcttaaagtgaaacaacctacacatggaaatgaatcttcttagcttgcattggagaatttcatgttaattgggtgtacattgaaatttgtttaagtgacacatcatttgataaacatttcatgcttaaggttaagtagattctgtgtaggaggcagaataatggaattttaattaagtctgtgcctactttattgatatttaaggactggggtgcatttcagtgtgctattataattatctatgcatttagcaataaaactatcattttattattgttccactatttaattacattattattctctcgtcattagttattagatggctttatgattacactgagcacagatggagtgatcatttgtgtggctgaaaacatctcttctcttcttggacatttaccagtaagttctttctacttttgggaaagtggatcattctggtttgttgtttaggggttcattatttattttctttttttattatactttaagttttagagtacatgtgcacaacgtgcaggtttgtttcatatggatacatgtgccatgttggtgtgctgcacccattaactcttcatttaatattaggtgtatctcctaatgctatccctcccccctccccccaccctacaacaggccccagtgtgtgatgttccccttcctgtgtccatgtgttctcattgttcaattcccacctatgagtgagaacatgcggtgtttggttttttgtccttgccatagtttgctgagaatgatggtttccagcttcatccatgtccctacaaaggacatgaactcatccttttttatggctgcatagtattccctgttgtatatgtgccacattttcttaatccagcctatcatgttggacatttggctggttccaagtctttgctattgtgaatagtgccacagtaaacatacgagtgcgtgtgtctttatagcagcatgatttataatcctttgggtatatacccagtaatgggatggctgggtcaaatggtatttctagttctagatccctgaggaatcgccacactgacttccacaatggttgaactagtttacagtcccaccgacagtgtaaaagtgttcctatttctccacatcctctccagcacctgtcgtttcctgactttttaatgatcgccattctaactggtgagagatggtatctcgttgtggttttgatttgcatttctctgatggccagtgatgctgagcattttttcatgtgtcttttggctgcataaatgtcttcttttgagaagtgtctgttcatatccttcgcccacttgttgatggggctgtttgtttttttcttgtaaatttgtttgagttcattgtagattctggatattagccctttgtcagatgagtagattgcaaaaattttctcccgttctgtaggttgcctgttcactctgatggtagtttcttttgctgtgcagaagctctttagtttaattagattccatttgtcaattttggcttctgttgccattgcctttggtgttttagacatgaagtcctagcccatgcctatgtcctgaatggtattgtctaggttttcttctagggtttttatggttttaggtctaacatttaagtctttaaaccatcttgaattaatttttgtataaggtgtaaggaagcgatccagtttcagctttcaacatatggctagcccgttttcccagcaccatttgttaaatagagaatcctttctccacttcttgtttttgtcaggtttgtcaaagatcggacagttgtagatacgtggcattatttctgagggctctgttctgttccattggtctatatctctgttttggtaccagtaccatgctgttttggttactgtagccttgtagtataatttgaagtcaggtagtatgatgcctccagctttgttcttttggcttaggattgacttggcaatgtgggctcttttttggttccatatgaactttaaagtagttttttccaattctgtgaagaaagtccttggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattcactttgaagcaattgcgaatgggagttcactcatgatttggctctcttgtttgtctgatattggtgtatgagaatgctggtgatttttgcacattgattttgtatcctgagactttgctgaaattgcttatcagcttaaggaggttttggggtattttcagaagcataaagctcatcagagaagatgttttcaatgttgtcaaaatgtgtccctgttttattgtcatttccattggtttcagagtactatagattgggtgtctttgtaaacaacacaaatttatattttatagttttagagtctgagaagtcgaagattaaggtgccaagagatttggtgtctagtgagggcccaatctctgcttcatagacatccttattcttactataacttcatatagtagaagaagcgagggagctcttttttttttttaagattgggtctcactcttgtcacccaggctggagtgcaatggtgcgatctcggctcactgcaacctctgcctcctgggttcaagtgattctcctgcctcagcctcctgagtagcagggattataggcacgcatcaccacgcctggctaatttttgtatttttaatagagacggggtttcaccatgttggccaagctggtctcgaactcctgacctcaagcgatccgcccatctcggcctcccaaagtgctgggattaaaagcgtgagccaccatgcccagcctaggggtttcttttataaggatactaatcccattaatcatctccaaaggccccacctcttaatataataccatcacattgacagctagattacttcaatatataaatttttgggggacataaacattcaatctgtagcaaggccttcatattccacttatacgtgtgtttgaagaggggttacctagaatacatttaccaacaaccctcccacacaaactgtctgccattggcatggttgtgttagcaaaaagttttgggagaggatatgaagaaattgaaacccctattcactaatggtagtagtgtaaaacaatcatatctccgttgttgttttcattacatattcctcattccacagagttgtctcaagaacttgacaaaccctaatccagaaatctatagtactcaaatttggaacatggaaattaatagaagctaggttagattatcttgtagttaggttggaagtggattaaaaatatgtcactattttagccaggccagttggcatgttccgtggccttcttggaagctcagagtccttatacccttttaaaaaaaattacagatgctagaatcgatctcttttatttctcattctctttcattttttaaaaaaacagtttacatttccaaattcagcttatatttgtaggataccaaaacagctaaatgaaatagtagagatatttattggattgcactttagtatatttaaatcatagaaggaaaagagtcttttaaaatatatattaaaagagggaatgtacgagtatgatccactacagcttaaattttattataatgaagaccagaaaaccacccaaattcttgtggcatcagatattgcttaaaccaaattggtcattggctgagactggtgactttttcttattatgtgaagatttatcatagtgatggtgttagttatgatatgatcttgcttctttatgtatttggttcaaagttttccctatcaagaagctctttcacccttcaacatttgaggtaccacacacacacacgccccccaaaaccacaaggtctagagaggtgtctgggacatgtgctttgaactgccagccttaaacaatagacttgatttacctgagatcagtgtacttaaaaataaatgtataactattacatttgtacataaacattaaatgggaattaagttatatattcctataaaacaaggttaaaaacgactacacctgaggcatagtttcacacttcctcattgaatcccaactgttcttaatttttcaaaacaggcaatctttttctcaggctttgattaaaaatttcattttataagtcatccaacttatattataaaatggagactgaaccatttctagagtgtctgcgtggctccaggaatcttcagtttcattacatatcagggcacctctgtctatggagcaactccaaactaatagcatggtgtgatggaaagaacttggtcttcggaatcaaataatctagagattaaaatttagctttgtttctctctaactgcctgacctttagtttctcttctataagtggggaaataatattacttagagagtgctgggagatgaattagtataaataacgtgattggctaaggcccatctgatcagtgacatttatacagagacctgaatggagtatgtgtgatatgcaggtaactggagcaagtgtctttcagacagaggaggaagcttatgtaagagcctgaaagcaggaaaaggtacagcaaagaggacagtgtaactggagtgctgtgagcaaaaggaaaatagagatgataaagtcagagcagtaacaggagaagtaacatcccttttcctctgagatgggaggaagccattggggaggttggagcagatgaaagaaatgatctaacttaagttttatcagaatcgctttggctgttatgtcaagaattggctatgaggggcaggcatggaagtacagagtccacttggagggccatagatggtagtgggttggattaatgtggcagtggaagcattttgtaggtaaaataagttgttttgctgatgtattggaagaggggtgtgacacagagataagatgtgtccaagttatgctgttacaacacataccatgaataaaatgatgcccattatcatcatgatcatggtattaaacttttatctgaaacctgccatcatattttcccaatcattgatttcattgacagttttttttttcctttggaaaaactcatagtcatttgtagtagtaagttccagtcactgccccctgttcttagcagcctgccctcctactcaccctactctgtcattccccctgaaaataaaatcaaatctgggagtttacatatatttattctcttttgcagttctaaagcaaatgaaacttttaaaacgtacactacatctgaaaaaattctcagcattgaatctttaagagattaaaacttagcaggttttgaacataggtacatggttagtttgtgataactgtgatgagatttgccctattttccctgagaagcttaccgcatagtagagatttagtagtgatgagtctcatttgatttgagatgctgcctaaatctcctgcagaggatcttatccttccctgtgccctatacagttgaatagttttctaatgcatgtataatatgagtgtctttggcaggaaaaaagatgcttcttgcctaggttctcagtaaatgtcatgaagtcctcagtaaatttcttaattctttctttttttgacgtgactgagactcaccacactaatatttgtgtgacaactaatagatatttgcaaacttggcttttgaaaaaccaccttagtttttcgctggtatttatccttgcttcattaagctctaagtaccttgatctttctaccttgtgtaataagaagagcaaatgctaaaaatttacaaaaataacatgaggtcgatcatgctttcaggtctcctccctttttctaactaaggaacaaggccactggaacagatccagtgtttcaattagcggttaattataaggcttattgtcactattcctatccctagagaggcaataagaaactcattaccactagtcacatccaagagaatgtagactatcaaaagatagctcactttgaactcttttaagtgacaatgctatcttcatttttcaactaatgaaagaacttacgagacatagcactttgtacctcttgttagggtattattttatactctacatcataattgattgtgcatatttaatctgccctactagactatgtgctcattggaattcgttgtcaggttcatcttttgtaacccttataagaaataagtataaaatcttattcagtgaattacttcatgtagaatgtccaaaatacaggaactggtccagtagcaaattttctgttcctgatgcaaactggacttgaggcagctatggtgtagtaaaaggaacaatagacatggaattggatggagctttcatgtcagtttcatttctgcatttctgaactctcaacaattggagaagccttaatttgctgatgaataaaacaagggataattcttactctcccaggggattaagtgagcttgtatatgtgaacatacctagaacagtgactggcatggagcaattgtttatcgtgtgttagatgagtgaatgaatgagtggtctccacagaggtaacccagtttggcatctaaagtctattttataactaaaccaacaaaagtgtttttattgaaaagttaaatttagtgaaaaaaatctacatttcttttgggaagtcagtattttactgtgtgactttcactgtcaagatgtattgcctgttaattccataatgttttgtttgctagattaaggtaatatttctatccttaatcaagccaagcttgattgagacagcatctgtctgctaatttgatcattgaccagttcataggctggcttctacaaatgggccataaagatatatttctaaatagtgactgtagattattaatgctaatcagttaaaaaatcattggaatttgtggttcatcacacaaagccattattcagctacaaggaatactttattactttgttgctatcacattaaagcctcattacttctatatctgatattcaatttatccatgtctcaccgtatttcagctacatgatacggtattattcattcattcaaccaatatttactgagtgcttaccagtgccaagctctgttctaggtgttgaagatatagcaatgaataagacaggcaaggtctctgttatactgcaatttacattttaatggggaaggtagataataaacagataacaaaaaaggcaataagagaatgtcaaggagttggtgctatgtaaaatacttttgagtaaagacctgtattaagtgagagagaaagccattgcaaatatttgggaacgagtgcttcacatttcaggaggagttagtttaagggctctgagatgagtatttgctctcattgtgtttggatgtgaatgaggagttgggtgtacctggagtgcagtgagagagagagagagagaaagcagataaggtcaatagcagcaaggaaccagaatatagagtggtgaaagcccttataaagactttggcttttattcagaatgacttggataatcagtagaaaatttggaatgagcataggaatagcatgatgtggctcatgtttggaaagaatcatgctggctgttctatagagaatggagtggtggcaggggcatggcaagaatagatgcagggagagcagttacggctactgcagtaatccaaactggaaatgagacttggaccaagtggcgaaaagtgaactgagcctgtatgtgttttgaaaattgatccattagagattgctgatggactggatattgagtttgagagataaaaggcaagtcaaggacaagtaaatgggtaaatggtggttgccattactgatattgggaagaccgagggaggaacatattttgtcaaagaaaagatcagttctttttggatatcttaaagttgaaatccgattagacatccaagttgagttatcatgggggcaagagacgactatctgtgagtcattaacagataggtggtatttaatgagatggaagtggaagagaccacgtagggaaacaggcctaatgactataagccctggcactccgatgcctagtattcaggaagcaagactaagatctagcaaattgtgaaggagtagcctttgaggtagaagtatatcctcatgtgtgtggtgtcctggaagtcaagtaaatgtatcaagggaaaaggaaggatcaattgcatcaaatgctgagacgcttggtaagatgagggctgagaagtgatgatttgatttggcaatatggagggcactagtgaccttgacaaaagcagtttcagtggagtggagtggttagatataaacttcattagtgtggtttcaagaaagagcgagaagtgaagaaaggggaggtaacaagtgtcgtttcatttcaggaatttttgttccaaagtggaccagataagcagagttataattgaagtgagaggcggtaatgtaaaggaaggttatgcatgtttcgaattttgtgttgtttttgttttcctgattatttttaaaatttcttattcatgtataaatttgtacataactccagataagtagaattataattgaagggagaggcggtaatgtaaaggaaggttatgcgtttttagaattttgtgttgttgtttttgttttcctgattatttttaaagtttcttattgatatgtaatatttgtacatatgtatggcgtacatgtgatatttcaatacatgcatagagtgtgtaatgaccaaatagatgacagatatcatagcatgtatagtacagcattttgtatgcttatgggaacacccagttgagagggaaagaaaacttgatgtgtggggtagggtgagactttctagaacaatgtcttttcatagtctacagaaaaatgggatgcagtgcacaggtgaaggagtgaaattcaggtaggagcttattcattggaagaggagggaaagcaggtctctaggcacaggaacagataggttggtagatttggtgtcagatgttgacatttcccatttttttttcactgaaacaagaaattaggtcagctgaaaatgaaggaaggctcgggggtcggaggtttgaaggaggaaaaagagtaggggagcaaattgtctaaataaatgatttttgggcagacttgaatacttatttcaaataatatactgcttagttgtgggtttttcttcatttacattcaattgcttgggtgaaggtgtagataaatgaaaggttggaagtaactagagtcaaaattttcccaggcaaatatggtagagggaaagagcacataggaggtggtgctcataaagtaggataatgggaattgtattttttagaggtacaacaggtataactgtacatggctgaggtggggcagagcataagctcactggaggtaaggagatagaggaactgaacagtattaacacagataaaaaagtttactctctccctcttcccctcctttttccctccacctcctcctctcctctcctgccaggctgagattgtgggcaaaaaattattaagccttctgcctgatgaagagaaagatgaagtctaccaaaagattattctcaaatttcctttactaaactcaggtatgtatatttttaaaagtagtaaattcttaggttttaagggacaagtaacaatcgctcaatggattaatttctaaaaagatattagagcacatacggctgttgatcatatattaatttacttttatataatattacaaactctatttctagtgttaaaaaaatctctcctccattaaatcttattcctcaccacagaccctgagtattgtagcatttgtacaattgcattagtgctatataaatgatggaccattgtatatagcgttctagctggtgccctactctactgatacaacatagctagctatgtaagtgctaatgttcgtggaaagaaaataatatttttgtaaaatctaatcgaagaaagacattggtcatatgaaataatccagtagaatatggtaaagtacaaatgtagacttgttttgtatttcttctctttttactagaaacacatattgaattttgctgtcatttaaaaagaggaaatgtcgaacatggtgatagttctgcttacgaaaacgtgaaatttattgtgaatgtaagagatatttgtaatggtaagcagttctgtttatcttatctatatgacatttatgagtcatgtagcctcacattactaacataaatgctcttctgcttggtacttgcaaactgtctgatatccctatggccacagtttctgactactcacattacttagacttttaaaaattaacagtgaaatttacaaggtgggggacactgagttgttaaggatggctctttctttttataaaacaaggaaatgattgcaaaaatataacaaaagaagtttaatgcatatccaagcttaaaataaaggggactctgtgggtctatgtgtaccagaaattaaagtttaaagcagtatgacagtggtaagaagcagctgattttgtggtggcctcggtggattttaagtcatgcataggctccattggctggggtcgggaattctaacacccagtcaagcaccagtatataaaacctagagatcaatgaagtgatcaataaagttctgtccattgacccagaggaatagtgagtaggtttatcatctctctgggaatttgaatggacaaaatgtgccatttacaagaaaccaaaacccaaatttttgtcgcgtgtggatatagggtccattttacaaattttgaggtttcagaaactgcaagctgagaaattaacataaattaattaatattaactggtttggagccattaaaatatctgggacttgaatcagaggtaaatagcccaaatagctaacaaatatatgaaaagatactccaactcactaataagcaaagaatgaaacatttaaaaaccagtgacattagcactctacacccatcagaatgggaaaaattagaagtttgaataataccaaatattgatgaacatgtgagaaatgaataaataaataaatgaaattaactcacgcaaaaggtggctgatatatttgtcatgattcttggaaattaaaagtcataccttttgaaaaaatcttacttgactctgtgtgcacagattacacacacacacacacacacacacacacacactcccacacactctacccatatggtctatataaaagagaggagccacatctcttttggagactaaaatatccatccacagggtaataacggaagactgaaaaccaaccttaactctcaatatttgattctcagtaataaattctttatgttttgatggggagggtggctgaaaaggaaagaagacaggaaaaatcccatggctcagaattttgaaaattgtcaatgggttagcaaacagcacatggatgtgtcaggtatttgtcttcttgtttaactggtccacctttctgttttcacatgtgtgtctatcttccttagagtttcctgtggtctttagtggcttgttttccagccacctctgtgctgactttgctgcatgtgttcctcaggaggatcggctttatcttgtgggaaatgtttgcattctcaggactcagctcctgcaggtgggtatactgtgtttgtgcttcccccgctgtggcgatgtgggcttcctttgaagggtcacttcccctttggtctgtcagccactggacaacattgctaaattactcagtgtgtgcagagggttgtgctgggatatgtaaataaggaaaatcagctcctatgtttcagaaggtgaacatctcagtgaaaatttagacacactcgaaagagatgcacaatcatttacaagtagtcttgacataatataaaatattataaaatgtaggtgctggggactggaacacatgaagagaaatgagcattttggcaggtagatgaaggaaggcttcttatactacgtgagttttgaggcagctccaccacaaccccattgggtagctgattgtaaaggcttctgctctctttgtgttctctaatatagcattcacaaattctagctctaaaaagaattcactttggaattcatctgatagattcagcttccattaatttttccattcagtaacatatatagtaagtacctactgtgttacaggtactgtgctaggtgccagagagacattaggggagatagacaatagctaaataatattggaaggtgccctgaaggatgacagaataatgtgctaatgactagtgcgggtggggagttcagacagagtggtcagggaaggtccttttcggataatttgtcttttgagcagagacccctagggatgctaactaagaaaggaaggcaacgcaggtagatggttcaacatctgtaaaagacctaaggtagtaactagcttggagagttccaagtaacaaagtaagttatgtgaccagaataaggtgaaagggggaaggagcagcagaaaataagatccaatagataggcaggggacagattatgtagaactttgagatccatggtaatcagtttgggttttatttcaagtgcattggaaagcaggaaggtgacatgatctgattttcttttttaaaggtcaggctgaatactggctgagaaatggagtacagagaaacaagaacagaagcaagaatacctaagtgaaagatgataggggcttggactatgattgtagtaatggagatacaagtattctgacttgggatgtattttggaggtagtgcccttgctgatgagttagaagtgtctaggagaagggagagaaacatctcgtggaggatttttagctttttggcttgtggaactcagcaaatggaggtgccattaactgattttagcaagactgggacaatgtggatcaggcagtgtgggaggctagaatcaagagcactgttcgggccatgttaatattgtgttgatgttacaacataaaacatctccaactcattaccttataagggaaggctctgatccagatttcctgtgttcagatcctttccctaccagctctgtgaccttggccaagtcacatcctttagcctcagtttctttttctataaatggcagtcatagtaccttctattagggttgtaaggagtaaataagacagtttctcctatatggtaagcactcagtaaatgtgagctattacagttgttgtgatcattgttattactgtcattattactgccagtgatccagagagggcaacatgcttgctttacttttcatctctggtttaaaacgtgggcttttcagaccacattttagaaactgtggagggggcctttacattcaattttagaacaagtaatatatgtcatcatttcttcaaattaaagatggtaagaaaagtagtatagaagaaaggcagtttaaggaagttgcctaattcagttgccccattcattattccgtctttgtagccctctgggatttgaactgtcacatctgccatgagaatacagacatcccattttggaagtcaaccccagtaactacttccttttctgagaaacagaaaaacatctgatttggcccaataccttggtagcccttacagcacaaggaactctatttgtgttctagtccagtttctctctgggtttataggatgtttgttccatattagtggacattttggagaaaaaaatcttgtgcaaacaggcgggcttttggaggaagatttttttcacagcgtgactgtgtagtacagtgggaagagggatgaactcacagttcaaactttgaaattctgctcctggatctactagctctatttcttgggtcaaatcattatatctctaatcctcagttttcaaatctgtaaaactccagtgcatttctcacattgatatgcagattatttgtaacattggatatgagcatgcctccaaaattaatatatgctgtgcatttttactatttatatacatattaaatgtctaaatatttgaatttttctgcagcaactttacacttcaaaggcagtcagtgatgaagctgtacttacacaagattcagatgaggaaccttttgtgggagagctcaggtgagaggtagtattgataaagctaatgaagatctagaattcaattttactaaacgaaactaaaacaagagaaataacacctacagatattttttttcccatcaaaatgaaaatgaaaaaagaaacaaacgggccagggatggtggctcatgcctgtagtcccagaactttgggaggctgaggcaggaggatcccctgagcccaagagtttgagaccagcttgagcaacatagtgagatcctatttctacaaaaaatacaaaaaaaattagccaagcatggtggcatgtgcttgtagtcctagctatttgggatactgatgtgggaggatcagttgagcccgggatatcaagtctgcagtgagcagtgatcatgccactgcactccagcctgggcaacagagtgagaccctgtctctaaataaataaataaaaccagaatagcagtctactagtctgaacttcctttcccagctcatataattcacatttttccaacagaatgtaaatacaggtgattggctttttattttttattttttaaaaaaagcattaaagcaataaatagagaaaacttaactgacccaggcatgtaatgactttcaaattaaggtaatgcattttaatatactacttcattacttttttttcttgaaaagaaaggtaatgtttagacacttttaaatggtagaagagcaagtatgcattgtggtaactgctaattatacaggcattcctcttttgtgaatctaatgtgttctttaaaatttgtttactaacacattttcagagaatagaagcaaatattccactatttcacgtgagaaaagtaaaaatatattcctaacccccaggaaaatgccgattaatttgccagataccactaaaacccctttataaacttatttaacaacccacaaaggatttctgtaaaatataaattatttataatactatatagttattcagcatttgataaactcattgtttggcacatttgtatgtagtaagccacaatagcatacactatacagtgtctagtattgggaggggattacattttccttctacgttgcagtgtacatgtactggtaaataaataatgaagtaatatattaaatatattaaagatgtgcactgtatgccagtaatatttagcaaaataaaataagcaaacaagagaactttgcaagagatttcttgggatcaaaggcatgcttgcatgaggtctgatggtgagaagagtgagctggaagctgtggtcacggttactattcgggggcaggaggaggtaaggaagccagagctggtgaaggaatgagttaaacaggaaatatttgaggctcatctggatttaagagaaggcagggagaatcttccattcccatcagaagagtacagaggtgattggttgtcaacctttagctgatgctacacacagagcagtgggatgagaaacagaactcatggtggctagctatttacatcccctttgcttgattaaaaattcttgctaacataaagctgcatttgtattaataattgtgtaattgtgtgttgaatgtgacaatgtgacatgtctgctcatgccatgatcacatttatttgtaccagcatgctgtttttatggaatctaatttttatttttatttatttatttttaaatttttatttattatttatttatttattatactttaagttttagggtacatgtgcacaacgtgcaggttagttacatatgtatacatgtggcatgttggtgtgctgcacccattaactcttcatttaacattaggtatatctcctaatgctatccctccccactccccccaccccacaacaggccccagtgtgtgatgttccccttcttgtgtccatgtgttcttattgttcggttcccacctgtgagtgaggacatgcagtgtttggttttttgtccttgccatagtttgctgagaatgatggtttccagcttcatccatgtccctacaaaggacatgaacacatcttttttatggctgcatggtattccatggtgtgtatgtgccacattttcttaatccagtctatcattgatggacatttgggctggttccaagtctttgctattgtgaatagtgccgcagtaaacatatgtgtgcacgtgtctttatagcagcatgatttataatcctttgggtatatacccagtaatgggatggctgggtcaaatggtatttctagttctagatccttgaggaattgccacactgtcttccacaatggttgaactagttcacagtcccaccgacagtgtaaaagtgttcctatttctccacatcctctccagcacctgttctttcctgactttttaatgatcgccattctaactggtgtgagatggtatctcgttgtggttttgatttgcatttctctgatggccagtgatgctgagcattttttcatgtgtcttttggctgcataaatgtcttcttttgagaagtgtctgttcatatccttcgcccacttgttgatggggctgtttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtcctagcccatgcctatgtcctgaatggtattgtctaggttttcttctagagtttttatggttttaggtctaacatttaagtctttaatccatctggaattaatttttgtataaggtgtaaggaagcgatccagtttcagctttatacatatgtctagccagttttcccagcaccatttgttaaatagggaatcctttccccatttcttgtttttgtcaggtttgtcaaagatcagatagttgtagatatgcggcattattctgttccattggtctatatctctgttttggtaccagtaccatgctgttttggttactgtagccttgtagtatagtttgaagtcaggtagcatgatgcctccagctttgttcttttggcttaggattgacttggcaatgcgggctcttttttggtcccatatgaactttaaagtagttttttccaattctgtgaagaaagtcattggtagcttgatggggatggcattgaatccataaattaccttgggcagtatggccattttcacaatattgattattcctacccatgagcatggaatgttcttctgtttgtttgtatcctcttttatttcattgagcagtggtttgtagttctccttgaagaggtccttcacatcccttgtaagttggattcctaggtattttattctctttgaagcaattgtgaatgagagttaactcatgatttggctctctgtttgtctgttattggtgtataagaatgcttgtgatttttgcatattgattttttatcctgagactttgctgaagttgcctatcagcttaaggagattttgggctgagacttcagcaaagtctcaggatatttttattttttattttttgagatggagtctcactctgtcgcccaggctggaatgcagtggtgcaatctcggctcgctgcaacctccacctgccgggttcaagcgattctcctgcctcagcctcctgagtagctgggattacaggcacgtaccaccacgcctggctactttttatatttttagtagggacggggtttcaccatgttggtcaggctggtctcgaactcctgacctcatgatccgcccgcctcggcctcccaaagtgctgggattaaaggtgtgatccactgcgaccagccagaatctaaattttacgtgaatcttcagtgttttatgtttggctcctaggagtggggagcacgtgcacgaccaagcttaagacttctagccagtctctgaatgtgctttattgctcccagcttttcttgtagtacatggacttcaataggcctgttagtcttgcccacttccttcattagtttctctagtttcttagatgaccttttactgaataatgtggaacgtaagatacctacaagacaacatgtttaaacaacatgaactcaagttttgctataaggagaatgactgagacacaatagcagcacactgacatgctcttgtctaggcatgcatgacttaaacatattcttgcatgcaccctaaaacagatttatttagcaggtttgggtaatgaattttgtttaaaaactagcatatcagtgtagcaaatattcagatagtgagagtttagagaacaaagatactcatattttatttaaaggtagagtttaattggatgaaaaatattctgatgcagcaaggagccagctaccacatctatgccgtaatcttcataagatacataataaaagtgttttctgaaggcttaaaattatatcatttctaattttgtaagaaattatgactcaaatgtgggtgaacgcacactctttcccctaaagttcaaaactagacaatggattgtttatcatgtaggaagtaagatagaaaatgacacttagggaaaaagcggatgcatttaatgaagaaaagtctgattaattccagactgcttgtccctctcatatccctccctcctccaactccatggccactactttggccccagtctcttcagctctcatgtgatggattgttggtggacctggctggcccactaacctgaactctgtaaggcaggacctgtcaccctcacccttgtctgagcacagaacctgacaatgagtaggcagaagtgacatctgctcattaactgattggttacttgatcttatcaaaatggtaatacattccgggccatgagatctctcaaacattatgcagtattgttagaaaaaaagtgcaaaccagtaccctattgcttgattttttcatagacttgtcccttgtccccatgatattttcaattaaaaaggagaagagattgcatcatatcagggttgtaatttttagttattaatagtctggcttccattttaccctctgggggatagttagaaaagcaattgttcacaaaggtcgtagggacccacagctcccaaaatgtttcccttatcttggtaattccattttttaagattaagaagcatcctgctaagttttctctatgcttatgaaggaaacacaaaggtgggaatttgaagtatttagaagaaagggtgtatttccacatagaatgtcctgtttgtgcaggtttaagatttgaggcttaaaaatctttcatttcaggagagggcctgaacagctggggtatttttcattgaggctacaggtgtaccggagtggaaagtcttgctttcttggactattgaaggtagaaagaagtaagggatttgtgagtcagtgaggggcaggcaaaaaagtgaatactgagtagccctctgctgtcttgctactgctaagagtcagaagtaagcaactaaggtactctttggatttgcccagttgcatgtattggtaaggcccaaattcctatcatagcatcatcttttaacacagtgcaatttgttctttatacttcatcatgttattttatgtttattaactcagttattttctacatatctataaggtagattttagactcattgtacaggtgagaaagtgcactcacagaggatgtatgattcacccaaactcacacagctggttaggcagtatagctgtatttgggacctaagttatcctgggctgcattccacgaggacaccagtttcaggagctgtggccggtatgtgattcaagggagaaaactcaaggagtctttggaaagtatgtgaccagggatgttactaagagaaaacatttttctttttaatttcaccttaaacttagagggaggagaatataccgattagttagccctaatactttttacaaagatggcacattttcacccaaaagtaaagtagaaaacactggaaaatcaaatgatgagtatttcccaggttctagtagctgttacctgtgcttgcaaagtcctcagaaactctgctataggactggaattggtccctggggagactccatctgtcagcaactccaccagaaagaatgttcctgcctaattcctctttcagtgaagagacaccttgtacaaaggtgtggggaaaattttgcaaagatgtacaatggtcctagttagtgaggttttgttgtaccgagtctttttaccatactatactataccgtattgactccattccttatgtctgtcccatcttgagcagaggaggggccttgcacatcattgtaaatgtggctagcatgcctagtcttatcactttagtcccagtgaaacttatttattcatacagaaaatagttagcatctgctatgtggaagtttctgttccaagatttaaggatatggtagtgagcaaaagtccttatcttcgtggtcattacattctggtggaggagaaagataataaacaagtcaatagactatagagcaggtgagatgatgagggccaagggaaaaaaaattgagcagtgaaaggggtatagggaatgttattggggggaagttaaatactactagattttgaaatggcattttataggttaaaaatggagtaatattggcaattccctgtggttcctttgtggccagaaagggcctcaacaagcaggtgacttgagttaacatctgaaaggagtggaggagcaagccttgtggattttggaggagatattccagacagaaggaagagcagatgcaaggtccttgaggcagaagtacatggcagaagcatatgtttgagaaacagcaaaggagccagcatagctggagcagagtcaccagagaggaacattcagagcatgcagggcctgtgagcaactgtgagggaaggacccaggatcgtgtcagctcgaccctgccttgtggaatagctcctgctagagtcattcaccattatttctcttgtttttcaatgccgtgtggagactcagtcaacactacctgctctccctttgcacgttacttggctatttctactaattctactctactaattctacctatcacctttggcaaatactgtggaggtcttgtaatatagttttaaaacaacataaaattaggatttttaaaaactataatgctcaggttttatttctcagttttgccatttacagtttgtgtgatcttggagaagcctgttaagtcttatgttctttatctataaatgatgaagataattactgcagaatgggtgtgaggctcaaataaaaaaaaaaagaaataagatctatatgttttgtaaaatactatgcaaagtcaaattattatggattagaaagtccttccaaatatggagtaattataatttaacactatagtccttactaatctatgcagacaccattaactacaaagggctacctgtgaacatagcagacagtcatgatctgaagtttgtgtctggtgatttcttcaatattctttttatttttctataaatttaaggtagttctttttttttctgcttaaagccagtacatttgaaacctccatactgagatggtactctctccatgaacaaccgagtcattccatgaagagcatccatgtctccttgcagggtgaagtgggtgcggcccaactttgaatatgatgaaacttccagcttggaggccacatacagccagatgactctgtgctccgacacccaccagacagatactcacatgctgacacctggtgttagcagataaggaaaggagttggggcttttcaggcttacatccagggaaagaacccttgagcccatttccacgcagctgtatttgttagatttgaagccagccccttggtgtacatttaactaatcatattagtagcatgtacagggtctggtccttgaaaaggacagacatcaaaagacacaggtagaagggatagcagtctcaggatcctgggttttatatatcattttctttatgatgtgatctctagccaacccatactccatcttcagctacatgacaaattattttgatcatctaaatgcataaaatcattaaactattagatttgcaattgataagagcagttttgttgttaatattttttgaaaagctctgtgtaagggtttgtactaaagacttattgaagcagcactgaaattactgaggtttagacactaatgaaaaaagtctaataaatataaaagtttaaaaaaactgggacaaattatctgatatatttgcctattttatgaaaagcaattttaaataaatattctcacagctgcatattcttctcaagtaataatgttatttttttctcacagtattcatttgccattccacaatatagttgcccagcttgtgtgttggtcatctgaagatgtggaatgggattcatccagctctcttttcacttaatgattttggctttacctctttcttatcttgagacattcttttgctttagctccattgccatttttaaaatttctttttattttttaactttttatttgaatattggcaggaactatatgtgtcctcttttacctatactcacaactttttacagcttgccccatttgctttattatcattctctcctcttctctccttctctcaacttctccccatcttttcttccctctctcttctctctctcttcatatagatagatattttgtgtgtgtgtaatttattataaactgtggagatacacctctatttctcaaatacttctatgtatttcctatgttcaagtttattataatacataaccttagtatggttataatatcaggaattttggtatctgtggaatattattatcatctattccacagtccatattcaaattttgtcagttatcttttgtagctttttttttggtataggatccaatttaggatcacgattacatttagttgtcatatgtctttaaactggaatagtttcccagacttcctttgatattcttaactttgaaatttgtgatgagtgcagactaaatattttatggaatgtccctccatttgggtttgtctgatgtgtcttcttaactagagtcaagttacgcatttttatcaggaataccacagaagcaatgttgtattctcagtacgacatatcaaaagatagatggtgttgatatttctcataagctgatgtgaactttgatcacatggttaaagagatgtccaccaagtttctcacctgtaaagtaaaatttccctttgtaaattttaagtaacttatgggaaagtacttgaagacatgtaaatattctgttcctcaagaaatttttacccactagtcttagtacctgttgataattttctaacagcatcataccttctacatttattggttggcattttggttaggaagtttcccctctgcctcattaattgaatcgttatttatttattcactggcttataatatactactattattacttattttaatgctcacattgtctcagaattggccagtgggagcctcttccagctgactcatctctttttaatgtgccctgtcattctttgagcatcacccttactacctggcacaagacttttcaggttcattttgtattttctctgcctcagagaaatcagccagttctctaagtcttagtctgagcaactccagcttctttaatcagaagtatttagaaaccaagatctaggcattagttctggtcatcattacttgtgtgccactgcttttaagtgctttcagaactaggaaacaaatacacatgtacctacatataaagatacatatctatatgtatgtgtacctttgtgtatgagtgtatataaaataatacaaatcatgagttcatagtgatgcttcagattctaagccaacaccatagggttcattctagtcttctcatttctgtatttgcaacactcttttccaatagtcacaaaggcctggccccactgtcctcaatatagttacttacttgctcaaatatcaaatgcacagaaagtagtttcagggttgccaacttatgtcattgcaaaaagaaaaccttctaaattgagtttaatagtatttacatttgtaaagtaaaatttacatgtagtaaaatacacctatcttaagtctatcattccatgagctttgaatggagaagcccgtgtaaacctcattcctgtcaagatggtacagtgtacatcatggtggctatggttaataacaatgtattttatgtttgaaaattgttaagagagtagattttaagtgttttcactacaaaaatgataagtatgtgaggtaatgcttgcatattttaaatagcttgatttagccatcccgcagtgtatacatatgtcaaaacattatattgtacaccagaaatacatatataatttttacttcttaattaaaaatttttaaagatatacaatgttttcagcacactagaagccttctttgtgccccttctctgtcatcctcccacctagaggcaactgctattttgaattttttcactctagattaattttgcctttactagaacttcataaaaatagaaccatacagtatatactctgttgattctgccttctaacccagcataagttgtacgtatcagtagttcattctttttgttgctgaggagtattctattgtatgactataccacaatttgttacgtattttccttttgatggacatttttttctagttttggattattacaaataaagctgcaatgaacgttctttaaaaaaagtctttctgtggatatgtattttctttttctttctttcttttttttaatttgttgagaaatttctcgctctgtcgcccaggctgaagtgcagtggcgtgatctcagctcactggaacttccacctcccaggttcaaatgattctcctgcctcagcctcctgagtagctgggattacaggtgcctgccaccaggcctggctaaattttgtatttttagtagggatggggtttcaccatgttggccagactggtcttgaactccttacctcaggtgatccacctgccttggcctcccaaagtgctaggattacaggcatgagccaccgtgcccagcctgtattttcatttttaaaattatttcttaaacaatctatctgttaaattgtgcagtaaattttttttttcctcttggtatacagttctgtggattttaagaaagctatagattcattcaaccaccaccataatcagaatacagaacagttccatcatccctcaaaaaacttccttgtcctgcctatttattgtcagccctaccccacctcacccctaacccatttcaaccactgatctatacttcatccttatagttttgtgtttttgagaatgtcatataaatggagtcatacagtatgtaatctttagagactggcttctttctctcaacacaattcctttaagattcatccgagtggttgcatgcatcaaaaactttttactgatgagttgcatttcattgtaggtatgtaccacagtttattatttcacctgctgaaggacttctgtgttattgccagttttctggcggttatgaatagtaccgtgataaacgtgtacaagattttggtaaacgtgttttcatttctctagggtagataggaatagaattgttagtacatacagtaattgtatgttcaactttataagaaactaccaaatccttttccagggtggttgtgccattttgcattcctactggcaatgtatgggagtttttgtttgttttttgtttgtttgtttgttttctggagacagagtctcgctcttgtccaggctggaatgcaatggcctgatctcggctcactgcaacctgtgcctcctgggctcaagtgattctcctgcctcagcctcctggtagccggaattacaggtgctcaccactacgcctggctaatttttgtatttttggtagaggggaggtttcaccatgttggtctcaacctccttacctcaggtgatctgcccgcctcggcctcccaaaatactgagattacaggtgtgagccaccacacccagcttgtatgggagttattattgcttcacttcctcctgagtgctaggtgttgtcatttttcaaaattttagccactaataggcacacagtggtattgaattatggttttaatttgcattccccctaaggactaataatattgaatatcttttcatcactttccatcattacatctttgacaaagtgtatgtttgaatcttttgcctaattttaaaattttgttgtttgttttcttactgaattttgagaattcttttttcagtttcattttttattcacaaaatattttctcatattcattgcctttaatctttgcaacatcctgcaaacattgttctaatattaattttgcaaagtcagagcagtaaaaattaaaaatgtagtctccaaagctaacagtctgggttcaaattctgggtttgtcacttattgctgtattaactttagcagcttgacttccttgaaccttgatatcctcaactatgaaatcatactcatacaaaacgatcattctcagcaaattatcacaaggacagaaaaccaaacaccgcatgttctcactcataggtggaattgagaaatgagaacacttgaacacaaggcagggaacatcacacactggggccttttggggagtggggggctgggggagagatagcattaggagaaatacctaatgtaaatgacgagttgatggatgcagcaaaccaacatggcacacgtatacatatgtaacaaacctgcacattgtgctcgtgtaccctagaacttaaagtaaaaaaaaaaaaaagaaaagaaaacaataacaacacttactgagtgcttactgtgtatcaggcatggttcagagtattttaaacacatcttaactcatttcgtcctcaccacagtctatgagttttgagaattctttatgcattctggatacaagttatttgttcaatatttgatgtgcaagtactttctcaagtctggggcttctattttcattctcaacagtgtattttgcagaacaaagggtttttattttaagaaaggaatattttgtcattttttttctctgatagattgcttttggtgacatgtcttaagaattcattaccgaaccaagaccacataaactttttttttcccaaaagttttatcattctggattttaagtttgtatctacgatctactttgagttactatttttataaggtgtgagatttaggtcaaagttcattgtttttggtatatggatgtccagttgttccagtatcatttgttgaaatatgatgttgttaccgtcctgctcaaaaactttcggtgctttctccattgcacttggaataaaatccagactccttttgtatggtctgtaaagcatactgctttcatgcctacttatttctgaaacctcattttgtgttgtattcccttttgtctgtcagacttcagcctccctggcttctcttttctgtgaattctcaacactcttttccagcgtagagcctttgcacaagtttgtgtcctcaacctgaaatatttttccattatgttgttcaatagttgccttatattggttcccctaagtttattttttattctctcccctggcattctgcccttttccttaatcatacttattacaatttttaactttatagttatctctaaactaatcactcattgtctggatttcccatgaaactgtaagatccatgagactgtgtttgcagtgcccagtactgtgcctatcctcataaaacttgctgtctagtgctgagatgtacaacgaaacgagaaactacaatactacaagaaactacaccattctgcatacatgccatttaagttcattcactatttctacatggactaaaatgtttttccccactatattttgtatacctgaatccttctcacccctcaagaaacagttccatcttccctctctgagaagttcctcctggtgcccagttcggaagagctcttcctccctgctttctactctcgtactgacactctccactttgccttgagatcacagagactgacttagctcttctcctagaaaatcaaaagcttgctgagagtgggattgcattcagcttgtgtctccctcagtacacagactagctcattttattcaattaattcattttctgatttctagaatacagtcatgtgtttagctatgggtccatcttgccattggaaactaacagagctgattttcagaacaaaaagagaaaacaaggccaaacttcaaatcatatctcatatttgcacagccaacacaggccattagagttttaataaatagcaaagacataaaacgttttcttttaacatatgctgggactcgactggtctcttgttgctttatttccccgcctggctcaataatagtcctataaaagtgacagaaaaaccatataccatgttaccttagagggatgactgagacagttacaaaaataggaagactcagatgccaaataaaacatgggatgtttggcaaaaccttagcatgaacatatgtacctagtccaggcgctctgaagttactggatgtattaaaaagaagttggtcctgccctgttttatgatgtaaaagtgtgtgtgtgtttgtgtgtgtcttgtttcattgaagtgaaagcaaatcattttgactgaatagtgacaaatattaattcataaaatagtttttagactggaaaaatatttgataatggatccaaatatgaaaataatgaaatataaaagtcaatatagtaccttacaaactgtagaaattatatctgagctgtcagttctagtccttcaaaaaccctgtcctctttgagtgagagatgcatccctatagaacatcctgtcctcagttggaaggcttggccttaagggcttattagttagtgggaacagagcaaactttctttatatcttaccacacagtgctggtcttagtatagtcttgtgtctgatttatgaatttctcctggaatgaattttccacaaatatatgatggggaactgtgtagccttgacattcattctgcccatgaatgtctttagtgttagcagctggcatccaggcatattccagtgactcaccaaccaaagctatatgttgccttctctacgtttgaaaaggggcagggggcggaccacagaacactaatcagattctaaagttgccttcatgtttacttaatatttctacactgctcagaggaagccaatatcagcaatattctttttgagatgacaaaaccttgaaacttttttggttatttttatagcaatagagtttttgttgacttagtattcatttttctgttttctctttattatttgacattagggcaactcttaccacagattaattgctcttcggggtacatcagactaagatttctaccatgttgatgatttgtgtttactttttaagtgtgatgaatattgtgtattacttgtttttttttaattctggtgaggaaataccaccaagtgctgttcggtgtttttcctcttttgatgtgtttgtggaaaactggtgtaaccaaaaaaaaagcacattagaggagttcaaaatggccctttagagagtgctgatttctatgaaatggatagatttttagttgtatattagcagtgatttgaagcaagtctttaccatacagctaaaagaagaattgaattttcttagctatgccataaaagtaattacctgccagataaaagggacctcatgttataaatagtagaaactcaacattttgttttaaatcttcattttctaatacgtgaaattatctgaactaatctatatggtgtaggttcagttatgtatcagcttcagatatatcagttatatatatgttaacccacaaaaagaatatgattttgaaagccataagaatccatatctgtgtctcgtacaggaaaacaggaaggctgaaatggaaagatgcttatagaccctaactcattgtctcatgaaagtcagtcctcttcatgctatggccagggagcagtgagggttgtggtgctcaggatagggaattggagaggagaagggtacattatttcctgagtcatcttgtttcactttctgcctatctctcaatcccaacacacaccatagacgtgtgcacacgcgtacttacacacacacacacacacacacacacgcgcgcgcgcgtataccagacattttccttccccatccttttaggccctgaagtaataaattactctgctggagaggacgggtaaattcaaatagcacactccttccattcagaatatcttaatgaaatatcatacttttcccctcacatcaaaaaagacagaactttttgtgactaaaagttaatttcttaagccaaaagaaaatttctggaagcagtcactcaggaagtttcctaaaacatttatatgctaagatggtaaacgatgggatttgttgtccctttgttagcaggaaggcatgatcttgagcagcttcaggtccatcaagatctttcccaagtgagaacgcaatgggcttttctggctgtaagttgtccattgcctctgctgtcattggagagaaagaaaccaatcacctgctcgtgttttttcaaattacaaaatccattcttacattgtaaaaaaacaggctgctgctgattttggctcacaggccatagtttggatcccttatctattcagtatactaagtatctgttcatatcaatatattattcttgattatatgcaatgactacattcttgattatagtcaatggatatattcttattttcaacattttaaggaatgtttaatttgtaaaaagttaaaagtcacagaatggtttaccattcttatgaataaaaacagaatttcaggatttcatatgaatgtttctagttcatgctaatttaataatacacttttaaagaatgcattttctaatttttcaatgatttagcatgttttcagattttatcaccaatatcatcaaatgacttatttgccaaatttaccattttccccaaacttatatctttgaactctgataaaacttaatgacttagagtggattgaaatattttaacagtttttgaagatacttaggatatattgtgcttggccaatttttctattaacattttaggaaaggttccatttgtctgtaccccaggtcccttactgctgcagctgaattgagcaggggacaagagaggggaacttgcaatggggaaaagaaacaaaggagagccagcatccagcacagcttgggcttccaacccctgaagttgggttgggaggaaactggagtccatgagagaaggaaatgaggagctaagcaggtgtctgaagccctcaggactctgaaatccttccttccaacgatagtcttaaactctgccaactcagcatactgcaaattttatgaatagcttaaaaaaacaggtttttggtaaatcagtatatttggataatttgacagattgttactttgattcatgttcattcagtccatttgtctcctggcaagttggcttttggaaaatttcctattagcagattgacttgggaagttggtatgcttccatactgaaaagcagtggctttccagaagcaaaactaagaaggagccaggagttggtcaagattgcatccttcctggaaacaatagtgtgcacaaactacctggcaaagttggtaatagctcataggtatctgcagttcattctgtgggggatgttagtgggttaagctgcggtgtgaatatacagtgatggaatggatcttaacatatgagcctatcgatttcaaagacatacacattttggtaatagagacaaatggaggcatcacatgcctctatcaaaacatttcatgtaccccataaatatatacacctactatgtacacacaaaaataaaaataaaaaataaaagtaaaaataaacaaattagggcatattggacgtgtgacatgacaaaatcaaggcatttctggctgggattaaacaaaactagagattattttactactccctagtggtgacacaactattgcccttactggtataaggagttagcagactgggttcatattctggctttgtcacttactggttgtgaacttatatgttattcatgttataaagctttattttcctcatctataaagcagagatgataacagagcatatgtcattgagttattgtaggattcagaaaggtaatatgtgtaagatacagacccctgggtaggaacttggtaaatgatagtgtcttttctgtcagtcagagatgagattggtcgtgggtagggagtatggttagttagcatttaccttaagattattgagggtgatgatgaagcattcacttcaagttactgatattctgaaccgatccaaattacatccattgactatctgcctttagccaaggttcctaaaatgaactaaattcatcttcaaataatgtaaatctattaagacgactatctccaattatttatttaataaaaggtggctatattgaaagagaaggacctatcaaatatttagaaggcagtgtagttattttgtattcggaaggatcaggatttgtacattgattcagaagatatttacaagtgtacattgtatgcagagccctgtagccacagaacacgcttctcttctccccctcaaaggagggtattggtctaggtgatctacagcaatagcaacattcccaactctctcagtgcagtttcaagtcacaaaacccaggctcttgatccctagtctgctcatcttaacactagagcacctgcttcttggctccaaaggaatagagaaatgatagtgcatgcagaactcatcttgcaggaagacgttttctaggagagagaattaaaattacaaaagaacaattgtaaagcaaattacagtattatgcctctcaaatcatatagttaagtggaatagaaacttagagacatagggtggtcaatgaaagaatggctaatgagggcatttgaactgaccacacttatggggactgtacagattacaacgtaatttttcttttttttttttaatttttcagaattttgttttcactttttgcatgtggagttgagaaaaatatttttccagctttatttaggtataattgaccaatgttgagggtatgtgaccccagcttctgttcaccttccatggcttgcctagaatactgaataaaatagtgggaggctggggcaaagagaggctgtttcaggcttaattcccagggagccacttaacaggaatcctcttctaagaacataatgactcttcaggagaggtgggctttggagctgctagtatctagttatcaaggatggctgagatgcagttggatttgaaggaaaagatgatacctgatccttgactcaagattttacatttcagacagggcatggtagtgggcttcctctgagagcctgtagacaagccttggttagagtaaccttaaaaattagctccataaactttgttcataacctgcaaccaagaagggaaatctggttttctttccctccatcacttcagattatatcatctcagctgtaaattaagtagggagagacatttaggattatatttttactgtcatcagtttcctgactctctgccacaactgttcaaaacacaccttagtttgtactccattgacgtatgaaaggacagtattcatttgacatctttttcatatttacagtttcatttatacagcaagtagaagtagatgatattttaagccaagaacaaccttgcattaaagtaattcagcagtgttgagcactttaccaatggatatcaaacctcggtaaaatatttaaaatgaagagagagaagaaacatgaagggctcgatttaagagtaatattttgagattttacataatgagacagaggtacttttctttgtagaattaggtgttatttttacgtaactacaactggcaaagtgttctttgatctttctccttatttttaaaaattaagtgatacaatttggacaaagaaagttgtgcttgtatctgttcctaaccaaaggccagcagtggatatggctgcaaaccctctgttacatgttatatcccatatcctgagcccaaactcattatttacatgcacaaactagttaggtattaaatattccctaatgtttttatttaaaattgtaagtgcttctctgtgacttttaattgtgaggtgttttttgttttgttttgttttgttttgttttcgggtctcgctctgtcatctaggctggagtgcattggcgtgatcacagctcactgcagccttgacctccccggctcaagtgatcttcccacttcagcctcctgaatagctgtgaccactggtgtgcaccgccacatctgactcattttttattttttctagagatgggatctcactgtgttgtcctggctggtctcaaactcctgggttcaagtgatcctcccaccttggcctcccagagtgcctgtgacttttatgttctacatcaaatatttgccatttatactggcttatggagaggcacaaaatgtaaattcactgaataatttggaaaatatttacttgtatttatattcttgatatttaagtcggtggatttgaaacaaaacatacttgcttcacaacatattgctgtcaaagagttttgtccagtaaaacttactgcatcctttaatacagcactgtccagtagaactttctgtgatgattgcagtggcctataatctgcttcatccaagacggcagccactagctacggagcacttgaaatgtggctactgtgactgaagactaaattttaaattgtatttaatttaaattaacttaaattttgatttagccacatgtgtctagtgactgccatattggacaatgcagcaagcaatatattcctatgttgtttatctcagatataaagttatgcactatttagaagccaatataaaggtattagattgcttttaagcaacaaatagaagctccagcttgttcattaaaataattttgtcaatccaggcagacttgggatgaaggatgtgaaaacattttgattgaattgactactaagttttatctgtttattcctttatttacttagcaaatatccattaagcacatagtaattgctctccattgtgtgaagtgcctgggatacaagaagtttaaagcatgttcattgccttgaagaaattaaccaggtagaaaaagtagatagaaagtaataagaaacattcatataaggcagaagagagttgagaaagagggaagagtctaggatgacttggagatttcagtcttgagtgactgggtggaaggtggcactgttcaccaagtaggagacactggagtggggaacaggagtctataccatgttgaattgaggttagatgcccacatgcatgtgctgaaggcagttggatatgtgggtctacagcttgggaagaggtcttgaggtagagctgtgggagtcacgcatagttgaagccaagggatacgacatggtctgcaaggcagataatataaagaaataacagaactccaagagcagccctgaagaggtaccagcatttatgatgtgagaaaacattctgttagactaacatagcttataaatttagtcggaggttgaaaaattattttaaaaatatgtaataatataggaattttgtttttaaataatatgtgggcagatttacaagtgactccatttatgtttgtttcatgacactgaaaatcaaaccagtaagaaatattttatattttacatattttatattttaattaaattaatattaacaacataaaatattaataaatatatttaattaaatatatactttttatatattttaaacattctgtattcgatatagtccagttatacatgcaaatgaatgacttaactcattaactagttgttttatgctgtgcaaatcagtacttcctaaatattacgtattttggatatccgaaatacatttttcaagctcttaattttttagtgttagaaataaatgatataaataaaatggatttttgtcagggtcctctgaaatacataatggaaaatttatctccattggatcagaattcactttttgaaatcatgtggcataacccaggttttctcttaattatgtgtcttctgaatatgcttggaaagttttatatatatcattttgccactgtcttgctgctctgaggtcttgttttttataatatttattatcagactttaatttctcattttgtggagtaataggggcttttctaaagaaaaactcgtgaaaacaaaatacatttcaataacagaatctcagttatgaaatttttaaggcttgaaacactattatcaatattagaaataagattctcattcattcatattttctcacccatacttaattggtgaaaagtaagctagtatttcgactctagtgtgccatgaagctgcatctcaccctgggcaaatttctatctaattttgatagaaatgaattgttaatgagccccgagaatggagagtttctctaattacaggaaacaaaattaaattgggcctaaaggcatttttttttttgtaattgcagttggtttaaaaattgaaaaagaatattcactcaaacaccttggctttaaaaatattggtttgctccccactgttaaaaaggcattgagacctgcagcaaacttcattctaatgagggtccagatgatttttttttttgtagatgtgtagaacaactctgtgggaaaaatgatacctcaaagattaatgatgttctgtagtagggaaaataaaacaaatagtttttatttgaacctttttattgtatgatagaaaattttgatttaaatggcgagtgagatatgcttaccatctctcttttttcctatttatagtagctctcaaggtcaaagaggacacactagcatgaaagccgtgtacgttgaacccgctgctgctgctgctgctgctgctatctcagacgtatgtacattgaggaccatagactacaatcttagacccttatccgtgtgatgttgattatttagttaatgtgtgttaccaagaagtatgtcatatggatgtgacacatgagcagtgttccacagttgccatcttgtagacatttcttattaggagccagtaactgccagacttcgaatggtccctgtagtgcttgaaaaagaattaagctaagctgtatcccagatgttgttcagggtctttttgccttgtgagtacatttcataatggaagtttacttactgacctgcctggtgtagaaagccatgaaggctagaacctagtgcctaattagcctaggttgtctgcatccgttctctaagacaacgaatgtatcatcaatttattcattaaccagatatgactagaaagaatccttaagggacatacattaatagaaatctacctgggtctaccctcagtgatctgatgaaactctagactgggacataaaaccaaactgcaaggagagaggtagagaagaacagaagaggtatcccagaaggcatttcccacgttaaaaagtgacagggtggttcctcaccttacatgccactctatgggtatatgtaccatagctgataggctggatcaccacagtggtaacagtgctacagagagaaaacatgaccgagacatcagaagacaagggtttgattcctgattctgccacttaccagttacatggcctggggaaagttgttttaccttggacagcctcagtttcctcatctgtaaaatggaagtagtaataataatctctgccaggctacctcatggggatataataatgctcaaaggaatcttatcgggatatttattttactcctataatagaatgaaacctctgtgagaggagagatcattggctgtcttgttggtcagcatatccccagtattttgaacaaggcttgttacacacagtaggcagtcataaatattagatgcacaaatgagtactctatgttaaagcactctgttatttttatagaactcttcaaatatttggtaaagggatttcaagagcagtatagacaggctgcatgcatagactctaactttggttttcaggcctccatgtgttttgcctgaatgaatttgtactgggatcagtgcagacagcaggtcttttcagtatttaagttcttctgtaatatggagatgccatgagcacatattttaaacatgaagtgctgattttgtattgaattgtccaagtattgctcatttaacaaagtatgtctatgtgaataaaactttctccattccgaataagtacctctgcttaacctaatattctgctcaaagaagtatgaaacaaagaggaaataaggtagaagaatgctaatttagacagagcagtgttctgtttacacacaaactaattacaggtatgctgggaaaaggggccaagccaaccatatagctctagccatcagtgtaacatctacacagttgtcaggcttgcttcatcagcccgtcagtaaataaatatttacccagggtttatactgtactgtgtgtgaagaatccagagtccctaaacttagtatatgttgaagaaagctggattaaaatattctcattttataaaatatataatgcctaagtaattataatatttagagaaaagtgggctgtttaaaaaaaaaaagaaacacataatcccactgctgtggcacagctgctatttaattttgcttattcccattcagtcttagtccaccaacgtatatatttttcatgtagttacaatgaaaaatatagcttacattctactgcatacccttggcttccacttatcactaagttccatttttttcaacagtcacattgatcattttttaaaactgtataatattccatgaaattgtgagacctgcttccagccaagatggagtgagggggccaggttaacttgcctacctgaaacgggcaaaaataaaacagacaaaatatatgacacaacagttttcatgataatggccagcaggcagcaaaggccatggattcttgagcaattggaaatcaatgagaggagcttcacagttaccagagcttactacatagcaagtttctaggccacattgcagagagggagaacacatatggagcccagtggactgcccgagttgagattgaggtgagagtatagggagactaagtttgctagcggagtcctagagaagagagagctgcatggagaaagaatgccagagatctgtgaggggccccctctagtattcagcagcatattgattggcatattcacttgaggaagctacttgaagtggggctaggggaaaaccattccagaggattacagagaacaatactagtactcacaaagggttagtaacagttcttgttcctaccagccatactggaaatcctcataacacacaagacattaagtgagagtacatagaaatgtcttgcatcaggtgtggagaaaaattaaccctaatgatatggtttggatctcctttttaattgactctgtcccaaatacttctcttaatgatgagtgtaggtgacttatgttagtagccacccacattctgccatccattcctagagacaggttgctccttagccatgttacactaaacaggcatgtttggcagaattgcagcttgtgcattatcagattgcttttgcacccaaatccattgtgtcaggaggtggcaggtggggtgggatcttcagaagcagctgtctttgagcatgaaccaagagctaggtaggacagaagcagacaacacagaaacagtcggctagagctgattacttgcaaatgagagtccaggacaaacctgatttagggaataatcatgagagcatcttgcactgattttatacctactatggtaggcatttagtcatttattcattcaacagatacttatttaagattctaaaaagtagtcaaagaaggtcagccctgaaaaagaataataacactgaaaactaaactgtattaagagcttcctatttgtgcattttactgggtgcttaagtcccacaacagacctgtgaggcattatcattccagttttacagatggcaaatctcagagtcttgctattgaataagttgcccaaagtcacacagtaagtgtcagagccaggattcaaacccagatctgtctgatctcagtatctatgtctcttactgcccaatgaggcgtctacttttaaaactattttgtcatattgtcctatttgttgcatggtttcccttttgttctttatatatttgaacattttaaatgtgtttatttttaaaggccatttctgattccttcatttactgatttattgaacaagtatttattgaacacctaccagataccagacactgttttaagttgggggtggattcatcagttaacaaaacagtgaaaaattgttgctctagaggaacttacattccaacagtgagaaacagacaataacgagatgaaaatattaaataaagaaatcattgattagaaggtgacaagacttaggccaggcacagtggctcatgcctgtaatcccagcactttgggaggccgaggcaggcagatcacgaggtcaggagttcgagaccagcctgaccaatatggtgaaaccccgtctctactaaaaaatacaaaaattagccaggcgtggtggcacacgcctgtagtcccagctactcaggaggctgaggtgggtgaatcacttgaacccgggaggcggagattgcagtgagctaagatcgtgccactgcactccagcctgggcgacagaatgagactccgtctcaaaaaaaaaaaaaacaaaaaacaaacaaacaaaaaaaactcaacccaacccaaacaaaagagaaggtgacaagacttattgaaaagatagaacaggatgaggaggtttgggaatgcaagaggtcggggagtacagtattaaatataagcaatgacttgaaaaaggtgagaaagctagccatgaagacatctatggtcgggggagactatttcaagaagaggaaaaacttctgcagggttttggaggtggaagcatgcccagtgtttagaggaataacgagaaggttagagcagctggagcagagtgagcaaagctgagagtaggtattgatgaagtcataaatgtaaggaggtcaggttgagtaaggctttggaagccattgtatagattttggctttaactctgaatgaaatggagaatgattagagagttttgagcagaagaatggcatgacctgacttgtttattaaaagagtcacagtgttgagaatagactgtgggaggaagggcaggaatggaagttaaggagtccagttaggaggctatcccagcagtccaaatgagagatgataatggcttgaagcagggtggtaaccgtagaagttatgagaagtggtcagattctgaaaatatatatgtgtgtgtgtgtatatatatatatatatttttttttttttgagataaagtttcgcccttgtcactcaggctggagtgcagtggtgccgtctcggctcactgcaacctccgcctcccaggttcaagcgattctccagcctcagcctcccaagtagctggattacaggcgcatgccaccacacctggctaatttttgtattattagtagagacggggtttcaccgtgttggccaggctggtcttgaacttctgacctcaggtgatccacccgcttcggcctcccaaagtgctgggattacaggtgtgagccaccgtgcctggccttctgaaaatattctgaaggaagagcccttacatttgttggcatttgatgacgggtgtgagaaaaagagaggagttagggatgacgtgagcaactgggaggataatgttgcattaactaagatgggaaaaattatgggaagaactcgcagcttagggatgttttcttccttctttccttccttccttccttccttccttccctcctcctccttcttcttcttccccttccttccttctctctctctctttctttccttccttctttctttctttctttctttctttctttctttctttctttctttctttccttccttccttccttccttccttccttccttccttccttccttccctccctccctccctccctccctctttctttctttctttctttctttctttctttctttctttctttctttctttctttctttctttctttctttttctctctttctctctttcctttcttctttcctcctttcttctttcaagacagggtctctcactgtgttgcccagactggaatgcagtggcatggtcagctcactgcaacttctgcttcccaggctcaaatgatcctcccaactcagcctcccaagtagctgggactgcaggcacacactgccagactcacctcattttaaatttttttctagagacagggtctcactatattgcccaagctggtctcaaacttctgggctcaagcagtcctcccacctcagcctcccaaagtgttgggattataggcatgagccattgtgcctagccaatggtgttttctttggggggaggagtaatatcaaggacttagttgtgaaaatgtttatgactgagaagccccttagacatccaactggagatgtaatacaggactggaaatttgaatttggggatcatcagcatggatggtcttaaagctgtaagtctggaggatggacactaaggtagatagcaacaaggaccaaggactgagttttgaagtacacccaaagttaagagattaggggaaaaaaaggaggaattagcaaaagagacttacaagtgactagtgaggtagaaggtaagcaaagtgaagaaagtatttacaggaagaaggaatgatgaacaatgtcagctactgctgatagattacataggttgacaattgagaagtgaccattagagttaggacctgtaggtcattgctaaacttgacaaaagttttggtggagtatggtggggttcaaggagataatgtctgatgagagtaggtttaagagaagatggtggaatggtggcaggtaaataagagataagatatagagatgatttctaaactcagggtatttctttgttttgatttttgtttttctttttattattattattatactttacgttctagggtacatgtgcacaacaagcaggtttgtcacatatgtatacatatgccatgttggtgtgctgcacccattaactcatcatttacattaggtatatctcctaatgctatccctccccactccccccaccccatgacaggccctggtgtgtgatgttccccttcctgtgtccaagtgttctcattgttcaattcccacctatgagtgagaacatgcggtgtttggttttttgtccttgtgatagtttgctgagaatgatggtttccagcttcatccatgtccctacaaaggacatgaactcatcattttttatggctgcatagtattccctggtgtatatgggccacattttcttaatccagtatatcactgatggacatttgggttggttcctagtctttgctattgtgaataatgccacaataaacatccgtgtgcatgtgtctttatagcagcatgatttataatcctttgggtatatacccagtaatgggatggctgggtcaaatggtatttctagttctagatccttgaggaattgccacactttcttccacaatggttgaactagtttacagtcccaccaacagtgtaaaagtgttcctatttctccacatcctctccagcacctgttctttcctgactttttaatgatttttattctaactggtgtgagatggtatctcattgtggttttgatttgcatttctctgatggccagtgatggtgtgcattttttcatgtgtcttttggctgcataaatgtcttcttttgagaagtgtctgttcatatcctttgcccacttgttgatggggctgtttgtttttttcttgtaaatttgtttgagttcattgtagattctggatattagccctttgtcagatgagcaggttgcaaaaattttctcccattttgtaggttgcctgttcactctgacggtagtttcttttgctgtgcagaagctctttagttgaattagatcccatttgtcaattctggcttttgttgccattgcttttggtgttttagacatgaagtccttgcccatacctatgtcctgaatggtaatgcctaggttttcttctagggtttttatggttttaggtctaacgtttaagtatttgatccatcttgaattaatttttgtataaggtgtaaggaagggatccagtttcagctttcaacatatgtctagccagttttcccagcaccatttattaaatagggaatcctttccccatgtcttgtttttgtcaggtttgtcaaagatcagatggttgtagatgtgtggtattatttctgagggctctgttctgttccattggtctatatctctgttttggtaccagtaccatgctgttttggttactgtagccttgtggtatagtttgaagtcaggtagcatgatgcctccagctttgttcttttggcttaggattgtcttggcaatgcgggctcttttttggttccatatgaactttaaagtagttttttccaattctgtgaagaaagtcattggtagcttgatgggggggatggcattgaatctataaattaccttgggcagtgtggccattttcacaatattgattcttcctatccatgagggtagaatgttcttccatttgtttgtgtccttttttatttcgttgagcagtggtttgtagttctccttgaagaggtccttcacatcccttgtaaattggattcctaggtattttattctctttgaagcaattgtgaatgggagttcactcatgatttggctctctgtttgtctgatattggtgtataagaatgcttgtgatttttgcacattgattttgtatcctgagactttgctgaagttgcttatcagcttaaggacattttgggctgagacgatggggttttctaaatatacaatcatgtcatctgcaaacagggacaatttgacttctcttttcctaattgaataccatttatttctttctcctgcctgattgccctggccagaacttccaacactatgttgaatagcagtggtgagagacggcatccctgtcttgtgcgaattttcaaagggaaagcctccggtttttgcccattcagtatgatattggctgtgggtttgtcataaatagctcttattattttgagatacgtcccatcaatacctaatttattgagagtttttagcatgaagggctgttgaattttgtcaaaggccttttctgcatctattgagataaccatgtggtttttgtcattggttctgtttatatgctggattacgtttattgatttgtctatgttgaaccagccttgcatccctgggatgaagcccacttgatgatggtggataagctttttgatgtgctgctagattctgtttgccagtattttattgaggatttttatatcagtgttcatcagggatattggtctaaaattctcttttttttgttgtttctctgccagactttggtatcaggatgatgctgggctcataaaatgagttagggaggattccctcttttcctattgattggaatagtttcagaaggaatggtaccagctcctccttgtacctctggtagaattcgactgtgagtccgtctggtcccggagtttgtttggttggtaggttattaattattgcctcaatttcagagcctgttattggtctattcagggattcagcttcttcctggtttagtcttgggagggcgtatgtgtccaggaatttatccatttcttctacattttctagtttatttgtgtagaggtgtttatagtattctctgatggcagtttgtatttctgtgggatcggtggtgatatcccctttatcattttttattgcgtctgttagattcttctctcttttcttctttattagtcttgctagcggtctatcaattttgttgatcttttcaaaaaaccagctcctggattcactgatttttttggagggtttttttttttttaaattctgctctattttatgtagcattttctccatgtctgtccaatctgctgtcttgattggaagccctatggcctttcccccaccacttccaaaaaagtaaaatgcaaggatctcctaaaaattagagcactttaacaataagccaccacagggaaaatgcaaagatttgggaacagacttcttgaatgccctcttccccctctccccctacatatttgcagtttacataaccatcaggtattggagtttgcatttgaagcctactctatatccagcctcaaaacccatgcctctcttttcaaatcctttagcacactattcgtggagacaattatggaataaaggtgaatccaaaactccactgaaaactgtaaaagcatgttgattttcttcctatctccatgcatgcattttcaccttagtcctaattgcattttaaactgttatctttttgcttccaaagtagtttcttggctttgttttttccaggccaattaccattactgcacatgatgctgtcatttaagttaatttaagctcactgcatttatattgataagcccgaacatacgaatacccaaaagtggacatcttaattaacatttgagaatataagtttatgttgaaaataatccagaaagcaaagagttagtgattaaatcgatagatggctatgaagaagaacagaaggaagaggaaagagacaggtcatatctcctcttaatgaataccgattcaccataatgtcattgtaagtaatgaaaagattgtcacatccccagcaacatatcacttattagggagtataaaacatagtcatttgaacagtgaggttgcacagtttcctgaagttgaaatgctgggatgtgatccaacaaacagattctttgtagaaaaatcaccatgggtctgtgtcttaagccaatccagaacaaaagcaaacaaaatattttgtcagggatgtaaaatatttcactgctaaaccaggtacttaaatttcaatggacagtgatccacagactattcaaaaaggattcagttgttcaggaaataggacaggatcactcaatagaaatattatgtatgtagtttaaggcaacaaatggcttaaaggtagccaggcttaggaaaaagagcattgggtttggagtcaatggattctatctctcactctgctcctgtctgtctgtatggccttgccctctttgacactatccagtgagaacattggactagaagctcttagaggccttttcacctctctgcttaaaatagttttgctaataatactttcaactttaatctgcctaaagacatgcaatagttgttaaacagcccctggttggccttttcttgctctaagcctaggatgcaagtgcaggaactctgggaaaatggccttatcagtggtggtgcaggtctcccactgctgtcccatttctctgtgaaccagtttgtttgggtctaataatgaggaatgggagatgaggtgactaccatccttggcaactatcatgacagcatcctactgacaccactgaaaggcagaattgtttttgccatgccttttgatctataaacattttttgatgcctttatttttagtgttatgtatactgtgtttctcttcttcagtttgtcagtgtataccttgtggcatctataatctccgcttgttatcttccagcaatatttttaaggaggtatttgatgatgatttttgttaggttttcagttgattgcagcagtgttagaaattgtgatgtgaaatgcatcaaagtttgtattctgcctgtgtttcctattctttctaactccaaaatgcaatgtcctatctttctcttttggaaatgtacaggaccaaattgatattgcagaggttgagcagtatggaccacaagaaaacgttcacatgtttgtagattctgattcaacttattgctccagtacagttttcctggatactatgcctgaatctccaggtaggtacatttatgcatttggatagggactattagaagaaaaacagtgacccccagggtagttacagtttttcaaatgaatataatgctctataatactgtgaaatcccagagtgaattccaactttcttcatcttctgtaaatatttgagatgatgatttgagaataataaaaatgagtatttcatcacagattcaagtcttttctcctatttaattttaatcttctaaaaattggcgctggatctcaatccttgaaggaatagcgttttatctttttatactcgtgtagtctattctgctatcacacagtatttggattccaaagaaacctcttgttattgagttttcatgccaataaagggggaaagtgagagtctctcaaaaacagtgatatttctttaatgagtttcaatattaaagatatttcgtaaccgtaattgtttgaaaagtacaaaacttaaggaaatggtggatgcataatacaaattatatctcctaattaatcttatcataaataattggtatgtggaatctccttatatagaagtaataagctctattttaatttttatttcactctttttcagtttttaaatccagttttagtatctccaacttttaaaattcttagttaacaacttttccattgttgctgtcaatctcaaagctgtgtttaaaaaattccttccaaaacaattgatttttggcaggagaggtcaaactccatgaactcataattgtgatttctaaaatttataagagcattgattgctttaaacctatttatctggacctaccattgtaactttgctatagagaattatttgtattcactactgttaagccaatgatggagaaatccttataaccttccacagatgactgttccaacaaaatgagcatattgaaatggctagcagcttatggctgatatggtagaagtcaagtaactcctgggtttctcactatcacttacagataatttagtagctttgtttacttggaatcagaaaattaaaaaatggtaaactgggccgggcacggtggctcatgcctgtaatcccagcactttgagaggccgaggtgggcggatcatgaggtcaggagatcgagaccatcctggctaacacggtgaaaccccgtctctactaaaaatacaaaaaattagccgggcgtggtggcaggcacgcctgtagtcccagctattcaggaggctggggcaggagaatggcatgaactcgggaggcggggcttgcagtgagccgagctcttgccactgcactccagcctgggcgacagagcaagactccgtctcaaaaaaaaaaaagaaaaatatgctaaaatgatttggaaaatggcttttagtggaaaaaagagttaagcagaagaatttagccaacagtctaaacactggaagtatccagaaaccagaatttttcaaaatattttcaatggtcatcccaaactcatgctatgattaaaggacaattcgctcatgaccatagcatggtaaggtatgcaaccccaggctgcagaaagcagataggaagtgacggagtggttcattctgcctaatccagatgtttctcttttccaaacttttaatcttgaaataattttggacttgaagagttgcaaaaatagcacaaagaaaaaaatagaaaaataagggaaagataccatttaggataaccttcatttagcttcccctaatgtaacattttacataaccacagtacagctggcaaaactaagaagttaacattgatgcaatacttttaagtgagcttcagcctttattcagttttcccagaaagttgtttttctgttccaataactaatccaggatccctcattgaatttaaataatatgtgtttttagtttcttccagtctttgacagtgtctcattcttgcttttttttttttttatcatccgatacttttgaaggatatgggccaggtatttgacagaatgtccctcaatttgggttcgtctgatgatttttcaagatgagattgaggtcttgcattttggggaagaataccacagatgtgatgtgccctccttagggcatcatatcagaatatacatgatggtatgttttattgctggtggtgttaacttgattgcttggttaaggtggtactgttttcccctttgtacttatcaaatatttgaggggagctacattgagaacatgcacataatgttttctgtttctccttaaactctccttcacatttagcatcatcagtggaattggcctacagcaattacttctaatgccaattttttatttccctcgttttttgtatatttattaactgcaatcttgctgtaagaaagagttgttccttgtctctctttcattcatttattcgtacattcatttacatcaggatgaatccatgggcatttttttattatttggtttgcaatccaataccgtcattaaaaaaaaattgttccagctttggctcatggggctcttttaggttggctcccttgtccttttatcatgtctgcatctttttttttcccttcacttccttatttccattattacatgttgtcatttaaatcaaccccttctttaaggaaccttatttaggtcctttatttggagagtggtatttagaaacgaagatctgggtgctagttgtactcattgttacaggtgtgtcactacttctaaaccctctcagtggactaggaaagatgtctattcatactaacccatgcaaccatatacaaccatctgtatttatttcagcatgtaacaaccaacaacaacaacaacaacaggagttcattgatagttcctactccagcccagtatcatagggttcattctagccttttctgtctgcttatttgtaatttgtatctctgacagtgagaaatctggctttcattatctatggtatatttattgatttttccaatacataaacattcataaaaagtagtttcacaattgctaacctgtaccccttaaggaacaaatttaccatttggaattaatttgtgtgtgcattttttttgtctttagctttgcagtatccaggcaaacctctgttttctgaagttcctgcgttagcttctttatttctcacccccatcactgtggatatgtcatttatctgtaatagaattagattcatttgttacagtctgtattttcgcctaggttttcctgcctcctgatcaatttcttttcaattttatatacagtaaaattcactctttgatatatacagttctatggattttgacaaatgttgagagtcatgtatccatcaccacagtaccaaacagaatagttccatcacccccaaaattcctttgtgctccctctttgtactcaacctttgtctcccatcccctgacaaccactgatctgtatttcacctctgaaggtttcccttttccagaatgtcatgtaagaggaatcatatgacatctagcctttttggtctagcccctttcacttagcaaaatgcatttaggattcatccacgtttgcatgaatcaacggttcattcccttttattgctgagtaatactgcatcttatgaatatatcaggttttaaaacttcattcacctgtaaaagaacatctggattgtttccaagtgttttttgatcatgaataaagctacattaaacatttgcgtagaagtttttgtgttgtatgaatataagttttcaactcctggttgcgggactgctgggtcatttgggaagtatgtgtttaactttattagaaactgacaaaatgttttcaaaaatgactgtaccattttgcattattcaaataatgttctccactgtgcttttcagggctgttgaaaccaagtcatgtcataacacctcccagagaactttgagcactcccgaggtcccacattctgggcaacccgattgtgcagaagtgatttatgactagattttatttggttttatcggttggatggtactaaatctccaaaagcagagccaaaataattttataatgaatgaaatgacactaacaaatgcagtgggtttaggcactagcttaagctggagggtaggcagtggtaacttcaaacactctctcccttttcttcattttcaaatatgaacagatttttaaaataatattctgaatgattcctggcacctggcacatctcatccttaacatgggctaaaatgaccctcgtacagtctttttgataacattagtacttttgctttttaagtcatgaactcccctgtgctttcttcctcagccttatccttgcaagactttcgaggtgagcctgaggtgaatccattgtacagggcagacccagtggacctggagttctcggtggatcaggtggactcagtggaccaggagggcccaatggaccagcaggacccagagaacccagttgccccgttggaccaggcaggcctgatggatccagtggatccagaggactcagtggacctgggggctgctggcgcaagtgctcaggtactctgaaagtctcgcttcactcgcttcacgtttgtctggatagctaaccttgcaaagcccaaattttcactcttgtgaccagtttcacttcacagaaagtatgtttgttactttttcaaaactatatcactatttctgttatactggattttcagatgccgttgagaactcaatggaccctcacaaacagggagattggaggttctctaagtaagaccaaatccctgtgctcttcttaatatgaaatcccatggacactttgtacttgaggaaaagtttgagccaaataagaagcttagctgctaagaaaaggtggtatttttaagagccctgcttttaatcacctgtgagagcatgctaaccatctagagggaagacaactttctggccttcccataccaaccctctccctgcaccacaagctaggttttcccagtggaatttttattaggttagaacatgcatttcagagtcgttagatatacccaaccttgaaacatcagtaccaatgtacagtccacggccaaatcaaaatggttggattaactactgtgtagttcctctaccctgaaatgtgtgtacataaccacagatttcgatgatcatcttttatattagacaggattattaaaatcaggattagaagccaagctaatgagttgatggtcagttacctggaattgtgtgcgttcatcactgagcctaagattgagtgactccggttcaaaaggatcctcatccagtgaaaataattaagggctagaacacaattgtttgagtttggccccagcagtgtggccttggcaaattactgagcctcagtttctccatgttgaaatggtcttgccttgcggggatttgcagactgctgtgaaaattctttgagctatttaaaaggaaatttctgtgaaaatctgctgtggcctgatttatgtccttatcatgccaaaaagttgtggtccccctttcactgttgacaggtttatcttctcttttgaattaacttgtaattaaattttgaagtataacttttaaaaaatcaccaaaataaccagcaatgaacgtgtgtcatctggctctgcatgtgctagtgtattaggcttattcctgggtgccatgtatcagcaacctggagtgtatccagaagatggagaccaggatgaggaaggggctggaaaacatcttaatcagttgccgaagacactgagaagggaagaatgggaagggacaggacagctttatccaagtagttgaagggtcataaagtggaagatatggttccagaggatcaaggaagcagtctgacactattagcccttctcagacggattaggtcacctctcaaaatagcaagtcctctctccttcgatggagtggtgagagtcaatgcttggcagctccttttccaggaaaagcaaagaaaatttctgcttggagagggtgagaggatgtgataacctgtagggtttgtctcttctagtcctgagtttagaggggtgtgtgtgtgtgtctgtgtgggtgtgtacacgcgcgtgcatgtgtgtgtgtgtgtttttttttttttggtctaatgaatgtctgctttcttataggaagagacatacaatacatagtgaaagaaggacaagttgaacaattttcaatggactaaaaatacatatataatttttattccaaataatgaaaacaacaacttgtagggtattctctctctctctctcaactcatctatgtacttacattactcataaagggtattgatgaaccacagtataagtctatttttggtttctgaaagttgcaagtgtaggtacctttttcttatcattaatgttgtaaattctttatcgatcaggactgtggctctctgaccttgtttatatgcatggtatccagcatagttcagggcaaatagcaattgttcccaggcccgacttccagccttgaaagataattattttccaagaatctcatctcttttctgtccctctcggccaatcagttgagaagtctcatccacctttttttttctccttttttttttaattatactttaagatttagggtacatgtgcacaacgtgtaggtttgtttcatacgtatacatgtaccatgttggtgtgctgcacctattaactcatcatttaacattaggtatatctcctaatgctatccctccccactccccccaccccatgacaggccctggtgtgtgatgttccccttcctgtgtccaagtgttctcattgttcaattcccacctatgagtgagaacatgcggtgtttggttttttgtccttgtgatagtatgctgagaatgatggtttccagcttcatccatgtccctacaaaggacatgaactcatcattttttatggctgcatagtattccctggtgtatatgggccacattttcttaatccagtatatcactgatggacatttgggttggttcctagtctttgctattgtgaatagtgccacaataaacatccgtgtgcatgtgtctttatagcagcatgatttataatcctttgggtatatacccagtaatgggatggctgggtcaaatggtatttctagttctagatccttgaggaattgccacactttcttccacaatggttgaactagtttacagtcccaccaacagtgtaaaagtgttcctatttctccacatcctctctagcatttgttgtttcctgactttttaatgatttttattctaactggtgtgagatggtatctcattgtggttttgatttgcatttctctgatggccagtgatgctgagcattttttcatgtgtcttttggctgcataaatgtcttcttttgagaagtgtctgttcatatccttcgcccacttgttgatggggttgtttgtttcttgtcaatttgtttgagttcattgtagattctggttattagccgtttgtcagatgagtagattgcaaaaattttctcccattctgtaggttgcctgttcactctgatggtagtttcttttgctgtgcagaagctctttagtttaattagatcccatttgtcaattttggcttttgttgccattgctttcggtgttttagacatgaagtccttgcccacgcctatgtcctgaatggtattgcctaggttttcttctatggctttgtggttttacgtctaacatttaagtctttaatccatcttgaattaatttttgtataaggtgtaaggaagggatccagtttcagctttctacatatggctagccagttttcccagcaccatttgttaaatagggaatcctttccccgtttcttgtttttgtcagatttgtcaaagataagatggttgtagatatgtggcattatttctgagggctctgttctgttccattggtctgtatctctgttttggtaccagtaccatgctgttttggttactgtagccttgtggtatagtttgaagtcaggtagcatgatgccaccagctttgttcttttgacttaagattgacttggcaatgcaggctcttttttggttccatatgaactttaaagtagttttttccgattctgtgaagaaagccattggtagcttgatggggacggcattgaatctataaattaccttgggcagtgtggccattttcacgatattgattctttctcatacctgattgccctggccagaacttgcaacactatgttgaataggagtggtgagagacggcatccctgtcttgtgccagttttcaaagggaatgcttccagtttttgcccattcagtatgatattggctgtgcgcttgtcatagatagctgttatcattttgagatacgtcccatcgatacctaatttactgagagtttttagcatgaagggttgttgaattttgtcaaagatcttttctgcatcaactgagataatcgtatggtttttgtcattggttctgtttatatgctggattacgtttattgatttgcatatgttgaaccagccttgcatcccagggatgaagcccacttgatcatagtggataagctttttgatgtgctgctggattcggtttgccagtattttattgaggatttttgaaaagatcaacaaaattgatagaccgctagcaagactaataaagaagaaaagagagaagaatcaaatagacgcaataaaaaatgataaaggggatatcaccgccaatcccacagaaatacaaactaccatcagagaatactataaacacctctacgcaaataaactagaaaatctagaagaaatggataaattcctcaacacatgcaccctcccaagactaaaccaggaagaagctgaatctctgaatagaccaataacagcctctgaaattgaggcaataattaatagcttaccaaccaaaaaaagtccaggaccagatggattcacagctgaattctaccagaggtacaaggaggagctggtaccattcgttctgaaactattccaatcaatagaaaaagagggaatcctacctaactcgttttatgaggccagcatcatcctgataccaaagcctggcagagacacaacaaaaaaaaaagagatttttttttttttcagagatggggtttttgctttgttgcccaggctggtctcaagcctcaagcagttctcccacgtcagcctcctgagtacctgggattacagatgcaagccaccacacccagctcagcctcttttttattactgttttttaaactttattttactttaagatattgtggatgttaatctttttcttagaattttgtttatttttgatatattgcagttgtacatattatatatactatatgtgtgtgtgtatatatatatatatatacactatatagtatacatagtttagtgccaattgatggttttcatattatatatatactatgtatagtgtatatatatacactatatatattatgttgtacatagttttggatacatgtatatatttggatacatatacacaatgtgtaatgatcaagtcagggtaatcaggatacccatcacttcaaatatttgttttttctttgtgttgggagcattacaattcttttagctattttaaaatatacaatagattgttttaactctaattttcctacttgagtactagaacttgttcctaacgtttaactgtattttggtacccagtaatcaacttctcttcatccccctcttccccattcccttcctagcctctggtaaccaccattctactctccacctccatgatatcaacatttttaactttcacatatgagtgagaacatgtgatatttgtctttctgtacctggcttatttcacttaacataatgacctccagttccatccatgttgctgcaggtgatgtgaatttattatttttatggctgaataatattctattctgtatatataacacattttctttagccatttgtctgttgatgaatacttgggttaattccaaattttggctattgtgaatagtactgcaacgaacatgggagtgcagatacctttttgatctactgatttcctttcttctggtgtatactcagcagtgggatttgctggatcatacggtagttgtatttttcgttctataaggaacctccatactgttttccatagtggctgtactaatttacattcttaccaacagtgtatgagcgttcttctttttccacatcctcaccagcatttgttattttcttaatttctctcaaatgtgtctctatatcgtctacctctggattgttccatgcccctattatctctatcctgaattactcccacagccttctaattgacttttcccaaactccacgcttcgtttctcccaccacttgatcttctgcacagctgccagaaggcatgttttataactgagttctgagcatcttacatccctgataagatctgggttgtagaacacatcttctagcagcagtgccaggtgactgatgaataaaatccaagttcctcggctgcctgaacctgtacaaaactctggtttctcctctacgtgtgacctgccttattccttctattccagctaatttggagcatcatttgccccatagcacactctctacttttataaacctgtacatttgcttctttccagatgtgaagctgttatccaagttaaaattagatttccaggacctagaggagagtccatctaagtactatatgagaacaataatagtacctgcttttcagggctctgtgaagatcagacctgtgagttttcgtacagtgcttagaagagtgcctggaacaaaggaagtgccagttgatggttttcattattgcattgctaacaggggccctattggtggactgccatttgtgatttgacccaggcgcagaatactttggcactggcccatgactcttccactaaggactttgggcatgttgcttcatgtctctgggccaattccacttctttctttttgggaaaagaatcaggctaaatgatctccgtggtccatttcttatctagaattcctaaattctctaaccattttttcaaactttctagtaatgaatgaaatcaggatttgagagctaccatttgcattctcagtctttcagaaattttgaagtgaaacaggatggtaagacttggagaaaccagtgttgctatacatgaaccataagtaattcctccccacagccattacagccatcatcaccagttgcatatgacatcattagccaggaactggaactgatgaagaagttgaaggagcagctagaagagaggacttggttgctgcatgatgccatccaaaaccagcagaatgcattggaattgatgatggatcaccttcaggtcagtcaggatgctaggtttcaggtcagagaccagttctatattagtagcagaaggaagaggagagagggaccttggcaagccttaaggagttagtcaatggtgtctgccggtagtgacagctgctgcccacagggtgatatgggatatctaatgtgatctccagcagggacttagagttttgccctttttctcctggctacaagagctgagattggcccagccaggccttggcaatggtagatgtggcttatatatagccaaggcttcctgtaggcttgcctgtgggcagtcctgctccatgcccagcttgtcttatgccttaaggaaaggtgtggactgtgaataagacctttgtgatactgtgtccttacagaagcagccaaacacattacgccacgttgtcattcctgatctccaatcttcggaggcagtgcccaagaaacaacagaaacaacacgctgggcaagtgaagcggcctctcccacatcccaaggacgtcaagtgtttctgtggtttatctttatccaactctctcaaaaacactggggagcttcaggagccttgtgttgccttcaaccaggtatggaaaggctgttttaactgtgtatctgaaaggggattttgttttcttgaggactttgactcacttggttctccttagggggtagtgactatccacttggctgcaatttatttgcccaagatagtaaaaaatcctgggctacctagacctgaatgcacatgctagaccatgtatacatacatgtacatatgtgctggattagcagactctcgctgccaggtgcatggctgcagctagtatccagtctaactaaagtagacagtcacacagatcactatgtgcagagaggctcaactgttgtcaccttttgctttgcgagaattgaatgggagtgttaaataagtttctgggaggctcttgcagacaccagggtgcttttatctgttgcctttcgatgcagcagcaactggtgcagcaagaacaacacctgaaggagcagcagcggcagctgcgggagcagctgcaacagctgagagagcaaaggaaggtgcagaagcagaagaagatgcaggagaagaagaagctgcaggagcagaaaatgcaggagaagaagaagctgcaggagcagaggcggcaaaagaagaagaagctacaggagcggaagaagtggcaggggcagatgctacagaaagagccagaggaggagcagcagaagcagcagctgcaagagcagccactgaagcataatgtcatcgtggggaatgagagggtgcagatatgcctgcaaaacccacgtgacgtatctgtgcccctctgcaatcaccctgttagatttttacaggcccaacccattgttcctgtccagagagcagctgaacaacagccctctggcttctatcaagatgaaaactgtgggcaacaggaagatgagagtcaaaggtaagacatgcatggaatggtgatagtggctatgattattgcttttccctcatggctggatcccatgcctgagatcacagacagacgacctatccatgtggcaccagcgtccctctcatcaatagcaacttgctctcaacttgccttctctgtggccacggccatcatccttctgcatgtgtggtgcatggatgagcatccattgatggaacaaaggggtacccatgaagaaaggactagataaggaagcctcaatgctagggaattagcccacaaaccttgaaatcacttggctggattccccaagcccagtctcttgcacagggtgtctatggacaagtcttgtgcccatagctgaaagacttctgggcttccagtttcattccccaactttcctggaatctggtgatggcagtaggccaagtgcaggtatctccctggcatttatgaacagtaagagggaagtgagtgtgaaacaactgctagattgctaagatcagccaagaacacatgaaggctaagtcctgagtggcaatatagggacatgaacacatttctgctcaataataaggtcttcagttccaaatgctagaaagataaggttcttctcagcaatgaaaggattgcttagcacatagttggggcccactaaatagttttgaatgaatgttagctttctgagacgggcctcctaaagctctctggacttccttctgggccttgctttcgaatcagtgactttgacatgaagactgctttagggccatattgtccacttgacctgatcatcagaatccacctgaggagggtttggaaagtatagattcagagtctgggatggggttcaaaaatctgtattgatcacaagacttccaggcttagggttgtggagagagcactggatttggagtttggaaatctgccttacagtctctgctcagccattagctccctgagtgctttcaaagtaggtgaaatgactttccaaggccacagagagcatagttgtagcaggaacaagactgtccaagtaatataaataaaaccaggtgagacaagggattgtaatttctctcagtgtctacattcacattactttgacaagttgaatcttagtcaggccaaagtgagaatacaaacaagtgaatcctgtggtgtagccaccaaaaccaaatgtgcctgaagcacctactgatgaccacgtgagtgtctcatcagttatcatgtccagatccacatcactgcaacagctttcttctcttacagtttttatcctgaggcgtatcaagggccccccgtgaaccagctgccattgatagatacctcaaactctgaggcaatttcttcttccagcattcctcagtttcccataacttcagactcaaccataagcaccctggagaccccacaggattacatccggctttggcaagagttgtctgattcactcggtcctgttgtccaagtgaacacttggtcttgcgatgagcagggcaccctgcacggccaacccacctaccatcaggtatgggacagccccctccttttccttccagcgcaggtcaagagggattctgggccccttccacataaggcacacaccccaagtgcatgctgtgtgtgagagccagacttcaaagctcagtacatttgacggcagttagtcacatgatggtagcactcattgctgagtaaaaatattctctacagggttcctcaaaaaagtgagctggcctagtgaaccttagacgcaatctgactgaaacttctctcaaaactatgttacatgggcaaagtgagccatgccatgtttttaatctgagctcatcgtctggtcccaagcctcctttcagacttatggatctttagttctgctacaaaatctaagacctagtgtaggtatgtttccttgtactaaaaataaacttagggcccctctgttgaatgtgcttggtatccatctatggggtaccccgtatttggaagggcaggcctaccttgtggattatctgcagtggccatgtttccaggatggaagctggtccagatggcagttacgtagcaggttttgctccccgcaggccccccacacacaatttcactaatgaatggaacttacaaaaggtgttttcactctagctttaaaaatcttattatagcctaaccttttttttttcaaacaacaaaaccaaaccaaaataaccagaacaaacagtaagctaaggcagaaaggagtttaaatacttgaggcaagcaaatgtatgattattttcacatataccccttgactaactgtgccaccagtactgctagaaacttggtcacttagagggactgctcacacggagagatcagagtgggcaataggtcctatggttcctatggttccattaccaagccagactttgttgagaacatctttcacgcctatttttgaggcactttccctcctagagggggtcctgagagaccaagccagcacaaggctgagcacgttgcccagggaagtgggaaaggtcagattctgaaaggttgctcagctgggagaaagcagggcaggaccaagtcggagctttcctgtccacaaaacctcaggggctccctgctatcctcaggatgaaacccgagctcctcttcttagcttcccagccctcactgcctgccctggcttatccctactgccttctggcacctttctgcctgcaggtccccagacacctccagctgtctgtccagagcccagccctgctccttttgctccctgtgtcttctccgcccccttgggttccagtccttgaaaccttgcatcactttgcaacataacccaaggaatccctcctccttaaccagaaaacaccccctcagcccatactttgtaacaccatctttgtatctattccttctccctcctccacaccccagtgtgggttggtacgtctcctgtcactttgttaaagtgggccaagtagctgcaaatcagtcagcatggaaatgactgagcccaagacccaaggctagtggccttggccggccatggctggcagagaagctggacaagagagggccagacacagacccaggagccttaagacaactttgagaaagcccaggtctgcttctgctgctctttaagctaagatgctgctgggagagagaagaggagaggaaccttatcttctgtagctcctccgtctcccatcaccttgcaggctcatgttccaaagaagtatttctcagcagcttgtgtatttgaactaaaggattcctcctaccaccaaaaaatgggcccacagactctagcaaacattccaccttgtttcactttttcctggcaggtgcaagtttctgaggtaggagtcgagggacctcctgatccacaggctttccaaggccctgctgcataccagccagaccagatgagatctgcggagcagaccagattgatgcctgcagagcaacgtgactcaaataagccgtgctaacagtactttcatgaccagtgatgaggggaaatggggggagggggcaggccaatgaggtctgcatggccaggggaccttcaaggtgcgtaaagtcccttggggtagggtttagtgggtagagacttatttgtttcctgataggttatgtttgtaattgtttgttaagcacagcctgtttcttggaagttatgctgtagaggcagcctgtgatccgtagtatgctagggtgtgacagcagccagccacagctggatctgatgtcttgtctgccccgcccagctttgcatatccatgttctaccacaggaaggtggcctgccaagagtctgctcaaagttttcaacataaagaataaagaaaaaaaaatgccaaa

SEQ ID NO: 3969 - DNA, 113117 bp, human
cgctgcctccatgcctgcctcccctctctgccacgcccccaccacgcgctttgcactctggggcccacgcacttccctgaagagtctagaagctgctcctcatttccagactttccgggcgcccaccaggctcccgggctctcaccggagaccacagggaggagcttcaaggtaccccaagtccctgcggcctccagcagtgaagagttccacaagggtgagtgaagtccgttaatgaaagctactgcaaagtaaaatgccttggggtggcggcggggagccagcccctttgtccctcggtggctgaggagcccaagctactccatcagagacattccctgcaggaccctcgttttcctggtcatcctgggaaggttggttgggatgaggcagaaggagaggggtggcagcgggtagctgggggttacacgaggaagacccccacattctgaacctcctcctgcattgggcaccatcgtaggtgcaccataggaggcacccattgatttttctttggacatttcgagaaattgaagcagagttgggaagaatggaaagcttgcggtgtcgcgaataggccggtctgagcgggcggttcgggtgagaacgccaggctctgtccggcaggtctggggcgcgtctccattaccacagtcggggacggtgtgctggggtgggcgcgtatatcgagaggtttgcctggttttcagcagattgagcagtttgtacacgtgaaatctcagacttcagaattttcagggcagtagcggcttttcaaaggatctgcttgaagtttttgttgtcctttgggtttgttttttgcttttttggatttcaaatgatgaggagtttatgtcaggatgtgtatttgggcacacttacacggagagcacagaagttgtggctaccttagaaaatgtgttttttcaaaatggagtcagattagcgtgaaagtgccagcagccatgtatctgaagaccgataatggaggcgaacgtcggtgcggtggcaggcatcttagtctcagctactggttacggctgagtttgagaccagctagggcggacttagcgagacctgttctctacaaaaattaaaaaaaaaaaaaaaattagctgggcgtgtggtgcccaactagtcaggaggctgaggtgggagggatcgcttgagcctgggagttcgaggttgcagtgagtcatgaatgaaccacggcaccccagcctgaacaacagagcaagaccctgtattttcaatcaaaacttccttcaaaaattacaactcataagacaataatttatcagttactcatccatcttaagggaacataactttccaatgtataaaatcaagaatgtaaattaatctaccctggattatgtaatatgcatgccatacaccacacaatatgccaggaaaggcaggtggcaaagtcatgctccaaaagagatccaggaacagaatcaggcatcctggtttttttgaggtatccctactgactggctgtgcttttctctaaccttagttctttcagtaagttaagctgtatctaaagtagatttgttgtgcttatttctctgccagttctagaacagagagtactgaggggtaaagacactcaggcagcaaaagaaaatcctttccaccaaactaaagagaatgggcagaaagcattggactcatgactttgaaagtattcaggccaatgtagccagtagatgccctccaatctgtcagtacttacttagagagacatctgtctttgagattagcctagcacttccttaggagagttggcagtgatggagggaggatgtgggggcgggaactggacctttcttccatcagcaaagaacaggcgtgagggctgttcctccttttcttttcccagcaagtcaggagccagtgggaagtggctttcttttttctttttccttactttttttttttttttttttgagacggagtctcgctctcaaccaggctggagtgcagtggcgtgatctcggctcactgcaagctccacctgccaggttcacgccattctcctgcctcagcctgccaagtagctgggactataggcgcccgctaccatgcccggctaatttttttgtatttttagtagagacggggtttcaccatgttagccaggatggtctcgatctcctgacctggtgatccgcccgccttcgcctcccaaagtgctgggattgcaggcatgagccaccgcgcccagccagaagtggctttctaatggctggcctttatgggcagatttctttgcaaagtaattcacagatacccagtttcttgggtaataagaattagactagaaatcctcctactcttaactgaaagttgatagggttgataaggtaattaggattatggggagagcatttggttgttggtagtaaaacgaaaatttgtgataaaagtgtagtttaactctcctggttttggtttcaacatttcattcaacacatattcagaagttctgttagaggcacgttttgagctaagatacagggcaaagcaactgagaataaagatgcagcttttagggagtccataggctagtggagcagagaaacgtgcaaacaaattattatatcccattatttgctttgagctataatatgtgaataagaaacccagacactggacttcaaagagaagggagtgatcaatttaccctgggttagggcctcagcccatcttccccaaagaggaggatttagattgggttttaagttatgagattaataactctggaaggagaaggcagagggagacacacatactaacaaaatgatggaggagcaaaaatgcctagcattttccgaagcaggaggtgaccaggtgagggtggctatccttgtgacctttgaaagaggagggatcagtttgaggagttgcctttcatttcttggacattagggagccacggcaggattttaagaaagtgattccctgtacaggttgataccctttatccaaaatgcttgggaccaaaagtgtatcagatttcagattttggaatacatgtaatttgcattatgcttactgggcgagcatccctaatttgaaaatctgaagtccaaaaatgtttcagtgagcatttcctttgagtgtcatatttacacttaaaaagtttcagattttgtccggacgcggtggctcatgcctgtaatcccagcactttgggaggctgaggcaggtggatcacctgaggtcgggagtttgagaccagcctgaccaacatggaaaaaccccgtctctactaagcccggtgcgtgcctgtaatcccagctactcgggatgctgaggcagaagaattgcttgacctgggaggtggaggttgtggtgagccgaaattgcaccactgcattccagcctgggcaacaagagtgaaactccgtctcaaaataaataaataaataaataaataaataaataaataaataaataaataaaataaaataaagtttcagattttggagcatttcagattttggattttcgattttcgagtcagggatgctccgccatacgtaccacacctgatttagaggtggactcatcaggatttgctggactggattgtttggaggcagagtgaaggagagggagctgttagcagtgatcctacaagtttttgttttatgcaactgattccacttactgagatgaggagcaccgggaccaggagaaatttgggtaagtttagttttggacctgagcataaggtgctggtgaagcatctaggaagccactggatatgcttctagagccagagctcaaaggagtagtcacagctggaaataaagatgcagtgtcatcaaggtttctttttggcagaggcttctggggactactagcacctctttatggctctggtgtcagggaaatgagtcaatgcctaccctgctctagccataaaaagctgctgtctctagtcatgctgatgtgacttagactctgtctgaatgttgataggcaaaggtctgtgtgacaaaggcttccactagattttcaaggaggtactccccgaaagtcagtctcttaaaagacgagatctaagcaattgtctttttgttctgttttgttttgtttgtttgagacagggtctttctctgtcacccagtctgtagtacagtggcatgatcttggctcactgcaacctctgcctgccgggctcaagcgatcctctcacctcagcctcctgagtagctgggaccacaggcatatgtcactatgcccggctaatttttgttttttttgtagagattgtagggttttgctatgttgtccaggctggtcttgagctcctgagctcaagtgatctgcccacctcggcctcccaaagttctgggattacaggtgtgagccaccacgcccgaacaattgtcatattttttaatggaaaatacaaactacctttgacgtcccagtttacactgaaactttacatttgccccttgtcctttatcaagggcttaagatgtcggcaaggctttctccaaacactatataaatattaaattgacttccaaatgttgtttatgagaactagaataccgttcttgttatttgatatgtatttatggagtgtgtgtgttctgacttgagtctagctaatgtcccagtagggtaggatgttttggacgttgatgagtttttcttctgattctatttctaacagttaagcacattgtttaggtaactggttgttccttgattatagagtgttcatggccactaataaatgtcccccatatttaaatatacaagttatacctttgggatggcagggagctaagggccatcagctcttttatatgctaatacctgagatcaaggcacacgatattattcaatcaagctaatatttagctttggaaattaaagcataaattcatgaatgtgaatagtgttcttctttctgcattgatatttaaccataatgtatgtatgcacacaatgttccaagatttctctttgtttttatttttttgatgatgtatgtttcacttgctgcaatatttgttgatttcatgaatactactgatatttagggaaaggatccaagaagtgttgaactcctagtgtgtctttctttaagcttgtctccttgttaaggtgaaccttaacattcaaggttatggtgatccttatcatttgagacatttcaccgaatatatgggtgagcaatgcaccttagacttttcggtgaacttctccatccgtgtggtatctgatcctcctgagagtggccatatgcggtagggaggccagggcttagcaccattttgcaggtactcagacaggctaggtgacttgcccaagatcacacagctagtgcagagctgggactagatcccaagaattctgacctcaagaggggtgttgatttccattgattttgcaattccccctacttaagtcactggattaataattttaaagtgtggattaaggcaagtatattttgttggcttgctctcctctaactttaggtctcccagttgggagaatgaacttgtaggttaatagtttcctagtagaaagcaataaatatattccttagtatagacaataaattgtggcagtttcactctcctccttgggctgcgtcaagatcactttgaaacattcctgggtattcttcatacaggacttagggctgtttactcttttccgtctcccatatcagcctcctttgccaatcatcttcagaaatacaggtgtaagctgtgctgtaaggcatgaaccacacagcactttgaaatgagaaagctttaaagtaacaggcaggaatttgagggggaaattgaaaagtctttctgcacaaaatgattgtactttaaggtgaaattcacaaagtcaatcaacatgaagaatctggaaactctcattgagagttctttcatttttttatacattccataagaaacaaggtagagctttcatgtaaagttctaacttgtgattagagaaggcatttgaagtgtatagaacagagagtatattgtagctggcagccagggcatttgcagagcttcacgttaatgggcaagtgtcttaaccatcagcattgcgaaaaggaatggcacaggagtgagggctgagggtggggtggggagaggggctctggcatcaggtagccaagagtcagcaaaaattagagataattttaagtgaggaggtccatagcctttctttcaggaagtggaaggtttccttggcccctttttctaatttgagaacaatgtggctcatacattgtcaaccttttcactcggtggtatatattttttgaccttttatgtgatattgatacttaaattatatatccatcttaaattaattttgttgcatatagatttttatgtgtggacatagccctttttaaaaaattattcaacagcttctaggagacaacttctctgctttttgggacaaggcagccctgcagtaggcagaacagtagggtaggattcaggagaactgggggttaggctggggattacttgaagataagggatttaaaggaagttaggattctgttcctcttctcaaagttgaaataaagtaaaataaattaggagaaacctaattagaaacctaattgctaaagggtttgtttccctactcagacttgccctgatttaaaaactgtatttacagaatgttcacagccatgtaaaatagactggaaagaaatactctaatgtggcaatgtttccctcagagtggtagaattatgcttgtgttgtctctcctttctattttgtaaatttggcactctttaaaaaagaaacctaaaataaatttccttttaaaaaatgaaattctaaaaagaaacaagaagcctggctcgttcccagcattctaaaggggaatgattgtagagctccacaaaactggccaaggagctacatagtgatgaaagggttttgatctctttgggaagtattgtagggaacagctttgctggcactctcacagcccctttcctgtgtggagattgggctgtgggacctttgtcttgagtggtaaatgcccagcatgccgccagaagccctagctgtggtcactccctcatggagcaccttttcggtctgaggctgataattgtcctgcttcttatgtggtaagctgtcaggactgtgggctgccagctgccttagctttactaaaaggaggtggttgattcattcttttactgtggattgtcagctgaataaagcggcccaccacagccttagggacaaaagctctccattaggattacactgccaggttggagaatggccctttaaatgctgtacagcctcaaacaggggctgtattaagctgaccacctttatgcaaatctctctcctttgtccaaaggccccctcatgacagaggccagctaagcctttatggacagataggctttgtgcaaggctgggggatcacccaggttaggtgtttccaggaagaaaagtggattgaggcgattttgtaaatgtcactgctaataaattgaacattggcaaacttgcacttaagacattacttgggaagaacagattattaaaatggaacaaattgaggtgccatagagttctggagtgctgaaattgttgtcctttggcattatgcaaaacaacattatgtctttatctgtcttttccagttcctttctagtttcctccctgatcctgagctgctttgtttttgtccaaagtggagaggctgctcccatctgtgctcatctcctccttagttgctttggctcttttctctctccttggtgctgtgttttccctccacccatctaatagaatatttccaaggtcttatcttcttttcctcatgtcactcccttggggcgctcaagtgacttgtctaatttcaaatattctctgtgaacatgtcttatagagtcatggattccccaagctgaaagagacttccaagtcatctgtccgactcatgtctatgtggtcaaattgacaattcttgtcaaatagaggttggagtttcttccatgtttcattgatgcctaagcatgcaagagaacctaaagttgatgacttttctttcagtacttttccatgattcagtttttctttaagaaaaaacactctccccttttgaccttcagctactttagcctccactgccccaggcccataacagtagcaacacatctaattcttaatctttgttccttctcatattagtctgcctccttcatagcatgtctgggagtcatcctctcttgcaacctttttctcttctttctgcagcagctaacctcgaaccccttctcagcctgtctgcttgagctccccttgcatcacctcttttaaaattagtttgatcttgtgagtcaattctcagaaaatttgagtagtgcccagctacctcacacagtaaataaaaatgttaacatcttcagttagagaatccagcctgacctgacgactttgattttctcatttgatttttcttaacaccttttaacattccagctgctcaatttttagagaattattttgacagttgtaagttataagagctatagctcttctttgaaataataatattttaatttttctttaggtccttttgatttacaaaaaccccccacaacaacaacaataataacaatagcaatgaaaacaccagacacagtgccttgcccatagtatgtttgggggcatgaatgatgaataaataaataaaagtatttgaaatcactgtagataacttgagttgcccagaagccagaaatgtagaacccgctgtcctggaaactgtattctttcttccttggtaaattcctacggcatcaagtagaggaaaccttaataaatacggactgggagtggcctaaaatattccactataatctgtaatactttcagattctttacggtttaaatttttctgttcatttatatatgaaaatctttctgtttaaaaagttctttaatgaagtgttccagtatcattttctctagattgttttactgattggctgtcaatattttaaattgaaaaaggactggagacagagaaaaacttacctatcaaattcttaattaaatgattcatgaagatgtcttttaaatggttcatttgaaatatacctttatacgaacaggaatggctatctccatattaagtcatctgtataagttcgttcttgcattgctacaaagaaatgcctgagactgggtaatttataaagaaaagagatttaattaactaacagttctttaggttttacaggaagcatggtattggcttctggatggagcttttactcatggtggaaagtgaagcgggagcttacacatcatgtggctagagcaaaagggggtgcaggaagatggggtggtgacggggggtgggggaagggcatgctgggggtagaggttgggggtggggggtaaggcaggggaagttttggggtgggggtgggggctgggggtgggattgggggaaggtgccacatacttttaaatgaccaaatctcccaagaactcactcactatggagaagacagcaccaagccatgaaggatccacccccatgatccagtcacctcctaccaggccccacccccaacctcggggattacaattcaacatgagatttggacaaggacagatattcaaactatatcatcatctgtcctgcatgttttcctacattttttctatgtcttaggtcgttctgttcctgcatctcatgatctctggagaagtaacaagttcttgatttttcacaattttcaactagctgaatgttattcttcatagttttacaggctatgtttagatagccttgtgttgctgagagaaacttaccctattcgctgcagtgatcggggagagactgacaatacaggactttgatacagtaccaagtaaggcaggtgccataagggtaaaggcaatgtgctgtggagatggaggacagaggatcagaaaaggcttattggagaagatgctttgggggaagtgctttgaaagatttatattacttcattaagtaaagatatagggaaggacattttaggcaaggagatgatcatgagcaaaggctgggcagtatgaatgaagagtgagtgtctggataatagtgggtagttcctggaattcaggaatgttgtgattggaaaggtgaattgggttgtattgtagagagccttgggtgacaggctgagacagttttattgtggtgatgcttaaaatctccagacaagaacacatgtgattgtaataggagagcacattcaataaatatttgtggagaaatcatatattgaacttcttgtatttcccctttactaacatgttgtctgtaatgaggcaaggtagaaatgaatttaataaaccaaaccaaactcaaacctgtctaactaagtgggttccaaagtccacatgactacttttgcttgcttcacaatggcttcaagtgacaaaccttgtgaggggatcttccttgaggtcacaattgtgccaaacaggtagtcccaagtgccagtcactagtgaagttaagcactgggcataactgccaactgtgggcacctagccaggttcttgccagatgctccttggctgatgtgaatgaaagtcatctgttgaggagtggctccagttcatgtcactggatgattcttgagcttctgccctgtgctgggtgctgcagacagggagaaatcagaccacattctggccttgtgctcatactccactgggggagacagacaaggggtcgaatagtgatcatacctcttagaaagtgacaagtgccctgagacagtagcagacaatgaattctagagggttcagggagaaggaagctgaggaaaacatttgtgagagtgcattctacctgaatctggaaaaacttgaaaaaaatgatgtactttgggattcaagtccatacatccaggttacacttaacctttacacccagtagatgctgtggggatagatatattttgccaaacatcagaaacagattgctcttttgggactacactatttggctttggcattggtatgctccagaggcaaaaatggtgtgtccctcagaaaaggcaagaatactatttgcctaaagtgaagcaagtccatagaatctgttaaaagaagtttttgaacatcaacacttacattttcttctttttttattaaaaaatagagacgaggtctcgttgtgttgcctaggctggtcttgaactcctgggctcaaggaatcctcctgtctcaggcttcccaaagtgttgggattacaggtgtgagccactgctcccagccatcacgcacttttgtatctataaaccaaggtaaagattacaagtaagagtttttacattgcagaaaaaggagaatttccttagaggcagatgtaaacaccatctctagggcttgtatcaaagaccactggacaaaatagcatgagaaagctcagtccctttggtcaagtaaaccatcatggtgattgcagggggctggaattgggaggagactaaagacatttgacttcgtgcaaaagctaaaagcagtttaagaccattttttttttggcgggggtggggggaggtgatgaacattcccagtttctccaatcaatagcatttctgtgagaattgtaacactatgaaaagtcatttctaatctggaaagtcttggtggttgaaaagtttctcttacctttattttcagttatgtgattattgaattccctggtgttgttagatgggctattttttatttaaaaacatctcttttttctaagatgatctggatagactatccagtgcccatacataacactcatcagtttttcaatctctcattctcaggtaagaaaacgatttttgtctttcagactttacttttgtacttacctttttatattttactatgtacttgtaatggaagtaagattcctctgtaatttgaaacggatcatcaagttgtaagtggggaaaatctaagtaatgagctggaattttttttttcttttttgagacgaggtctctctctctctctgtcacccaggctggagtgcagtggcataatcatggctcactacagcctcgacttccagggctcaagcaattattccacctcagcctcctcagtagccagtgaatagctgggactacagacatgtagtgccatgcccagctaatttattttttatttttaaaattatttttatttttatttatttattcttttgagacagagtctcaccctgtcacccaagctggagtgcagtggcacagtcttggctcactgcaacctccacctcccaggttcaagtgattctcctgcctcagcctcccaagtagctgggattacaggcacctgccaccatacctaatttttttttttttgtatttttagaagggatagggtttcaccatgttggccaggctggtttcgaactcctgacctcaagtgatctgcccccctcggcttctcaaagtgctaggattacagatgtgagccatggcgctcagtcctaatttttaaatttttttgtagagacagtgtctccctgtattctccaggctggtcttgaactcctgggctcaagcgatcctcctgcctcaccctccaaaagtgttgggattgtaggcgtgagccaccatgcctagcaataagctgcattttaaaataataacacctgagttagtaattcatacaatgctcagtcaggcttaaagcataggccaagatgtaacatcattcaaatagtcaaaatcaactcttatcctagtgaattgattacatgtgaaattgtgtagcatcaataataaaattatctgtttatggatgttcttgattttcaccaatgacaactacagatttaaagtgcaaatcatattttatcttgagattctacttgatcactttaaatgtagcactcttctaatttccctcagagaattataaaatcaagtgaaggaaagaagatgtcttagttttgataaattggtgattgtagatcaataagaagtgtgtgtgtgtatgtgtgtgtgtgtgcacacgtgtgtatgtgtactcagttgtagaacagttgcaaacagaaatgaactttaatgttaattttcgccaactactgtaattttatgtttatatagatattatatgattgtattctatcaaaacatagcatatatttattgccataaatgtaatttgtttttttacatgatttgccataaatgtaatttgatacttctgtaattaaaaagtaaatagatatagaaaatagatttataaatcttaagatataacaattagagctcattctcacccaactctttcaaatggggcatttttccagctatgcggctcgtcaattctgtaaatatattttttgaaattacatgagacagcccagtgcagtggttgtgcacctgtagtcttagttatacgggaggcttaggtgggaggattgcttgaaccgaggaattattaatagaagccagcctgggcaatatagtgagacctcgtcttgaaagagagagagagagagtgagagaatgagatttacatttctgttatgctaagttgctcatttaataaaaaattctcaatagaaacacaaattatccttgcacagccttgaaattccattttgggaccatttccttagtataggaattctactgtggtggtatatacagtgaacagattttaccttgtttctgtcttcaaagttatttcaatggcagggattaatagcatattaatttatggctcatactgtttgcctgaaggagacttatcttacacagataattctgacagagacatataccataatgcacagtcattgcaattgttttgtaaaagaaaggttaggtgagagtctttatttatttatttatgagatgaagtcttgctctgttgcccaggctggagtgcagtggtgcgatctcgactcaccaaaacctccacctcccgggttcaagtgattctcctgcctcagcctcccgagtagctgggactacaggcatccgccaccacgcccagcaaattttttttgtatttttagtagagacggggtttcaccgtgttagccaggatggtctcgatctcctgacctcgtgatctgcccgcctcagcctcccaaagtgctgtgattataggcgtgagccactgcgcccggccctgagagtcctttattcttcaagttgtttcccaggtatttgggcaggctatgctggggacctttatgggagcactttgaactgcaaccagtaaaccagttaaaaaggatctctgctattaccacattcatctttccctggaccattcataaaccttggaggggatcctaagactagtatttttgtcacagagaccattcaatatttgttaggctttcaaagtttccattttgtcatgtataagccaaaatgcatgcataggtgtttgaggatagaaagtaaaacaagacaaagacacactgaagtcattttggagattctctgtgctcctagatctattaaaagtgctgagatgtcttgtgtcaagaaatctgcttcagtgtatttaaccagcatttttcaaatgttctccgctaaggaacacttaatacctatttttatttttgcttaatcctgttaacatcttttggtattcgtgttctgcaggaccagtgacctttaggaaagttgttgttacctgtatgataccattttatatatatgatcaatggtatttggctcagctatattgaattccccaggaataatattgaccagctatttctgggcaagaagaccatcagctaattgcagtgtcaaacttcttatgacaactggtcatgaatgcttttgtgccaaattctctgatgtgttgactaaggctctggcaggtttgaaggcatcaaaaactcctgaggtatctccagtagattcaaaaactggccttgcaggcttaagaactttctctgctgcagagacaacagaaacaagcctaactccccaaatccagaatgaatctgttgactcagtcccctctgatcttagatgctgttgcttggggatgacatttgccagagatttctcccctctccctctcctctgagtggctttgagatggtgggttttgataactgagttcacctcgttggagagaaagtgtggacaccagcatcacaactgtggtgaacaaaaagtctcctccccttccaaggaagctgggaaggtggattgcttcactgaagagttaaagaaaagagttttagaatatattatttgattttttttcttttttcaggatcatctgttgggcacttaagtcacagaccaaatcccattccatgttcctgagaacccgtcctttaaaatactgcagaaaaatgggtttgcctgtagtttgacaaattaacttttctttaaggaaacagtaaaatgtgattttcccattcagcaaaacttagaaattctttgcatcaaatttcagtgagttttatttttagtgtatatgattggaattctgtttaatacataattttgaaaagtcagcatctgtttatattgtgtataagatagatccagtgtggacaatgtcatataaaatgttaatcttacaaaccggtaaaggcttcaagtttaacttaagcctgttactaactttgcaaaattttttaataaggtgagtgactagaaaaaccctagtttctatagattttaataaactcaagtgaggaaatatatataaaatgaagttttacccttacatgagtaataatagaagttttaaactgttatgcagatctgtagaatccaagtcaaaggataagttgttattcagcttttgtaaggagcaaaggaataactgtaggaagcttaaaagctgtagacattttagggaaagaggcatagtgaaatggacatgagagtaatgtaatcttgactcaattttaactttttaagcaatcatttgcaaaccccaatgctttaactaatattaaaacatgattatttcattcatttatttattcattgaataaaaattattgggagaaagtgaagatgggaggtgtggaggagatgtgcaggaaagaaagagcctctattctgggttgttggaggctgtcatttagtacttcacattatttttcttgttagacaagattacacatgttggattgcctcagtggattgaaatggaaattctattgaaatataatgggtgaaaatagtttttcttctataatggtttgctctctttatctcagtagcagtgcagtctgttttctctgtgagtctaagaatgacagcctgagcttttcattagccagggaaccctgagcttcactctagcagagttcagggcatttaagaaaaagtatgattactttaacccaggtacttccctgctgtccataacaccagatgctgaccctctgtgcttctgtttctgtattccatctgtgctcttcatttttatttctccctcttagcttccagaacactttacgtataactttttaatggaatttataaattttgaccttgtattctagttatctatttacaagtctgatctccaaagagcagaacaaattggcttcatctctttattctccagagtcagccacagagtccacacttagaaaatgtctataaaatgaattaatgttaaatgaataagtggaatttttacagaggactcttccggaaagatgtgttacatgatgtgtgttatctttagttccacaaacgagtctctactttttatataaaagctatctggtaaagagaaccaggatattagaatatgggattttctcctgttgaccttttccttcgaacatgctccctttacatcatttctttttttcttttttttttttttttttggtggaagtagtctatatattattttggatagtgattacacttgtcagaattcatgagactgaaaatatgtgtattgtatattgttatatctcaattaaaatattttagaaaataatacaatataaacatgcaatacaataaatacaataatataatacaatacagtaaacataatgatatatgtctctcttgatatggaaagatgttcatggtataatgttaagtaaattaacttggttaaaaactctggctaccataaccctttgtgcatatatatcaaggtagtgagtttttaaattttattctttaatgtctttcacatttttcaacttattttgaatgagtattttaccaataaagtattgtttactatacagtaaaaaatttaaagtacatcccctgcttattaaaactgcagaaattattgaaccatatgagaagtttatttttatttctattaaattacgaggctgccagatcacttgaggtcaggagttcaagactagcctggccaacatggcgaaaccccatctccacaaaaaatacaaaaattagctgggtgtggtggcacatgcctgtaatcccagctactcgggaggctgaggcacaagaactgcttgaacctgggaggcggaggtggcagcgagccaagactgcaccactgcactccagcctaggcaacagagtaaagctctgtatcaaaaaaaaaaaaaaaaaaaaaaaaaagtaacagaactgtagcttaaaaatagtcatgaaaatttatttaaaaatgtcttggggccaagtgcagtggctcacacctataatccctgtgctttgggagaccaatgcaggaggatcccctcaggccaggggtttgaggaccagcctgggaaatatagtaaaacctatctctacaaaattataaaaattagctaggcatggtggcatgcacctgtaggtcctagctactcaggagtctgaggtagagtatcacttgagcccggagtttgaggttgcagtgagctatgatagcaccactgcactccagcctgagtgacaaaggccctgtctctaaaattaattaattaatttaatttaatagaaatacatcttttcttatagatgaactatcagttacatgttttgagtttctcattcttcatttttggtaaattctctggttgatttcttttggagaggaacccatattagaacttggggacaaaatgatgaaaaaggagagaggaaaagagcaggatacaggaatagtgtccactaatgaaccctagaaagagaggccatgaacagccagctctgtcaactcaattttgcatagctctcagttcaatgagtagctgaaatagataggatagagttacagtgtgtgaagagtagacaggaaaatttctctaggaggtgttcaggggcaatattcccaataatatgtccttgaatcttttttttttctttttccttttttttttttttttttgagaaggagtctcgctctgttgcccaggctggagtgcagtggcacgatctcagctcactgcaacctccgcctcccgggttcacgtgattcacctgcctcagcctcccgaatagctgggattacaggtgtgtgtcaccacgcccggctaattttttgtatttttagtagagacggggtttcaccgtgttagccggggtggtctctctcctgacctcgtgatccaccaccttggccttccaaagtgctgggattacaggcttgagccaccgcacctggcccccgcttttttttgagacaaagtctcactctgtcacctaggctggagtacagtgagtggcacaatcatggctccctgcagccttgacctcccaggctcaagtgatcctcctgcctcagcctcctgagtagctgggactacagacctgtaccaccatgcctggcctgtctttggatcttgagtgtatctaagagtatcagccttggttcagtgtcatggtccactcagatatgacagcaacaaacacccaaaggggctttaggagagctctaggtgggagagagatgtagcaggggcctagaactcaaatactggagggggaagtgatgaggcaaggatggaatgcacttcaagattcttacctcctccgaagcctaaaatgctgctgcacttcagctttgatactgtctagaggtttgaagtgcactggactgtcactccttgctatagaccaggaattctcaaatattcaaatcccgtgtcttagcaatcactgtcaagggactgagctcttaacatgatggaaaccaaactctctctcctatttttttttcaacgaacaacactgatgtgtttacagacactttgtcagcatagttatgattttttgtgagtttcaagagcaagatcaattgctgaaaagttattggacataaatgtaattgctacagaacatcaaagtaatttgttgataggcaagggaaccagaattgggagaaatgtgggatgttcgtgcttagtcctagtgagctgaaggtcacagatggaaattgggggtgggtgtaagcagggtggttgggaaacaacacgtgacacttgcagatgggcaagagtgttgaaaaagggccaatgctaagtaatgaaaaggcagtacactacagcaagtgagtgctcaggcactgccatggactcccaggatggccttgggaaagttagcaaaaatatttggaacccattttcctcatgtgtaaaatggggaacataatgcctgggatgtgtagtaagtgtttaataaatatcacttaatgttattactatctttaattattctaaaatcttatacttttctactgctataaatctaaattcactaactatggttgcatatgagccccattccaagggaggtttattgcttaaatataaaagtaacataaggaggatggtttcatctccaaggaactcttataacaagggacctgaagacagattccctgtcaagtcccagcgtagttttttttgtgtgtgtgctttggaagaagaatgatagtaacatactcttcataattaattaaaaaactggcaatatttttcagttctacctgtcttttagatttcacagactgttttaatcttgatgaaatcctttctaattgtggagttataatgattgacttcaatgcctctccttattgactgtgaactttgtgaggacagagactgtggcatcttcatctctggattctcacacttgatattgctaaggctggctcggagtatgcactttgtgaatgtattgggaataaatgcagtacttcagctttttgacttaaggtgctttcatgtgtcccagtcctagaagaattcaggctaagtctaagggaaatcaaaagaagatctaaaagagataaaaatttactgatagttctatcagttctcagctagatttttataagatgtcaatttggagaagagtatgaatttaatggattaatagaacaacaaggttggtatataggcacattcctagtgagcagaaggtcacaaatggatggaaattgtgacatagctagaaatgtaaggaccattaacaataactttggaattcccctctgaatcccacagtagaccactctcattgggaagtgaaggctagcctttgaaatacagattgaagaaatcaatcagggaaagatagcaccagacaatacatccagaagaaaagcagaagcttttcttttcttcatatcaggggtttattgcttcctatacagattgatttctgtgtttaatattaggacatgctttgggaataatgaaaaacattaagttctacaggctgattgaattccacttaaaatcttacaattcgtgtttgtcacctggatatctataggtcttattcactaggttttattgtccagctactgtaactagccgtgataatgtgtacatttgagtagcagacttcagattaattttcctttttcaggaagtaaagtcctgcaaggatgtcttgttattttactggaaatcaaagggatgatgaactttcctttgcctgttgggggtggaggtagccctggacagttatagatagtgtgagacagcactttaaccactagatgcaagaaacttggaattgatttgtcttgtaaatgcttccacaggccattacccattctctaaccctttgaaacatccttagacatgatggggttggtaaacttcacacagaattcactacggaaattaaatatgctggatttctctggaattatttattctgtaaaatcctaggactcctagggaccacatctctttgattttggtattctaaattctcatttcctctattttgtcatctcattgtataggaccatattctgtcactgcactttgcaaagagaagggtgagctgttaaggaaacatagtttgtaccaagttttctatatcatcttttgtacttacatacatttaatttgattgaacaaatacccaatgctttgtgtctgtggtgcacagttctagatgttttaggatatagaaaatggaataagccttccctgtcctgaggaagcttacattctagtggaagaataagaaaaatgcacataaagggcaaggtttagtaggggtaatccaggaagacttcttggaaacagtggcataggtatataaggaaatccagtgtactttttaattcttataccagactctctggattcaaatctttgatctactacttactagctggttgatcttgggctacctttctgtgactcagttttttcatctataaagtgaagataacatcagatcatacctcaaaaagatctgagaatcaaataaattacttgctgcagagggcttcaagcagggcctttccagtagtctgggataatgggggacccaggggaaggctttaagtggaaggacagatcaagtcagtgtataagatcatattggccgctggttgaggatggactagagggggcaaaaatggagaccatggaggaagaggtggttgcaggaattgaggtgaaagggcctgagcttgaggcctggcattgaggattggtaggagcaggcaagtgtgagtgatagtacagagatgggatccaaggacagacaggctatggttgctggtcagttgggcccaaaccagggcagagaaggaagagatgttatgaaaattgacttggcaaccatcatttgcaagaatagattgatgatattcatgcttgagtattttgtcgtataactgggattttctctgctaatatccaggtaaatatgaatacctggctttctactcctttcagaggattgttatacaataaatgtagaaatttaattctaccgaatttttgttgtttcaaccaaggaaggagaatgttgcattctgttgataaataagggagggaaattaacaaacatttaattacctgcctgatactgatcagcagaattcttacatggcttagggattctggaggaaagggttgtgggaagggcactcagtttgaccatggaagaggaagcagattgctttggggcttcatgtacaacccaggaaaatgctaggggacaggatgtagaagactgcatctgagagggtagctagagagctttcctgggcaagagtgaatgtgaaggctgttacaaaagcttaggtggtgttgtccagagaatgtagtggttataaactgaattctaaagtttcccacttattcatatactcactttcacatcagttgggcctccaaaatagtttagagagcttttagagtaatcacttcagagtttagtaagagagaaagaaagtgggtagcgtagcaagagagagaaagatcaccttccttgagagttgaaaagcactacagaggagatggtgaagcaaatgtttacagactgattttccagtgctgtcaggtactagctatgtaacttcagacaagctacttaaactctgagtctcagtaccctcatgtgggaaatgggagtaacagcacctatcgaacagggctgttgtaaggattaaatggtgactggtgaaatacacaggacctagtatgtatgtagtaatctcagtaaatgttggttattttggctctacctctgctgccactgccctacttcaaggccccaacctctcccagctgaactccctgggtcttctaacttaagtgcttctcaaaggttagtgtgcatagacatggcttagagaacttgatgccgtgatgattctgattgtaaatgtccggggcatccctagaacttgccatcttctgtgaagcttctagttcggtattgattactctcttgccccttgccctgaatcagtggatttatacaggtgccagtcttccccacaagcctgtgtactgccagggtgtggcagggacaggagttgaattgctgagatttcagaactggcaggaacacagaagggttttatggacttaattagaataagactgggattaatcgtttaatggattgctgatctgttttagagcctgcagaaatttttgctggaccatctagaaacttgaaatattctgccggaatgttcagggatgccagaaatcttctgtttctttagtattccttattgtctcagactaagagaacatgacatatgaattcccaaaagggggaaatcagtaagaaacacccttttaaatctgactttgtttctttacagatctgggtttgcctttttttttttttttttgtacctatcttttaggaacaggattaggattagctgggtgagaggaggtgttcagcaaactttgaccatttgcatttttacaggtaagactcagcgttccctcattcatttattcatccaccaaacatttattcaacatgggttttctaccaggcacagtttagggtgctaggaatataataagtgacaaaattggcctgaccctgttctcagaaggggccacaaaatatgcacctgtgctcagaatgcacctcagctttggtctaggaaagactgggcatttttcctatgcaggtatgtgtgtatgtgtgtgtgcgtgcttccgtggaattgagttcattttcttcattgcttggattccctcacaacgttggctcaggtcagggtctatgcttgtgcagtgagagcttactgaaagaactaaggttagagaaaagcacagccagtcagtagggatacctcaaaaacaccaggatgcctgattctgttcctggatctcttttggagcatgactttgccacctgcctttcctggcgtattgtgtggtgtatggcatgcatattacgtaatccagggtagattaatttacattcttgattttatccgttggaaagttatattcccttaagatggatgagtaactgataaaatattgtcttatgagttgtaatttttgaaggaattttgattgaaaataaattggaaatttccactgacttggttgatatgtttatatcatacacatttaacatcattactgtctacttgagaattgtaaatatttcattctttctcactgattaaatgcctttaataaaccttatatgagaagagaagatgacttcactcacattgatgaaatgtgccataatgcattttcccctataaacttaaaacaaattcctggaaccatattgagatttgaaagaccattttcctttgcttgagcaattgtttataaagagtgtgtacgtgtctctctctatagaaagacagagttgatccctgatagtgcgcagcaatttttataactacaaatatatgatgtgattatcttccacaatagcattttcaatactttgaggtttttactttaaaataaacaaatattgtaaccaaagtaatttccaaagatgtagtagtctctgcattctgcttttcttctgaccttctctggttttctttaaaattccatgtaaacatcttaaatgatgtttacatgagtcaaacactttctggccattactgcactgggaggccacagagttttctttctctctgtcagtctggctaagctgactgacagactgggtgagggaggacagactgatctgcagagcacatttctgggtgctgctgaaatagtactcattctgacaaatcgctgattaggcctgccaggaactgcctgtgatttaggcaaccccacagagattcctgggttctagagcactaactagttaactttaacctcttcagatgtggaagagtgaggatatgttctctcttagtctctctttatgaaagatagaatattgttcatgatcatactttttgcaccattagaaattactgctaacatttgcaacttaattctgctcaattaggcccagaaactccaatccttgcattactctttctctgggacttttaatacacctgcccattgcctgctgaagattcattccagccacttggcttctctactttttttctcagtgagctttccccacatccctgccccaacttcttcacttagtcaatctttacatcacagttctacacgtcaagtactgtggctaatattcttagtgtctcttgttctccttggtgctcagaaacactcggagcaaggactgatctgatcaccccctttccccattcctacatgtgggctgctgtgtgttattggggacaatgtcacttctgcgcagatcattaccactacagggttatcctcttctgccacatgttgcacattacgcgggcatacattaggtgccatgataccctgactctgcacctagacctgagacagcacttattcatgacatgttagacttacctggtaggcccactgcatggagattggtctccacacagttctctcattgttgcaacaacaggtgatgtgaagaaacctctctgtattgccaaatttttgccatcactgccccctctgagaagactgcatccttctcacagtcttttagattttatactgctattaacaatcgctaatgaaagccataatttattgggtggttgctatgagtcagtcatagtgctagccacttcatatacattaacttaattctcataaaaaccttggcatgtaggtattataacccccattttaaagttgagataattgagactcatagaagttaaggaccaaaggtcacacatctacaaacaggtagagagttgggatttaaacccaggtccaattgattccagagcccagtctcttcactcttcaacactggtgtccacattatttttgagaggagtttcttaattctgaatggcacacatactaattgtaacaaactttaaaaatataaaaaaaatgtacttgctcattgttctatcactaaaagacaccttgtgaatgctttgcttttatttctcattctgttttctacacaatattgcatttgatcatttgcttaacatgattgggttcatatagcacatacaatcctgtaaccttttccagacaacattataagtatttttcgtaatacagattctctgaaaacatgcttttcactagcctctgcattgattacaaaacatgaaaaatctactggggagtgtcacaaatgagatattccatgaaataagaaatgtaatctggggtgggaggataaagggagcttggactcctagtcctgggcaaatgttactctatttgaaaatgaagaatgccacaaatatagacatttcacatggaactgcactaaaattcaactttaaaaggcagaacaggcaaaggtggatgagtacaagttatttatctgaatttgtgaaggatttgttggaaaggacatcagccctgagatatgtaagtaaactcatgaattacagtgctttagtctttattttaaactctttcctagtcccctaggtttgcattcagaaagtcatgatcttgcaattcttgctcctcagcctggtttctctccttccacggctgtcaggtgtagtaaaaatttggcattgtaaagtagtccatggatggtggaagatttaataccttgaacctaaccccatagtaaatgggtcctggactgattctcaggacatgttccactttcactttttatttttacttttatttttacttttatttgagatggtctcactctgtcgcccaggctggagtgcagtggtgccatgtcatctcactgcaacctccgcctcccaggctcaagcgatcctcccacctcagcctccacagtagctgagtctacaggtgcgcgccatcatgcccagcttatttcttatattttcaccgtgttgcccaggctgggcttgaactcctgggctcaagctatcctcctgccttgacctcccgaagtgccgggattgcaggtgtgagccactgcacccagccaggacatgcttcactttgattctaattcaggattacaactttagtgtcatttagtcctgaaatatttgttctgggagatatggcacatgacatgtatgtcacataggtcccagatagaactcctgcaacatgtttcaggaacattagcaacaggagcccagattttgatcagtaagtcacttgtctctagaaaaggttggtattgctgtggagcttgagctgtaagtctgatatttgggtcttggaagttttgagactgagagagttagactgaggattcttttgactgtgggccttatcccaattagacactgatacatctatattatcatagtagtcatgccggaaagtatatatctaagtgattctcaactacagagagccaatgatgaattaaatccacctattcagtgtgtcttcttgtaaactaaaacaaatatctatgtatgtatagatgtgtgtgtacacacacatctatcatacgtttttccagaaaattaaaaatggatgagaacaacactccccacaaaacctcttagaagaaatgtttgcaagtgtgaccctcctgacctttatattatacttcagtaatacaatttgatgggattttagattatttcccattgattttggaaaaatgtacttatgtaaacagctatttccaaccaattaattattattttgcataggagggctgactattcttggcctgagagcttttaattagccttattctttttcaatctttccatgttctttcaccgacataagtttctgaatctgttgttttagaatgaattactgagtggagaaggtgcaaagtccattagcagttaggtgtttgagcctaccttgcccagtaggtaaggagagtggtcaggtgtttatctgtggattttgagtgtgtgctctgtgtgaagctgtgtgctgttggaggtatcaaagatatgtaaagcatggctcctgtcttcaaagaacttgtaaacaaattttgttgccccaaaacacagaaagggctatattaaacacacacacatactctctctctctctttttttgtctctctccatggtaaaacttcaaaattttaatgcctcttttatcataaatcaaatttcagtttatgttgtctcttctctgctatatgtatgtgtttaccattattgattagcctgaatacagtagctttataataagctttgatgtctagtaggcacaccctttatattgctgttgttcttcaaagttattgtaggtattttggccctttactttccacaggaattttgtaattaacttgtgaagttacatagaaaaacaaagcaaagcaaaacaaaaaaacttactggtctgatcagaattatgttaatttgtacattagttgggaagatctgataaattgatgatattgagacatcccttacacagacttcgcattgtcactgcatttattttatgtgattcaataaagccttattatttctagtgtagtatttctgtgcagttttgttaaattagctactaagcactggatagtttcctttctatatgaaggaacctataaatgttatttaagaacatgaaaaacgggtttgaataattgtagagagagaacttttcttgatggaaatatataccataaagatgtataaatgtaattttaataaattacaattagattattgaagtttttggaatttaaaattaatttttatagtaaatcattttgaaatattttccaattttctttggggtttcttctttgacccacagattgtttagaagtatgacatttaacttccaaatatttgaggggtttccagatatttgtgtgtttagtattactaatttaatcctgttgtggtcagagaacaaaatctgtgtgattttaatgctttaaatttattgaaacagtagatgttgaatcttattgaatgttccatatacagtggaagataatgtacgttccatagctgcctggatgtggtgttctgtaaatattattgctggtaatgttaagtcttcgatatccttacttattttctctttatttattctattgattactaaggggagtatttaaattaccaactcttaattgtggatttatttatttcttctttcatttatgtccgtttttacttcactgtaaagctttgtagttagatgtaaacatatttagggttgttaagttttcttgattgacttcctttatcattatgaaatgtcccttcttttccctagtgatatatttatcctagagtctactttgtgtaatattaatatagtcacccaaatcttttattattagggctgagtggtatatatgtttttatcccacttttttgtagttatttaagtttatttttttattttattttttaaaattttattattatactctaagttctagggtacatgtgcacaatgtgcaggtttgatatataggtatacatgtgtcatattggtttgctgcacccatcaactcgtcatttacattaggtatttctcctaatgctatccctcccccaaccccccacccctgacaggccccagtgtgtgatattccctgccctgtgtccaagtgttctcattgtttgattcccacctgtgagtgagaacatgcggtgtatagttttctgtccttgtgatagtttgctgggaatgatggttcccagcttcttccatgtccccgcaaaggacatgaacccatccttttttatggctgcatactattccatggcgtatatgtgccacattttctgaatccagtctatcattgatggacatttgggttggttccaagtcactactattgtgaatagtgctgcaataaacatatgtgtgcatgtgtctttatagtagcatgatttataatcctttgggtatatacccagtaatgggattgctgggtcaaatggtatttctagttctagatccttgaggaatcatcacactgtcttccacagtggttaatcccacttttaacctgtgtctttataattaaattgagtttcttatagacgatacatatagtttggtcttgctttttaaaaatctaatcaacaatcctaaactacatttgtgtgtttagcccattgataatttatattattattattattttgagacggagtctcactctgtcacccaggctggaatgcagtggcacggtctcggctcactgcaatctcggcctcctggattcatgccattctcctgcctcagcctcctgagcagctgggactacaggtgcccgccaccatgcctggccaatttttcgtatttttagtagagaccgggtttcactgtgttagccaggatggtctcgatctcctgacctcgtgatccacccacctcagcctcccaaagtgctaggattacaggcgtgagccaccgtgcccggctgataatttatattattatgagtatgttttgatttaagtctaccatcttactatatgttttctgtttgtcctatttgattgatgtttccattgtcttcttttttctgctttcttttggattaaatgagcttttagttagtattccattttatctcttttttgatttataatctatatctgtgccttttatttgttgtctaggcagtttgtcatatacatctttaatttattacagtctgccatggattaatattgtgccacttcatgtataatgtaagaagcttacaacagcagatttctattttccaccctcccgtcctttgtgctatcattgtcacgggttttacttcagcatatattataaactttagaatattttgcttttacatcaattatcttttatagaaataaattaaagaagataaacattcttttatatttatgaacatatatattcttgccagtgcttttcattcctttgtgtagatctgagattccacctgggatcattttccttctacctgaagtacttcctttaatatttctattaaagctggtatgcttctcattgacttctttcagattttgttcacctgaaaatatctttagttttctcaaagggtgtatttttgctggatgtagaattctaggttgattttccaacccccccttcccagcactttaaagatgtttcattgtcttttggtttgagttgttctgatgggaagccagagagaaaacattatttttcctcctgtattaaatgtatcttttatttctgtttgctttaagatttctgtttaaaattggttttcagcaatttgttttagtttttctttgtgtttattttattgggttcaccaatattcttggatatatgagtttatatttttcatccagtatggcaaaaaaattggtaattatttttccaaaaaatatttttgcctccctcttctgggaatctagttacttatattttagattgcctgataccatcccacactgagagagactctgctccttttcctctactctggctggatacaactcaaatgtcttccacctaggcatgaactgtggtggttatttagttttgtattcataccatttgttctctccctggtagttttgatctttgactggtcttgtagaatgtcaccttgcaggccgggcgcagtggcttacgcctgtaatcccaggactttgggaggctgaggcgggcggatcacgaggtcaggagatggagaccatcctggctaacatggtgaaaccccgtctctactaaaaatacaaaaaaaaaaaaatgtacccggcgttgtggcaggcccctgtagtcccggctactcgggaagttgaggcaggagaatggcatgaacccgggaggcagagcttgcagtgagccgagatcgtgccactgtactccagccctggcgacagagtgagactctgtctcaaaaaacacaacaaaaaacaaaaaacatgtgtgcagatttctggaactctttttcccccagagctcccttctttctgatactctgctccacaaattgtaaccatctttcttggttttctgaactcttaggtctgtttcctaaaacttaatgagaccactttattctggttgagatccttctccctcaatcatggtctggaagtgccctcaggtagaaatctgggatttctgtggagctcttctcatttttgctcttatctcaaagatcacaggcatgtgctacctgctttccagtgtcttagaacaggcatttcctataatttgtccagtttcctaattgttcatggcagggggactgttcccacatcagttattctagagtgataaacagcaatcctgtcttagtctgttttctgttgttataacagaatacctgagactgggtaatttataaagaaaaggggtttatttaactcaaggttctgcaggatgagaagttcaaggggatggccctagcttctggcaagggattttgcgctacatcacaacatggcagagaaagtctaaggggaaggggacatgtgcaaaaagtgaggcaggcaggaggaggaacttaagcttctaacaacccagtctctcagaaattaatccattcccctgagaagtaatcctgtatcaagagagtgagaactcacgaccaggagaatggcaccaagccattcataacccaaaccttctcactaggctccaccttccagcattgcctctttttaaggatcaaatttcaacatgagttttggtggagacaggaaaccacaaccaagccatagcagacctctgtaactttttgttgctattgtatgttttaaaaatatttcctaattttggttgctggtatgtaggaacaaattaatttttaaatattaatcttgtacacagcaaccttgctggactattttatttctaataatttgcagaatttcttaggttttctatgtagataatcagagtgttcatgaatgcaaccactcttttttttcctgaagctaaaaaattcctttaatgttctacctttaggaggtttgtatgtttctggttgacatattttatcaggttaaggaacttcctgtctattcctagtctgttaagaatattttcaaaaatcatatgtgtgtattaaattacatcaaatgtgtttttctgaatctactgagatgatcacatgctttttctctttttaactgggatgttgaattatatattttttctaatgtgaaagtatcctgatatttctggattaactccactttcttaataccctgctggtttgggtttttacaatttatttagaactttttcatatggatcataaacaaaactgacataaaatttctctttttgatgctgcctttctctggtttggtatgaagaatatactagcattataaaatagattgggtaatttctctttttatgtgttttctagtgtaatctgcatgggataggagatacctatcagttctctaaatgtttagaagcatccatttgcgaaatcatcaggttttgtttagatttgtttaggttattttctgtggatggatttttaactaccaaatttatttatttagatttgtagagtttattcaggttttctttgtatccttaaataggtttgggtaaaattcattttccaaggcagtatcccattttatctgtttctctgttttcaaatttatgggtataacgttgatcatactgctttttactatgttgtatttataatatgccctttcattccaaaatgtgtcctctcccatgtttcttgattaatcttgtataacaatgctttatttatttcactactttttattttaagaaagcattttaagatttctgttttatctttatttttattgcattattttctggtcctatctattattttcttctcctttctttagctttacttttatttttaaattattttgtttactaatttattaattttgtttgtttgtttgtatgaaatggagtctcactcagtcgcctaggctggagtgcagtggtgcgatctcagctcactgcaatctctgcctcccaggttcaagcaattctcctgcctcagcctccagagtagctgggattataggtgcctgccaccacgcccagctatgttttgtattttagtagagagagggttttaccatgttgccgaggctagtctcaaactcctgacttcaggtaatctgcccgcctcggcctcccaaagtgctgagattacaggcgtgagccactgcgcccggccaacttactaattttgtttactaacttgtttactagtttttgtttgctttttttcctaataggcatttaagactaaaagctttggtactactttagctgcattttactttaatatatttgtaatatgtggtatacttgtaatactttagttctgagtattttctgcttttcagagctatttaggaagttttgttattttgaatgttcaaatcgatcaggttttgtattgtctttttattattgatttctaatttaattgtatttgggccagaaaatatggtctatatgataatattctttggtatgtattgatcttttttatggcttagaatggcttagctgttttttgtgctctgagatttcactgtgatatttctaggtgtggttttattttgatttatccagattgggtcacattttccattctggaaaatttaaaattatctccttactgctcatctccccttgctattatgcccatctggaacccctcttagatatatactgtgccttcccattttgtccttcatgtctcataacctcttgtttcatattttctaacccatttctcctactgtatggcaagtttcctcatagctctgttccacttactaatttccctatctgatgtttctaatacattgttcaatccatcttttaaaaattagtttcattgaatatatctatttatataatttctaattcatctttgtccacatctatttgaagttcttgggggattcatactgttggggtatgtgtgtcccttattttggggactgatagattattattattattattttagtatttattgatcattcttgggtgtttcttggagagggggatttggcagggtcataggacaatagtggagggaaggtcagcagataaacatgtgaacaaaggtctctggttttcctaggcagagggccctgccgccttccgcagtgtttgtgtccctgggtacttgagattagggagtggtgatgactcttaaccagtatgctgccttcaagcatctgtttaacaaagcacatcttgcaccgcccttaatccatttaacccttagtggacacagcatatgtttcagagagcatggggttgggggtaaggttatagattaacagcatcccaaggcagaagaatttttcttagtacagaacaaaatggagtctcctatgtctacttctttctacacagacacagtaacaatctgatctctctttcttttccccacatttcccccttttctattcgacaaaaccgccatcgtcatcatggcccgttctcaatgagctgttgggtacacctcccagatggggcagcggccgggcagagggactcctcacttcccagacggggcggcagggcagaggcgccccccacctcccggacggggcggctggccgggcgggggctgcccgccacctcccggactgggcggctgccgggcggagacgctcctcacttcccagacggggcggctgccgggtggaggggctcctcacttctcagacggggcggccggtcagagacgctcctcacctcccagacggggtggcggcggggcagagacactcctcagttcccagatggggtcgcggccgggcagaggcgctcctcacatctcagacggggcagacgggcagaggcgctccccacatcccagacaatgggcggccgggcagagacgctcctcacctcctagatgggatgacggctgggaagaggcgctcctcacttcccagactgggcggccgggcagagggcctcctcacatcccagacgatgggcagccaggcagagacgctcctcacttcctagacggggtggcggccgggcagaggctgcaatcttggcactttgggaggccaaggcaggcggctgggaggtggaggttgtagcgagccgagatcacgccactgcacaccagcctgggcaacattgagcactgagtgagcgagactctgtttgcaatcccggcacctcgggacgccgaggctggcagatcactcgcggtcaggagctggagaccagcccggccaacaaggcgaaaccccgtctccaccaaaaaatacgaaaaccagtcaggcgtggcggcgtgcgcctgcaatcccaggcactcgacaggctgaggcaggagaatcagtcagggaggttgcagtgagtcgagatggtggcagtacagtccagccttagctcggcatcagagggagaccgtgcaaagagagagacgagggagagggagagggagaccgtgcaaagagggagacgggagcgagagagggggagggggagggggagagattatttccttatgtattttctaattttgaatggtgagctcatcttcaacagtgccttatttgtggaaattctgtggaatctgtctttagaaagtatgtctccagaaggggtttatctttgctttttctggaaccccaaggttgattcagtatggtggtgtcttttctcctgtacccagagaacatgctgagacagacaagcttcctgttttcttcttttgttggtaggaggattttttttttcaatgtaatgttagcctctgggagtcctggctacatgtagggagaggtggtgagttttaattccacttcgctgtttgggttattttttatccaatttttcttttcaatgtaatgttagcctctgggagttctggctatacatagggagaggtggtgatttttagtttcacttccctgttcaggttattttttatctaggagagcattaacaccaagcacgggttcatattttgtgctcagtaccgttccagtgtttgactccctgaactttcccttacttagagaacatttaaaggatgtttgctatattttaatcacttttttgtaacacatatgtattgggatgccattgacatctaccttgaggctttggccttgaggtgatgtgtgagtctaattgtatagctcaaagcagaggacttcagtgatttcagggctattgttttatatgtcaaggatttctgtgaacatcaacaataatgcaaatttttcccttttgtggcatgtacacgcttggcatgaagctttcaaactgcatctgtcttcatttccttaaattttctcaaagttagtgaaagttaaatgaatttaagggtatggaattaaaacacaaattaagggtatggaattaaaatacaaatatttggttttttttttggttaagtggtgtaaccacagaatgtttttgtaacttttacaaatatattcatttgtaatgttattatcaaaaatattcattggggattatgcaataaagcaagtcttcaacatctacataacatatgagagtgttattggtacttaatgaaagcctatctttaaaagaagtagacattccttgagggaaaagtgttacacaattgagaattttgattagtcttattgctttactgtgattcaccatagactgatctcttagtaaaatgttgcttcactttgatttcaggagtcttcctacgtcactgaataatgaatgaagatgagaggggaaaagagaagaggtatgcattcataactgactgacatttctgtcaaagccctctccctcgtcctgtgttcccgtttcacatctagcaaaatgctacttcctcagggaagcctgattcactcagagaaatgtggtttctccagtgtttttttttcataactctcagctccagctctattataatacttagcacatcacctgtttacctgacagccctcttcctcaaactgtgtcctccatgccttgcacagtgcctgcccagagctgactctaagggttgtcaaatgactgacaagtatacagtccctgatatttttagaagacagtttttgagccttggcttgcctacagcttaaattcatttgtgtttgagaagataaattaacttacttttccagatcaaacttctaaaataaattcaagtacactgatcaaaaagtttttgtcaaaagtttgcagtatgatctgtggtatccaatggatacatttgatacattgtggaatggctaaatccagctaattgatatatgcattacctcacatacttaactttttctgatgagaccacataaaatctactctcttagcaattctcaagtgtacaatatactgttatttactgtagtcaccatgatgtgcaatagaactcttgaacttactctaactgaaatcttatatcctttgtccaacatctccccactccttcatctcttacttttgatgaaggttcatagctagattctgcctctatctttgctacccactttattctgtttgtaacaaacaaccatagggatcttgtaaaaacctaacatgtcactctcctgcttaaaagcacttcatgggctgggcacgctggctcacacctgtcatcttggcactttgggaggccgaggtgggtggatcacctgaggtcaggagttcaagaccagcctggccaacgtggtgaaaccccgtctctactaaaaatacaaaaaattaactgggtgtgatggcaggtacctgtagtcccggctactcgggaggctgaggcaagacaatggcttgaacctggaaggcggaggttgtagtgagctgagattgcgccactgcactccagcctgggagacagagcaagactccatctcaaaataataataataataagaagaagaagaagaagaattaaaagcacttcatgttttactcagcataaaataccaacttcttaccatataccctacatgatctggcccttcctgtctctcaggcttcacttcctactgctttaacccctggtcatcccactgcagccactctgggatcttgtcatctctttaaataggcaaaatgatttcctgtttcatgttgcacttactgtttcatctccctgagacggtttggtcccgtgtcttcacatggttgctttcttgtcaatcaaatcttagctcagatgttaccttcctaataccttcctagtaaggcttttcttgatcacccgatcttacgaattattgtacttgcagatacctgaaactgtctgttctgttgtctatgtgttgattatctgtctacgctgccccgtcagtctgtaagatacaaaagaacagtcaccttatttttcttgtttatgctatatcctaaacctgtaaagcagaatatgacccatagcaggagctctgtaaacattcgttaaataaatgaataaaagaggttcactttaacaacaggtactgaatccctgccatgacctaagtactatgttagacgttggggatatgatgaagaactggatatgatgcacaccttagagaataaacaaaaacaagttcatgggtaatagtaaagtagaaaagtcctttatgatttatttataaaatacagtggttatcctttcttggcaatatatgaactcccctctcttttttatttctttgaatgaagtctaggagatgaaagttatgagatggaactggaaggcaatggagaaatttcttcagaaattgactatggaagagtgtcatgggttgtttcttgagtttgaagagctatgcctagaattgagtttccaagctgggacagtggtcaggatcactgatcctgactcatttatgcagttggcatggtttacttttcatgttactcctatttcacacccagttacacaccctattttcattccctcatcagtgagggctctaaagctctctttatgcatggcctccctcttacccaactctactcctaggaaagagtcagagactcatgcctgtcaagaaagcaatagccactgtcaacattatccttgtcataggattttacatttttaatagagatcaaagttgtatgctatgggtctcatttttctgtgaggagaaggaactaatgtttattgacatgaagcattaaaatcacttgagattggagggctgtgttagtgaagtccctttgctagtgaagttagtggagtagggtggagttggggaggtagagaggagcacatgttgacagcaaagactaagcacaggagcagaaacacacttctcattgaggaaaccagaaaaccctgaagaatgtgataggacagatgggggagaggacagtaccaggagctttgaagagataaaagataaggcttgaagatattctagttaaggaaccttgtgcaaagcttaaatagatgaagctaaagagtggaatttcataatttagttaggactagggaagggctttgggagtctggatctgcttagaaccccttgacttacctggcagattatggatactgggttttggtagaattcaagaggaaaaaaagaactagaagttgaaaaatcataaaattgttggacaggtcataatgtgtgtggtagaaattgagttggatgatcttcaaagtctttttcaattccaaacacttctgggtttatgatcatttatatacaattagttagccaacatcagatccttcattagcactcagcattttctcataagagtcttttctataaattaagtataactttgaaaaatctaatacccatagctaatcattttaatgtgacactgttctgtactttcttcctttttctaaaaagacaaagtcaatccaaaaagctctcaaaggaaattaaactggattccatcatttcctacctatgattacttcaaccaagtgacgctacaggtaagagggcttttgttctttgattacttcatatgttgaatacatgtaatagaagacaaagaatagtgtttgtcaaagtgtgattaggagatcatatgcattagaatcaaccagggagcttgataacttaaatcgtctgaatcagactctcaaacctgttagggccgggagtttgcatttctctcaagctccctggatgcttcctatgccaactgagttttgagaaccactgattttgagtgacaacaaacacaaacaagtcttcgcataggttagtggcaagttaagtggttatctggtagactagttcaacatagatggttatactctaatgaattagccttcaagtagtttctcccccctcaagaatgtaaggtgtttatagtttctgtctccaagagaactggttagtttcacaagccacaaactgcactctgaagaaccatattcctttgagtgggacagacagggatacagattttgcctttgtcccttacttgctgtatgtcttgactgaattaccatctctgagccttgatttctttctctttaaaatgggtaaaaattatctttatctcattgagatgatgtgagaataaaataaagtgaacatgtgtaaaatatatagtacagcgtttggcaatattagacgcctggaaattatccgtccagtcccttttctccttcagtactggctgaccacccagcactatgaccattagtggtcataaaggtgtgtgagaaaggcattgtgtgagtgaatcttttcaaacctatcccaatgttaggggcaaaattctgactgtgaatgaatggagccatattgtaatattctacttcatttttcttccttttaagaaacagactctcacttttttttgtgacacagggtctcactgtgtcatccaggttggagtgcagttgtgtgattgtggctcactgcagcctcaaacttctgggcccaagcaattcccccaactcagcccccaaagtagctgggaccagaggtgcacactactatgttcagctcattatgtttcattacatctcactctgtcacccaggctggtctcccaagctcctgggctcaagcgatccaccttggcctcccaaagtgctgggattacatgcgtgagccactgcacctgactctctctcaattttattagaggttttgttttaggaatcctatacacaaatatttgctaaatagaggacttaaaatgtgttatgtgaaatcctgttaccaattttatgaaaccagatgcttatttgaaatattttagaagctagacaaggtataaatacaccctagagggataattatgttcacaactacagaacatatggcattcaagtggaaggatcagaatttcttgggtaattccctcctttccacttttttcccctccattaggctttaataacttccctagaaaagtctgttctttattctttattcatgaagttttttcttgaaataaacaagcccagtctggctaatcagagctgacttcaaccagggagatggaaacatcagggaatctgagaagagggacagtagagggctctttctcttcactttccagtttcattacagctttggccattcttttgaagcatgaaagaaagcggggtttggagggcaagagagcaaggtgactttgtttcttatggcttgtatttcagagcagtgacttagctttggatgtttccttcctgtttgccatactgttggtcaaacgtaacagcctcctgacatctgcataacaacctacactgtgctctcatgtagagtagccgatttcatcctcataagaagcctatgattaacttaataatgatgttgatcccttttactgcaggaaagaggagaccaaagctgggagagcttgcaccttgcccaaatccaagacctgttgagtagcacagccgagtagcacaccatgttttctcacttacactccagcccatgggggtccagactaactcagagcaaaccgtctcagtagagaatgtggtaatcaaaatgccaaaagcaagcagacatacagaaaatgagtagagaagcaaagtgccttaccagatctgcctagactcttttctgaacctatgtgtttgggaggtcacttcaggcatgtggcaattttggatgtcatcttttgatgtctaatgggaaatagcaaacacccagttttaaaagtttttacttaaaattttatcttacaaaaatatacataacatatagtaacacttaaaaaaatagtacaggtgacaccgagcttaagaaatagagcattaccagatcctttgaaatccctttgtcgtaatcttcttcttccacaccacttcttccctactatttcctgagttctgtatcaatatttctttgctttgctttgtatttttaggacatgtgtatgcatctctaagtgatatgttgttttcttttgcatgattttcacctttatataaatggaattatattggatgtattcttctctgacttgatatttttgctcaacctttctttttcaattcatccatgatattgcatgtaactctagtgcattcatttttacttctgtattcttgttagaacatactacacaattacttacccattttgctgttgatgggcactagaaatctgttttagctcatgctccttaggaagtagaggctgaagcaaaatttatatgctaaggttttagtgggatatgcaatctcaggatagcgagggtgagggggaaagtaaggcagggaagaagggaactgaaatatagggtagtttattaccaagctggatagagcttcacaagaacacacagcgggttgttcagtcactcttaaaactatgtaaaaggcaccacaccttgaaatagtctgtataggggaggaagggaaaatactgtatctaccagttcctttctttctcctgtcattagtcaaaagtcacacccaggatgttagcaattctgtcctttgggttacctggcttttctggaaacccaatggggaacccagatcccatgctccgaggtggatgaagttactgccttcatgaatccagtccctttggatggatactgaagcacctagtgctggcggagttaggagactaggttgggactgcaaaagcaaagctaacatccctggcttgattgagggtgggatggggtatgaatcttgaggaggcgcataaactgagtctggtatagctgtaggtttttgttattgtgagcaggtttggtttgaacgtttttgttcatatatcctcttccatataagcaagagtgtttctaggtgtatgtctaggagtgagattgctggagggtagggtggagtggtagggtcgctccctctacatgaaaatgacaatgcttttcaagtgactctgtttcactgtgtatttcactgttcttttatattcttagtagtagtggatgaaagttcttattgctccacatccttgctaacaatttattgtctaatttttaaatttttgtcaattgggtgggaatggaatggcgtcttgtttcattacaaatgacaatgagcctcttttcaccaattttgaggccacttgtgtttcctcttctatgagatgcttgtttctagcctttgctcagtttcttatggtattgttctttctaattattcatatgttggagatttttaaaatagattctggaaacgaatcacttgctagttatgtgttgcaaaattcttgttctagtttgtagcttgccttttcacaatttaaggtgacttttgacaaattattaattttaaagtaatcaaatttaccaatcaaagggtgtttactttcctgtttaaaaaatccttacctaccacaaggtaataaatatattctcttatattttattttaaaagctttaacgttttatctattatatttaatgtgttcatactttttgagttatttcttgtgtatgccatgaaggagaaacatcacaaagataagagaatattctaaactagtgatttcattctttaatgatgatgtgattggttatattttttacttcttcccaagtcactttttgcaatttatatgtttttaagacttgctttcaaatttattggcataaagttgttcataatattctcttatcttcataatgtctaaagcttctgtaatgatatccacttttcactcctaatattgtttgtgttttttgccccatgattcatcttaccagaggtttgtcgattttaatgttcttttcaaagaattgacttttaacattcttgattctgtccattgtgtcattattttttgttttattaatttctgctcttatttttattatttacttttttctactttttggggttcattttttgttctctaacaattttagattatttaattcattgatttgtaaccaattttcttttctaatatatacatttaggcgaagattcccaagtgttgttttagctgcttttcacaggtctcaataaatagtgtttaaaaaattattctattataaatactttgtaatctccattattacttattatttggcctatttttttattacggtaaaatgtatataacacgaatttaccgtttaatcacttttaaatgtagaattcagtggcattaagtacattcacattattgtgcaaccatcaccaccatccatttccagctttgaaaatcttgcgtaactgaaactctgtactcaaacaataactccccattctcactttctcccagttcctggtaaccacctttctactttctgcatctatcaatttggctatcctaggaacttcatataaatggaatcatacagtaatgtccttttgtgacatgtttcgcttagtataatatcttcatgtttcatccatgttgtagtatgtggcaaaattctctttccttttaaggctgaataatattttgttgtttgttacgcattttggttatacattcatctgttggacacttagattgtttacaccttttggccattatgaataatgcttctgtgagcataggtgtacacatacctgtttgagtccctgctttcagggtgttttttttttttttcactatacactcagaagtggaaatgctgaatcacatgatagttctatgtttagttatttgagagactgccgtagagttttctatagcagctttgtcattttatactaccatcaatagtgcataggggtttcaatttcttcatatcttgtcccaaaactatttgttttgttttaatcatagcccatcctaatgggtttgaggagttcatgactttatacaaatagagaatcctgcttcaattatttgggcttcctgaatcttaagattggtgtattttattacttctggataattttccacctatatctcactgagtatttcctcttctctgttatattatctccttcaggaacactgatcagacatatgttggactttctgattctcttctccatgaaatgaatttatcttatttttccatttgtatctccttgtgttacattctgagtcatttcctcagctctttccagctcaaaaattttatttctggctgtgttctaacatgctacttaacctatacattaagtttctaattttgatgacaatatcatctatagacattttgtttgattatgttttatatctcacgagtcagttttgagtctcttgtttcttcatatttctagtgccctgtgttatttatttaagcctattaagcatacttattttgtattctgtatctgataattccaataagttatttttaaatatgattctttattttattatgtctgttgcctcttattcgtaatgcttcatctcttcctgtgttttatttttattataagctcatattatttgtaattttatctacatgaattctttgaaccctcactttaaaataattctctagatgtgattttgatttccttttattagacatatggggtcaggatcactttaaactaaatattagactttggttgttgagggccacacaggtagtatatgaattctagctccaagtttgtgtgaaggtgggcttctgcttagtacctcctaaagttgactattttctcttttcctactcttcccaggatggaggctgaggcagacatgcacattccctgtctcctttcactggataagatttttctgttttacctgttgaaagtgtctcccttttggagacctggctttgtactgtggtctttgatttcacctcctaccttgtacaggcctcggctttgcttttgtcccccaagctctaggctatcagtgttggaagatagtctcaaggcaaatacagggtctaatattctccagtgtcttaattctcacaatctagtcatttctgatatcaggttatttcccttactttaccagtagcttggtcctgttttgaaaaataagttttaatctattttattcatcattttagatattctctaccaggaggcatttgtctggctattgaatccatcatacagcaggaaagtgatggcaatatccatatttataaggagatgactaacctaaccacaaatgaaagtgtccttaaaatatttttaacatttttgaaattaagtgttcttaaagtgaaacaacctacacatggaaatgaatcttcttagcttgcattggagaatttcatgttaattgggtgtacattgaaatttgtttaagtgacacatcatttgataaacatttcatgcttaaggttaagtagattctgtgtaggaggcagaataatggaattttaattaagtctgtgcctactttattgatatttaaggactggggtgcatttcagtgtgctattataattatctatgcatttagcaataaaactatcattttattattgttccactatttaattacattattattctctcgtcattagttattagatggctttatgattacactgagcacagatggagtgatcatttgtgtggctgaaaacatctcttctcttcttggacatttaccagtaagttctttctacttttgggaaagtggatcattctggtttgttgtttaggggttcattatttattttctttttttattatactttaagttttagagtacatgtgcacaacgtgcaggtttgtttcatatggatacatgtgccatgttggtgtgctgcacccattaactcttcatttaatattaggtgtatctcctaatgctatccctcccccctccccccaccctacaacaggccccagtgtgtgatgttccccttcctgtgtccatgtgttctcattgttcaattcccacctatgagtgagaacatgcggtgtttggttttttgtccttgccatagtttgctgagaatgatggtttccagcttcatccatgtccctacaaaggacatgaactcatccttttttatggctgcatagtattccctgttgtatatgtgccacattttcttaatccagcctatcatgttggacatttggctggttccaagtctttgctattgtgaatagtgccacagtaaacatacgagtgcgtgtgtctttatagcagcatgatttataatcctttgggtatatacccagtaatgggatggctgggtcaaatggtatttctagttctagatccctgaggaatcgccacactgacttccacaatggttgaactagtttacagtcccaccgacagtgtaaaagtgttcctatttctccacatcctctccagcacctgtcgtttcctgactttttaatgatcgccattctaactggtgagagatggtatctcgttgtggttttgatttgcatttctctgatggccagtgatgctgagcattttttcatgtgtcttttggctgcataaatgtcttcttttgagaagtgtctgttcatatccttcgcccacttgttgatggggctgtttgtttttttcttgtaaatttgtttgagttcattgtagattctggatattagccctttgtcagatgagtagattgcaaaaattttctcccgttctgtaggttgcctgttcactctgatggtagtttcttttgctgtgcagaagctctttagtttaattagattccatttgtcaattttggcttctgttgccattgcctttggtgttttagacatgaagtcctagcccatgcctatgtcctgaatggtattgtctaggttttcttctagggtttttatggttttaggtctaacatttaagtctttaaaccatcttgaattaatttttgtataaggtgtaaggaagcgatccagtttcagctttcaacatatggctagcccgttttcccagcaccatttgttaaatagagaatcctttctccacttcttgtttttgtcaggtttgtcaaagatcggacagttgtagatacgtggcattatttctgagggctctgttctgttccattggtctatatctctgttttggtaccagtaccatgctgttttggttactgtagccttgtagtataatttgaagtcaggtagtatgatgcctccagctttgttcttttggcttaggattgacttggcaatgtgggctcttttttggttccatatgaactttaaagtagttttttccaattctgtgaagaaagtccttggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattcactttgaagcaattgcgaatgggagttcactcatgatttggctctcttgtttgtctgatattggtgtatgagaatgctggtgatttttgcacattgattttgtatcctgagactttgctgaaattgcttatcagcttaaggaggttttggggtattttcagaagcataaagctcatcagagaagatgttttcaatgttgtcaaaatgtgtccctgttttattgtcatttccattggtttcagagtactatagattgggtgtctttgtaaacaacacaaatttatattttatagttttagagtctgagaagtcgaagattaaggtgccaagagatttggtgtctagtgagggcccaatctctgcttcatagacatccttattcttactataacttcatatagtagaagaagcgagggagctcttttttttttttaagattgggtctcactcttgtcacccaggctggagtgcaatggtgcgatctcggctcactgcaacctctgcctcctgggttcaagtgattctcctgcctcagcctcctgagtagcagggattataggcacgcatcaccacgcctggctaatttttgtatttttaatagagacggggtttcaccatgttggccaagctggtctcgaactcctgacctcaagcgatccgcccatctcggcctcccaaagtgctgggattaaaagcgtgagccaccatgcccagcctaggggtttcttttataaggatactaatcccattaatcatctccaaaggccccacctcttaatataataccatcacattgacagctagattacttcaatatataaatttttgggggacataaacattcaatctgtagcaaggccttcatattccacttatacgtgtgtttgaagaggggttacctagaatacatttaccaacaaccctcccacacaaactgtctgccattggcatggttgtgttagcaaaaagttttgggagaggatatgaagaaattgaaacccctattcactaatggtagtagtgtaaaacaatcatatctccgttgttgttttcattacatattcctcattccacagagttgtctcaagaacttgacaaaccctaatccagaaatctatagtactcaaatttggaacatggaaattaatagaagctaggttagattatcttgtagttaggttggaagtggattaaaaatatgtcactattttagccaggccagttggcatgttccgtggccttcttggaagctcagagtccttatacccttttaaaaaaaattacagatgctagaatcgatctcttttatttctcattctctttcattttttaaaaaaacagtttacatttccaaattcagcttatatttgtaggataccaaaacagctaaatgaaatagtagagatatttattggattgcactttagtatatttaaatcatagaaggaaaagagtcttttaaaatatatattaaaagagggaatgtacgagtatgatccactacagcttaaattttattataatgaagaccagaaaaccacccaaattcttgtggcatcagatattgcttaaaccaaattggtcattggctgagactggtgactttttcttattatgtgaagatttatcatagtgatggtgttagttatgatatgatcttgcttctttatgtatttggttcaaagttttccctatcaagaagctctttcacccttcaacatttgaggtaccacacacacacacgccccccaaaaccacaaggtctagagaggtgtctgggacatgtgctttgaactgccagccttaaacaatagacttgatttacctgagatcagtgtacttaaaaataaatgtataactattacatttgtacataaacattaaatgggaattaagttatatattcctataaaacaaggttaaaaacgactacacctgaggcatagtttcacacttcctcattgaatcccaactgttcttaatttttcaaaacaggcaatctttttctcaggctttgattaaaaatttcattttataagtcatccaacttatattataaaatggagactgaaccatttctagagtgtctgcgtggctccaggaatcttcagtttcattacatatcagggcacctctgtctatggagcaactccaaactaatagcatggtgtgatggaaagaacttggtcttcggaatcaaataatctagagattaaaatttagctttgtttctctctaactgcctgacctttagtttctcttctataagtggggaaataatattacttagagagtgctgggagatgaattagtataaataacgtgattggctaaggcccatctgatcagtgacatttatacagagacctgaatggagtatgtgtgatatgcaggtaactggagcaagtgtctttcagacagaggaggaagcttatgtaagagcctgaaagcaggaaaaggtacagcaaagaggacagtgtaactggagtgctgtgagcaaaaggaaaatagagatgataaagtcagagcagtaacaggagaagtaacatcccttttcctctgagatgggaggaagccattggggaggttggagcagatgaaagaaatgatctaacttaagttttatcagaatcgctttggctgttatgtcaagaattggctatgaggggcaggcatggaagtacagagtccacttggagggccatagatggtagtgggttggattaatgtggcagtggaagcattttgtaggtaaaataagttgttttgctgatgtattggaagaggggtgtgacacagagataagatgtgtccaagttatgctgttacaacacataccatgaataaaatgatgcccattatcatcatgatcatggtattaaacttttatctgaaacctgccatcatattttcccaatcattgatttcattgacagttttttttttcctttggaaaaactcatagtcatttgtagtagtaagttccagtcactgccccctgttcttagcagcctgccctcctactcaccctactctgtcattccccctgaaaataaaatcaaatctgggagtttacatatatttattctcttttgcagttctaaagcaaatgaaacttttaaaacgtacactacatctgaaaaaattctcagcattgaatctttaagagattaaaacttagcaggttttgaacataggtacatggttagtttgtgataactgtgatgagatttgccctattttccctgagaagcttaccgcatagtagagatttagtagtgatgagtctcatttgatttgagatgctgcctaaatctcctgcagaggatcttatccttccctgtgccctatacagttgaatagttttctaatgcatgtataatatgagtgtctttggcaggaaaaaagatgcttcttgcctaggttctcagtaaatgtcatgaagtcctcagtaaatttcttaattctttctttttttgacgtgactgagactcaccacactaatatttgtgtgacaactaatagatatttgcaaacttggcttttgaaaaaccaccttagtttttcgctggtatttatccttgcttcattaagctctaagtaccttgatctttctaccttgtgtaataagaagagcaaatgctaaaaatttacaaaaataacatgaggtcgatcatgctttcaggtctcctccctttttctaactaaggaacaaggccactggaacagatccagtgtttcaattagcggttaattataaggcttattgtcactattcctatccctagagaggcaataagaaactcattaccactagtcacatccaagagaatgtagactatcaaaagatagctcactttgaactcttttaagtgacaatgctatcttcatttttcaactaatgaaagaacttacgagacatagcactttgtacctcttgttagggtattattttatactctacatcataattgattgtgcatatttaatctgccctactagactatgtgctcattggaattcgttgtcaggttcatcttttgtaacccttataagaaataagtataaaatcttattcagtgaattacttcatgtagaatgtccaaaatacaggaactggtccagtagcaaattttctgttcctgatgcaaactggacttgaggcagctatggtgtagtaaaaggaacaatagacatggaattggatggagctttcatgtcagtttcatttctgcatttctgaactctcaacaattggagaagccttaatttgctgatgaataaaacaagggataattcttactctcccaggggattaagtgagcttgtatatgtgaacatacctagaacagtgactggcatggagcaattgtttatcgtgtgttagatgagtgaatgaatgagtggtctccacagaggtaacccagtttggcatctaaagtctattttataactaaaccaacaaaagtgtttttattgaaaagttaaatttagtgaaaaaaatctacatttcttttgggaagtcagtattttactgtgtgactttcactgtcaagatgtattgcctgttaattccataatgttttgtttgctagattaaggtaatatttctatccttaatcaagccaagcttgattgagacagcatctgtctgctaatttgatcattgaccagttcataggctggcttctacaaatgggccataaagatatatttctaaatagtgactgtagattattaatgctaatcagttaaaaaatcattggaatttgtggttcatcacacaaagccattattcagctacaaggaatactttattactttgttgctatcacattaaagcctcattacttctatatctgatattcaatttatccatgtctcaccgtatttcagctacatgatacggtattattcattcattcaaccaatatttactgagtgcttaccagtgccaagctctgttctaggtgttgaagatatagcaatgaataagacaggcaaggtctctgttatactgcaatttacattttaatggggaaggtagataataaacagataacaaaaaaggcaataagagaatgtcaaggagttggtgctatgtaaaatacttttgagtaaagacctgtattaagtgagagagaaagccattgcaaatatttgggaacgagtgcttcacatttcaggaggagttagtttaagggctctgagatgagtatttgctctcattgtgtttggatgtgaatgaggagttgggtgtacctggagtgcagtgagagagagagagagagaaagcagataaggtcaatagcagcaaggaaccagaatatagagtggtgaaagcccttataaagactttggcttttattcagaatgacttggataatcagtagaaaatttggaatgagcataggaatagcatgatgtggctcatgtttggaaagaatcatgctggctgttctatagagaatggagtggtggcaggggcatggcaagaatagatgcagggagagcagttacggctactgcagtaatccaaactggaaatgagacttggaccaagtggcgaaaagtgaactgagcctgtatgtgttttgaaaattgatccattagagattgctgatggactggatattgagtttgagagataaaaggcaagtcaaggacaagtaaatgggtaaatggtggttgccattactgatattgggaagaccgagggaggaacatattttgtcaaagaaaagatcagttctttttggatatcttaaagttgaaatccgattagacatccaagttgagttatcatgggggcaagagacgactatctgtgagtcattaacagataggtggtatttaatgagatggaagtggaagagaccacgtagggaaacaggcctaatgactataagccctggcactccgatgcctagtattcaggaagcaagactaagatctagcaaattgtgaaggagtagcctttgaggtagaagtatatcctcatgtgtgtggtgtcctggaagtcaagtaaatgtatcaagggaaaaggaaggatcaattgcatcaaatgctgagacgcttggtaagatgagggctgagaagtgatgatttgatttggcaatatggagggcactagtgaccttgacaaaagcagtttcagtggagtggagtggttagatataaacttcattagtgtggtttcaagaaagagcgagaagtgaagaaaggggaggtaacaagtgtcgtttcatttcaggaatttttgttccaaagtggaccagataagcagagttataattgaagtgagaggcggtaatgtaaaggaaggttatgcatgtttcgaattttgtgttgtttttgttttcctgattatttttaaaatttcttattcatgtataaatttgtacataactccagataagtagaattataattgaagggagaggcggtaatgtaaaggaaggttatgcgtttttagaattttgtgttgttgtttttgttttcctgattatttttaaagtttcttattgatatgtaatatttgtacatatgtatggcgtacatgtgatatttcaatacatgcatagagtgtgtaatgaccaaatagatgacagatatcatagcatgtatagtacagcattttgtatgcttatgggaacacccagttgagagggaaagaaaacttgatgtgtggggtagggtgagactttctagaacaatgtcttttcatagtctacagaaaaatgggatgcagtgcacaggtgaaggagtgaaattcaggtaggagcttattcattggaagaggagggaaagcaggtctctaggcacaggaacagataggttggtagatttggtgtcagatgttgacatttcccatttttttttcactgaaacaagaaattaggtcagctgaaaatgaaggaaggctcgggggtcggaggtttgaaggaggaaaaagagtaggggagcaaattgtctaaataaatgatttttgggcagacttgaatacttatttcaaataatatactgcttagttgtgggtttttcttcatttacattcaattgcttgggtgaaggtgtagataaatgaaaggttggaagtaactagagtcaaaattttcccaggcaaatatggtagagggaaagagcacataggaggtggtgctcataaagtaggataatgggaattgtattttttagaggtacaacaggtataactgtacatggctgaggtggggcagagcataagctcactggaggtaaggagatagaggaactgaacagtattaacacagataaaaaagtttactctctccctcttcccctcctttttccctccacctcctcctctcctctcctgccaggctgagattgtgggcaaaaaattattaagccttctgcctgatgaagagaaagatgaagtctaccaaaagattattctcaaatttcctttactaaactcaggtatgtatatttttaaaagtagtaaattcttaggttttaagggacaagtaacaatcgctcaatggattaatttctaaaaagatattagagcacatacggctgttgatcatatattaatttacttttatataatattacaaactctatttctagtgttaaaaaaatctctcctccattaaatcttattcctcaccacagaccctgagtattgtagcatttgtacaattgcattagtgctatataaatgatggaccattgtatatagcgttctagctggtgccctactctactgatacaacatagctagctatgtaagtgctaatgttcgtggaaagaaaataatatttttgtaaaatctaatcgaagaaagacattggtcatatgaaataatccagtagaatatggtaaagtacaaatgtagacttgttttgtatttcttctctttttactagaaacacatattgaattttgctgtcatttaaaaagaggaaatgtcgaacatggtgatagttctgcttacgaaaacgtgaaatttattgtgaatgtaagagatatttgtaatggtaagcagttctgtttatcttatctatatgacatttatgagtcatgtagcctcacattactaacataaatgctcttctgcttggtacttgcaaactgtctgatatccctatggccacagtttctgactactcacattacttagacttttaaaaattaacagtgaaatttacaaggtgggggacactgagttgttaaggatggctctttctttttataaaacaaggaaatgattgcaaaaatataacaaaagaagtttaatgcatatccaagcttaaaataaaggggactctgtgggtctatgtgtaccagaaattaaagtttaaagcagtatgacagtggtaagaagcagctgattttgtggtggcctcggtggattttaagtcatgcataggctccattggctggggtcgggaattctaacacccagtcaagcaccagtatataaaacctagagatcaatgaagtgatcaataaagttctgtccattgacccagaggaatagtgagtaggtttatcatctctctgggaatttgaatggacaaaatgtgccatttacaagaaaccaaaacccaaatttttgtcgcgtgtggatatagggtccattttacaaattttgaggtttcagaaactgcaagctgagaaattaacataaattaattaatattaactggtttggagccattaaaatatctgggacttgaatcagaggtaaatagcccaaatagctaacaaatatatgaaaagatactccaactcactaataagcaaagaatgaaacatttaaaaaccagtgacattagcactctacacccatcagaatgggaaaaattagaagtttgaataataccaaatattgatgaacatgtgagaaatgaataaataaataaatgaaattaactcacgcaaaaggtggctgatatatttgtcatgattcttggaaattaaaagtcataccttttgaaaaaatcttacttgactctgtgtgcacagattacacacacacacacacacacacacacacacactcccacacactctacccatatggtctatataaaagagaggagccacatctcttttggagactaaaatatccatccacagggtaataacggaagactgaaaaccaaccttaactctcaatatttgattctcagtaataaattctttatgttttgatggggagggtggctgaaaaggaaagaagacaggaaaaatcccatggctcagaattttgaaaattgtcaatgggttagcaaacagcacatggatgtgtcaggtatttgtcttcttgtttaactggtccacctttctgttttcacatgtgtgtctatcttccttagagtttcctgtggtctttagtggcttgttttccagccacctctgtgctgactttgctgcatgtgttcctcaggaggatcggctttatcttgtgggaaatgtttgcattctcaggactcagctcctgcaggtgggtatactgtgtttgtgcttcccccgctgtggcgatgtgggcttcctttgaagggtcacttcccctttggtctgtcagccactggacaacattgctaaattactcagtgtgtgcagagggttgtgctgggatatgtaaataaggaaaatcagctcctatgtttcagaaggtgaacatctcagtgaaaatttagacacactcgaaagagatgcacaatcatttacaagtagtcttgacataatataaaatattataaaatgtaggtgctggggactggaacacatgaagagaaatgagcattttggcaggtagatgaaggaaggcttcttatactacgtgagttttgaggcagctccaccacaaccccattgggtagctgattgtaaaggcttctgctctctttgtgttctctaatatagcattcacaaattctagctctaaaaagaattcactttggaattcatctgatagattcagcttccattaatttttccattcagtaacatatatagtaagtacctactgtgttacaggtactgtgctaggtgccagagagacattaggggagatagacaatagctaaataatattggaaggtgccctgaaggatgacagaataatgtgctaatgactagtgcgggtggggagttcagacagagtggtcagggaaggtccttttcggataatttgtcttttgagcagagacccctagggatgctaactaagaaaggaaggcaacgcaggtagatggttcaacatctgtaaaagacctaaggtagtaactagcttggagagttccaagtaacaaagtaagttatgtgaccagaataaggtgaaagggggaaggagcagcagaaaataagatccaatagataggcaggggacagattatgtagaactttgagatccatggtaatcagtttgggttttatttcaagtgcattggaaagcaggaaggtgacatgatctgattttcttttttaaaggtcaggctgaatactggctgagaaatggagtacagagaaacaagaacagaagcaagaatacctaagtgaaagatgataggggcttggactatgattgtagtaatggagatacaagtattctgacttgggatgtattttggaggtagtgcccttgctgatgagttagaagtgtctaggagaagggagagaaacatctcgtggaggatttttagctttttggcttgtggaactcagcaaatggaggtgccattaactgattttagcaagactgggacaatgtggatcaggcagtgtgggaggctagaatcaagagcactgttcgggccatgttaatattgtgttgatgttacaacataaaacatctccaactcattaccttataagggaaggctctgatccagatttcctgtgttcagatcctttccctaccagctctgtgaccttggccaagtcacatcctttagcctcagtttctttttctataaatggcagtcatagtaccttctattagggttgtaaggagtaaataagacagtttctcctatatggtaagcactcagtaaatgtgagctattacagttgttgtgatcattgttattactgtcattattactgccagtgatccagagagggcaacatgcttgctttacttttcatctctggtttaaaacgtgggcttttcagaccacattttagaaactgtggagggggcctttacattcaattttagaacaagtaatatatgtcatcatttcttcaaattaaagatggtaagaaaagtagtatagaagaaaggcagtttaaggaagttgcctaattcagttgccccattcattattccgtctttgtagccctctgggatttgaactgtcacatctgccatgagaatacagacatcccattttggaagtcaaccccagtaactacttccttttctgagaaacagaaaaacatctgatttggcccaataccttggtagcccttacagcacaaggaactctatttgtgttctagtccagtttctctctgggtttataggatgtttgttccatattagtggacattttggagaaaaaaatcttgtgcaaacaggcgggcttttggaggaagatttttttcacagcgtgactgtgtagtacagtgggaagagggatgaactcacagttcaaactttgaaattctgctcctggatctactagctctatttcttgggtcaaatcattatatctctaatcctcagttttcaaatctgtaaaactccagtgcatttctcacattgatatgcagattatttgtaacattggatatgagcatgcctccaaaattaatatatgctgtgcatttttactatttatatacatattaaatgtctaaatatttgaatttttctgcagcaactttacacttcaaaggcagtcagtgatgaagctgtacttacacaagattcagatgaggaaccttttgtgggagagctcaggtgagaggtagtattgataaagctaatgaagatctagaattcaattttactaaacgaaactaaaacaagagaaataacacctacagatattttttttcccatcaaaatgaaaatgaaaaaagaaacaaacgggccagggatggtggctcatgcctgtagtcccagaactttgggaggctgaggcaggaggatcccctgagcccaagagtttgagaccagcttgagcaacatagtgagatcctatttctacaaaaaatacaaaaaaaattagccaagcatggtggcatgtgcttgtagtcctagctatttgggatactgatgtgggaggatcagttgagcccgggatatcaagtctgcagtgagcagtgatcatgccactgcactccagcctgggcaacagagtgagaccctgtctctaaataaataaataaaaccagaatagcagtctactagtctgaacttcctttcccagctcatataattcacatttttccaacagaatgtaaatacaggtgattggctttttattttttattttttaaaaaaagcattaaagcaataaatagagaaaacttaactgacccaggcatgtaatgactttcaaattaaggtaatgcattttaatatactacttcattacttttttttcttgaaaagaaaggtaatgtttagacacttttaaatggtagaagagcaagtatgcattgtggtaactgctaattatacaggcattcctcttttgtgaatctaatgtgttctttaaaatttgtttactaacacattttcagagaatagaagcaaatattccactatttcacgtgagaaaagtaaaaatatattcctaacccccaggaaaatgccgattaatttgccagataccactaaaacccctttataaacttatttaacaacccacaaaggatttctgtaaaatataaattatttataatactatatagttattcagcatttgataaactcattgtttggcacatttgtatgtagtaagccacaatagcatacactatacagtgtctagtattgggaggggattacattttccttctacgttgcagtgtacatgtactggtaaataaataatgaagtaatatattaaatatattaaagatgtgcactgtatgccagtaatatttagcaaaataaaataagcaaacaagagaactttgcaagagatttcttgggatcaaaggcatgcttgcatgaggtctgatggtgagaagagtgagctggaagctgtggtcacggttactattcgggggcaggaggaggtaaggaagccagagctggtgaaggaatgagttaaacaggaaatatttgaggctcatctggatttaagagaaggcagggagaatcttccattcccatcagaagagtacagaggtgattggttgtcaacctttagctgatgctacacacagagcagtgggatgagaaacagaactcatggtggctagctatttacatcccctttgcttgattaaaaattcttgctaacataaagctgcatttgtattaataattgtgtaattgtgtgttgaatgtgacaatgtgacatgtctgctcatgccatgatcacatttatttgtaccagcatgctgtttttatggaatctaatttttatttttatttatttatttttaaatttttatttattatttatttatttattatactttaagttttagggtacatgtgcacaacgtgcaggttagttacatatgtatacatgtggcatgttggtgtgctgcacccattaactcttcatttaacattaggtatatctcctaatgctatccctccccactccccccaccccacaacaggccccagtgtgtgatgttccccttcttgtgtccatgtgttcttattgttcggttcccacctgtgagtgaggacatgcagtgtttggttttttgtccttgccatagtttgctgagaatgatggtttccagcttcatccatgtccctacaaaggacatgaacacatcttttttatggctgcatggtattccatggtgtgtatgtgccacattttcttaatccagtctatcattgatggacatttgggctggttccaagtctttgctattgtgaatagtgccgcagtaaacatatgtgtgcacgtgtctttatagcagcatgatttataatcctttgggtatatacccagtaatgggatggctgggtcaaatggtatttctagttctagatccttgaggaattgccacactgtcttccacaatggttgaactagttcacagtcccaccgacagtgtaaaagtgttcctatttctccacatcctctccagcacctgttctttcctgactttttaatgatcgccattctaactggtgtgagatggtatctcgttgtggttttgatttgcatttctctgatggccagtgatgctgagcattttttcatgtgtcttttggctgcataaatgtcttcttttgagaagtgtctgttcatatccttcgcccacttgttgatggggctgtttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtcctagcccatgcctatgtcctgaatggtattgtctaggttttcttctagagtttttatggttttaggtctaacatttaagtctttaatccatctggaattaatttttgtataaggtgtaaggaagcgatccagtttcagctttatacatatgtctagccagttttcccagcaccatttgttaaatagggaatcctttccccatttcttgtttttgtcaggtttgtcaaagatcagatagttgtagatatgcggcattattctgttccattggtctatatctctgttttggtaccagtaccatgctgttttggttactgtagccttgtagtatagtttgaagtcaggtagcatgatgcctccagctttgttcttttggcttaggattgacttggcaatgcgggctcttttttggtcccatatgaactttaaagtagttttttccaattctgtgaagaaagtcattggtagcttgatggggatggcattgaatccataaattaccttgggcagtatggccattttcacaatattgattattcctacccatgagcatggaatgttcttctgtttgtttgtatcctcttttatttcattgagcagtggtttgtagttctccttgaagaggtccttcacatcccttgtaagttggattcctaggtattttattctctttgaagcaattgtgaatgagagttaactcatgatttggctctctgtttgtctgttattggtgtataagaatgcttgtgatttttgcatattgattttttatcctgagactttgctgaagttgcctatcagcttaaggagattttgggctgagacttcagcaaagtctcaggatatttttattttttattttttgagatggagtctcactctgtcgcccaggctggaatgcagtggtgcaatctcggctcgctgcaacctccacctgccgggttcaagcgattctcctgcctcagcctcctgagtagctgggattacaggcacgtaccaccacgcctggctactttttatatttttagtagggacggggtttcaccatgttggtcaggctggtctcgaactcctgacctcatgatccgcccgcctcggcctcccaaagtgctgggattaaaggtgtgatccactgcgaccagccagaatctaaattttacgtgaatcttcagtgttttatgtttggctcctaggagtggggagcacgtgcacgaccaagcttaagacttctagccagtctctgaatgtgctttattgctcccagcttttcttgtagtacatggacttcaataggcctgttagtcttgcccacttccttcattagtttctctagtttcttagatgaccttttactgaataatgtggaacgtaagatacctacaagacaacatgtttaaacaacatgaactcaagttttgctataaggagaatgactgagacacaatagcagcacactgacatgctcttgtctaggcatgcatgacttaaacatattcttgcatgcaccctaaaacagatttatttagcaggtttgggtaatgaattttgtttaaaaactagcatatcagtgtagcaaatattcagatagtgagagtttagagaacaaagatactcatattttatttaaaggtagagtttaattggatgaaaaatattctgatgcagcaaggagccagctaccacatctatgccgtaatcttcataagatacataataaaagtgttttctgaaggcttaaaattatatcatttctaattttgtaagaaattatgactcaaatgtgggtgaacgcacactctttcccctaaagttcaaaactagacaatggattgtttatcatgtaggaagtaagatagaaaatgacacttagggaaaaagcggatgcatttaatgaagaaaagtctgattaattccagactgcttgtccctctcatatccctccctcctccaactccatggccactactttggccccagtctcttcagctctcatgtgatggattgttggtggacctggctggcccactaacctgaactctgtaaggcaggacctgtcaccctcacccttgtctgagcacagaacctgacaatgagtaggcagaagtgacatctgctcattaactgattggttacttgatcttatcaaaatggtaatacattccgggccatgagatctctcaaacattatgcagtattgttagaaaaaaagtgcaaaccagtaccctattgcttgattttttcatagacttgtcccttgtccccatgatattttcaattaaaaaggagaagagattgcatcatatcagggttgtaatttttagttattaatagtctggcttccattttaccctctgggggatagttagaaaagcaattgttcacaaaggtcgtagggacccacagctcccaaaatgtttcccttatcttggtaattccattttttaagattaagaagcatcctgctaagttttctctatgcttatgaaggaaacacaaaggtgggaatttgaagtatttagaagaaagggtgtatttccacatagaatgtcctgtttgtgcaggtttaagatttgaggcttaaaaatctttcatttcaggagagggcctgaacagctggggtatttttcattgaggctacaggtgtaccggagtggaaagtcttgctttcttggactattgaaggtagaaagaagtaagggatttgtgagtcagtgaggggcaggcaaaaaagtgaatactgagtagccctctgctgtcttgctactgctaagagtcagaagtaagcaactaaggtactctttggatttgcccagttgcatgtattggtaaggcccaaattcctatcatagcatcatcttttaacacagtgcaatttgttctttatacttcatcatgttattttatgtttattaactcagttattttctacatatctataaggtagattttagactcattgtacaggtgagaaagtgcactcacagaggatgtatgattcacccaaactcacacagctggttaggcagtatagctgtatttgggacctaagttatcctgggctgcattccacgaggacaccagtttcaggagctgtggccggtatgtgattcaagggagaaaactcaaggagtctttggaaagtatgtgaccagggatgttactaagagaaaacatttttctttttaatttcaccttaaacttagagggaggagaatataccgattagttagccctaatactttttacaaagatggcacattttcacccaaaagtaaagtagaaaacactggaaaatcaaatgatgagtatttcccaggttctagtagctgttacctgtgcttgcaaagtcctcagaaactctgctataggactggaattggtccctggggagactccatctgtcagcaactccaccagaaagaatgttcctgcctaattcctctttcagtgaagagacaccttgtacaaaggtgtggggaaaattttgcaaagatgtacaatggtcctagttagtgaggttttgttgtaccgagtctttttaccatactatactataccgtattgactccattccttatgtctgtcccatcttgagcagaggaggggccttgcacatcattgtaaatgtggctagcatgcctagtcttatcactttagtcccagtgaaacttatttattcatacagaaaatagttagcatctgctatgtggaagtttctgttccaagatttaaggatatggtagtgagcaaaagtccttatcttcgtggtcattacattctggtggaggagaaagataataaacaagtcaatagactatagagcaggtgagatgatgagggccaagggaaaaaaaattgagcagtgaaaggggtatagggaatgttattggggggaagttaaatactactagattttgaaatggcattttataggttaaaaatggagtaatattggcaattccctgtggttcctttgtggccagaaagggcctcaacaagcaggtgacttgagttaacatctgaaaggagtggaggagcaagccttgtggattttggaggagatattccagacagaaggaagagcagatgcaaggtccttgaggcagaagtacatggcagaagcatatgtttgagaaacagcaaaggagccagcatagctggagcagagtcaccagagaggaacattcagagcatgcagggcctgtgagcaactgtgagggaaggacccaggatcgtgtcagctcgaccctgccttgtggaatagctcctgctagagtcattcaccattatttctcttgtttttcaatgccgtgtggagactcagtcaacactacctgctctccctttgcacgttacttggctatttctactaattctactctactaattctacctatcacctttggcaaatactgtggaggtcttgtaatatagttttaaaacaacataaaattaggatttttaaaaactataatgctcaggttttatttctcagttttgccatttacagtttgtgtgatcttggagaagcctgttaagtcttatgttctttatctataaatgatgaagataattactgcagaatgggtgtgaggctcaaataaaaaaaaaaagaaataagatctatatgttttgtaaaatactatgcaaagtcaaattattatggattagaaagtccttccaaatatggagtaattataatttaacactatagtccttactaatctatgcagacaccattaactacaaagggctacctgtgaacatagcagacagtcatgatctgaagtttgtgtctggtgatttcttcaatattctttttatttttctataaatttaaggtagttctttttttttctgcttaaagccagtacatttgaaacctccatactgagatggtactctctccatgaacaaccgagtcattccatgaagagcatccatgtctccttgcagggtgaagtgggtgcggcccaactttgaatatgatgaaacttccagcttggaggccacatacagccagatgactctgtgctccgacacccaccagacagatactcacatgctgacacctggtgttagcagataaggaaaggagttggggcttttcaggcttacatccagggaaagaacccttgagcccatttccacgcagctgtatttgttagatttgaagccagccccttggtgtacatttaactaatcatattagtagcatgtacagggtctggtccttgaaaaggacagacatcaaaagacacaggtagaagggatagcagtctcaggatcctgggttttatatatcattttctttatgatgtgatctctagccaacccatactccatcttcagctacatgacaaattattttgatcatctaaatgcataaaatcattaaactattagatttgcaattgataagagcagttttgttgttaatattttttgaaaagctctgtgtaagggtttgtactaaagacttattgaagcagcactgaaattactgaggtttagacactaatgaaaaaagtctaataaatataaaagtttaaaaaaactgggacaaattatctgatatatttgcctattttatgaaaagcaattttaaataaatattctcacagctgcatattcttctcaagtaataatgttatttttttctcacagtattcatttgccattccacaatatagttgcccagcttgtgtgttggtcatctgaagatgtggaatgggattcatccagctctcttttcacttaatgattttggctttacctctttcttatcttgagacattcttttgctttagctccattgccatttttaaaatttctttttattttttaactttttatttgaatattggcaggaactatatgtgtcctcttttacctatactcacaactttttacagcttgccccatttgctttattatcattctctcctcttctctccttctctcaacttctccccatcttttcttccctctctcttctctctctcttcatatagatagatattttgtgtgtgtgtaatttattataaactgtggagatacacctctatttctcaaatacttctatgtatttcctatgttcaagtttattataatacataaccttagtatggttataatatcaggaattttggtatctgtggaatattattatcatctattccacagtccatattcaaattttgtcagttatcttttgtagctttttttttggtataggatccaatttaggatcacgattacatttagttgtcatatgtctttaaactggaatagtttcccagacttcctttgatattcttaactttgaaatttgtgatgagtgcagactaaatattttatggaatgtccctccatttgggtttgtctgatgtgtcttcttaactagagtcaagttacgcatttttatcaggaataccacagaagcaatgttgtattctcagtacgacatatcaaaagatagatggtgttgatatttctcataagctgatgtgaactttgatcacatggttaaagagatgtccaccaagtttctcacctgtaaagtaaaatttccctttgtaaattttaagtaacttatgggaaagtacttgaagacatgtaaatattctgttcctcaagaaatttttacccactagtcttagtacctgttgataattttctaacagcatcataccttctacatttattggttggcattttggttaggaagtttcccctctgcctcattaattgaatcgttatttatttattcactggcttataatatactactattattacttattttaatgctcacattgtctcagaattggccagtgggagcctcttccagctgactcatctctttttaatgtgccctgtcattctttgagcatcacccttactacctggcacaagacttttcaggttcattttgtattttctctgcctcagagaaatcagccagttctctaagtcttagtctgagcaactccagcttctttaatcagaagtatttagaaaccaagatctaggcattagttctggtcatcattacttgtgtgccactgcttttaagtgctttcagaactaggaaacaaatacacatgtacctacatataaagatacatatctatatgtatgtgtacctttgtgtatgagtgtatataaaataatacaaatcatgagttcatagtgatgcttcagattctaagccaacaccatagggttcattctagtcttctcatttctgtatttgcaacactcttttccaatagtcacaaaggcctggccccactgtcctcaatatagttacttacttgctcaaatatcaaatgcacagaaagtagtttcagggttgccaacttatgtcattgcaaaaagaaaaccttctaaattgagtttaatagtatttacatttgtaaagtaaaatttacatgtagtaaaatacacctatcttaagtctatcattccatgagctttgaatggagaagcccgtgtaaacctcattcctgtcaagatggtacagtgtacatcatggtggctatggttaataacaatgtattttatgtttgaaaattgttaagagagtagattttaagtgttttcactacaaaaatgataagtatgtgaggtaatgcttgcatattttaaatagcttgatttagccatcccgcagtgtatacatatgtcaaaacattatattgtacaccagaaatacatatataatttttacttcttaattaaaaatttttaaagatatacaatgttttcagcacactagaagccttctttgtgccccttctctgtcatcctcccacctagaggcaactgctattttgaattttttcactctagattaattttgcctttactagaacttcataaaaatagaaccatacagtatatactctgttgattctgccttctaacccagcataagttgtacgtatcagtagttcattctttttgttgctgaggagtattctattgtatgactataccacaatttgttacgtattttccttttgatggacatttttttctagttttggattattacaaataaagctgcaatgaacgttctttaaaaaaagtctttctgtggatatgtattttctttttctttctttcttttttttaatttgttgagaaatttctcgctctgtcgcccaggctgaagtgcagtggcgtgatctcagctcactggaacttccacctcccaggttcaaatgattctcctgcctcagcctcctgagtagctgggattacaggtgcctgccaccaggcctggctaaattttgtatttttagtagggatggggtttcaccatgttggccagactggtcttgaactccttacctcaggtgatccacctgccttggcctcccaaagtgctaggattacaggcatgagccaccgtgcccagcctgtattttcatttttaaaattatttcttaaacaatctatctgttaaattgtgcagtaaattttttttttcctcttggtatacagttctgtggattttaagaaagctatagattcattcaaccaccaccataatcagaatacagaacagttccatcatccctcaaaaaacttccttgtcctgcctatttattgtcagccctaccccacctcacccctaacccatttcaaccactgatctatacttcatccttatagttttgtgtttttgagaatgtcatataaatggagtcatacagtatgtaatctttagagactggcttctttctctcaacacaattcctttaagattcatccgagtggttgcatgcatcaaaaactttttactgatgagttgcatttcattgtaggtatgtaccacagtttattatttcacctgctgaaggacttctgtgttattgccagttttctggcggttatgaatagtaccgtgataaacgtgtacaagattttggtaaacgtgttttcatttctctagggtagataggaatagaattgttagtacatacagtaattgtatgttcaactttataagaaactaccaaatccttttccagggtggttgtgccattttgcattcctactggcaatgtatgggagtttttgtttgttttttgtttgtttgtttgttttctggagacagagtctcgctcttgtccaggctggaatgcaatggcctgatctcggctcactgcaacctgtgcctcctgggctcaagtgattctcctgcctcagcctcctggtagccggaattacaggtgctcaccactacgcctggctaatttttgtatttttggtagaggggaggtttcaccatgttggtctcaacctccttacctcaggtgatctgcccgcctcggcctcccaaaatactgagattacaggtgtgagccaccacacccagcttgtatgggagttattattgcttcacttcctcctgagtgctaggtgttgtcatttttcaaaattttagccactaataggcacacagtggtattgaattatggttttaatttgcattccccctaaggactaataatattgaatatcttttcatcactttccatcattacatctttgacaaagtgtatgtttgaatcttttgcctaattttaaaattttgttgtttgttttcttactgaattttgagaattcttttttcagtttcattttttattcacaaaatattttctcatattcattgcctttaatctttgcaacatcctgcaaacattgttctaatattaattttgcaaagtcagagcagtaaaaattaaaaatgtagtctccaaagctaacagtctgggttcaaattctgggtttgtcacttattgctgtattaactttagcagcttgacttccttgaaccttgatatcctcaactatgaaatcatactcatacaaaacgatcattctcagcaaattatcacaaggacagaaaaccaaacaccgcatgttctcactcataggtggaattgagaaatgagaacacttgaacacaaggcagggaacatcacacactggggccttttggggagtggggggctgggggagagatagcattaggagaaatacctaatgtaaatgacgagttgatggatgcagcaaaccaacatggcacacgtatacatatgtaacaaacctgcacattgtgctcgtgtaccctagaacttaaagtaaaaaaaaaaaaaagaaaagaaaacaataacaacacttactgagtgcttactgtgtatcaggcatggttcagagtattttaaacacatcttaactcatttcgtcctcaccacagtctatgagttttgagaattctttatgcattctggatacaagttatttgttcaatatttgatgtgcaagtactttctcaagtctggggcttctattttcattctcaacagtgtattttgcagaacaaagggtttttattttaagaaaggaatattttgtcattttttttctctgatagattgcttttggtgacatgtcttaagaattcattaccgaaccaagaccacataaactttttttttcccaaaagttttatcattctggattttaagtttgtatctacgatctactttgagttactatttttataaggtgtgagatttaggtcaaagttcattgtttttggtatatggatgtccagttgttccagtatcatttgttgaaatatgatgttgttaccgtcctgctcaaaaactttcggtgctttctccattgcacttggaataaaatccagactccttttgtatggtctgtaaagcatactgctttcatgcctacttatttctgaaacctcattttgtgttgtattcccttttgtctgtcagacttcagcctccctggcttctcttttctgtgaattctcaacactcttttccagcgtagagcctttgcacaagtttgtgtcctcaacctgaaatatttttccattatgttgttcaatagttgccttatattggttcccctaagtttattttttattctctcccctggcattctgcccttttccttaatcatacttattacaatttttaactttatagttatctctaaactaatcactcattgtctggatttcccatgaaactgtaagatccatgagactgtgtttgcagtgcccagtactgtgcctatcctcataaaacttgctgtctagtgctgagatgtacaacgaaacgagaaactacaatactacaagaaactacaccattctgcatacatgccatttaagttcattcactatttctacatggactaaaatgtttttccccactatattttgtatacctgaatccttctcacccctcaagaaacagttccatcttccctctctgagaagttcctcctggtgcccagttcggaagagctcttcctccctgctttctactctcgtactgacactctccactttgccttgagatcacagagactgacttagctcttctcctagaaaatcaaaagcttgctgagagtgggattgcattcagcttgtgtctccctcagtacacagactagctcattttattcaattaattcattttctgatttctagaatacagtcatgtgtttagctatgggtccatcttgccattggaaactaacagagctgattttcagaacaaaaagagaaaacaaggccaaacttcaaatcatatctcatatttgcacagccaacacaggccattagagttttaataaatagcaaagacataaaacgttttcttttaacatatgctgggactcgactggtctcttgttgctttatttccccgcctggctcaataatagtcctataaaagtgacagaaaaaccatataccatgttaccttagagggatgactgagacagttacaaaaataggaagactcagatgccaaataaaacatgggatgtttggcaaaaccttagcatgaacatatgtacctagtccaggcgctctgaagttactggatgtattaaaaagaagttggtcctgccctgttttatgatgtaaaagtgtgtgtgtgtttgtgtgtgtcttgtttcattgaagtgaaagcaaatcattttgactgaatagtgacaaatattaattcataaaatagtttttagactggaaaaatatttgataatggatccaaatatgaaaataatgaaatataaaagtcaatatagtaccttacaaactgtagaaattatatctgagctgtcagttctagtccttcaaaaaccctgtcctctttgagtgagagatgcatccctatagaacatcctgtcctcagttggaaggcttggccttaagggcttattagttagtgggaacagagcaaactttctttatatcttaccacacagtgctggtcttagtatagtcttgtgtctgatttatgaatttctcctggaatgaattttccacaaatatatgatggggaactgtgtagccttgacattcattctgcccatgaatgtctttagtgttagcagctggcatccaggcatattccagtgactcaccaaccaaagctatatgttgccttctctacgtttgaaaaggggcagggggcggaccacagaacactaatcagattctaaagttgccttcatgtttacttaatatttctacactgctcagaggaagccaatatcagcaatattctttttgagatgacaaaaccttgaaacttttttggttatttttatagcaatagagtttttgttgacttagtattcatttttctgttttctctttattatttgacattagggcaactcttaccacagattaattgctcttcggggtacatcagactaagatttctaccatgttgatgatttgtgtttactttttaagtgtgatgaatattgtgtattacttgtttttttttaattctggtgaggaaataccaccaagtgctgttcggtgtttttcctcttttgatgtgtttgtggaaaactggtgtaaccaaaaaaaaagcacattagaggagttcaaaatggccctttagagagtgctgatttctatgaaatggatagatttttagttgtatattagcagtgatttgaagcaagtctttaccatacagctaaaagaagaattgaattttcttagctatgccataaaagtaattacctgccagataaaagggacctcatgttataaatagtagaaactcaacattttgttttaaatcttcattttctaatacgtgaaattatctgaactaatctatatggtgtaggttcagttatgtatcagcttcagatatatcagttatatatatgttaacccacaaaaagaatatgattttgaaagccataagaatccatatctgtgtctcgtacaggaaaacaggaaggctgaaatggaaagatgcttatagaccctaactcattgtctcatgaaagtcagtcctcttcatgctatggccagggagcagtgagggttgtggtgctcaggatagggaattggagaggagaagggtacattatttcctgagtcatcttgtttcactttctgcctatctctcaatcccaacacacaccatagacgtgtgcacacgcgtacttacacacacacacacacacacacacacgcgcgcgcgcgtataccagacattttccttccccatccttttaggccctgaagtaataaattactctgctggagaggacgggtaaattcaaatagcacactccttccattcagaatatcttaatgaaatatcatacttttcccctcacatcaaaaaagacagaactttttgtgactaaaagttaatttcttaagccaaaagaaaatttctggaagcagtcactcaggaagtttcctaaaacatttatatgctaagatggtaaacgatgggatttgttgtccctttgttagcaggaaggcatgatcttgagcagcttcaggtccatcaagatctttcccaagtgagaacgcaatgggcttttctggctgtaagttgtccattgcctctgctgtcattggagagaaagaaaccaatcacctgctcgtgttttttcaaattacaaaatccattcttacattgtaaaaaaacaggctgctgctgattttggctcacaggccatagtttggatcccttatctattcagtatactaagtatctgttcatatcaatatattattcttgattatatgcaatgactacattcttgattatagtcaatggatatattcttattttcaacattttaaggaatgtttaatttgtaaaaagttaaaagtcacagaatggtttaccattcttatgaataaaaacagaatttcaggatttcatatgaatgtttctagttcatgctaatttaataatacacttttaaagaatgcattttctaatttttcaatgatttagcatgttttcagattttatcaccaatatcatcaaatgacttatttgccaaatttaccattttccccaaacttatatctttgaactctgataaaacttaatgacttagagtggattgaaatattttaacagtttttgaagatacttaggatatattgtgcttggccaatttttctattaacattttaggaaaggttccatttgtctgtaccccaggtcccttactgctgcagctgaattgagcaggggacaagagaggggaacttgcaatggggaaaagaaacaaaggagagccagcatccagcacagcttgggcttccaacccctgaagttgggttgggaggaaactggagtccatgagagaaggaaatgaggagctaagcaggtgtctgaagccctcaggactctgaaatccttccttccaacgatagtcttaaactctgccaactcagcatactgcaaattttatgaatagcttaaaaaaacaggtttttggtaaatcagtatatttggataatttgacagattgttactttgattcatgttcattcagtccatttgtctcctggcaagttggcttttggaaaatttcctattagcagattgacttgggaagttggtatgcttccatactgaaaagcagtggctttccagaagcaaaactaagaaggagccaggagttggtcaagattgcatccttcctggaaacaatagtgtgcacaaactacctggcaaagttggtaatagctcataggtatctgcagttcattctgtgggggatgttagtgggttaagctgcggtgtgaatatacagtgatggaatggatcttaacatatgagcctatcgatttcaaagacatacacattttggtaatagagacaaatggaggcatcacatgcctctatcaaaacatttcatgtaccccataaatatatacacctactatgtacacacaaaaataaaaataaaaaataaaagtaaaaataaacaaattagggcatattggacgtgtgacatgacaaaatcaaggcatttctggctgggattaaacaaaactagagattattttactactccctagtggtgacacaactattgcccttactggtataaggagttagcagactgggttcatattctggctttgtcacttactggttgtgaacttatatgttattcatgttataaagctttattttcctcatctataaagcagagatgataacagagcatatgtcattgagttattgtaggattcagaaaggtaatatgtgtaagatacagacccctgggtaggaacttggtaaatgatagtgtcttttctgtcagtcagagatgagattggtcgtgggtagggagtatggttagttagcatttaccttaagattattgagggtgatgatgaagcattcacttcaagttactgatattctgaaccgatccaaattacatccattgactatctgcctttagccaaggttcctaaaatgaactaaattcatcttcaaataatgtaaatctattaagacgactatctccaattatttatttaataaaaggtggctatattgaaagagaaggacctatcaaatatttagaaggcagtgtagttattttgtattcggaaggatcaggatttgtacattgattcagaagatatttacaagtgtacattgtatgcagagccctgtagccacagaacacgcttctcttctccccctcaaaggagggtattggtctaggtgatctacagcaatagcaacattcccaactctctcagtgcagtttcaagtcacaaaacccaggctcttgatccctagtctgctcatcttaacactagagcacctgcttcttggctccaaaggaatagagaaatgatagtgcatgcagaactcatcttgcaggaagacgttttctaggagagagaattaaaattacaaaagaacaattgtaaagcaaattacagtattatgcctctcaaatcatatagttaagtggaatagaaacttagagacatagggtggtcaatgaaagaatggctaatgagggcatttgaactgaccacacttatggggactgtacagattacaacgtaatttttcttttttttttttaatttttcagaattttgttttcactttttgcatgtggagttgagaaaaatatttttccagctttatttaggtataattgaccaatgttgagggtatgtgaccccagcttctgttcaccttccatggcttgcctagaatactgaataaaatagtgggaggctggggcaaagagaggctgtttcaggcttaattcccagggagccacttaacaggaatcctcttctaagaacataatgactcttcaggagaggtgggctttggagctgctagtatctagttatcaaggatggctgagatgcagttggatttgaaggaaaagatgatacctgatccttgactcaagattttacatttcagacagggcatggtagtgggcttcctctgagagcctgtagacaagccttggttagagtaaccttaaaaattagctccataaactttgttcataacctgcaaccaagaagggaaatctggttttctttccctccatcacttcagattatatcatctcagctgtaaattaagtagggagagacatttaggattatatttttactgtcatcagtttcctgactctctgccacaactgttcaaaacacaccttagtttgtactccattgacgtatgaaaggacagtattcatttgacatctttttcatatttacagtttcatttatacagcaagtagaagtagatgatattttaagccaagaacaaccttgcattaaagtaattcagcagtgttgagcactttaccaatggatatcaaacctcggtaaaatatttaaaatgaagagagagaagaaacatgaagggctcgatttaagagtaatattttgagattttacataatgagacagaggtacttttctttgtagaattaggtgttatttttacgtaactacaactggcaaagtgttctttgatctttctccttatttttaaaaattaagtgatacaatttggacaaagaaagttgtgcttgtatctgttcctaaccaaaggccagcagtggatatggctgcaaaccctctgttacatgttatatcccatatcctgagcccaaactcattatttacatgcacaaactagttaggtattaaatattccctaatgtttttatttaaaattgtaagtgcttctctgtgacttttaattgtgaggtgttttttgttttgttttgttttgttttgttttcgggtctcgctctgtcatctaggctggagtgcattggcgtgatcacagctcactgcagccttgacctccccggctcaagtgatcttcccacttcagcctcctgaatagctgtgaccactggtgtgcaccgccacatctgactcattttttattttttctagagatgggatctcactgtgttgtcctggctggtctcaaactcctgggttcaagtgatcctcccaccttggcctcccagagtgcctgtgacttttatgttctacatcaaatatttgccatttatactggcttatggagaggcacaaaatgtaaattcactgaataatttggaaaatatttacttgtatttatattcttgatatttaagtcggtggatttgaaacaaaacatacttgcttcacaacatattgctgtcaaagagttttgtccagtaaaacttactgcatcctttaatacagcactgtccagtagaactttctgtgatgattgcagtggcctataatctgcttcatccaagacggcagccactagctacggagcacttgaaatgtggctactgtgactgaagactaaattttaaattgtatttaatttaaattaacttaaattttgatttagccacatgtgtctagtgactgccatattggacaatgcagcaagcaatatattcctatgttgtttatctcagatataaagttatgcactatttagaagccaatataaaggtattagattgcttttaagcaacaaatagaagctccagcttgttcattaaaataattttgtcaatccaggcagacttgggatgaaggatgtgaaaacattttgattgaattgactactaagttttatctgtttattcctttatttacttagcaaatatccattaagcacatagtaattgctctccattgtgtgaagtgcctgggatacaagaagtttaaagcatgttcattgccttgaagaaattaaccaggtagaaaaagtagatagaaagtaataagaaacattcatataaggcagaagagagttgagaaagagggaagagtctaggatgacttggagatttcagtcttgagtgactgggtggaaggtggcactgttcaccaagtaggagacactggagtggggaacaggagtctataccatgttgaattgaggttagatgcccacatgcatgtgctgaaggcagttggatatgtgggtctacagcttgggaagaggtcttgaggtagagctgtgggagtcacgcatagttgaagccaagggatacgacatggtctgcaaggcagataatataaagaaataacagaactccaagagcagccctgaagaggtaccagcatttatgatgtgagaaaacattctgttagactaacatagcttataaatttagtcggaggttgaaaaattattttaaaaatatgtaataatataggaattttgtttttaaataatatgtgggcagatttacaagtgactccatttatgtttgtttcatgacactgaaaatcaaaccagtaagaaatattttatattttacatattttatattttaattaaattaatattaacaacataaaatattaataaatatatttaattaaatatatactttttatatattttaaacattctgtattcgatatagtccagttatacatgcaaatgaatgacttaactcattaactagttgttttatgctgtgcaaatcagtacttcctaaatattacgtattttggatatccgaaatacatttttcaagctcttaattttttagtgttagaaataaatgatataaataaaatggatttttgtcagggtcctctgaaatacataatggaaaatttatctccattggatcagaattcactttttgaaatcatgtggcataacccaggttttctcttaattatgtgtcttctgaatatgcttggaaagttttatatatatcattttgccactgtcttgctgctctgaggtcttgttttttataatatttattatcagactttaatttctcattttgtggagtaataggggcttttctaaagaaaaactcgtgaaaacaaaatacatttcaataacagaatctcagttatgaaatttttaaggcttgaaacactattatcaatattagaaataagattctcattcattcatattttctcacccatacttaattggtgaaaagtaagctagtatttcgactctagtgtgccatgaagctgcatctcaccctgggcaaatttctatctaattttgatagaaatgaattgttaatgagccccgagaatggagagtttctctaattacaggaaacaaaattaaattgggcctaaaggcatttttttttttgtaattgcagttggtttaaaaattgaaaaagaatattcactcaaacaccttggctttaaaaatattggtttgctccccactgttaaaaaggcattgagacctgcagcaaacttcattctaatgagggtccagatgatttttttttttgtagatgtgtagaacaactctgtgggaaaaatgatacctcaaagattaatgatgttctgtagtagggaaaataaaacaaatagtttttatttgaacctttttattgtatgatagaaaattttgatttaaatggcgagtgagatatgcttaccatctctcttttttcctatttatagtagctctcaaggtcaaagaggacacactagcatgaaagccgtgtacgttgaacccgctgctgctgctgctgctgctgctatctcagacgtatgtacattgaggaccatagactacaatcttagacccttatccgtgtgatgttgattatttagttaatgtgtgttaccaagaagtatgtcatatggatgtgacacatgagcagtgttccacagttgccatcttgtagacatttcttattaggagccagtaactgccagacttcgaatggtccctgtagtgcttgaaaaagaattaagctaagctgtatcccagatgttgttcagggtctttttgccttgtgagtacatttcataatggaagtttacttactgacctgcctggtgtagaaagccatgaaggctagaacctagtgcctaattagcctaggttgtctgcatccgttctctaagacaacgaatgtatcatcaatttattcattaaccagatatgactagaaagaatccttaagggacatacattaatagaaatctacctgggtctaccctcagtgatctgatgaaactctagactgggacataaaaccaaactgcaaggagagaggtagagaagaacagaagaggtatcccagaaggcatttcccacgttaaaaagtgacagggtggttcctcaccttacatgccactctatgggtatatgtaccatagctgataggctggatcaccacagtggtaacagtgctacagagagaaaacatgaccgagacatcagaagacaagggtttgattcctgattctgccacttaccagttacatggcctggggaaagttgttttaccttggacagcctcagtttcctcatctgtaaaatggaagtagtaataataatctctgccaggctacctcatggggatataataatgctcaaaggaatcttatcgggatatttattttactcctataatagaatgaaacctctgtgagaggagagatcattggctgtcttgttggtcagcatatccccagtattttgaacaaggcttgttacacacagtaggcagtcataaatattagatgcacaaatgagtactctatgttaaagcactctgttatttttatagaactcttcaaatatttggtaaagggatttcaagagcagtatagacaggctgcatgcatagactctaactttggttttcaggcctccatgtgttttgcctgaatgaatttgtactgggatcagtgcagacagcaggtcttttcagtatttaagttcttctgtaatatggagatgccatgagcacatattttaaacatgaagtgctgattttgtattgaattgtccaagtattgctcatttaacaaagtatgtctatgtgaataaaactttctccattccgaataagtacctctgcttaacctaatattctgctcaaagaagtatgaaacaaagaggaaataaggtagaagaatgctaatttagacagagcagtgttctgtttacacacaaactaattacaggtatgctgggaaaaggggccaagccaaccatatagctctagccatcagtgtaacatctacacagttgtcaggcttgcttcatcagcccgtcagtaaataaatatttacccagggtttatactgtactgtgtgtgaagaatccagagtccctaaacttagtatatgttgaagaaagctggattaaaatattctcattttataaaatatataatgcctaagtaattataatatttagagaaaagtgggctgtttaaaaaaaaaaagaaacacataatcccactgctgtggcacagctgctatttaattttgcttattcccattcagtcttagtccaccaacgtatatatttttcatgtagttacaatgaaaaatatagcttacattctactgcatacccttggcttccacttatcactaagttccatttttttcaacagtcacattgatcattttttaaaactgtataatattccatgaaattgtgagacctgcttccagccaagatggagtgagggggccaggttaacttgcctacctgaaacgggcaaaaataaaacagacaaaatatatgacacaacagttttcatgataatggccagcaggcagcaaaggccatggattcttgagcaattggaaatcaatgagaggagcttcacagttaccagagcttactacatagcaagtttctaggccacattgcagagagggagaacacatatggagcccagtggactgcccgagttgagattgaggtgagagtatagggagactaagtttgctagcggagtcctagagaagagagagctgcatggagaaagaatgccagagatctgtgaggggccccctctagtattcagcagcatattgattggcatattcacttgaggaagctacttgaagtggggctaggggaaaaccattccagaggattacagagaacaatactagtactcacaaagggttagtaacagttcttgttcctaccagccatactggaaatcctcataacacacaagacattaagtgagagtacatagaaatgtcttgcatcaggtgtggagaaaaattaaccctaatgatatggtttggatctcctttttaattgactctgtcccaaatacttctcttaatgatgagtgtaggtgacttatgttagtagccacccacattctgccatccattcctagagacaggttgctccttagccatgttacactaaacaggcatgtttggcagaattgcagcttgtgcattatcagattgcttttgcacccaaatccattgtgtcaggaggtggcaggtggggtgggatcttcagaagcagctgtctttgagcatgaaccaagagctaggtaggacagaagcagacaacacagaaacagtcggctagagctgattacttgcaaatgagagtccaggacaaacctgatttagggaataatcatgagagcatcttgcactgattttatacctactatggtaggcatttagtcatttattcattcaacagatacttatttaagattctaaaaagtagtcaaagaaggtcagccctgaaaaagaataataacactgaaaactaaactgtattaagagcttcctatttgtgcattttactgggtgcttaagtcccacaacagacctgtgaggcattatcattccagttttacagatggcaaatctcagagtcttgctattgaataagttgcccaaagtcacacagtaagtgtcagagccaggattcaaacccagatctgtctgatctcagtatctatgtctcttactgcccaatgaggcgtctacttttaaaactattttgtcatattgtcctatttgttgcatggtttcccttttgttctttatatatttgaacattttaaatgtgtttatttttaaaggccatttctgattccttcatttactgatttattgaacaagtatttattgaacacctaccagataccagacactgttttaagttgggggtggattcatcagttaacaaaacagtgaaaaattgttgctctagaggaacttacattccaacagtgagaaacagacaataacgagatgaaaatattaaataaagaaatcattgattagaaggtgacaagacttaggccaggcacagtggctcatgcctgtaatcccagcactttgggaggccgaggcaggcagatcacgaggtcaggagttcgagaccagcctgaccaatatggtgaaaccccgtctctactaaaaaatacaaaaattagccaggcgtggtggcacacgcctgtagtcccagctactcaggaggctgaggtgggtgaatcacttgaacccgggaggcggagattgcagtgagctaagatcgtgccactgcactccagcctgggcgacagaatgagactccgtctcaaaaaaaaaaaaaacaaaaaacaaacaaacaaaaaaaactcaacccaacccaaacaaaagagaaggtgacaagacttattgaaaagatagaacaggatgaggaggtttgggaatgcaagaggtcggggagtacagtattaaatataagcaatgacttgaaaaaggtgagaaagctagccatgaagacatctatggtcgggggagactatttcaagaagaggaaaaacttctgcagggttttggaggtggaagcatgcccagtgtttagaggaataacgagaaggttagagcagctggagcagagtgagcaaagctgagagtaggtattgatgaagtcataaatgtaaggaggtcaggttgagtaaggctttggaagccattgtatagattttggctttaactctgaatgaaatggagaatgattagagagttttgagcagaagaatggcatgacctgacttgtttattaaaagagtcacagtgttgagaatagactgtgggaggaagggcaggaatggaagttaaggagtccagttaggaggctatcccagcagtccaaatgagagatgataatggcttgaagcagggtggtaaccgtagaagttatgagaagtggtcagattctgaaaatatatatgtgtgtgtgtgtatatatatatatatatttttttttttttgagataaagtttcgcccttgtcactcaggctggagtgcagtggtgccgtctcggctcactgcaacctccgcctcccaggttcaagcgattctccagcctcagcctcccaagtagctggattacaggcgcatgccaccacacctggctaatttttgtattattagtagagacggggtttcaccgtgttggccaggctggtcttgaacttctgacctcaggtgatccacccgcttcggcctcccaaagtgctgggattacaggtgtgagccaccgtgcctggccttctgaaaatattctgaaggaagagcccttacatttgttggcatttgatgacgggtgtgagaaaaagagaggagttagggatgacgtgagcaactgggaggataatgttgcattaactaagatgggaaaaattatgggaagaactcgcagcttagggatgttttcttccttctttccttccttccttccttccttccttccctcctcctccttcttcttcttccccttccttccttctctctctctctttctttccttccttctttctttctttctttctttctttctttctttctttctttctttctttccttccttccttccttccttccttccttccttccttccttccttccctccctccctccctccctccctctttctttctttctttctttctttctttctttctttctttctttctttctttctttctttctttctttctttttctctctttctctctttcctttcttctttcctcctttcttctttcaagacagggtctctcactgtgttgcccagactggaatgcagtggcatggtcagctcactgcaacttctgcttcccaggctcaaatgatcctcccaactcagcctcccaagtagctgggactgcaggcacacactgccagactcacctcattttaaatttttttctagagacagggtctcactatattgcccaagctggtctcaaacttctgggctcaagcagtcctcccacctcagcctcccaaagtgttgggattataggcatgagccattgtgcctagccaatggtgttttctttggggggaggagtaatatcaaggacttagttgtgaaaatgtttatgactgagaagccccttagacatccaactggagatgtaatacaggactggaaatttgaatttggggatcatcagcatggatggtcttaaagctgtaagtctggaggatggacactaaggtagatagcaacaaggaccaaggactgagttttgaagtacacccaaagttaagagattaggggaaaaaaaggaggaattagcaaaagagacttacaagtgactagtgaggtagaaggtaagcaaagtgaagaaagtatttacaggaagaaggaatgatgaacaatgtcagctactgctgatagattacataggttgacaattgagaagtgaccattagagttaggacctgtaggtcattgctaaacttgacaaaagttttggtggagtatggtggggttcaaggagataatgtctgatgagagtaggtttaagagaagatggtggaatggtggcaggtaaataagagataagatatagagatgatttctaaactcagggtatttctttgttttgatttttgtttttctttttattattattattatactttacgttctagggtacatgtgcacaacaagcaggtttgtcacatatgtatacatatgccatgttggtgtgctgcacccattaactcatcatttacattaggtatatctcctaatgctatccctccccactccccccaccccatgacaggccctggtgtgtgatgttccccttcctgtgtccaagtgttctcattgttcaattcccacctatgagtgagaacatgcggtgtttggttttttgtccttgtgatagtttgctgagaatgatggtttccagcttcatccatgtccctacaaaggacatgaactcatcattttttatggctgcatagtattccctggtgtatatgggccacattttcttaatccagtatatcactgatggacatttgggttggttcctagtctttgctattgtgaataatgccacaataaacatccgtgtgcatgtgtctttatagcagcatgatttataatcctttgggtatatacccagtaatgggatggctgggtcaaatggtatttctagttctagatccttgaggaattgccacactttcttccacaatggttgaactagtttacagtcccaccaacagtgtaaaagtgttcctatttctccacatcctctccagcacctgttctttcctgactttttaatgatttttattctaactggtgtgagatggtatctcattgtggttttgatttgcatttctctgatggccagtgatggtgtgcattttttcatgtgtcttttggctgcataaatgtcttcttttgagaagtgtctgttcatatcctttgcccacttgttgatggggctgtttgtttttttcttgtaaatttgtttgagttcattgtagattctggatattagccctttgtcagatgagcaggttgcaaaaattttctcccattttgtaggttgcctgttcactctgacggtagtttcttttgctgtgcagaagctctttagttgaattagatcccatttgtcaattctggcttttgttgccattgcttttggtgttttagacatgaagtccttgcccatacctatgtcctgaatggtaatgcctaggttttcttctagggtttttatggttttaggtctaacgtttaagtatttgatccatcttgaattaatttttgtataaggtgtaaggaagggatccagtttcagctttcaacatatgtctagccagttttcccagcaccatttattaaatagggaatcctttccccatgtcttgtttttgtcaggtttgtcaaagatcagatggttgtagatgtgtggtattatttctgagggctctgttctgttccattggtctatatctctgttttggtaccagtaccatgctgttttggttactgtagccttgtggtatagtttgaagtcaggtagcatgatgcctccagctttgttcttttggcttaggattgtcttggcaatgcgggctcttttttggttccatatgaactttaaagtagttttttccaattctgtgaagaaagtcattggtagcttgatgggggggatggcattgaatctataaattaccttgggcagtgtggccattttcacaatattgattcttcctatccatgagggtagaatgttcttccatttgtttgtgtccttttttatttcgttgagcagtggtttgtagttctccttgaagaggtccttcacatcccttgtaaattggattcctaggtattttattctctttgaagcaattgtgaatgggagttcactcatgatttggctctctgtttgtctgatattggtgtataagaatgcttgtgatttttgcacattgattttgtatcctgagactttgctgaagttgcttatcagcttaaggacattttgggctgagacgatggggttttctaaatatacaatcatgtcatctgcaaacagggacaatttgacttctcttttcctaattgaataccatttatttctttctcctgcctgattgccctggccagaacttccaacactatgttgaatagcagtggtgagagacggcatccctgtcttgtgcgaattttcaaagggaaagcctccggtttttgcccattcagtatgatattggctgtgggtttgtcataaatagctcttattattttgagatacgtcccatcaatacctaatttattgagagtttttagcatgaagggctgttgaattttgtcaaaggccttttctgcatctattgagataaccatgtggtttttgtcattggttctgtttatatgctggattacgtttattgatttgtctatgttgaaccagccttgcatccctgggatgaagcccacttgatgatggtggataagctttttgatgtgctgctagattctgtttgccagtattttattgaggatttttatatcagtgttcatcagggatattggtctaaaattctcttttttttgttgtttctctgccagactttggtatcaggatgatgctgggctcataaaatgagttagggaggattccctcttttcctattgattggaatagtttcagaaggaatggtaccagctcctccttgtacctctggtagaattcgactgtgagtccgtctggtcccggagtttgtttggttggtaggttattaattattgcctcaatttcagagcctgttattggtctattcagggattcagcttcttcctggtttagtcttgggagggcgtatgtgtccaggaatttatccatttcttctacattttctagtttatttgtgtagaggtgtttatagtattctctgatggcagtttgtatttctgtgggatcggtggtgatatcccctttatcattttttattgcgtctgttagattcttctctcttttcttctttattagtcttgctagcggtctatcaattttgttgatcttttcaaaaaaccagctcctggattcactgatttttttggagggtttttttttttttaaattctgctctattttatgtagcattttctccatgtctgtccaatctgctgtcttgattggaagccctatggcctttcccccaccacttccaaaaaagtaaaatgcaaggatctcctaaaaattagagcactttaacaataagccaccacagggaaaatgcaaagatttgggaacagacttcttgaatgccctcttccccctctccccctacatatttgcagtttacataaccatcaggtattggagtttgcatttgaagcctactctatatccagcctcaaaacccatgcctctcttttcaaatcctttagcacactattcgtggagacaattatggaataaaggtgaatccaaaactccactgaaaactgtaaaagcatgttgattttcttcctatctccatgcatgcattttcaccttagtcctaattgcattttaaactgttatctttttgcttccaaagtagtttcttggctttgttttttccaggccaattaccattactgcacatgatgctgtcatttaagttaatttaagctcactgcatttatattgataagcccgaacatacgaatacccaaaagtggacatcttaattaacatttgagaatataagtttatgttgaaaataatccagaaagcaaagagttagtgattaaatcgatagatggctatgaagaagaacagaaggaagaggaaagagacaggtcatatctcctcttaatgaataccgattcaccataatgtcattgtaagtaatgaaaagattgtcacatccccagcaacatatcacttattagggagtataaaacatagtcatttgaacagtgaggttgcacagtttcctgaagttgaaatgctgggatgtgatccaacaaacagattctttgtagaaaaatcaccatgggtctgtgtcttaagccaatccagaacaaaagcaaacaaaatattttgtcagggatgtaaaatatttcactgctaaaccaggtacttaaatttcaatggacagtgatccacagactattcaaaaaggattcagttgttcaggaaataggacaggatcactcaatagaaatattatgtatgtagtttaaggcaacaaatggcttaaaggtagccaggcttaggaaaaagagcattgggtttggagtcaatggattctatctctcactctgctcctgtctgtctgtatggccttgccctctttgacactatccagtgagaacattggactagaagctcttagaggccttttcacctctctgcttaaaatagttttgctaataatactttcaactttaatctgcctaaagacatgcaatagttgttaaacagcccctggttggccttttcttgctctaagcctaggatgcaagtgcaggaactctgggaaaatggccttatcagtggtggtgcaggtctcccactgctgtcccatttctctgtgaaccagtttgtttgggtctaataatgaggaatgggagatgaggtgactaccatccttggcaactatcatgacagcatcctactgacaccactgaaaggcagaattgtttttgccatgccttttgatctataaacattttttgatgcctttatttttagtgttatgtatactgtgtttctcttcttcagtttgtcagtgtataccttgtggcatctataatctccgcttgttatcttccagcaatatttttaaggaggtatttgatgatgatttttgttaggttttcagttgattgcagcagtgttagaaattgtgatgtgaaatgcatcaaagtttgtattctgcctgtgtttcctattctttctaactccaaaatgcaatgtcctatctttctcttttggaaatgtacaggaccaaattgatattgcagaggttgagcagtatggaccacaagaaaacgttcacatgtttgtagattctgattcaacttattgctccagtacagttttcctggatactatgcctgaatctccaggtaggtacatttatgcatttggatagggactattagaagaaaaacagtgacccccagggtagttacagtttttcaaatgaatataatgctctataatactgtgaaatcccagagtgaattccaactttcttcatcttctgtaaatatttgagatgatgatttgagaataataaaaatgagtatttcatcacagattcaagtcttttctcctatttaattttaatcttctaaaaattggcgctggatctcaatccttgaaggaatagcgttttatctttttatactcgtgtagtctattctgctatcacacagtatttggattccaaagaaacctcttgttattgagttttcatgccaataaagggggaaagtgagagtctctcaaaaacagtgatatttctttaatgagtttcaatattaaagatatttcgtaaccgtaattgtttgaaaagtacaaaacttaaggaaatggtggatgcataatacaaattatatctcctaattaatcttatcataaataattggtatgtggaatctccttatatagaagtaataagctctattttaatttttatttcactctttttcagtttttaaatccagttttagtatctccaacttttaaaattcttagttaacaacttttccattgttgctgtcaatctcaaagctgtgtttaaaaaattccttccaaaacaattgatttttggcaggagaggtcaaactccatgaactcataattgtgatttctaaaatttataagagcattgattgctttaaacctatttatctggacctaccattgtaactttgctatagagaattatttgtattcactactgttaagccaatgatggagaaatccttataaccttccacagatgactgttccaacaaaatgagcatattgaaatggctagcagcttatggctgatatggtagaagtcaagtaactcctgggtttctcactatcacttacagataatttagtagctttgtttacttggaatcagaaaattaaaaaatggtaaactgggccgggcacggtggctcatgcctgtaatcccagcactttgagaggccgaggtgggcggatcatgaggtcaggagatcgagaccatcctggctaacacggtgaaaccccgtctctactaaaaatacaaaaaattagccgggcgtggtggcaggcacgcctgtagtcccagctattcaggaggctggggcaggagaatggcatgaactcgggaggcggggcttgcagtgagccgagctcttgccactgcactccagcctgggcgacagagcaagactccgtctcaaaaaaaaaaaagaaaaatatgctaaaatgatttggaaaatggcttttagtggaaaaaagagttaagcagaagaatttagccaacagtctaaacactggaagtatccagaaaccagaatttttcaaaatattttcaatggtcatcccaaactcatgctatgattaaaggacaattcgctcatgaccatagcatggtaaggtatgcaaccccaggctgcagaaagcagataggaagtgacggagtggttcattctgcctaatccagatgtttctcttttccaaacttttaatcttgaaataattttggacttgaagagttgcaaaaatagcacaaagaaaaaaatagaaaaataagggaaagataccatttaggataaccttcatttagcttcccctaatgtaacattttacataaccacagtacagctggcaaaactaagaagttaacattgatgcaatacttttaagtgagcttcagcctttattcagttttcccagaaagttgtttttctgttccaataactaatccaggatccctcattgaatttaaataatatgtgtttttagtttcttccagtctttgacagtgtctcattcttgcttttttttttttttatcatccgatacttttgaaggatatgggccaggtatttgacagaatgtccctcaatttgggttcgtctgatgatttttcaagatgagattgaggtcttgcattttggggaagaataccacagatgtgatgtgccctccttagggcatcatatcagaatatacatgatggtatgttttattgctggtggtgttaacttgattgcttggttaaggtggtactgttttcccctttgtacttatcaaatatttgaggggagctacattgagaacatgcacataatgttttctgtttctccttaaactctccttcacatttagcatcatcagtggaattggcctacagcaattacttctaatgccaattttttatttccctcgttttttgtatatttattaactgcaatcttgctgtaagaaagagttgttccttgtctctctttcattcatttattcgtacattcatttacatcaggatgaatccatgggcatttttttattatttggtttgcaatccaataccgtcattaaaaaaaaattgttccagctttggctcatggggctcttttaggttggctcccttgtccttttatcatgtctgcatctttttttttcccttcacttccttatttccattattacatgttgtcatttaaatcaaccccttctttaaggaaccttatttaggtcctttatttggagagtggtatttagaaacgaagatctgggtgctagttgtactcattgttacaggtgtgtcactacttctaaaccctctcagtggactaggaaagatgtctattcatactaacccatgcaaccatatacaaccatctgtatttatttcagcatgtaacaaccaacaacaacaacaacaacaggagttcattgatagttcctactccagcccagtatcatagggttcattctagccttttctgtctgcttatttgtaatttgtatctctgacagtgagaaatctggctttcattatctatggtatatttattgatttttccaatacataaacattcataaaaagtagtttcacaattgctaacctgtaccccttaaggaacaaatttaccatttggaattaatttgtgtgtgcattttttttgtctttagctttgcagtatccaggcaaacctctgttttctgaagttcctgcgttagcttctttatttctcacccccatcactgtggatatgtcatttatctgtaatagaattagattcatttgttacagtctgtattttcgcctaggttttcctgcctcctgatcaatttcttttcaattttatatacagtaaaattcactctttgatatatacagttctatggattttgacaaatgttgagagtcatgtatccatcaccacagtaccaaacagaatagttccatcacccccaaaattcctttgtgctccctctttgtactcaacctttgtctcccatcccctgacaaccactgatctgtatttcacctctgaaggtttcccttttccagaatgtcatgtaagaggaatcatatgacatctagcctttttggtctagcccctttcacttagcaaaatgcatttaggattcatccacgtttgcatgaatcaacggttcattcccttttattgctgagtaatactgcatcttatgaatatatcaggttttaaaacttcattcacctgtaaaagaacatctggattgtttccaagtgttttttgatcatgaataaagctacattaaacatttgcgtagaagtttttgtgttgtatgaatataagttttcaactcctggttgcgggactgctgggtcatttgggaagtatgtgtttaactttattagaaactgacaaaatgttttcaaaaatgactgtaccattttgcattattcaaataatgttctccactgtgcttttcagggctgttgaaaccaagtcatgtcataacacctcccagagaactttgagcactcccgaggtcccacattctgggcaacccgattgtgcagaagtgatttatgactagattttatttggttttatcggttggatggtactaaatctccaaaagcagagccaaaataattttataatgaatgaaatgacactaacaaatgcagtgggtttaggcactagcttaagctggagggtaggcagtggtaacttcaaacactctctcccttttcttcattttcaaatatgaacagatttttaaaataatattctgaatgattcctggcacctggcacatctcatccttaacatgggctaaaatgaccctcgtacagtctttttgataacattagtacttttgctttttaagtcatgaactcccctgtgctttcttcctcagccttatccttgcaagactttcgaggtgagcctgaggtgaatccattgtacagggcagacccagtggacctggagttctcggtggatcaggtggactcagtggaccaggagggcccaatggaccagcaggacccagagaacccagttgccccgttggaccaggcaggcctgatggatccagtggatccagaggactcagtggacctgggggctgctggcgcaagtgctcaggtactctgaaagtctcgcttcactcgcttcacgtttgtctggatagctaaccttgcaaagcccaaattttcactcttgtgaccagtttcacttcacagaaagtatgtttgttactttttcaaaactatatcactatttctgttatactggattttcagatgccgttgagaactcaatggaccctcacaaacagggagattggaggttctctaagtaagaccaaatccctgtgctcttcttaatatgaaatcccatggacactttgtacttgaggaaaagtttgagccaaataagaagcttagctgctaagaaaaggtggtatttttaagagccctgcttttaatcacctgtgagagcatgctaaccatctagagggaagacaactttctggccttcccataccaaccctctccctgcaccacaagctaggttttcccagtggaatttttattaggttagaacatgcatttcagagtcgttagatatacccaaccttgaaacatcagtaccaatgtacagtccacggccaaatcaaaatggttggattaactactgtgtagttcctctaccctgaaatgtgtgtacataaccacagatttcgatgatcatcttttatattagacaggattattaaaatcaggattagaagccaagctaatgagttgatggtcagttacctggaattgtgtgcgttcatcactgagcctaagattgagtgactccggttcaaaaggatcctcatccagtgaaaataattaagggctagaacacaattgtttgagtttggccccagcagtgtggccttggcaaattactgagcctcagtttctccatgttgaaatggtcttgccttgcggggatttgcagactgctgtgaaaattctttgagctatttaaaaggaaatttctgtgaaaatctgctgtggcctgatttatgtccttatcatgccaaaaagttgtggtccccctttcactgttgacaggtttatcttctcttttgaattaacttgtaattaaattttgaagtataacttttaaaaaatcaccaaaataaccagcaatgaacgtgtgtcatctggctctgcatgtgctagtgtattaggcttattcctgggtgccatgtatcagcaacctggagtgtatccagaagatggagaccaggatgaggaaggggctggaaaacatcttaatcagttgccgaagacactgagaagggaagaatgggaagggacaggacagctttatccaagtagttgaagggtcataaagtggaagatatggttccagaggatcaaggaagcagtctgacactattagcccttctcagacggattaggtcacctctcaaaatagcaagtcctctctccttcgatggagtggtgagagtcaatgcttggcagctccttttccaggaaaagcaaagaaaatttctgcttggagagggtgagaggatgtgataacctgtagggtttgtctcttctagtcctgagtttagaggggtgtgtgtgtgtgtctgtgtgggtgtgtacacgcgcgtgcatgtgtgtgtgtgtgtttttttttttttggtctaatgaatgtctgctttcttataggaagagacatacaatacatagtgaaagaaggacaagttgaacaattttcaatggactaaaaatacatatataatttttattccaaataatgaaaacaacaacttgtagggtattctctctctctctctcaactcatctatgtacttacattactcataaagggtattgatgaaccacagtataagtctatttttggtttctgaaagttgcaagtgtaggtacctttttcttatcattaatgttgtaaattctttatcgatcaggactgtggctctctgaccttgtttatatgcatggtatccagcatagttcagggcaaatagcaattgttcccaggcccgacttccagccttgaaagataattattttccaagaatctcatctcttttctgtccctctcggccaatcagttgagaagtctcatccacctttttttttctccttttttttttaattatactttaagatttagggtacatgtgcacaacgtgtaggtttgtttcatacgtatacatgtaccatgttggtgtgctgcacctattaactcatcatttaacattaggtatatctcctaatgctatccctccccactccccccaccccatgacaggccctggtgtgtgatgttccccttcctgtgtccaagtgttctcattgttcaattcccacctatgagtgagaacatgcggtgtttggttttttgtccttgtgatagtatgctgagaatgatggtttccagcttcatccatgtccctacaaaggacatgaactcatcattttttatggctgcatagtattccctggtgtatatgggccacattttcttaatccagtatatcactgatggacatttgggttggttcctagtctttgctattgtgaatagtgccacaataaacatccgtgtgcatgtgtctttatagcagcatgatttataatcctttgggtatatacccagtaatgggatggctgggtcaaatggtatttctagttctagatccttgaggaattgccacactttcttccacaatggttgaactagtttacagtcccaccaacagtgtaaaagtgttcctatttctccacatcctctctagcatttgttgtttcctgactttttaatgatttttattctaactggtgtgagatggtatctcattgtggttttgatttgcatttctctgatggccagtgatgctgagcattttttcatgtgtcttttggctgcataaatgtcttcttttgagaagtgtctgttcatatccttcgcccacttgttgatggggttgtttgtttcttgtcaatttgtttgagttcattgtagattctggttattagccgtttgtcagatgagtagattgcaaaaattttctcccattctgtaggttgcctgttcactctgatggtagtttcttttgctgtgcagaagctctttagtttaattagatcccatttgtcaattttggcttttgttgccattgctttcggtgttttagacatgaagtccttgcccacgcctatgtcctgaatggtattgcctaggttttcttctatggctttgtggttttacgtctaacatttaagtctttaatccatcttgaattaatttttgtataaggtgtaaggaagggatccagtttcagctttctacatatggctagccagttttcccagcaccatttgttaaatagggaatcctttccccgtttcttgtttttgtcagatttgtcaaagataagatggttgtagatatgtggcattatttctgagggctctgttctgttccattggtctgtatctctgttttggtaccagtaccatgctgttttggttactgtagccttgtggtatagtttgaagtcaggtagcatgatgccaccagctttgttcttttgacttaagattgacttggcaatgcaggctcttttttggttccatatgaactttaaagtagttttttccgattctgtgaagaaagccattggtagcttgatggggacggcattgaatctataaattaccttgggcagtgtggccattttcacgatattgattctttctcatacctgattgccctggccagaacttgcaacactatgttgaataggagtggtgagagacggcatccctgtcttgtgccagttttcaaagggaatgcttccagtttttgcccattcagtatgatattggctgtgcgcttgtcatagatagctgttatcattttgagatacgtcccatcgatacctaatttactgagagtttttagcatgaagggttgttgaattttgtcaaagatcttttctgcatcaactgagataatcgtatggtttttgtcattggttctgtttatatgctggattacgtttattgatttgcatatgttgaaccagccttgcatcccagggatgaagcccacttgatcatagtggataagctttttgatgtgctgctggattcggtttgccagtattttattgaggatttttgaaaagatcaacaaaattgatagaccgctagcaagactaataaagaagaaaagagagaagaatcaaatagacgcaataaaaaatgataaaggggatatcaccgccaatcccacagaaatacaaactaccatcagagaatactataaacacctctacgcaaataaactagaaaatctagaagaaatggataaattcctcaacacatgcaccctcccaagactaaaccaggaagaagctgaatctctgaatagaccaataacagcctctgaaattgaggcaataattaatagcttaccaaccaaaaaaagtccaggaccagatggattcacagctgaattctaccagaggtacaaggaggagctggtaccattcgttctgaaactattccaatcaatagaaaaagagggaatcctacctaactcgttttatgaggccagcatcatcctgataccaaagcctggcagagacacaacaaaaaaaaaagagatttttttttttttcagagatggggtttttgctttgttgcccaggctggtctcaagcctcaagcagttctcccacgtcagcctcctgagtacctgggattacagatgcaagccaccacacccagctcagcctcttttttattactgttttttaaactttattttactttaagatattgtggatgttaatctttttcttagaattttgtttatttttgatatattgcagttgtacatattatatatactatatgtgtgtgtgtatatatatatatatatacactatatagtatacatagtttagtgccaattgatggttttcatattatatatatactatgtatagtgtatatatatacactatatatattatgttgtacatagttttggatacatgtatatatttggatacatatacacaatgtgtaatgatcaagtcagggtaatcaggatacccatcacttcaaatatttgttttttctttgtgttgggagcattacaattcttttagctattttaaaatatacaatagattgttttaactctaattttcctacttgagtactagaacttgttcctaacgtttaactgtattttggtacccagtaatcaacttctcttcatccccctcttccccattcccttcctagcctctggtaaccaccattctactctccacctccatgatatcaacatttttaactttcacatatgagtgagaacatgtgatatttgtctttctgtacctggcttatttcacttaacataatgacctccagttccatccatgttgctgcaggtgatgtgaatttattatttttatggctgaataatattctattctgtatatataacacattttctttagccatttgtctgttgatgaatacttgggttaattccaaattttggctattgtgaatagtactgcaacgaacatgggagtgcagatacctttttgatctactgatttcctttcttctggtgtatactcagcagtgggatttgctggatcatacggtagttgtatttttcgttctataaggaacctccatactgttttccatagtggctgtactaatttacattcttaccaacagtgtatgagcgttcttctttttccacatcctcaccagcatttgttattttcttaatttctctcaaatgtgtctctatatcgtctacctctggattgttccatgcccctattatctctatcctgaattactcccacagccttctaattgacttttcccaaactccacgcttcgtttctcccaccacttgatcttctgcacagctgccagaaggcatgttttataactgagttctgagcatcttacatccctgataagatctgggttgtagaacacatcttctagcagcagtgccaggtgactgatgaataaaatccaagttcctcggctgcctgaacctgtacaaaactctggtttctcctctacgtgtgacctgccttattccttctattccagctaatttggagcatcatttgccccatagcacactctctacttttataaacctgtacatttgcttctttccagatgtgaagctgttatccaagttaaaattagatttccaggacctagaggagagtccatctaagtactatatgagaacaataatagtacctgcttttcagggctctgtgaagatcagacctgtgagttttcgtacagtgcttagaagagtgcctggaacaaaggaagtgccagttgatggttttcattattgcattgctaacaggggccctattggtggactgccatttgtgatttgacccaggcgcagaatactttggcactggcccatgactcttccactaaggactttgggcatgttgcttcatgtctctgggccaattccacttctttctttttgggaaaagaatcaggctaaatgatctccgtggtccatttcttatctagaattcctaaattctctaaccattttttcaaactttctagtaatgaatgaaatcaggatttgagagctaccatttgcattctcagtctttcagaaattttgaagtgaaacaggatggtaagacttggagaaaccagtgttgctatacatgaaccataagtaattcctccccacagccattacagccatcatcaccagttgcatatgacatcattagccaggaactggaactgatgaagaagttgaaggagcagctagaagagaggacttggttgctgcatgatgccatccaaaaccagcagaatgcattggaattgatgatggatcaccttcaggtcagtcaggatgctaggtttcaggtcagagaccagttctatattagtagcagaaggaagaggagagagggaccttggcaagccttaaggagttagtcaatggtgtctgccggtagtgacagctgctgcccacagggtgatatgggatatctaatgtgatctccagcagggacttagagttttgccctttttctcctggctacaagagctgagattggcccagccaggccttggcaatggtagatgtggcttatatatagccaaggcttcctgtaggcttgcctgtgggcagtcctgctccatgcccagcttgtcttatgccttaaggaaaggtgtggactgtgaataagacctttgtgatactgtgtccttacagaagcagccaaacacattacgccacgttgtcattcctgatctccaatcttcggaggcagtgcccaagaaacaacagaaacaacacgctgggcaagtgaagcggcctctcccacatcccaaggacgtcaagtgtttctgtggtttatctttatccaactctctcaaaaacactggggagcttcaggagccttgtgttgccttcaaccaggtatggaaaggctgttttaactgtgtatctgaaaggggattttgttttcttgaggactttgactcacttggttctccttagggggtagtgactatccacttggctgcaatttatttgcccaagatagtaaaaaatcctgggctacctagacctgaatgcacatgctagaccatgtatacatacatgtacatatgtgctggattagcagactctcgctgccaggtgcatggctgcagctagtatccagtctaactaaagtagacagtcacacagatcactatgtgcagagaggctcaactgttgtcaccttttgctttgcgagaattgaatgggagtgttaaataagtttctgggaggctcttgcagacaccagggtgcttttatctgttgcctttcgatgcagcagcaactggtgcagcaagaacaacacctgaaggagcagcagcggcagctgcgggagcagctgcaacagctgagagagcaaaggaaggtgcagaagcagaagaagatgcaggagaagaagaagctgcaggagcagaaaatgcaggagaagaagaagctgcaggagcagaggcggcaaaagaagaagaagctacaggagcggaagaagtggcaggggcagatgctacagaaagagccagaggaggagcagcagaagcagcagctgcaagagcagccactgaagcataatgtcatcgtggggaatgagagggtgcagatatgcctgcaaaacccacgtgacgtatctgtgcccctctgcaatcaccctgttagatttttacaggcccaacccattgttcctgtccagagagcagctgaacaacagccctctggcttctatcaagatgaaaactgtgggcaacaggaagatgagagtcaaaggtaagacatgcatggaatggtgatagtggctatgattattgcttttccctcatggctggatcccatgcctgagatcacagacagacgacctatccatgtggcaccagcgtccctctcatcaatagcaacttgctctcaacttgccttctctgtggccacggccatcatccttctgcatgtgtggtgcatggatgagcatccattgatggaacaaaggggtacccatgaagaaaggactagataaggaagcctcaatgctagggaattagcccacaaaccttgaaatcacttggctggattccccaagcccagtctcttgcacagggtgtctatggacaagtcttgtgcccatagctgaaagacttctgggcttccagtttcattccccaactttcctggaatctggtgatggcagtaggccaagtgcaggtatctccctggcatttatgaacagtaagagggaagtgagtgtgaaacaactgctagattgctaagatcagccaagaacacatgaaggctaagtcctgagtggcaatatagggacatgaacacatttctgctcaataataaggtcttcagttccaaatgctagaaagataaggttcttctcagcaatgaaaggattgcttagcacatagttggggcccactaaatagttttgaatgaatgttagctttctgagacgggcctcctaaagctctctggacttccttctgggccttgctttcgaatcagtgactttgacatgaagactgctttagggccatattgtccacttgacctgatcatcagaatccacctgaggagggtttggaaagtatagattcagagtctgggatggggttcaaaaatctgtattgatcacaagacttccaggcttagggttgtggagagagcactggatttggagtttggaaatctgccttacagtctctgctcagccattagctccctgagtgctttcaaagtaggtgaaatgactttccaaggccacagagagcatagttgtagcaggaacaagactgtccaagtaatataaataaaaccaggtgagacaagggattgtaatttctctcagtgtctacattcacattactttgacaagttgaatcttagtcaggccaaagtgagaatacaaacaagtgaatcctgtggtgtagccaccaaaaccaaatgtgcctgaagcacctactgatgaccacgtgagtgtctcatcagttatcatgtccagatccacatcactgcaacagctttcttctcttacagtttttatcctgaggcgtatcaagggccccccgtgaaccagctgccattgatagatacctcaaactctgaggcaatttcttcttccagcattcctcagtttcccataacttcagactcaaccataagcaccctggagaccccacaggattacatccggctttggcaagagttgtctgattcactcggtcctgttgtccaagtgaacacttggtcttgcgatgagcagggcaccctgcacggccaacccacctaccatcaggtatgggacagccccctccttttccttccagcgcaggtcaagagggattctgggccccttccacataaggcacacaccccaagtgcatgctgtgtgtgagagccagacttcaaagctcagtacatttgacggcagttagtcacatgatggtagcactcattgctgagtaaaaatattctctacagggttcctcaaaaaagtgagctggcctagtgaaccttagacgcaatctgactgaaacttctctcaaaactatgttacatgggcaaagtgagccatgccatgtttttaatctgagctcatcgtctggtcccaagcctcctttcagacttatggatctttagttctgctacaaaatctaagacctagtgtaggtatgtttccttgtactaaaaataaacttagggcccctctgttgaatgtgcttggtatccatctatggggtaccccgtatttggaagggcaggcctaccttgtggattatctgcagtggccatgtttccaggatggaagctggtccagatggcagttacgtagcaggttttgctccccgcaggccccccacacacaatttcactaatgaatggaacttacaaaaggtgttttcactctagctttaaaaatcttattatagcctaaccttttttttttcaaacaacaaaaccaaaccaaaataaccagaacaaacagtaagctaaggcagaaaggagtttaaatacttgaggcaagcaaatgtatgattattttcacatataccccttgactaactgtgccaccagtactgctagaaacttggtcacttagagggactgctcacacggagagatcagagtgggcaataggtcctatggttcctatggttccattaccaagccagactttgttgagaacatctttcacgcctatttttgaggcactttccctcctagagggggtcctgagagaccaagccagcacaaggctgagcacgttgcccagggaagtgggaaaggtcagattctgaaaggttgctcagctgggagaaagcagggcaggaccaagtcggagctttcctgtccacaaaacctcaggggctccctgctatcctcaggatgaaacccgagctcctcttcttagcttcccagccctcactgcctgccctggcttatccctactgccttctggcacctttctgcctgcaggtccccagacacctccagctgtctgtccagagcccagccctgctccttttgctccctgtgtcttctccgcccccttgggttccagtccttgaaaccttgcatcactttgcaacataacccaaggaatccctcctccttaaccagaaaacaccccctcagcccatactttgtaacaccatctttgtatctattccttctccctcctccacaccccagtgtgggttggtacgtctcctgtcactttgttaaagtgggccaagtagctgcaaatcagtcagcatggaaatgactgagcccaagacccaaggctagtggccttggccggccatggctggcagagaagctggacaagagagggccagacacagacccaggagccttaagacaactttgagaaagcccaggtctgcttctgctgctctttaagctaagatgctgctgggagagagaagaggagaggaaccttatcttctgtagctcctccgtctcccatcaccttgcaggctcatgttccaaagaagtatttctcagcagcttgtgtatttgaactaaaggattcctcctaccaccaaaaaatgggcccacagactctagcaaacattccaccttgtttcactttttcctggcaggtgcaagtttctgaggtaggagtcgagggacctcctgatccacaggctttccaaggccctgctgcataccagccagaccagatgagatctgcggagcagaccagattgatgcctgcagagcaacgtgactcaaataagccgtgctaacagtactttcatgaccagtgatgaggggaaatggggggagggggcaggccaatgaggtctgcatggccaggggaccttcaaggtgcgtaaagtcccttggggtagggtttagtgggtagagacttatttgtttcctgataggttatgtttgtaattgtttgttaagcacagcctgtttcttggaagttatgctgtagaggcagcctgtgatccgtagtatgctagggtgtgacagcagccagccacagctggatctgatgtcttgtctgccccgcccagctttgcatatccatgttctaccacaggaaggtggcctgccaagagtctgctcaaagttttcaacataaagaataaagaaaaaaaaatgccaaagtgcttttcaatctagtaaatctagagggttgttttgtcttagccacaagaattccgaggtcttgaccctgatgatcaacctgcctcccctccatagtcttgttggagaagcccagagagaatgggactccaactaagggaacctgaaatcaactcaatggaggcacttcagagctaaaataattatggcttccttgcttaataaacattttcgttcactgcaa

SEQ ID NO: 3970 - DNA, 59532 bp, human
tattagatggctttatgattacactgagcacagatggagtgatcatttgtgtggctgaaaacatctcttctcttcttggacatttaccagtaagttctttctacttttgggaaagtggatcattctggtttgttgtttaggggttcattatttattttctttttttattatactttaagttttagagtacatgtgcacaacgtgcaggtttgtttcatatggatacatgtgccatgttggtgtgctgcacccattaactcttcatttaatattaggtgtatctcctaatgctatccctcccccctccccccaccctacaacaggccccagtgtgtgatgttccccttcctgtgtccatgtgttctcattgttcaattcccacctatgagtgagaacatgcggtgtttggttttttgtccttgccatagtttgctgagaatgatggtttccagcttcatccatgtccctacaaaggacatgaactcatccttttttatggctgcatagtattccctgttgtatatgtgccacattttcttaatccagcctatcatgttggacatttggctggttccaagtctttgctattgtgaatagtgccacagtaaacatacgagtgcgtgtgtctttatagcagcatgatttataatcctttgggtatatacccagtaatgggatggctgggtcaaatggtatttctagttctagatccctgaggaatcgccacactgacttccacaatggttgaactagtttacagtcccaccgacagtgtaaaagtgttcctatttctccacatcctctccagcacctgtcgtttcctgactttttaatgatcgccattctaactggtgagagatggtatctcgttgtggttttgatttgcatttctctgatggccagtgatgctgagcattttttcatgtgtcttttggctgcataaatgtcttcttttgagaagtgtctgttcatatccttcgcccacttgttgatggggctgtttgtttttttcttgtaaatttgtttgagttcattgtagattctggatattagccctttgtcagatgagtagattgcaaaaattttctcccgttctgtaggttgcctgttcactctgatggtagtttcttttgctgtgcagaagctctttagtttaattagattccatttgtcaattttggcttctgttgccattgcctttggtgttttagacatgaagtcctagcccatgcctatgtcctgaatggtattgtctaggttttcttctagggtttttatggttttaggtctaacatttaagtctttaaaccatcttgaattaatttttgtataaggtgtaaggaagcgatccagtttcagctttcaacatatggctagcccgttttcccagcaccatttgttaaatagagaatcctttctccacttcttgtttttgtcaggtttgtcaaagatcggacagttgtagatacgtggcattatttctgagggctctgttctgttccattggtctatatctctgttttggtaccagtaccatgctgttttggttactgtagccttgtagtataatttgaagtcaggtagtatgatgcctccagctttgttcttttggcttaggattgacttggcaatgtgggctcttttttggttccatatgaactttaaagtagttttttccaattctgtgaagaaagtccttggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattcactttgaagcaattgcgaatgggagttcactcatgatttggctctcttgtttgtctgatattggtgtatgagaatgctggtgatttttgcacattgattttgtatcctgagactttgctgaaattgcttatcagcttaaggaggttttggggtattttcagaagcataaagctcatcagagaagatgttttcaatgttgtcaaaatgtgtccctgttttattgtcatttccattggtttcagagtactatagattgggtgtctttgtaaacaacacaaatttatattttatagttttagagtctgagaagtcgaagattaaggtgccaagagatttggtgtctagtgagggcccaatctctgcttcatagacatccttattcttactataacttcatatagtagaagaagcgagggagctcttttttttttttaagattgggtctcactcttgtcacccaggctggagtgcaatggtgcgatctcggctcactgcaacctctgcctcctgggttcaagtgattctcctgcctcagcctcctgagtagcagggattataggcacgcatcaccacgcctggctaatttttgtatttttaatagagacggggtttcaccatgttggccaagctggtctcgaactcctgacctcaagcgatccgcccatctcggcctcccaaagtgctgggattaaaagcgtgagccaccatgcccagcctaggggtttcttttataaggatactaatcccattaatcatctccaaaggccccacctcttaatataataccatcacattgacagctagattacttcaatatataaatttttgggggacataaacattcaatctgtagcaaggccttcatattccacttatacgtgtgtttgaagaggggttacctagaatacatttaccaacaaccctcccacacaaactgtctgccattggcatggttgtgttagcaaaaagttttgggagaggatatgaagaaattgaaacccctattcactaatggtagtagtgtaaaacaatcatatctccgttgttgttttcattacatattcctcattccacagagttgtctcaagaacttgacaaaccctaatccagaaatctatagtactcaaatttggaacatggaaattaatagaagctaggttagattatcttgtagttaggttggaagtggattaaaaatatgtcactattttagccaggccagttggcatgttccgtggccttcttggaagctcagagtccttatacccttttaaaaaaaattacagatgctagaatcgatctcttttatttctcattctctttcattttttaaaaaaacagtttacatttccaaattcagcttatatttgtaggataccaaaacagctaaatgaaatagtagagatatttattggattgcactttagtatatttaaatcatagaaggaaaagagtcttttaaaatatatattaaaagagggaatgtacgagtatgatccactacagcttaaattttattataatgaagaccagaaaaccacccaaattcttgtggcatcagatattgcttaaaccaaattggtcattggctgagactggtgactttttcttattatgtgaagatttatcatagtgatggtgttagttatgatatgatcttgcttctttatgtatttggttcaaagttttccctatcaagaagctctttcacccttcaacatttgaggtaccacacacacacacgccccccaaaaccacaaggtctagagaggtgtctgggacatgtgctttgaactgccagccttaaacaatagacttgatttacctgagatcagtgtacttaaaaataaatgtataactattacatttgtacataaacattaaatgggaattaagttatatattcctataaaacaaggttaaaaacgactacacctgaggcatagtttcacacttcctcattgaatcccaactgttcttaatttttcaaaacaggcaatctttttctcaggctttgattaaaaatttcattttataagtcatccaacttatattataaaatggagactgaaccatttctagagtgtctgcgtggctccaggaatcttcagtttcattacatatcagggcacctctgtctatggagcaactccaaactaatagcatggtgtgatggaaagaacttggtcttcggaatcaaataatctagagattaaaatttagctttgtttctctctaactgcctgacctttagtttctcttctataagtggggaaataatattacttagagagtgctgggagatgaattagtataaataacgtgattggctaaggcccatctgatcagtgacatttatacagagacctgaatggagtatgtgtgatatgcaggtaactggagcaagtgtctttcagacagaggaggaagcttatgtaagagcctgaaagcaggaaaaggtacagcaaagaggacagtgtaactggagtgctgtgagcaaaaggaaaatagagatgataaagtcagagcagtaacaggagaagtaacatcccttttcctctgagatgggaggaagccattggggaggttggagcagatgaaagaaatgatctaacttaagttttatcagaatcgctttggctgttatgtcaagaattggctatgaggggcaggcatggaagtacagagtccacttggagggccatagatggtagtgggttggattaatgtggcagtggaagcattttgtaggtaaaataagttgttttgctgatgtattggaagaggggtgtgacacagagataagatgtgtccaagttatgctgttacaacacataccatgaataaaatgatgcccattatcatcatgatcatggtattaaacttttatctgaaacctgccatcatattttcccaatcattgatttcattgacagttttttttttcctttggaaaaactcatagtcatttgtagtagtaagttccagtcactgccccctgttcttagcagcctgccctcctactcaccctactctgtcattccccctgaaaataaaatcaaatctgggagtttacatatatttattctcttttgcagttctaaagcaaatgaaacttttaaaacgtacactacatctgaaaaaattctcagcattgaatctttaagagattaaaacttagcaggttttgaacataggtacatggttagtttgtgataactgtgatgagatttgccctattttccctgagaagcttaccgcatagtagagatttagtagtgatgagtctcatttgatttgagatgctgcctaaatctcctgcagaggatcttatccttccctgtgccctatacagttgaatagttttctaatgcatgtataatatgagtgtctttggcaggaaaaaagatgcttcttgcctaggttctcagtaaatgtcatgaagtcctcagtaaatttcttaattctttctttttttgacgtgactgagactcaccacactaatatttgtgtgacaactaatagatatttgcaaacttggcttttgaaaaaccaccttagtttttcgctggtatttatccttgcttcattaagctctaagtaccttgatctttctaccttgtgtaataagaagagcaaatgctaaaaatttacaaaaataacatgaggtcgatcatgctttcaggtctcctccctttttctaactaaggaacaaggccactggaacagatccagtgtttcaattagcggttaattataaggcttattgtcactattcctatccctagagaggcaataagaaactcattaccactagtcacatccaagagaatgtagactatcaaaagatagctcactttgaactcttttaagtgacaatgctatcttcatttttcaactaatgaaagaacttacgagacatagcactttgtacctcttgttagggtattattttatactctacatcataattgattgtgcatatttaatctgccctactagactatgtgctcattggaattcgttgtcaggttcatcttttgtaacccttataagaaataagtataaaatcttattcagtgaattacttcatgtagaatgtccaaaatacaggaactggtccagtagcaaattttctgttcctgatgcaaactggacttgaggcagctatggtgtagtaaaaggaacaatagacatggaattggatggagctttcatgtcagtttcatttctgcatttctgaactctcaacaattggagaagccttaatttgctgatgaataaaacaagggataattcttactctcccaggggattaagtgagcttgtatatgtgaacatacctagaacagtgactggcatggagcaattgtttatcgtgtgttagatgagtgaatgaatgagtggtctccacagaggtaacccagtttggcatctaaagtctattttataactaaaccaacaaaagtgtttttattgaaaagttaaatttagtgaaaaaaatctacatttcttttgggaagtcagtattttactgtgtgactttcactgtcaagatgtattgcctgttaattccataatgttttgtttgctagattaaggtaatatttctatccttaatcaagccaagcttgattgagacagcatctgtctgctaatttgatcattgaccagttcataggctggcttctacaaatgggccataaagatatatttctaaatagtgactgtagattattaatgctaatcagttaaaaaatcattggaatttgtggttcatcacacaaagccattattcagctacaaggaatactttattactttgttgctatcacattaaagcctcattacttctatatctgatattcaatttatccatgtctcaccgtatttcagctacatgatacggtattattcattcattcaaccaatatttactgagtgcttaccagtgccaagctctgttctaggtgttgaagatatagcaatgaataagacaggcaaggtctctgttatactgcaatttacattttaatggggaaggtagataataaacagataacaaaaaaggcaataagagaatgtcaaggagttggtgctatgtaaaatacttttgagtaaagacctgtattaagtgagagagaaagccattgcaaatatttgggaacgagtgcttcacatttcaggaggagttagtttaagggctctgagatgagtatttgctctcattgtgtttggatgtgaatgaggagttgggtgtacctggagtgcagtgagagagagagagagagaaagcagataaggtcaatagcagcaaggaaccagaatatagagtggtgaaagcccttataaagactttggcttttattcagaatgacttggataatcagtagaaaatttggaatgagcataggaatagcatgatgtggctcatgtttggaaagaatcatgctggctgttctatagagaatggagtggtggcaggggcatggcaagaatagatgcagggagagcagttacggctactgcagtaatccaaactggaaatgagacttggaccaagtggcgaaaagtgaactgagcctgtatgtgttttgaaaattgatccattagagattgctgatggactggatattgagtttgagagataaaaggcaagtcaaggacaagtaaatgggtaaatggtggttgccattactgatattgggaagaccgagggaggaacatattttgtcaaagaaaagatcagttctttttggatatcttaaagttgaaatccgattagacatccaagttgagttatcatgggggcaagagacgactatctgtgagtcattaacagataggtggtatttaatgagatggaagtggaagagaccacgtagggaaacaggcctaatgactataagccctggcactccgatgcctagtattcaggaagcaagactaagatctagcaaattgtgaaggagtagcctttgaggtagaagtatatcctcatgtgtgtggtgtcctggaagtcaagtaaatgtatcaagggaaaaggaaggatcaattgcatcaaatgctgagacgcttggtaagatgagggctgagaagtgatgatttgatttggcaatatggagggcactagtgaccttgacaaaagcagtttcagtggagtggagtggttagatataaacttcattagtgtggtttcaagaaagagcgagaagtgaagaaaggggaggtaacaagtgtcgtttcatttcaggaatttttgttccaaagtggaccagataagcagagttataattgaagtgagaggcggtaatgtaaaggaaggttatgcatgtttcgaattttgtgttgtttttgttttcctgattatttttaaaatttcttattcatgtataaatttgtacataactccagataagtagaattataattgaagggagaggcggtaatgtaaaggaaggttatgcgtttttagaattttgtgttgttgtttttgttttcctgattatttttaaagtttcttattgatatgtaatatttgtacatatgtatggcgtacatgtgatatttcaatacatgcatagagtgtgtaatgaccaaatagatgacagatatcatagcatgtatagtacagcattttgtatgcttatgggaacacccagttgagagggaaagaaaacttgatgtgtggggtagggtgagactttctagaacaatgtcttttcatagtctacagaaaaatgggatgcagtgcacaggtgaaggagtgaaattcaggtaggagcttattcattggaagaggagggaaagcaggtctctaggcacaggaacagataggttggtagatttggtgtcagatgttgacatttcccatttttttttcactgaaacaagaaattaggtcagctgaaaatgaaggaaggctcgggggtcggaggtttgaaggaggaaaaagagtaggggagcaaattgtctaaataaatgatttttgggcagacttgaatacttatttcaaataatatactgcttagttgtgggtttttcttcatttacattcaattgcttgggtgaaggtgtagataaatgaaaggttggaagtaactagagtcaaaattttcccaggcaaatatggtagagggaaagagcacataggaggtggtgctcataaagtaggataatgggaattgtattttttagaggtacaacaggtataactgtacatggctgaggtggggcagagcataagctcactggaggtaaggagatagaggaactgaacagtattaacacagataaaaaagtttactctctccctcttcccctcctttttccctccacctcctcctctcctctcctgccaggctgagattgtgggcaaaaaattattaagccttctgcctgatgaagagaaagatgaagtctaccaaaagattattctcaaatttcctttactaaactcaggtatgtatatttttaaaagtagtaaattcttaggttttaagggacaagtaacaatcgctcaatggattaatttctaaaaagatattagagcacatacggctgttgatcatatattaatttacttttatataatattacaaactctatttctagtgttaaaaaaatctctcctccattaaatcttattcctcaccacagaccctgagtattgtagcatttgtacaattgcattagtgctatataaatgatggaccattgtatatagcgttctagctggtgccctactctactgatacaacatagctagctatgtaagtgctaatgttcgtggaaagaaaataatatttttgtaaaatctaatcgaagaaagacattggtcatatgaaataatccagtagaatatggtaaagtacaaatgtagacttgttttgtatttcttctctttttactagaaacacatattgaattttgctgtcatttaaaaagaggaaatgtcgaacatggtgatagttctgcttacgaaaacgtgaaatttattgtgaatgtaagagatatttgtaatggtaagcagttctgtttatcttatctatatgacatttatgagtcatgtagcctcacattactaacataaatgctcttctgcttggtacttgcaaactgtctgatatccctatggccacagtttctgactactcacattacttagacttttaaaaattaacagtgaaatttacaaggtgggggacactgagttgttaaggatggctctttctttttataaaacaaggaaatgattgcaaaaatataacaaaagaagtttaatgcatatccaagcttaaaataaaggggactctgtgggtctatgtgtaccagaaattaaagtttaaagcagtatgacagtggtaagaagcagctgattttgtggtggcctcggtggattttaagtcatgcataggctccattggctggggtcgggaattctaacacccagtcaagcaccagtatataaaacctagagatcaatgaagtgatcaataaagttctgtccattgacccagaggaatagtgagtaggtttatcatctctctgggaatttgaatggacaaaatgtgccatttacaagaaaccaaaacccaaatttttgtcgcgtgtggatatagggtccattttacaaattttgaggtttcagaaactgcaagctgagaaattaacataaattaattaatattaactggtttggagccattaaaatatctgggacttgaatcagaggtaaatagcccaaatagctaacaaatatatgaaaagatactccaactcactaataagcaaagaatgaaacatttaaaaaccagtgacattagcactctacacccatcagaatgggaaaaattagaagtttgaataataccaaatattgatgaacatgtgagaaatgaataaataaataaatgaaattaactcacgcaaaaggtggctgatatatttgtcatgattcttggaaattaaaagtcataccttttgaaaaaatcttacttgactctgtgtgcacagattacacacacacacacacacacacacacacacactcccacacactctacccatatggtctatataaaagagaggagccacatctcttttggagactaaaatatccatccacagggtaataacggaagactgaaaaccaaccttaactctcaatatttgattctcagtaataaattctttatgttttgatggggagggtggctgaaaaggaaagaagacaggaaaaatcccatggctcagaattttgaaaattgtcaatgggttagcaaacagcacatggatgtgtcaggtatttgtcttcttgtttaactggtccacctttctgttttcacatgtgtgtctatcttccttagagtttcctgtggtctttagtggcttgttttccagccacctctgtgctgactttgctgcatgtgttcctcaggaggatcggctttatcttgtgggaaatgtttgcattctcaggactcagctcctgcaggtgggtatactgtgtttgtgcttcccccgctgtggcgatgtgggcttcctttgaagggtcacttcccctttggtctgtcagccactggacaacattgctaaattactcagtgtgtgcagagggttgtgctgggatatgtaaataaggaaaatcagctcctatgtttcagaaggtgaacatctcagtgaaaatttagacacactcgaaagagatgcacaatcatttacaagtagtcttgacataatataaaatattataaaatgtaggtgctggggactggaacacatgaagagaaatgagcattttggcaggtagatgaaggaaggcttcttatactacgtgagttttgaggcagctccaccacaaccccattgggtagctgattgtaaaggcttctgctctctttgtgttctctaatatagcattcacaaattctagctctaaaaagaattcactttggaattcatctgatagattcagcttccattaatttttccattcagtaacatatatagtaagtacctactgtgttacaggtactgtgctaggtgccagagagacattaggggagatagacaatagctaaataatattggaaggtgccctgaaggatgacagaataatgtgctaatgactagtgcgggtggggagttcagacagagtggtcagggaaggtccttttcggataatttgtcttttgagcagagacccctagggatgctaactaagaaaggaaggcaacgcaggtagatggttcaacatctgtaaaagacctaaggtagtaactagcttggagagttccaagtaacaaagtaagttatgtgaccagaataaggtgaaagggggaaggagcagcagaaaataagatccaatagataggcaggggacagattatgtagaactttgagatccatggtaatcagtttgggttttatttcaagtgcattggaaagcaggaaggtgacatgatctgattttcttttttaaaggtcaggctgaatactggctgagaaatggagtacagagaaacaagaacagaagcaagaatacctaagtgaaagatgataggggcttggactatgattgtagtaatggagatacaagtattctgacttgggatgtattttggaggtagtgcccttgctgatgagttagaagtgtctaggagaagggagagaaacatctcgtggaggatttttagctttttggcttgtggaactcagcaaatggaggtgccattaactgattttagcaagactgggacaatgtggatcaggcagtgtgggaggctagaatcaagagcactgttcgggccatgttaatattgtgttgatgttacaacataaaacatctccaactcattaccttataagggaaggctctgatccagatttcctgtgttcagatcctttccctaccagctctgtgaccttggccaagtcacatcctttagcctcagtttctttttctataaatggcagtcatagtaccttctattagggttgtaaggagtaaataagacagtttctcctatatggtaagcactcagtaaatgtgagctattacagttgttgtgatcattgttattactgtcattattactgccagtgatccagagagggcaacatgcttgctttacttttcatctctggtttaaaacgtgggcttttcagaccacattttagaaactgtggagggggcctttacattcaattttagaacaagtaatatatgtcatcatttcttcaaattaaagatggtaagaaaagtagtatagaagaaaggcagtttaaggaagttgcctaattcagttgccccattcattattccgtctttgtagccctctgggatttgaactgtcacatctgccatgagaatacagacatcccattttggaagtcaaccccagtaactacttccttttctgagaaacagaaaaacatctgatttggcccaataccttggtagcccttacagcacaaggaactctatttgtgttctagtccagtttctctctgggtttataggatgtttgttccatattagtggacattttggagaaaaaaatcttgtgcaaacaggcgggcttttggaggaagatttttttcacagcgtgactgtgtagtacagtgggaagagggatgaactcacagttcaaactttgaaattctgctcctggatctactagctctatttcttgggtcaaatcattatatctctaatcctcagttttcaaatctgtaaaactccagtgcatttctcacattgatatgcagattatttgtaacattggatatgagcatgcctccaaaattaatatatgctgtgcatttttactatttatatacatattaaatgtctaaatatttgaatttttctgcagcaactttacacttcaaaggcagtcagtgatgaagctgtacttacacaagattcagatgaggaaccttttgtgggagagctcaggtgagaggtagtattgataaagctaatgaagatctagaattcaattttactaaacgaaactaaaacaagagaaataacacctacagatattttttttcccatcaaaatgaaaatgaaaaaagaaacaaacgggccagggatggtggctcatgcctgtagtcccagaactttgggaggctgaggcaggaggatcccctgagcccaagagtttgagaccagcttgagcaacatagtgagatcctatttctacaaaaaatacaaaaaaaattagccaagcatggtggcatgtgcttgtagtcctagctatttgggatactgatgtgggaggatcagttgagcccgggatatcaagtctgcagtgagcagtgatcatgccactgcactccagcctgggcaacagagtgagaccctgtctctaaataaataaataaaaccagaatagcagtctactagtctgaacttcctttcccagctcatataattcacatttttccaacagaatgtaaatacaggtgattggctttttattttttattttttaaaaaaagcattaaagcaataaatagagaaaacttaactgacccaggcatgtaatgactttcaaattaaggtaatgcattttaatatactacttcattacttttttttcttgaaaagaaaggtaatgtttagacacttttaaatggtagaagagcaagtatgcattgtggtaactgctaattatacaggcattcctcttttgtgaatctaatgtgttctttaaaatttgtttactaacacattttcagagaatagaagcaaatattccactatttcacgtgagaaaagtaaaaatatattcctaacccccaggaaaatgccgattaatttgccagataccactaaaacccctttataaacttatttaacaacccacaaaggatttctgtaaaatataaattatttataatactatatagttattcagcatttgataaactcattgtttggcacatttgtatgtagtaagccacaatagcatacactatacagtgtctagtattgggaggggattacattttccttctacgttgcagtgtacatgtactggtaaataaataatgaagtaatatattaaatatattaaagatgtgcactgtatgccagtaatatttagcaaaataaaataagcaaacaagagaactttgcaagagatttcttgggatcaaaggcatgcttgcatgaggtctgatggtgagaagagtgagctggaagctgtggtcacggttactattcgggggcaggaggaggtaaggaagccagagctggtgaaggaatgagttaaacaggaaatatttgaggctcatctggatttaagagaaggcagggagaatcttccattcccatcagaagagtacagaggtgattggttgtcaacctttagctgatgctacacacagagcagtgggatgagaaacagaactcatggtggctagctatttacatcccctttgcttgattaaaaattcttgctaacataaagctgcatttgtattaataattgtgtaattgtgtgttgaatgtgacaatgtgacatgtctgctcatgccatgatcacatttatttgtaccagcatgctgtttttatggaatctaatttttatttttatttatttatttttaaatttttatttattatttatttatttattatactttaagttttagggtacatgtgcacaacgtgcaggttagttacatatgtatacatgtggcatgttggtgtgctgcacccattaactcttcatttaacattaggtatatctcctaatgctatccctccccactccccccaccccacaacaggccccagtgtgtgatgttccccttcttgtgtccatgtgttcttattgttcggttcccacctgtgagtgaggacatgcagtgtttggttttttgtccttgccatagtttgctgagaatgatggtttccagcttcatccatgtccctacaaaggacatgaacacatcttttttatggctgcatggtattccatggtgtgtatgtgccacattttcttaatccagtctatcattgatggacatttgggctggttccaagtctttgctattgtgaatagtgccgcagtaaacatatgtgtgcacgtgtctttatagcagcatgatttataatcctttgggtatatacccagtaatgggatggctgggtcaaatggtatttctagttctagatccttgaggaattgccacactgtcttccacaatggttgaactagttcacagtcccaccgacagtgtaaaagtgttcctatttctccacatcctctccagcacctgttctttcctgactttttaatgatcgccattctaactggtgtgagatggtatctcgttgtggttttgatttgcatttctctgatggccagtgatgctgagcattttttcatgtgtcttttggctgcataaatgtcttcttttgagaagtgtctgttcatatccttcgcccacttgttgatggggctgtttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtcctagcccatgcctatgtcctgaatggtattgtctaggttttcttctagagtttttatggttttaggtctaacatttaagtctttaatccatctggaattaatttttgtataaggtgtaaggaagcgatccagtttcagctttatacatatgtctagccagttttcccagcaccatttgttaaatagggaatcctttccccatttcttgtttttgtcaggtttgtcaaagatcagatagttgtagatatgcggcattattctgttccattggtctatatctctgttttggtaccagtaccatgctgttttggttactgtagccttgtagtatagtttgaagtcaggtagcatgatgcctccagctttgttcttttggcttaggattgacttggcaatgcgggctcttttttggtcccatatgaactttaaagtagttttttccaattctgtgaagaaagtcattggtagcttgatggggatggcattgaatccataaattaccttgggcagtatggccattttcacaatattgattattcctacccatgagcatggaatgttcttctgtttgtttgtatcctcttttatttcattgagcagtggtttgtagttctccttgaagaggtccttcacatcccttgtaagttggattcctaggtattttattctctttgaagcaattgtgaatgagagttaactcatgatttggctctctgtttgtctgttattggtgtataagaatgcttgtgatttttgcatattgattttttatcctgagactttgctgaagttgcctatcagcttaaggagattttgggctgagacttcagcaaagtctcaggatatttttattttttattttttgagatggagtctcactctgtcgcccaggctggaatgcagtggtgcaatctcggctcgctgcaacctccacctgccgggttcaagcgattctcctgcctcagcctcctgagtagctgggattacaggcacgtaccaccacgcctggctactttttatatttttagtagggacggggtttcaccatgttggtcaggctggtctcgaactcctgacctcatgatccgcccgcctcggcctcccaaagtgctgggattaaaggtgtgatccactgcgaccagccagaatctaaattttacgtgaatcttcagtgttttatgtttggctcctaggagtggggagcacgtgcacgaccaagcttaagacttctagccagtctctgaatgtgctttattgctcccagcttttcttgtagtacatggacttcaataggcctgttagtcttgcccacttccttcattagtttctctagtttcttagatgaccttttactgaataatgtggaacgtaagatacctacaagacaacatgtttaaacaacatgaactcaagttttgctataaggagaatgactgagacacaatagcagcacactgacatgctcttgtctaggcatgcatgacttaaacatattcttgcatgcaccctaaaacagatttatttagcaggtttgggtaatgaattttgtttaaaaactagcatatcagtgtagcaaatattcagatagtgagagtttagagaacaaagatactcatattttatttaaaggtagagtttaattggatgaaaaatattctgatgcagcaaggagccagctaccacatctatgccgtaatcttcataagatacataataaaagtgttttctgaaggcttaaaattatatcatttctaattttgtaagaaattatgactcaaatgtgggtgaacgcacactctttcccctaaagttcaaaactagacaatggattgtttatcatgtaggaagtaagatagaaaatgacacttagggaaaaagcggatgcatttaatgaagaaaagtctgattaattccagactgcttgtccctctcatatccctccctcctccaactccatggccactactttggccccagtctcttcagctctcatgtgatggattgttggtggacctggctggcccactaacctgaactctgtaaggcaggacctgtcaccctcacccttgtctgagcacagaacctgacaatgagtaggcagaagtgacatctgctcattaactgattggttacttgatcttatcaaaatggtaatacattccgggccatgagatctctcaaacattatgcagtattgttagaaaaaaagtgcaaaccagtaccctattgcttgattttttcatagacttgtcccttgtccccatgatattttcaattaaaaaggagaagagattgcatcatatcagggttgtaatttttagttattaatagtctggcttccattttaccctctgggggatagttagaaaagcaattgttcacaaaggtcgtagggacccacagctcccaaaatgtttcccttatcttggtaattccattttttaagattaagaagcatcctgctaagttttctctatgcttatgaaggaaacacaaaggtgggaatttgaagtatttagaagaaagggtgtatttccacatagaatgtcctgtttgtgcaggtttaagatttgaggcttaaaaatctttcatttcaggagagggcctgaacagctggggtatttttcattgaggctacaggtgtaccggagtggaaagtcttgctttcttggactattgaaggtagaaagaagtaagggatttgtgagtcagtgaggggcaggcaaaaaagtgaatactgagtagccctctgctgtcttgctactgctaagagtcagaagtaagcaactaaggtactctttggatttgcccagttgcatgtattggtaaggcccaaattcctatcatagcatcatcttttaacacagtgcaatttgttctttatacttcatcatgttattttatgtttattaactcagttattttctacatatctataaggtagattttagactcattgtacaggtgagaaagtgcactcacagaggatgtatgattcacccaaactcacacagctggttaggcagtatagctgtatttgggacctaagttatcctgggctgcattccacgaggacaccagtttcaggagctgtggccggtatgtgattcaagggagaaaactcaaggagtctttggaaagtatgtgaccagggatgttactaagagaaaacatttttctttttaatttcaccttaaacttagagggaggagaatataccgattagttagccctaatactttttacaaagatggcacattttcacccaaaagtaaagtagaaaacactggaaaatcaaatgatgagtatttcccaggttctagtagctgttacctgtgcttgcaaagtcctcagaaactctgctataggactggaattggtccctggggagactccatctgtcagcaactccaccagaaagaatgttcctgcctaattcctctttcagtgaagagacaccttgtacaaaggtgtggggaaaattttgcaaagatgtacaatggtcctagttagtgaggttttgttgtaccgagtctttttaccatactatactataccgtattgactccattccttatgtctgtcccatcttgagcagaggaggggccttgcacatcattgtaaatgtggctagcatgcctagtcttatcactttagtcccagtgaaacttatttattcatacagaaaatagttagcatctgctatgtggaagtttctgttccaagatttaaggatatggtagtgagcaaaagtccttatcttcgtggtcattacattctggtggaggagaaagataataaacaagtcaatagactatagagcaggtgagatgatgagggccaagggaaaaaaaattgagcagtgaaaggggtatagggaatgttattggggggaagttaaatactactagattttgaaatggcattttataggttaaaaatggagtaatattggcaattccctgtggttcctttgtggccagaaagggcctcaacaagcaggtgacttgagttaacatctgaaaggagtggaggagcaagccttgtggattttggaggagatattccagacagaaggaagagcagatgcaaggtccttgaggcagaagtacatggcagaagcatatgtttgagaaacagcaaaggagccagcatagctggagcagagtcaccagagaggaacattcagagcatgcagggcctgtgagcaactgtgagggaaggacccaggatcgtgtcagctcgaccctgccttgtggaatagctcctgctagagtcattcaccattatttctcttgtttttcaatgccgtgtggagactcagtcaacactacctgctctccctttgcacgttacttggctatttctactaattctactctactaattctacctatcacctttggcaaatactgtggaggtcttgtaatatagttttaaaacaacataaaattaggatttttaaaaactataatgctcaggttttatttctcagttttgccatttacagtttgtgtgatcttggagaagcctgttaagtcttatgttctttatctataaatgatgaagataattactgcagaatgggtgtgaggctcaaataaaaaaaaaaagaaataagatctatatgttttgtaaaatactatgcaaagtcaaattattatggattagaaagtccttccaaatatggagtaattataatttaacactatagtccttactaatctatgcagacaccattaactacaaagggctacctgtgaacatagcagacagtcatgatctgaagtttgtgtctggtgatttcttcaatattctttttatttttctataaatttaaggtagttctttttttttctgcttaaagccagtacatttgaaacctccatactgagatggtactctctccatgaacaaccgagtcattccatgaagagcatccatgtctccttgcagggtgaagtgggtgcggcccaactttgaatatgatgaaacttccagcttggaggccacatacagccagatgactctgtgctccgacacccaccagacagatactcacatgctgacacctggtgttagcagataaggaaaggagttggggcttttcaggcttacatccagggaaagaacccttgagcccatttccacgcagctgtatttgttagatttgaagccagccccttggtgtacatttaactaatcatattagtagcatgtacagggtctggtccttgaaaaggacagacatcaaaagacacaggtagaagggatagcagtctcaggatcctgggttttatatatcattttctttatgatgtgatctctagccaacccatactccatcttcagctacatgacaaattattttgatcatctaaatgcataaaatcattaaactattagatttgcaattgataagagcagttttgttgttaatattttttgaaaagctctgtgtaagggtttgtactaaagacttattgaagcagcactgaaattactgaggtttagacactaatgaaaaaagtctaataaatataaaagtttaaaaaaactgggacaaattatctgatatatttgcctattttatgaaaagcaattttaaataaatattctcacagctgcatattcttctcaagtaataatgttatttttttctcacagtattcatttgccattccacaatatagttgcccagcttgtgtgttggtcatctgaagatgtggaatgggattcatccagctctcttttcacttaatgattttggctttacctctttcttatcttgagacattcttttgctttagctccattgccatttttaaaatttctttttattttttaactttttatttgaatattggcaggaactatatgtgtcctcttttacctatactcacaactttttacagcttgccccatttgctttattatcattctctcctcttctctccttctctcaacttctccccatcttttcttccctctctcttctctctctcttcatatagatagatattttgtgtgtgtgtaatttattataaactgtggagatacacctctatttctcaaatacttctatgtatttcctatgttcaagtttattataatacataaccttagtatggttataatatcaggaattttggtatctgtggaatattattatcatctattccacagtccatattcaaattttgtcagttatcttttgtagctttttttttggtataggatccaatttaggatcacgattacatttagttgtcatatgtctttaaactggaatagtttcccagacttcctttgatattcttaactttgaaatttgtgatgagtgcagactaaatattttatggaatgtccctccatttgggtttgtctgatgtgtcttcttaactagagtcaagttacgcatttttatcaggaataccacagaagcaatgttgtattctcagtacgacatatcaaaagatagatggtgttgatatttctcataagctgatgtgaactttgatcacatggttaaagagatgtccaccaagtttctcacctgtaaagtaaaatttccctttgtaaattttaagtaacttatgggaaagtacttgaagacatgtaaatattctgttcctcaagaaatttttacccactagtcttagtacctgttgataattttctaacagcatcataccttctacatttattggttggcattttggttaggaagtttcccctctgcctcattaattgaatcgttatttatttattcactggcttataatatactactattattacttattttaatgctcacattgtctcagaattggccagtgggagcctcttccagctgactcatctctttttaatgtgccctgtcattctttgagcatcacccttactacctggcacaagacttttcaggttcattttgtattttctctgcctcagagaaatcagccagttctctaagtcttagtctgagcaactccagcttctttaatcagaagtatttagaaaccaagatctaggcattagttctggtcatcattacttgtgtgccactgcttttaagtgctttcagaactaggaaacaaatacacatgtacctacatataaagatacatatctatatgtatgtgtacctttgtgtatgagtgtatataaaataatacaaatcatgagttcatagtgatgcttcagattctaagccaacaccatagggttcattctagtcttctcatttctgtatttgcaacactcttttccaatagtcacaaaggcctggccccactgtcctcaatatagttacttacttgctcaaatatcaaatgcacagaaagtagtttcagggttgccaacttatgtcattgcaaaaagaaaaccttctaaattgagtttaatagtatttacatttgtaaagtaaaatttacatgtagtaaaatacacctatcttaagtctatcattccatgagctttgaatggagaagcccgtgtaaacctcattcctgtcaagatggtacagtgtacatcatggtggctatggttaataacaatgtattttatgtttgaaaattgttaagagagtagattttaagtgttttcactacaaaaatgataagtatgtgaggtaatgcttgcatattttaaatagcttgatttagccatcccgcagtgtatacatatgtcaaaacattatattgtacaccagaaatacatatataatttttacttcttaattaaaaatttttaaagatatacaatgttttcagcacactagaagccttctttgtgccccttctctgtcatcctcccacctagaggcaactgctattttgaattttttcactctagattaattttgcctttactagaacttcataaaaatagaaccatacagtatatactctgttgattctgccttctaacccagcataagttgtacgtatcagtagttcattctttttgttgctgaggagtattctattgtatgactataccacaatttgttacgtattttccttttgatggacatttttttctagttttggattattacaaataaagctgcaatgaacgttctttaaaaaaagtctttctgtggatatgtattttctttttctttctttcttttttttaatttgttgagaaatttctcgctctgtcgcccaggctgaagtgcagtggcgtgatctcagctcactggaacttccacctcccaggttcaaatgattctcctgcctcagcctcctgagtagctgggattacaggtgcctgccaccaggcctggctaaattttgtatttttagtagggatggggtttcaccatgttggccagactggtcttgaactccttacctcaggtgatccacctgccttggcctcccaaagtgctaggattacaggcatgagccaccgtgcccagcctgtattttcatttttaaaattatttcttaaacaatctatctgttaaattgtgcagtaaattttttttttcctcttggtatacagttctgtggattttaagaaagctatagattcattcaaccaccaccataatcagaatacagaacagttccatcatccctcaaaaaacttccttgtcctgcctatttattgtcagccctaccccacctcacccctaacccatttcaaccactgatctatacttcatccttatagttttgtgtttttgagaatgtcatataaatggagtcatacagtatgtaatctttagagactggcttctttctctcaacacaattcctttaagattcatccgagtggttgcatgcatcaaaaactttttactgatgagttgcatttcattgtaggtatgtaccacagtttattatttcacctgctgaaggacttctgtgttattgccagttttctggcggttatgaatagtaccgtgataaacgtgtacaagattttggtaaacgtgttttcatttctctagggtagataggaatagaattgttagtacatacagtaattgtatgttcaactttataagaaactaccaaatccttttccagggtggttgtgccattttgcattcctactggcaatgtatgggagtttttgtttgttttttgtttgtttgtttgttttctggagacagagtctcgctcttgtccaggctggaatgcaatggcctgatctcggctcactgcaacctgtgcctcctgggctcaagtgattctcctgcctcagcctcctggtagccggaattacaggtgctcaccactacgcctggctaatttttgtatttttggtagaggggaggtttcaccatgttggtctcaacctccttacctcaggtgatctgcccgcctcggcctcccaaaatactgagattacaggtgtgagccaccacacccagcttgtatgggagttattattgcttcacttcctcctgagtgctaggtgttgtcatttttcaaaattttagccactaataggcacacagtggtattgaattatggttttaatttgcattccccctaaggactaataatattgaatatcttttcatcactttccatcattacatctttgacaaagtgtatgtttgaatcttttgcctaattttaaaattttgttgtttgttttcttactgaattttgagaattcttttttcagtttcattttttattcacaaaatattttctcatattcattgcctttaatctttgcaacatcctgcaaacattgttctaatattaattttgcaaagtcagagcagtaaaaattaaaaatgtagtctccaaagctaacagtctgggttcaaattctgggtttgtcacttattgctgtattaactttagcagcttgacttccttgaaccttgatatcctcaactatgaaatcatactcatacaaaacgatcattctcagcaaattatcacaaggacagaaaaccaaacaccgcatgttctcactcataggtggaattgagaaatgagaacacttgaacacaaggcagggaacatcacacactggggccttttggggagtggggggctgggggagagatagcattaggagaaatacctaatgtaaatgacgagttgatggatgcagcaaaccaacatggcacacgtatacatatgtaacaaacctgcacattgtgctcgtgtaccctagaacttaaagtaaaaaaaaaaaaaagaaaagaaaacaataacaacacttactgagtgcttactgtgtatcaggcatggttcagagtattttaaacacatcttaactcatttcgtcctcaccacagtctatgagttttgagaattctttatgcattctggatacaagttatttgttcaatatttgatgtgcaagtactttctcaagtctggggcttctattttcattctcaacagtgtattttgcagaacaaagggtttttattttaagaaaggaatattttgtcattttttttctctgatagattgcttttggtgacatgtcttaagaattcattaccgaaccaagaccacataaactttttttttcccaaaagttttatcattctggattttaagtttgtatctacgatctactttgagttactatttttataaggtgtgagatttaggtcaaagttcattgtttttggtatatggatgtccagttgttccagtatcatttgttgaaatatgatgttgttaccgtcctgctcaaaaactttcggtgctttctccattgcacttggaataaaatccagactccttttgtatggtctgtaaagcatactgctttcatgcctacttatttctgaaacctcattttgtgttgtattcccttttgtctgtcagacttcagcctccctggcttctcttttctgtgaattctcaacactcttttccagcgtagagcctttgcacaagtttgtgtcctcaacctgaaatatttttccattatgttgttcaatagttgccttatattggttcccctaagtttattttttattctctcccctggcattctgcccttttccttaatcatacttattacaatttttaactttatagttatctctaaactaatcactcattgtctggatttcccatgaaactgtaagatccatgagactgtgtttgcagtgcccagtactgtgcctatcctcataaaacttgctgtctagtgctgagatgtacaacgaaacgagaaactacaatactacaagaaactacaccattctgcatacatgccatttaagttcattcactatttctacatggactaaaatgtttttccccactatattttgtatacctgaatccttctcacccctcaagaaacagttccatcttccctctctgagaagttcctcctggtgcccagttcggaagagctcttcctccctgctttctactctcgtactgacactctccactttgccttgagatcacagagactgacttagctcttctcctagaaaatcaaaagcttgctgagagtgggattgcattcagcttgtgtctccctcagtacacagactagctcattttattcaattaattcattttctgatttctagaatacagtcatgtgtttagctatgggtccatcttgccattggaaactaacagagctgattttcagaacaaaaagagaaaacaaggccaaacttcaaatcatatctcatatttgcacagccaacacaggccattagagttttaataaatagcaaagacataaaacgttttcttttaacatatgctgggactcgactggtctcttgttgctttatttccccgcctggctcaataatagtcctataaaagtgacagaaaaaccatataccatgttaccttagagggatgactgagacagttacaaaaataggaagactcagatgccaaataaaacatgggatgtttggcaaaaccttagcatgaacatatgtacctagtccaggcgctctgaagttactggatgtattaaaaagaagttggtcctgccctgttttatgatgtaaaagtgtgtgtgtgtttgtgtgtgtcttgtttcattgaagtgaaagcaaatcattttgactgaatagtgacaaatattaattcataaaatagtttttagactggaaaaatatttgataatggatccaaatatgaaaataatgaaatataaaagtcaatatagtaccttacaaactgtagaaattatatctgagctgtcagttctagtccttcaaaaaccctgtcctctttgagtgagagatgcatccctatagaacatcctgtcctcagttggaaggcttggccttaagggcttattagttagtgggaacagagcaaactttctttatatcttaccacacagtgctggtcttagtatagtcttgtgtctgatttatgaatttctcctggaatgaattttccacaaatatatgatggggaactgtgtagccttgacattcattctgcccatgaatgtctttagtgttagcagctggcatccaggcatattccagtgactcaccaaccaaagctatatgttgccttctctacgtttgaaaaggggcagggggcggaccacagaacactaatcagattctaaagttgccttcatgtttacttaatatttctacactgctcagaggaagccaatatcagcaatattctttttgagatgacaaaaccttgaaacttttttggttatttttatagcaatagagtttttgttgacttagtattcatttttctgttttctctttattatttgacattagggcaactcttaccacagattaattgctcttcggggtacatcagactaagatttctaccatgttgatgatttgtgtttactttttaagtgtgatgaatattgtgtattacttgtttttttttaattctggtgaggaaataccaccaagtgctgttcggtgtttttcctcttttgatgtgtttgtggaaaactggtgtaaccaaaaaaaaagcacattagaggagttcaaaatggccctttagagagtgctgatttctatgaaatggatagatttttagttgtatattagcagtgatttgaagcaagtctttaccatacagctaaaagaagaattgaattttcttagctatgccataaaagtaattacctgccagataaaagggacctcatgttataaatagtagaaactcaacattttgttttaaatcttcattttctaatacgtgaaattatctgaactaatctatatggtgtaggttcagttatgtatcagcttcagatatatcagttatatatatgttaacccacaaaaagaatatgattttgaaagccataagaatccatatctgtgtctcgtacaggaaaacaggaaggctgaaatggaaagatgcttatagaccctaactcattgtctcatgaaagtcagtcctcttcatgctatggccagggagcagtgagggttgtggtgctcaggatagggaattggagaggagaagggtacattatttcctgagtcatcttgtttcactttctgcctatctctcaatcccaacacacaccatagacgtgtgcacacgcgtacttacacacacacacacacacacacacacgcgcgcgcgcgtataccagacattttccttccccatccttttaggccctgaagtaataaattactctgctggagaggacgggtaaattcaaatagcacactccttccattcagaatatcttaatgaaatatcatacttttcccctcacatcaaaaaagacagaactttttgtgactaaaagttaatttcttaagccaaaagaaaatttctggaagcagtcactcaggaagtttcctaaaacatttatatgctaagatggtaaacgatgggatttgttgtccctttgttagcaggaaggcatgatcttgagcagcttcaggtccatcaagatctttcccaagtgagaacgcaatgggcttttctggctgtaagttgtccattgcctctgctgtcattggagagaaagaaaccaatcacctgctcgtgttttttcaaattacaaaatccattcttacattgtaaaaaaacaggctgctgctgattttggctcacaggccatagtttggatcccttatctattcagtatactaagtatctgttcatatcaatatattattcttgattatatgcaatgactacattcttgattatagtcaatggatatattcttattttcaacattttaaggaatgtttaatttgtaaaaagttaaaagtcacagaatggtttaccattcttatgaataaaaacagaatttcaggatttcatatgaatgtttctagttcatgctaatttaataatacacttttaaagaatgcattttctaatttttcaatgatttagcatgttttcagattttatcaccaatatcatcaaatgacttatttgccaaatttaccattttccccaaacttatatctttgaactctgataaaacttaatgacttagagtggattgaaatattttaacagtttttgaagatacttaggatatattgtgcttggccaatttttctattaacattttaggaaaggttccatttgtctgtaccccaggtcccttactgctgcagctgaattgagcaggggacaagagaggggaacttgcaatggggaaaagaaacaaaggagagccagcatccagcacagcttgggcttccaacccctgaagttgggttgggaggaaactggagtccatgagagaaggaaatgaggagctaagcaggtgtctgaagccctcaggactctgaaatccttccttccaacgatagtcttaaactctgccaactcagcatactgcaaattttatgaatagcttaaaaaaacaggtttttggtaaatcagtatatttggataatttgacagattgttactttgattcatgttcattcagtccatttgtctcctggcaagttggcttttggaaaatttcctattagcagattgacttgggaagttggtatgcttccatactgaaaagcagtggctttccagaagcaaaactaagaaggagccaggagttggtcaagattgcatccttcctggaaacaatagtgtgcacaaactacctggcaaagttggtaatagctcataggtatctgcagttcattctgtgggggatgttagtgggttaagctgcggtgtgaatatacagtgatggaatggatcttaacatatgagcctatcgatttcaaagacatacacattttggtaatagagacaaatggaggcatcacatgcctctatcaaaacatttcatgtaccccataaatatatacacctactatgtacacacaaaaataaaaataaaaaataaaagtaaaaataaacaaattagggcatattggacgtgtgacatgacaaaatcaaggcatttctggctgggattaaacaaaactagagattattttactactccctagtggtgacacaactattgcccttactggtataaggagttagcagactgggttcatattctggctttgtcacttactggttgtgaacttatatgttattcatgttataaagctttattttcctcatctataaagcagagatgataacagagcatatgtcattgagttattgtaggattcagaaaggtaatatgtgtaagatacagacccctgggtaggaacttggtaaatgatagtgtcttttctgtcagtcagagatgagattggtcgtgggtagggagtatggttagttagcatttaccttaagattattgagggtgatgatgaagcattcacttcaagttactgatattctgaaccgatccaaattacatccattgactatctgcctttagccaaggttcctaaaatgaactaaattcatcttcaaataatgtaaatctattaagacgactatctccaattatttatttaataaaaggtggctatattgaaagagaaggacctatcaaatatttagaaggcagtgtagttattttgtattcggaaggatcaggatttgtacattgattcagaagatatttacaagtgtacattgtatgcagagccctgtagccacagaacacgcttctcttctccccctcaaaggagggtattggtctaggtgatctacagcaatagcaacattcccaactctctcagtgcagtttcaagtcacaaaacccaggctcttgatccctagtctgctcatcttaacactagagcacctgcttcttggctccaaaggaatagagaaatgatagtgcatgcagaactcatcttgcaggaagacgttttctaggagagagaattaaaattacaaaagaacaattgtaaagcaaattacagtattatgcctctcaaatcatatagttaagtggaatagaaacttagagacatagggtggtcaatgaaagaatggctaatgagggcatttgaactgaccacacttatggggactgtacagattacaacgtaatttttcttttttttttttaatttttcagaattttgttttcactttttgcatgtggagttgagaaaaatatttttccagctttatttaggtataattgaccaatgttgagggtatgtgaccccagcttctgttcaccttccatggcttgcctagaatactgaataaaatagtgggaggctggggcaaagagaggctgtttcaggcttaattcccagggagccacttaacaggaatcctcttctaagaacataatgactcttcaggagaggtgggctttggagctgctagtatctagttatcaaggatggctgagatgcagttggatttgaaggaaaagatgatacctgatccttgactcaagattttacatttcagacagggcatggtagtgggcttcctctgagagcctgtagacaagccttggttagagtaaccttaaaaattagctccataaactttgttcataacctgcaaccaagaagggaaatctggttttctttccctccatcacttcagattatatcatctcagctgtaaattaagtagggagagacatttaggattatatttttactgtcatcagtttcctgactctctgccacaactgttcaaaacacaccttagtttgtactccattgacgtatgaaaggacagtattcatttgacatctttttcatatttacagtttcatttatacagcaagtagaagtagatgatattttaagccaagaacaaccttgcattaaagtaattcagcagtgttgagcactttaccaatggatatcaaacctcggtaaaatatttaaaatgaagagagagaagaaacatgaagggctcgatttaagagtaatattttgagattttacataatgagacagaggtacttttctttgtagaattaggtgttatttttacgtaactacaactggcaaagtgttctttgatctttctccttatttttaaaaattaagtgatacaatttggacaaagaaagttgtgcttgtatctgttcctaaccaaaggccagcagtggatatggctgcaaaccctctgttacatgttatatcccatatcctgagcccaaactcattatttacatgcacaaactagttaggtattaaatattccctaatgtttttatttaaaattgtaagtgcttctctgtgacttttaattgtgaggtgttttttgttttgttttgttttgttttgttttcgggtctcgctctgtcatctaggctggagtgcattggcgtgatcacagctcactgcagccttgacctccccggctcaagtgatcttcccacttcagcctcctgaatagctgtgaccactggtgtgcaccgccacatctgactcattttttattttttctagagatgggatctcactgtgttgtcctggctggtctcaaactcctgggttcaagtgatcctcccaccttggcctcccagagtgcctgtgacttttatgttctacatcaaatatttgccatttatactggcttatggagaggcacaaaatgtaaattcactgaataatttggaaaatatttacttgtatttatattcttgatatttaagtcggtggatttgaaacaaaacatacttgcttcacaacatattgctgtcaaagagttttgtccagtaaaacttactgcatcctttaatacagcactgtccagtagaactttctgtgatgattgcagtggcctataatctgcttcatccaagacggcagccactagctacggagcacttgaaatgtggctactgtgactgaagactaaattttaaattgtatttaatttaaattaacttaaattttgatttagccacatgtgtctagtgactgccatattggacaatgcagcaagcaatatattcctatgttgtttatctcagatataaagttatgcactatttagaagccaatataaaggtattagattgcttttaagcaacaaatagaagctccagcttgttcattaaaataattttgtcaatccaggcagacttgggatgaaggatgtgaaaacattttgattgaattgactactaagttttatctgtttattcctttatttacttagcaaatatccattaagcacatagtaattgctctccattgtgtgaagtgcctgggatacaagaagtttaaagcatgttcattgccttgaagaaattaaccaggtagaaaaagtagatagaaagtaataagaaacattcatataaggcagaagagagttgagaaagagggaagagtctaggatgacttggagatttcagtcttgagtgactgggtggaaggtggcactgttcaccaagtaggagacactggagtggggaacaggagtctataccatgttgaattgaggttagatgcccacatgcatgtgctgaaggcagttggatatgtgggtctacagcttgggaagaggtcttgaggtagagctgtgggagtcacgcatagttgaagccaagggatacgacatggtctgcaaggcagataatataaagaaataacagaactccaagagcagccctgaagaggtaccagcatttatgatgtgagaaaacattctgttagactaacatagcttataaatttagtcggaggttgaaaaattattttaaaaatatgtaataatataggaattttgtttttaaataatatgtgggcagatttacaagtgactccatttatgtttgtttcatgacactgaaaatcaaaccagtaagaaatattttatattttacatattttatattttaattaaattaatattaacaacataaaatattaataaatatatttaattaaatatatactttttatatattttaaacattctgtattcgatatagtccagttatacatgcaaatgaatgacttaactcattaactagttgttttatgctgtgcaaatcagtacttcctaaatattacgtattttggatatccgaaatacatttttcaagctcttaattttttagtgttagaaataaatgatataaataaaatggatttttgtcagggtcctctgaaatacataatggaaaatttatctccattggatcagaattcactttttgaaatcatgtggcataacccaggttttctcttaattatgtgtcttctgaatatgcttggaaagttttatatatatcattttgccactgtcttgctgctctgaggtcttgttttttataatatttattatcagactttaatttctcattttgtggagtaataggggcttttctaaagaaaaactcgtgaaaacaaaatacatttcaataacagaatctcagttatgaaatttttaaggcttgaaacactattatcaatattagaaataagattctcattcattcatattttctcacccatacttaattggtgaaaagtaagctagtatttcgactctagtgtgccatgaagctgcatctcaccctgggcaaatttctatctaattttgatagaaatgaattgttaatgagccccgagaatggagagtttctctaattacaggaaacaaaattaaattgggcctaaaggcatttttttttttgtaattgcagttggtttaaaaattgaaaaagaatattcactcaaacaccttggctttaaaaatattggtttgctccccactgttaaaaaggcattgagacctgcagcaaacttcattctaatgagggtccagatgatttttttttttgtagatgtgtagaacaactctgtgggaaaaatgatacctcaaagattaatgatgttctgtagtagggaaaataaaacaaatagtttttatttgaacctttttattgtatgatagaaaattttgatttaaatggcgagtgagatatgcttaccatctctcttttttcctatttatagtagctctcaaggtcaaagaggacacactagcatgaaagccgtgtacgttgaacccgctgctgctgctgctgctgctgctatctcagacgtatgtacattgaggaccatagactacaatcttagacccttatccgtgtgatgttgattatttagttaatgtgtgttaccaagaagtatgtcatatggatgtgacacatgagcagtgttccacagttgccatcttgtagacatttcttattaggagccagtaactgccagacttcgaatggtccctgtagtgcttgaaaaagaattaagctaagctgtatcccagatgttgttcagggtctttttgccttgtgagtacatttcataatggaagtttacttactgacctgcctggtgtagaaagccatgaaggctagaacctagtgcctaattagcctaggttgtctgcatccgttctctaagacaacgaatgtatcatcaatttattcattaaccagatatgactagaaagaatccttaagggacatacattaatagaaatctacctgggtctaccctcagtgatctgatgaaactctagactgggacataaaaccaaactgcaaggagagaggtagagaagaacagaagaggtatcccagaaggcatttcccacgttaaaaagtgacagggtggttcctcaccttacatgccactctatgggtatatgtaccatagctgataggctggatcaccacagtggtaacagtgctacagagagaaaacatgaccgagacatcagaagacaagggtttgattcctgattctgccacttaccagttacatggcctggggaaagttgttttaccttggacagcctcagtttcctcatctgtaaaatggaagtagtaataataatctctgccaggctacctcatggggatataataatgctcaaaggaatcttatcgggatatttattttactcctataatagaatgaaacctctgtgagaggagagatcattggctgtcttgttggtcagcatatccccagtattttgaacaaggcttgttacacacagtaggcagtcataaatattagatgcacaaatgagtactctatgttaaagcactctgttatttttatagaactcttcaaatatttggtaaagggatttcaagagcagtatagacaggctgcatgcatagactctaactttggttttcaggcctccatgtgttttgcctgaatgaatttgtactgggatcagtgcagacagcaggtcttttcagtatttaagttcttctgtaatatggagatgccatgagcacatattttaaacatgaagtgctgattttgtattgaattgtccaagtattgctcatttaacaaagtatgtctatgtgaataaaactttctccattccgaataagtacctctgcttaacctaatattctgctcaaagaagtatgaaacaaagaggaaataaggtagaagaatgctaatttagacagagcagtgttctgtttacacacaaactaattacaggtatgctgggaaaaggggccaagccaaccatatagctctagccatcagtgtaacatctacacagttgtcaggcttgcttcatcagcccgtcagtaaataaatatttacccagggtttatactgtactgtgtgtgaagaatccagagtccctaaacttagtatatgttgaagaaagctggattaaaatattctcattttataaaatatataatgcctaagtaattataatatttagagaaaagtgggctgtttaaaaaaaaaaagaaacacataatcccactgctgtggcacagctgctatttaattttgcttattcccattcagtcttagtccaccaacgtatatatttttcatgtagttacaatgaaaaatatagcttacattctactgcatacccttggcttccacttatcactaagttccatttttttcaacagtcacattgatcattttttaaaactgtataatattccatgaaattgtgagacctgcttccagccaagatggagtgagggggccaggttaacttgcctacctgaaacgggcaaaaataaaacagacaaaatatatgacacaacagttttcatgataatggccagcaggcagcaaaggccatggattcttgagcaattggaaatcaatgagaggagcttcacagttaccagagcttactacatagcaagtttctaggccacattgcagagagggagaacacatatggagcccagtggactgcccgagttgagattgaggtgagagtatagggagactaagtttgctagcggagtcctagagaagagagagctgcatggagaaagaatgccagagatctgtgaggggccccctctagtattcagcagcatattgattggcatattcacttgaggaagctacttgaagtggggctaggggaaaaccattccagaggattacagagaacaatactagtactcacaaagggttagtaacagttcttgttcctaccagccatactggaaatcctcataacacacaagacattaagtgagagtacatagaaatgtcttgcatcaggtgtggagaaaaattaaccctaatgatatggtttggatctcctttttaattgactctgtcccaaatacttctcttaatgatgagtgtaggtgacttatgttagtagccacccacattctgccatccattcctagagacaggttgctccttagccatgttacactaaacaggcatgtttggcagaattgcagcttgtgcattatcagattgcttttgcacccaaatccattgtgtcaggaggtggcaggtggggtgggatcttcagaagcagctgtctttgagcatgaaccaagagctaggtaggacagaagcagacaacacagaaacagtcggctagagctgattacttgcaaatgagagtccaggacaaacctgatttagggaataatcatgagagcatcttgcactgattttatacctactatggtaggcatttagtcatttattcattcaacagatacttatttaagattctaaaaagtagtcaaagaaggtcagccctgaaaaagaataataacactgaaaactaaactgtattaagagcttcctatttgtgcattttactgggtgcttaagtcccacaacagacctgtgaggcattatcattccagttttacagatggcaaatctcagagtcttgctattgaataagttgcccaaagtcacacagtaagtgtcagagccaggattcaaacccagatctgtctgatctcagtatctatgtctcttactgcccaatgaggcgtctacttttaaaactattttgtcatattgtcctatttgttgcatggtttcccttttgttctttatatatttgaacattttaaatgtgtttatttttaaaggccatttctgattccttcatttactgatttattgaacaagtatttattgaacacctaccagataccagacactgttttaagttgggggtggattcatcagttaacaaaacagtgaaaaattgttgctctagaggaacttacattccaacagtgagaaacagacaataacgagatgaaaatattaaataaagaaatcattgattagaaggtgacaagacttaggccaggcacagtggctcatgcctgtaatcccagcactttgggaggccgaggcaggcagatcacgaggtcaggagttcgagaccagcctgaccaatatggtgaaaccccgtctctactaaaaaatacaaaaattagccaggcgtggtggcacacgcctgtagtcccagctactcaggaggctgaggtgggtgaatcacttgaacccgggaggcggagattgcagtgagctaagatcgtgccactgcactccagcctgggcgacagaatgagactccgtctcaaaaaaaaaaaaaacaaaaaacaaacaaacaaaaaaaactcaacccaacccaaacaaaagagaaggtgacaagacttattgaaaagatagaacaggatgaggaggtttgggaatgcaagaggtcggggagtacagtattaaatataagcaatgacttgaaaaaggtgagaaagctagccatgaagacatctatggtcgggggagactatttcaagaagaggaaaaacttctgcagggttttggaggtggaagcatgcccagtgtttagaggaataacgagaaggttagagcagctggagcagagtgagcaaagctgagagtaggtattgatgaagtcataaatgtaaggaggtcaggttgagtaaggctttggaagccattgtatagattttggctttaactctgaatgaaatggagaatgattagagagttttgagcagaagaatggcatgacctgacttgtttattaaaagagtcacagtgttgagaatagactgtgggaggaagggcaggaatggaagttaaggagtccagttaggaggctatcccagcagtccaaatgagagatgataatggcttgaagcagggtggtaaccgtagaagttatgagaagtggtcagattctgaaaatatatatgtgtgtgtgtgtatatatatatatatatttttttttttttgagataaagtttcgcccttgtcactcaggctggagtgcagtggtgccgtctcggctcactgcaacctccgcctcccaggttcaagcgattctccagcctcagcctcccaagtagctggattacaggcgcatgccaccacacctggctaatttttgtattattagtagagacggggtttcaccgtgttggccaggctggtcttgaacttctgacctcaggtgatccacccgcttcggcctcccaaagtgctgggattacaggtgtgagccaccgtgcctggccttctgaaaatattctgaaggaagagcccttacatttgttggcatttgatgacgggtgtgagaaaaagagaggagttagggatgacgtgagcaactgggaggataatgttgcattaactaagatgggaaaaattatgggaagaactcgcagcttagggatgttttcttccttctttccttccttccttccttccttccttccctcctcctccttcttcttcttccccttccttccttctctctctctctttctttccttccttctttctttctttctttctttctttctttctttctttctttctttctttccttccttccttccttccttccttccttccttccttccttccttccctccctccctccctccctccctctttctttctttctttctttctttctttctttctttctttctttctttctttctttctttctttctttctttttctctctttctctctttcctttcttctttcctcctttcttctttcaagacagggtctctcactgtgttgcccagactggaatgcagtggcatggtcagctcactgcaacttctgcttcccaggctcaaatgatcctcccaactcagcctcccaagtagctgggactgcaggcacacactgccagactcacctcattttaaatttttttctagagacagggtctcactatattgcccaagctggtctcaaacttctgggctcaagcagtcctcccacctcagcctcccaaagtgttgggattataggcatgagccattgtgcctagccaatggtgttttctttggggggaggagtaatatcaaggacttagttgtgaaaatgtttatgactgagaagccccttagacatccaactggagatgtaatacaggactggaaatttgaatttggggatcatcagcatggatggtcttaaagctgtaagtctggaggatggacactaaggtagatagcaacaaggaccaaggactgagttttgaagtacacccaaagttaagagattaggggaaaaaaaggaggaattagcaaaagagacttacaagtgactagtgaggtagaaggtaagcaaagtgaagaaagtatttacaggaagaaggaatgatgaacaatgtcagctactgctgatagattacataggttgacaattgagaagtgaccattagagttaggacctgtaggtcattgctaaacttgacaaaagttttggtggagtatggtggggttcaaggagataatgtctgatgagagtaggtttaagagaagatggtggaatggtggcaggtaaataagagataagatatagagatgatttctaaactcagggtatttctttgttttgatttttgtttttctttttattattattattatactttacgttctagggtacatgtgcacaacaagcaggtttgtcacatatgtatacatatgccatgttggtgtgctgcacccattaactcatcatttacattaggtatatctcctaatgctatccctccccactccccccaccccatgacaggccctggtgtgtgatgttccccttcctgtgtccaagtgttctcattgttcaattcccacctatgagtgagaacatgcggtgtttggttttttgtccttgtgatagtttgctgagaatgatggtttccagcttcatccatgtccctacaaaggacatgaactcatcattttttatggctgcatagtattccctggtgtatatgggccacattttcttaatccagtatatcactgatggacatttgggttggttcctagtctttgctattgtgaataatgccacaataaacatccgtgtgcatgtgtctttatagcagcatgatttataatcctttgggtatatacccagtaatgggatggctgggtcaaatggtatttctagttctagatccttgaggaattgccacactttcttccacaatggttgaactagtttacagtcccaccaacagtgtaaaagtgttcctatttctccacatcctctccagcacctgttctttcctgactttttaatgatttttattctaactggtgtgagatggtatctcattgtggttttgatttgcatttctctgatggccagtgatggtgtgcattttttcatgtgtcttttggctgcataaatgtcttcttttgagaagtgtctgttcatatcctttgcccacttgttgatggggctgtttgtttttttcttgtaaatttgtttgagttcattgtagattctggatattagccctttgtcagatgagcaggttgcaaaaattttctcccattttgtaggttgcctgttcactctgacggtagtttcttttgctgtgcagaagctctttagttgaattagatcccatttgtcaattctggcttttgttgccattgcttttggtgttttagacatgaagtccttgcccatacctatgtcctgaatggtaatgcctaggttttcttctagggtttttatggttttaggtctaacgtttaagtatttgatccatcttgaattaatttttgtataaggtgtaaggaagggatccagtttcagctttcaacatatgtctagccagttttcccagcaccatttattaaatagggaatcctttccccatgtcttgtttttgtcaggtttgtcaaagatcagatggttgtagatgtgtggtattatttctgagggctctgttctgttccattggtctatatctctgttttggtaccagtaccatgctgttttggttactgtagccttgtggtatagtttgaagtcaggtagcatgatgcctccagctttgttcttttggcttaggattgtcttggcaatgcgggctcttttttggttccatatgaactttaaagtagttttttccaattctgtgaagaaagtcattggtagcttgatgggggggatggcattgaatctataaattaccttgggcagtgtggccattttcacaatattgattcttcctatccatgagggtagaatgttcttccatttgtttgtgtccttttttatttcgttgagcagtggtttgtagttctccttgaagaggtccttcacatcccttgtaaattggattcctaggtattttattctctttgaagcaattgtgaatgggagttcactcatgatttggctctctgtttgtctgatattggtgtataagaatgcttgtgatttttgcacattgattttgtatcctgagactttgctgaagttgcttatcagcttaaggacattttgggctgagacgatggggttttctaaatatacaatcatgtcatctgcaaacagggacaatttgacttctcttttcctaattgaataccatttatttctttctcctgcctgattgccctggccagaacttccaacactatgttgaatagcagtggtgagagacggcatccctgtcttgtgcgaattttcaaagggaaagcctccggtttttgcccattcagtatgatattggctgtgggtttgtcataaatagctcttattattttgagatacgtcccatcaatacctaatttattgagagtttttagcatgaagggctgttgaattttgtcaaaggccttttctgcatctattgagataaccatgtggtttttgtcattggttctgtttatatgctggattacgtttattgatttgtctatgttgaaccagccttgcatccctgggatgaagcccacttgatgatggtggataagctttttgatgtgctgctagattctgtttgccagtattttattgaggatttttatatcagtgttcatcagggatattggtctaaaattctcttttttttgttgtttctctgccagactttggtatcaggatgatgctgggctcataaaatgagttagggaggattccctcttttcctattgattggaatagtttcagaaggaatggtaccagctcctccttgtacctctggtagaattcgactgtgagtccgtctggtcccggagtttgtttggttggtaggttattaattattgcctcaatttcagagcctgttattggtctattcagggattcagcttcttcctggtttagtcttgggagggcgtatgtgtccaggaatttatccatttcttctacattttctagtttatttgtgtagaggtgtttatagtattctctgatggcagtttgtatttctgtgggatcggtggtgatatcccctttatcattttttattgcgtctgttagattcttctctcttttcttctttattagtcttgctagcggtctatcaattttgttgatcttttcaaaaaaccagctcctggattcactgatttttttggagggtttttttttttttaaattctgctctattttatgtagcattttctccatgtctgtccaatctgctgtcttgattggaagccctatggcctttcccccaccacttccaaaaaagtaaaatgcaaggatctcctaaaaattagagcactttaacaataagccaccacagggaaaatgcaaagatttgggaacagacttcttgaatgccctcttccccctctccccctacatatttgcagtttacataaccatcaggtattggagtttgcatttgaagcctactctatatccagcctcaaaacccatgcctctcttttcaaatcctttagcacactattcgtggagacaattatggaataaaggtgaatccaaaactccactgaaaactgtaaaagcatgttgattttcttcctatctccatgcatgcattttcaccttagtcctaattgcattttaaactgttatctttttgcttccaaagtagtttcttggctttgttttttccaggccaattaccattactgcacatgatgctgtcatttaagttaatttaagctcactgcatttatattgataagcccgaacatacgaatacccaaaagtggacatcttaattaacatttgagaatataagtttatgttgaaaataatccagaaagcaaagagttagtgattaaatcgatagatggctatgaagaagaacagaaggaagaggaaagagacaggtcatatctcctcttaatgaataccgattcaccataatgtcattgtaagtaatgaaaagattgtcacatccccagcaacatatcacttattagggagtataaaacatagtcatttgaacagtgaggttgcacagtttcctgaagttgaaatgctgggatgtgatccaacaaacagattctttgtagaaaaatcaccatgggtctgtgtcttaagccaatccagaacaaaagcaaacaaaatattttgtcagggatgtaaaatatttcactgctaaaccaggtacttaaatttcaatggacagtgatccacagactattcaaaaaggattcagttgttcaggaaataggacaggatcactcaatagaaatattatgtatgtagtttaaggcaacaaatggcttaaaggtagccaggcttaggaaaaagagcattgggtttggagtcaatggattctatctctcactctgctcctgtctgtctgtatggccttgccctctttgacactatccagtgagaacattggactagaagctcttagaggccttttcacctctctgcttaaaatagttttgctaataatactttcaactttaatctgcctaaagacatgcaatagttgttaaacagcccctggttggccttttcttgctctaagcctaggatgcaagtgcaggaactctgggaaaatggccttatcagtggtggtgcaggtctcccactgctgtcccatttctctgtgaaccagtttgtttgggtctaataatgaggaatgggagatgaggtgactaccatccttggcaactatcatgacagcatcctactgacaccactgaaaggcagaattgtttttgccatgccttttgatctataaacattttttgatgcctttatttttagtgttatgtatactgtgtttctcttcttcagtttgtcagtgtataccttgtggcatctataatctccgcttgttatcttccagcaatatttttaaggaggtatttgatgatgatttttgttaggttttcagttgattgcagcagtgttagaaattgtgatgtgaaatgcatcaaagtttgtattctgcctgtgtttcctattctttctaactccaaaatgcaatgtcctatctttctcttttggaaatgtacaggaccaaattgatattgcagaggttgagcagtatggaccacaagaaaacgttcacatgtttgtagattctgattcaacttattgctccagtacagttttcctggatactatgcctgaatctccaggtaggtacatttatgcatttggatagggactattagaagaaaaacagtgacccccagggtagttacagtttttcaaatgaatataatgctctataatactgtgaaatcccagagtgaattccaactttcttcatcttctgtaaatatttgagatgatgatttgagaataataaaaatgagtatttcatcacagattcaagtcttttctcctatttaattttaatcttctaaaaattggcgctggatctcaatccttgaaggaatagcgttttatctttttatactcgtgtagtctattctgctatcacacagtatttggattccaaagaaacctcttgttattgagttttcatgccaataaagggggaaagtgagagtctctcaaaaacagtgatatttctttaatgagtttcaatattaaagatatttcgtaaccgtaattgtttgaaaagtacaaaacttaaggaaatggtggatgcataatacaaattatatctcctaattaatcttatcataaataattggtatgtggaatctccttatatagaagtaataagctctattttaatttttatttcactctttttcagtttttaaatccagttttagtatctccaacttttaaaattcttagttaacaacttttccattgttgctgtcaatctcaaagctgtgtttaaaaaattccttccaaaacaattgatttttggcaggagaggtcaaactccatgaactcataattgtgatttctaaaatttataagagcattgattgctttaaacctatttatctggacctaccattgtaactttgctatagagaattatttgtattcactactgttaagccaatgatggagaaatccttataaccttccacagatgactgttccaacaaaatgagcatattgaaatggctagcagcttatggctgatatggtagaagtcaagtaactcctgggtttctcactatcacttacagataatttagtagctttgtttacttggaatcagaaaattaaaaaatggtaaactgggccgggcacggtggctcatgcctgtaatcccagcactttgagaggccgaggtgggcggatcatgaggtcaggagatcgagaccatcctggctaacacggtgaaaccccgtctctactaaaaatacaaaaaattagccgggcgtggtggcaggcacgcctgtagtcccagctattcaggaggctggggcaggagaatggcatgaactcgggaggcggggcttgcagtgagccgagctcttgccactgcactccagcctgggcgacagagcaagactccgtctcaaaaaaaaaaaagaaaaatatgctaaaatgatttggaaaatggcttttagtggaaaaaagagttaagcagaagaatttagccaacagtctaaacactggaagtatccagaaaccagaatttttcaaaatattttcaatggtcatcccaaactcatgctatgattaaaggacaattcgctcatgaccatagcatggtaaggtatgcaaccccaggctgcagaaagcagataggaagtgacggagtggttcattctgcctaatccagatgtttctcttttccaaacttttaatcttgaaataattttggacttgaagagttgcaaaaatagcacaaagaaaaaaatagaaaaataagggaaagataccatttaggataaccttcatttagcttcccctaatgtaacattttacataaccacagtacagctggcaaaactaagaagttaacattgatgcaatacttttaagtgagcttcagcctttattcagttttcccagaaagttgtttttctgttccaataactaatccaggatccctcattgaatttaaataatatgtgtttttagtttcttccagtctttgacagtgtctcattcttgcttttttttttttttatcatccgatacttttgaaggatatgggccaggtatttgacagaatgtccctcaatttgggttcgtctgatgatttttcaagatgagattgaggtcttgcattttggggaagaataccacagatgtgatgtgccctccttagggcatcatatcagaatatacatgatggtatgttttattgctggtggtgttaacttgattgcttggttaaggtggtactgttttcccctttgtacttatcaaatatttgaggggagctacattgagaacatgcacataatgttttctgtttctccttaaactctccttcacatttagcatcatcagtggaattggcctacagcaattacttctaatgccaattttttatttccctcgttttttgtatatttattaactgcaatcttgctgtaagaaagagttgttccttgtctctctttcattcatttattcgtacattcatttacatcaggatgaatccatgggcatttttttattatttggtttgcaatccaataccgtcattaaaaaaaaattgttccagctttggctcatggggctcttttaggttggctcccttgtccttttatcatgtctgcatctttttttttcccttcacttccttatttccattattacatgttgtcatttaaatcaaccccttctttaaggaaccttatttaggtcctttatttggagagtggtatttagaaacgaagatctgggtgctagttgtactcattgttacaggtgtgtcactacttctaaaccctctcagtggactaggaaagatgtctattcatactaacccatgcaaccatatacaaccatctgtatttatttcagcatgtaacaaccaacaacaacaacaacaacaggagttcattgatagttcctactccagcccagtatcatagggttcattctagccttttctgtctgcttatttgtaatttgtatctctgacagtgagaaatctggctttcattatctatggtatatttattgatttttccaatacataaacattcataaaaagtagtttcacaattgctaacctgtaccccttaaggaacaaatttaccatttggaattaatttgtgtgtgcattttttttgtctttagctttgcagtatccaggcaaacctctgttttctgaagttcctgcgttagcttctttatttctcacccccatcactgtggatatgtcatttatctgtaatagaattagattcatttgttacagtctgtattttcgcctaggttttcctgcctcctgatcaatttcttttcaattttatatacagtaaaattcactctttgatatatacagttctatggattttgacaaatgttgagagtcatgtatccatcaccacagtaccaaacagaatagttccatcacccccaaaattcctttgtgctccctctttgtactcaacctttgtctcccatcccctgacaaccactgatctgtatttcacctctgaaggtttcccttttccagaatgtcatgtaagaggaatcatatgacatctagcctttttggtctagcccctttcacttagcaaaatgcatttaggattcatccacgtttgcatgaatcaacggttcattcccttttattgctgagtaatactgcatcttatgaatatatcaggttttaaaacttcattcacctgtaaaagaacatctggattgtttccaagtgttttttgatcatgaataaagctacattaaacatttgcgtagaagtttttgtgttgtatgaatataagttttcaactcctggttgcgggactgctgggtcatttgggaagtatgtgtttaactttattagaaactgacaaaatgttttcaaaaatgactgtaccattttgcattattcaaataatgttctccactgtgcttttcagggctgttgaaaccaagtcatgtcataacacctcccagagaactttgagcactcccgaggtcccacattctgggcaacccgattgtgcagaagtgatttatgactagattttatttggttttatcggttggatggtactaaatctccaaaagcagagccaaaataattttataatgaatgaaatgacactaacaaatgcagtgggtttaggcactagcttaagctggagggtaggcagtggtaacttcaaacactctctcccttttcttcattttcaaatatgaacagatttttaaaataatattctgaatgattcctggcacctggcacatctcatccttaacatgggctaaaatgaccctcgtacagtctttttgataacattagtacttttgctttttaagtcatgaactcccctgtgctttcttcctcagccttatccttgcaagactttcgaggtgagcctgaggtgaatccattgtacagggcagacccagtggacctggagttctcggtggatcaggtggactcagtggaccaggagggcccaatggaccagcaggacccagagaacccagttgccccgttggaccaggcaggcctgatggatccagtggatccagaggactcagtggacctgggggctgctggcgcaagtgctcaggtactctgaaagtctcgcttcactcgcttcacgtttgtctggatagctaaccttgcaaagcccaaattttcactcttgtgaccagtttcacttcacagaaagtatgtttgttactttttcaaaactatatcactatttctgttatactggattttcagatgccgttgagaactcaatggaccctcacaaacagggagattggaggttctctaagtaagaccaaatccctgtgctcttcttaatatgaaatcccatggacactttgtacttgaggaaaagtttgagccaaataagaagcttagctgctaagaaaaggtggtatttttaagagccctgcttttaatcacctgtgagagcatgctaaccatctagagggaagacaactttctggccttcccataccaaccctctccctgcaccacaagctaggttttcccagtggaatttttattaggttagaacatgcatttcagagtcgttagatatacccaaccttgaaacatcagtaccaatgtacagtccacggccaaatcaaaatggttggattaactactgtgtagttcctctaccctgaaatgtgtgtacataaccacagatttcgatgatcatcttttatattagacaggattattaaaatcaggattagaagccaagctaatgagttgatggtcagttacctggaattgtgtgcgttcatcactgagcctaagattgagtgactccggttcaaaaggatcctcatccagtgaaaataattaagggctagaacacaattgtttgagtttggccccagcagtgtggccttggcaaattactgagcctcagtttctccatgttgaaatggtcttgccttgcggggatttgcagactgctgtgaaaattctttgagctatttaaaaggaaatttctgtgaaaatctgctgtggcctgatttatgtccttatcatgccaaaaagttgtggtccccctttcactgttgacaggtttatcttctcttttgaattaacttgtaattaaattttgaagtataacttttaaaaaatcaccaaaataaccagcaatgaacgtgtgtcatctggctctgcatgtgctagtgtattaggcttattcctgggtgccatgtatcagcaacctggagtgtatccagaagatggagaccaggatgaggaaggggctggaaaacatcttaatcagttgccgaagacactgagaagggaagaatgggaagggacaggacagctttatccaagtagttgaagggtcataaagtggaagatatggttccagaggatcaaggaagcagtctgacactattagcccttctcagacggattaggtcacctctcaaaatagcaagtcctctctccttcgatggagtggtgagagtcaatgcttggcagctccttttccaggaaaagcaaagaaaatttctgcttggagagggtgagaggatgtgataacctgtagggtttgtctcttctagtcctgagtttagaggggtgtgtgtgtgtgtctgtgtgggtgtgtacacgcgcgtgcatgtgtgtgtgtgtgtttttttttttttggtctaatgaatgtctgctttcttataggaagagacatacaatacatagtgaaagaaggacaagttgaacaattttcaatggactaaaaatacatatataatttttattccaaataatgaaaacaacaacttgtagggtattctctctctctctctcaactcatctatgtacttacattactcataaagggtattgatgaaccacagtataagtctatttttggtttctgaaagttgcaagtgtaggtacctttttcttatcattaatgttgtaaattctttatcgatcaggactgtggctctctgaccttgtttatatgcatggtatccagcatagttcagggcaaatagcaattgttcccaggcccgacttccagccttgaaagataattattttccaagaatctcatctcttttctgtccctctcggccaatcagttgagaagtctcatccacctttttttttctccttttttttttaattatactttaagatttagggtacatgtgcacaacgtgtaggtttgtttcatacgtatacatgtaccatgttggtgtgctgcacctattaactcatcatttaacattaggtatatctcctaatgctatccctccccactccccccaccccatgacaggccctggtgtgtgatgttccccttcctgtgtccaagtgttctcattgttcaattcccacctatgagtgagaacatgcggtgtttggttttttgtccttgtgatagtatgctgagaatgatggtttccagcttcatccatgtccctacaaaggacatgaactcatcattttttatggctgcatagtattccctggtgtatatgggccacattttcttaatccagtatatcactgatggacatttgggttggttcctagtctttgctattgtgaatagtgccacaataaacatccgtgtgcatgtgtctttatagcagcatgatttataatcctttgggtatatacccagtaatgggatggctgggtcaaatggtatttctagttctagatccttgaggaattgccacactttcttccacaatggttgaactagtttacagtcccaccaacagtgtaaaagtgttcctatttctccacatcctctctagcatttgttgtttcctgactttttaatgatttttattctaactggtgtgagatggtatctcattgtggttttgatttgcatttctctgatggccagtgatgctgagcattttttcatgtgtcttttggctgcataaatgtcttcttttgagaagtgtctgttcatatccttcgcccacttgttgatggggttgtttgtttcttgtcaatttgtttgagttcattgtagattctggttattagccgtttgtcagatgagtagattgcaaaaattttctcccattctgtaggttgcctgttcactctgatggtagtttcttttgctgtgcagaagctctttagtttaattagatcccatttgtcaattttggcttttgttgccattgctttcggtgttttagacatgaagtccttgcccacgcctatgtcctgaatggtattgcctaggttttcttctatggctttgtggttttacgtctaacatttaagtctttaatccatcttgaattaatttttgtataaggtgtaaggaagggatccagtttcagctttctacatatggctagccagttttcccagcaccatttgttaaatagggaatcctttccccgtttcttgtttttgtcagatttgtcaaagataagatggttgtagatatgtggcattatttctgagggctctgttctgttccattggtctgtatctctgttttggtaccagtaccatgctgttttggttactgtagccttgtggtatagtttgaagtcaggtagcatgatgccaccagctttgttcttttgacttaagattgacttggcaatgcaggctcttttttggttccatatgaactttaaagtagttttttccgattctgtgaagaaagccattggtagcttgatggggacggcattgaatctataaattaccttgggcagtgtggccattttcacgatattgattctttctcatacctgattgccctggccagaacttgcaacactatgttgaataggagtggtgagagacggcatccctgtcttgtgccagttttcaaagggaatgcttccagtttttgcccattcagtatgatattggctgtgcgcttgtcatagatagctgttatcattttgagatacgtcccatcgatacctaatttactgagagtttttagcatgaagggttgttgaattttgtcaaagatcttttctgcatcaactgagataatcgtatggtttttgtcattggttctgtttatatgctggattacgtttattgatttgcatatgttgaaccagccttgcatcccagggatgaagcccacttgatcatagtggataagctttttgatgtgctgctggattcggtttgccagtattttattgaggatttttgaaaagatcaacaaaattgatagaccgctagcaagactaataaagaagaaaagagagaagaatcaaatagacgcaataaaaaatgataaaggggatatcaccgccaatcccacagaaatacaaactaccatcagagaatactataaacacctctacgcaaataaactagaaaatctagaagaaatggataaattcctcaacacatgcaccctcccaagactaaaccaggaagaagctgaatctctgaatagaccaataacagcctctgaaattgaggcaataattaatagcttaccaaccaaaaaaagtccaggaccagatggattcacagctgaattctaccagaggtacaaggaggagctggtaccattcgttctgaaactattccaatcaatagaaaaagagggaatcctacctaactcgttttatgaggccagcatcatcctgataccaaagcctggcagagacacaacaaaaaaaaaagagatttttttttttttcagagatggggtttttgctttgttgcccaggctggtctcaagcctcaagcagttctcccacgtcagcctcctgagtacctgggattacagatgcaagccaccacacccagctcagcctcttttttattactgttttttaaactttattttactttaagatattgtggatgttaatctttttcttagaattttgtttatttttgatatattgcagttgtacatattatatatactatatgtgtgtgtgtatatatatatatatatacactatatagtatacatagtttagtgccaattgatggttttcatattatatatatactatgtatagtgtatatatatacactatatatattatgttgtacatagttttggatacatgtatatatttggatacatatacacaatgtgtaatgatcaagtcagggtaatcaggatacccatcacttcaaatatttgttttttctttgtgttgggagcattacaattcttttagctattttaaaatatacaatagattgttttaactctaattttcctacttgagtactagaacttgttcctaacgtttaactgtattttggtacccagtaatcaacttctcttcatccccctcttccccattcccttcctagcctctggtaaccaccattctactctccacctccatgatatcaacatttttaactttcacatatgagtgagaacatgtgatatttgtctttctgtacctggcttatttcacttaacataatgacctccagttccatccatgttgctgcaggtgatgtgaatttattatttttatggctgaataatattctattctgtatatataacacattttctttagccatttgtctgttgatgaatacttgggttaattccaaattttggctattgtgaatagtactgcaacgaacatgggagtgcagatacctttttgatctactgatttcctttcttctggtgtatactcagcagtgggatttgctggatcatacggtagttgtatttttcgttctataaggaacctccatactgttttccatagtggctgtactaatttacattcttaccaacagtgtatgagcgttcttctttttccacatcctcaccagcatttgttattttcttaatttctctcaaatgtgtctctatatcgtctacctctggattgttccatgcccctattatctctatcctgaattactcccacagccttctaattgacttttcccaaactccacgcttcgtttctcccaccacttgatcttctgcacagctgccagaaggcatgttttataactgagttctgagcatcttacatccctgataagatctgggttgtagaacacatcttctagcagcagtgccaggtgactgatgaataaaatccaagttcctcggctgcctgaacctgtacaaaactctggtttctcctctacgtgtgacctgccttattccttctattccagctaatttggagcatcatttgccccatagcacactctctacttttataaacctgtacatttgcttctttccagatgtgaagctgttatccaagttaaaattagatttccaggacctagaggagagtccatctaagtactatatgagaacaataatagtacctgcttttcagggctctgtgaagatcagacctgtgagttttcgtacagtgcttagaagagtgcctggaacaaaggaagtgccagttgatggttttcattattgcattgctaacaggggccctattggtggactgccatttgtgatttgacccaggcgcagaatactttggcactggcccatgactcttccactaaggactttgggcatgttgcttcatgtctctgggccaattccacttctttctttttgggaaaagaatcaggctaaatgatctccgtggtccatttcttatctagaattcctaaattctctaaccattttttcaaactttctagtaatgaatgaaatcaggatttgagagctaccatttgcattctcagtctttcagaaattttgaagtgaaacaggatggtaagacttggagaaaccagtgttgctatacatgaaccataagtaattcctccccacagccattacagccatcatcaccagttgcatatgacatcattagccaggaactggaactgatgaagaagttgaaggagcagctagaagagaggacttggttgctgcatgatgccatccaaaaccagcagaatgcattggaattgatgatggatcaccttcag

SEQ ID NO: 3971 - DNA, 112786 bp, human; identical to SEQ ID NO: 3968

SEQ ID NO: 3972 - DNA, 113117 bp, human; identical to SEQ ID NO: 3969

SEQ ID NO: 3973 - DNA, 4952 bp, human
acccctcgcagagctcagatgccatgtatgtggtggtaccccttctgggggtggcactgctgattgtcatcgccttgttcatcatctggaggtgccagctgcagaaagcgacccgtcaccacccctcctatgctcagaaccggtacctagccagtcgcgccgggcacaccctcccccgggtcatggtgtaccggggtactgtgcatagccaaggggagccttctgggcaccgagaggcagcgaacagcccccaggtggtgctggggcccagtcgggggggcaggaccacagtccggctagagagcaccctctacctccctgagctctctctctccagactgtccagcaccacccctcccccctcctacgaggaggtgactgcgccccaagagagcagcagtgaggaggccagcgtgtcttacagtgacccacccccaaagtacgaggagatagtggccgccaaccctggcgctgacaagtagtgggacgtttgtgccctgtcctggatgaacgcctctttccgaggtctcctattttctttttaactttttaaagactgtgccaccacaaaacagccttagcctccttgttgccaaataattccctaactgtggagttttaggaagtcagttgtcagagacaggtggggagggtgggggtagggaccacgcatgagtcgaagcccccgggaagagccaaaggccaaagtgcccaactctttgggatgacccccaagcctccaacatcctgtctttccatcaggaactggcttctcttatgccaaaggaataaccccattgagttgattgtggccagaatgtccacaggcctggcctgggggctgtgggactggctggaggcctgcctgtgtctagagctctgggcctcaggggtaagggaaggaagccagcctttcagcaccccttaccctccacagttctgtgatttctgtccttgcttacatttggaggacagggacaaggactgagcaaaaacaaaatgaaaaaatcatgacaaataaataattaacacaatagaacaaaactctagcacccgggccgttcataggaggccaagggaaatttatcacatggatctgtgatgtccgcctcccctaaaacctgtccccacactcctggaaggaggacagggtgtgtgaaggatgagggccagagggctgggtggcagagtttcctcttccacattgaccaaggggcccacgtggactctgccattcagtttctagtgtgcttgtctctccagacatgtggaccagctgtgttcaaaccactacccactggcatgagcctactttttgcgaatggtgcattgaaattgaacttcagattgaggatttctccttaacgatggtgcgcatctcaggagaagatcctaaagtgtcccttttaaaacatttatttgtggagaagcccgtggcctggggttgaaggcccatatggggtttgctctgctgttgccaggtgccagtctgttttcagtgaggctttggacagcagtggggcagaaggcacctgccctttaactgtcagtgaccatgctagacactgttgataccacctccccctacttccgtctccatcctcctgacctcaacaccaaaccatttctcctctgtggtgctttaaaaattgtagcaaatttttgtgtggtgcaagaatgcatggcctgcgtctattggcaaccacagcaatttaaaatccactgagctgacaagcttttttctgtcaaaatatctctctaaggcagacattgggactcatttccttgaatgcagccctgccttcaggccacagaggacttctggaggctgctctagccctgaggacttgccctgggacgtgcttccagttagaaggcttgtgtccctaccccagtgaggccaccagcttggaccactccaccctgtggctggggttttccatccttccccctacctcacaggcccgttggaggctgactgagcaaatgcctgcgaagtgcttgaattgccggggagccagcgaggtttgccttaggaagagtcttctagaaaggtgtaggttataagggagcagtcttagctgaggccctcatatgcctctgatgttgagtctccacttggagagtcaatctcccgtcagttgaccctttccatcctctcgtcctccctttccagagctccctgatgccagagatgctggtgaatgcaggtgacattctacctttcgtttccttgtctttccctcccctgggccttcagcattgcactcctgcccttcatcacaaaggggtttttggcttaagaggcccctgctttttccatgttgggggacctggggaagcctgaagctcggggctagccctggctctcccagtatttcttcaagtaggtgccagagtgtgacctgggagcaggtgagaagaaacttatcccaatatgtctactcagttagcacagagccaggcatgagctccactgatcagagccaaagggagtttgccaagaaatgcccgctgcctttggcatctgagttgcagctgggtggtaatgggagagagcaggaagaggcccaaggcctggcccatggagggcaacatgtgtccttcaggggctgaggacaggccgtgggaagagtcacaggaggttgcttaaggcctgtgatgttcggttcagatgcttcatggtgttctgccaggtggggttgcaccacggtctctgggatggtttctgcagcacattgtagaaaaaagactgtacagcacacagcaggcatcactccttgcgatgcacacttggattttatgaatgccctgtacatatcttttcaaactctgtgtttgtatggaggtggatttgatacaatgctgactctttcgtggctacatttttgctgtttttggacttctatgtgtgtgtgtgtgtgtgtgtgtgtgtgtatctatgtgtgcacgttgccttttctcattgcttatctgaaacaatagccggtgtgcagctatatttgtaccaggagggatccggtctgaaaagaggaatgtcacctcccctcgcagggctgagtagcctgatgacagggccctgagcaaggaaacgtggcattaactatattggacacccaacccccaaagttgtcactgtttgcctccttgaaaaaggctttggaagaagacaaagcagctccattctgcaggtctccaccctatgcaacccccgctcacacgcccttttggcatggtgcccctggcccaggcttctgttctgtgggtgtcagcagctgaaagaaatctgagtactcctgggcatggttttttttttttttttttttttttttttttttttttttttttttttttttttttttgtgtgtgtgtgtgtgtgtgtgtgtgtgtgtgtgtgtgtgtatggaaagatgtgtgactattgactttgggtatcgcgggactagttaattagatgtttttcatttttcaaaaagaaaaggttttaaaaattttcttgaaatgtgactgtcacttgttttcaaccaaaaactttttaagattttttaaaagaaaaatcgaaatcctgtccctcccccgcttcccatcgcctccggttttcaaaatgaaagcacaagtgcaagagtggggtgcacaggtgcctggcgtgtacacaccacccacacagctgcgtccagccctggctgagggagacgcagtgctgagcagtcagccccgggaggcctctttttcaacttccaatcccactgccatgaatgtgaattccttagggtgcttccaaaaacaggagtctgcctgatctgttggacattgcctttttggtagcccgaatatgaggaattcaggacaggaaagtgtctttttgtcaagtagtcagagccggatgcttcccctctcccagtgggtggagcatcgcaacccccagccagagttgatcttttgacaacccagtgacatcccatgagaaggaagaaaaaaaattcaacactgcctctagattgttattttgtccaagagagagatcatggagagagtctctctcgctcacggaggctctgtctttctaggagtatgtgtgtgtgctgtctcatgtgtggacactcacagttgaggctgagatggatatcttggcagcagagctgctggtctaggtggcttttcagcttgacaagtaatgaagctccatttcaggacttcatcgattccgaaacaagcacagccccccaccccccgccacggaactctactaatactaatcactataattagctaatttaaaagtacggtaatcagactgcttgcaactattttaaaagcccattaatttgaagcccactacttcagaacttcgagaaaatcacaacttaagacaattcacagtagctgtgattctggctacataaaaatatttgaaatattcttccctttagtcaatgttcagggtcttttgtgtaagagaaatccagtttaaaatgagtacccttttcaaagaaaaggctcaagatattaaggatcccttcaccgtgccttcagctttgcagttcagcacttctcgtatgtacagggtgatctcttgttctctctccatcacagggatgttggatattgcagcctttcactctactccgttatttatcctgtgaataacatagtttgtgaactagactgcaatttaaactaatacacatgatgtatctttctaaatattctgtaaagcagatgcttcgctgtcagactggccgctccatcattcgcctccaaatattcaaacgtgggagcttttcctttcagactgtgggcagcgagtctctctctagcaagaatttatctgacaaacatacccaaatagcacaccctctcaagctcaatgcctcaacagttgtttcactgtactgatatctgactgctgaacagtgcctgcccttcacccacccccagcccgagcattaaca

SEQ ID NO: 3974 - DNA, 7617 bp, human
agttgtgaattctggtcctgccactgtcactgttgatttgcttaaccttgtctgagcccgtctctctgggctgtatctcctcatctatctctgaggtcctttccaattggaagttgcaaagattcattgaggggagcaaggaaggaggagcctcagcctttaggagctttcctttttaaaagaaaaaggtcaacccttggttcttatagatgctcagaacatgttcttgggggaaaacgctgaaaggtttgctttgggccctactgggcctggggaggtctctggagaagagcttggggcagaatgagaagcagcggaagccatgggtggctgcatggaggacgacgcaccccacaaggtgctgcttcaaccttttgaccacgccagtgggaggggggcacatcccagagccaagagtgtgccctgtaaatttctagatgtggtttcactgcaactttgcttttctcttactccagagaagtgagaccctgcagctgagggagcatcatggcaggtgagtttttccaggcctgggcagagccgtggagggccatgcctaggggttcatgagtcaggtttcaagtccttcccagcttccctgccccctaccccccaagtgggcctgtagccattttccaaatggctgagtagcagttttgccctctcaactctttggctcccttctgaagtatatgtcacttgtagatgtgtacctacccaggcttccctgagtgacactaacgtgacaggccatagggcctggggaagggtgcctgcctgctggcaaagacatgccagcttgggcatccagggggagttgctttacatgggaaccaggaagtcccacctctaggtgaacaacaggagcaaacgtcacctcttctttcatccttcacagtctcaacttaggcttatgtgggtgcagagctcaagctattctggtcagcctgtttgtagctgggtgtctctctctggaataagtagatatgcccaccatccaaagacggtattgtagggagattctgtgccccgtctgtaaaagcttagactctccatctgaaccctgctacttcccatccccagaggtgctcttaggctcgtgtatgcccacttgtctgatctagcctaggctggctttgcattagactttcttgaacaagactattgatgccagaccacctggtggcacaggtggatgttcaggtggaggaacaccaccctggtagagtcttctaggattatctggtattagttccaccagtatcagccttaaagaggaatacattctcattgcaagggctccaactttcacttttcaaggtgatgcagaagatactggagctttagtcactgaacattgcctacttacaattcttattctttcttgttcctgtgcaacgtgcactttccttgcagttggctaccattttcttccatgtagccagggacctaaaccttgttggggctgtggtattctagacaggtgtatcatggcaccatagaatgtcagcccttccatccctttcacaaagggccggccatgtcctttgatcagaagcctggtgtcttgcctgctcactcggccttgtttccctgcataattatgcttcagttgctgggctgggcctggtttgaaggagcccctgggcatctccccattccaggcctcagtagggctctctcctcagtgtttctggaggccaaggatgcccattcggtcctgaaacgattccctcgtgccaatgagttcctggaggagctgcgccagggcaccatcgagcgagagtgcatggaggagatctgcagctacgaggaggtcaaggaagtgtttgagaacaaagagaaaacggcatgtaccaccctggggctggttctgggagtaggagtagcctcaggaatagcaagaacaggccctggtaatgcagaccaatcagaagcaaggaaagacacccagcctaaggcatagccactagggccatcacggagcagataaagtacgtacagtcccattgcctgactcttttggggtcctcctcacttgggagcattgtcctttgcccttggtacattctgctgcctctctggtaactctgtgagacaagtcagatggggaagggtaggaagcaccagagttactgaaggcctctgagcccacctggagcttgagcttctcttaagtaccactttttcttttgcagatggagttctggaaagggtacccaaatgcagtctactctgtccgagacccctcgcagagctcagatgccatgtatgtggtggtaccccttctgggggtggcactgctgattgtcatcgccttgttcatcatctggaggtgccagctgcagaaagcgacccgtcaccacccctcctatgctcagaaccggtacctagccagtcgcgccgggcacaccctcccccgggtcatggtgtaccggggtactgtgcatagccaaggggagccttctgggcaccgagaggcagcgaacagcccccaggtggtgctggggcccagtcgggggggcaggaccacagtccggctagagagcaccctctacctccctgagctctctctctccagactgtccagcaccacccctcccccctcctacgaggaggtgactgcgccccaagagagcagcagtgaggaggccagcgtgtcttacagtgacccacccccaaagtacgaggagatagtggccgccaaccctggcgctgacaagtagtgggacgtttgtgccctgtcctggatgaacgcctctttccgaggtctcctattttctttttaactttttaaagactgtgccaccacaaaacagccttagcctccttgttgccaaataattccctaactgtggagttttaggaagtcagttgtcagagacaggtggggagggtgggggtagggaccacgcatgagtcgaagcccccgggaagagccaaaggccaaagtgcccaactctttgggatgacccccaagcctccaacatcctgtctttccatcaggaactggcttctcttatgccaaaggaataaccccattgagttgattgtggccagaatgtccacaggcctggcctgggggctgtgggactggctggaggcctgcctgtgtctagagctctgggcctcaggggtaagggaaggaagccagcctttcagcaccccttaccctccacagttctgtgatttctgtccttgcttacatttggaggacagggacaaggactgagcaaaaacaaaatgaaaaaatcatgacaaataaataattaacacaatagaacaaaactctagcacccgggccgttcataggaggccaagggaaatttatcacatggatctgtgatgtccgcctcccctaaaacctgtccccacactcctggaaggaggacagggtgtgtgaaggatgagggccagagggctgggtggcagagtttcctcttccacattgaccaaggggcccacgtggactctgccattcagtttctagtgtgcttgtctctccagacatgtggaccagctgtgttcaaaccactacccactggcatgagcctactttttgcgaatggtgcattgaaattgaacttcagattgaggatttctccttaacgatggtgcgcatctcaggagaagatcctaaagtgtcccttttaaaacatttatttgtggagaagcccgtggcctggggttgaaggcccatatggggtttgctctgctgttgccaggtgccagtctgttttcagtgaggctttggacagcagtggggcagaaggcacctgccctttaactgtcagtgaccatgctagacactgttgataccacctccccctacttccgtctccatcctcctgacctcaacaccaaaccatttctcctctgtggtgctttaaaaattgtagcaaatttttgtgtggtgcaagaatgcatggcctgcgtctattggcaaccacagcaatttaaaatccactgagctgacaagcttttttctgtcaaaatatctctctaaggcagacattgggactcatttccttgaatgcagccctgccttcaggccacagaggacttctggaggctgctctagccctgaggacttgccctgggacgtgcttccagttagaaggcttgtgtccctaccccagtgaggccaccagcttggaccactccaccctgtggctggggttttccatccttccccctacctcacaggcccgttggaggctgactgagcaaatgcctgcgaagtgcttgaattgccggggagccagcgaggtttgccttaggaagagtcttctagaaaggtgtaggttataagggagcagtcttagctgaggccctcatatgcctctgatgttgagtctccacttggagagtcaatctcccgtcagttgaccctttccatcctctcgtcctccctttccagagctccctgatgccagagatgctggtgaatgcaggtgacattctacctttcgtttccttgtctttccctcccctgggccttcagcattgcactcctgcccttcatcacaaaggggtttttggcttaagaggcccctgctttttccatgttgggggacctggggaagcctgaagctcggggctagccctggctctcccagtatttcttcaagtaggtgccagagtgtgacctgggagcaggtgagaagaaacttatcccaatatgtctactcagttagcacagagccaggcatgagctccactgatcagagccaaagggagtttgccaagaaatgcccgctgcctttggcatctgagttgcagctgggtggtaatgggagagagcaggaagaggcccaaggcctggcccatggagggcaacatgtgtccttcaggggctgaggacaggccgtgggaagagtcacaggaggttgcttaaggcctgtgatgttcggttcagatgcttcatggtgttctgccaggtggggttgcaccacggtctctgggatggtttctgcagcacattgtagaaaaaagactgtacagcacacagcaggcatcactccttgcgatgcacacttggattttatgaatgccctgtacatatcttttcaaactctgtgtttgtatggaggtggatttgatacaatgctgactctttcgtggctacatttttgctgtttttggacttctatgtgtgtgtgtgtgtgtgtgtgtgtgtgtatctatgtgtgcacgttgccttttctcattgcttatctgaaacaatagccggtgtgcagctatatttgtaccaggagggatccggtctgaaaagaggaatgtcacctcccctcgcagggctgagtagcctgatgacagggccctgagcaaggaaacgtggcattaactatattggacacccaacccccaaagttgtcactgtttgcctccttgaaaaaggctttggaagaagacaaagcagctccattctgcaggtctccaccctatgcaacccccgctcacacgcccttttggcatggtgcccctggcccaggcttctgttctgtgggtgtcagcagctgaaagaaatctgagtactcctgggcatggttttttttttttttttttttttttttttttttttttttttttttttttttttttttgtgtgtgtgtgtgtgtgtgtgtgtgtgtgtgtgtgtgtgtatggaaagatgtgtgactattgactttgggtatcgcgggactagttaattagatgtttttcatttttcaaaaagaaaaggttttaaaaattttcttgaaatgtgactgtcacttgttttcaaccaaaaactttttaagattttttaaaagaaaaatcgaaatcctgtccctcccccgcttcccatcgcctccggttttcaaaatgaaagcacaagtgcaagagtggggtgcacaggtgcctggcgtgtacacaccacccacacagctgcgtccagccctggctgagggagacgcagtgctgagcagtcagccccgggaggcctctttttcaacttccaatcccactgccatgaatgtgaattccttagggtgcttccaaaaacaggagtctgcctgatctgttggacattgcctttttggtagcccgaatatgaggaattcaggacaggaaagtgtctttttgtcaagtagtcagagccggatgcttcccctctcccagtgggtggagcatcgcaacccccagccagagttgatcttttgacaacccagtgacatcccatgagaaggaagaaaaaaaattcaacactgcctctagattgttattttgtccaagagagagatcatggagagagtctctctcgctcacggaggctctgtctttctaggagtatgtgtgtgtgctgtctcatgtgtggacactcacagttgaggctgagatggatatcttggcagcagagctgctggtctaggtggcttttcagcttgacaagtaatgaagctccatttcaggacttcatcgattccgaaacaagcacagccccccaccccccgccacggaactctactaatactaatcactataattagctaatttaaaagtacggtaatcagactgcttgcaactattttaaaagcccattaatttgaagcccactacttcagaacttcgagaaaatcacaacttaagacaattcacagtagctgtgattctggctacataaaaatatttgaaatattcttccctttagtcaatgttcagggtcttttgtgtaagagaaatccagtttaaaatgagtacccttttcaaagaaaaggctcaagatattaaggatcccttcaccgtgccttcagctttgcagttcagcacttctcgtatgtacagggtgatctcttgttctctctccatcacagggatgttggatattgcagcctttcactctactccgttatttatcctgtgaataacatagtttgtgaactagactgcaatttaaactaatacacatgatgtatctttctaaatattctgtaaagcagatgcttcgctgtcagactggccgctccatcattcgcctccaaatattcaaacgtgggagcttttcctttcagactgtgggcagcgagtctctctctagcaagaatttatctgacaaacatacccaaatagcacaccctctcaagctcaatgcctcaacagttgtttcactgtactgatatctgactgctgaacagtgcctgcccttcacccacccccagcccgagcattaacacagatcttcaggattgggacaaatcccccagctgcttttgcctctcaatccatctcccctcatcgataccaatttcccaggcctgaacacatctgttattttgctctgacattgtgaatttgtgacagtggaaaccctgatatgtgcaactgagcttatagaaataattactgtgaaatggattaattttgataccactttaaactgtgcttgtattcatgtgttgacccttgtcagctgggaaatctgtacattcagtatatgtcagcatttcattggagcctgggggcaacagacaaacttgcttctgatttctctctctctctctttctttttataattgttgaatttggctgttacattttgtctccttctttacaagaaaacaataataataaagagcaaatggcatccacttgaa

SEQ ID NO: 3975 - DNA, 6853 bp, human
tggcagataagtgctctggttgtacatggaggatgaccgaaaaaaccaatggtgtgaagagctccccagccaataatcacaaccatcatgcacctcctgccatcaaggccaatggcaaagatgaccacaggacaagcagcaggtgagtctgcatggtatcagggaaggtacagaggctgctacttcttcccatctctgcctcattgtcacagagcaagcaatctttgtctccaggacagcctctaaaaagaacatgggatttctaagcatgacccaggaggggagacaagtcatgccctgagaaccctgggtcaattctgctcttttttctgcaggccacactctgcagctgacgatgacacctcctcagaactgcagaggctggcagacgtggatgccccacagcagggaaggagtggcttccgcaggtgggtcccaccactaccctgctgcttccccttcctgtgcatggagcctgtcagggtggctaccactgccctcctcttcacggtcccaccagtcctgtccaccaagacctccaaggagcactgtcactggtagccaaatttaattccgtcctcctgaggtctgggcaaaccccaaggcaggcaagctcagaggggccagaagaggcctcccttcacatttggctgtctcagcatcagggagcgatatccttcccggtagagagacctaggtagaggacccaaggcctctctgtcccagagtcagaggctccatagggaaagcaggaagctcagggcaagctttactcatgatagttcctgccttaacaccacctccaactttccctgaagacctcctgcttgctcttcgcaccatcaactgagatggcacttcctataggaagtcttcccaggacagcagtctccccctggactgcattcagggtcatgcctgagccccagccccctgccctatggcctctaccccagcttttagcacacgggaaatcatggtctggcctgtttgtaggtttcactgtccttctttcatcttccttagcagacagtgagctcttggggactggtgctttctgaacagcatgagtcttggctctggctcatactctttttctctcacctctaggatagttcgcctggtggggatcatcagagaatgggccaacaagaatttccgagaggaggaacctaggcctgactcattcctcgagcgttttcgtgggcctgaactccagactgtgaccacacaggagggggatggcaaaggcgacaaggatggcgaggacaaaggcaccaagtacagctgttcagcctatgggactcaaatgggctttaagcatgcaatggaagagctcactggggtttctatgctactgctaggggctatgacaagccctgctgtagtaaaaagagtggtgggcaagggtgatttgcaatgttttcacctccagaatatttccattgtttccccaacagccagtggcctacttgccatgagaacctctggtgtcttttctcgccttagttgcctcttgccagatgtcctcttgctgcacatgaatgtatagcccagttccagtggtcaggaaatactgagagggtgcattcagggagtgccctggaggggatgccaatctcatctccactgtgggcaaggaagtgggtctttgaagagatcatgtagagggatggaggagaagcgctgaatgatggagcaggatagcatggggagggcagagaaggcagagctggagggtttgtcttttgaggaatgagaaggcaactgcagatgtctggccaagctgacattccccacctctggctagtggagagaaagcaggacacaacatcccttgtcaaagcaggacacaacatctggggaagtgatttggaggctggaggccaatgaccaaaaagggagggtgaggtgggcaggaagctcatggtgctcactcacctggagcacctctctctagggagggatgtgggaataggcctaagccccaattatcatcctgtggaaatcccttcccaggccctgagacccaccactactgaaagctctgccccttgacatgccctctgggcaaggggcctgtaacgtgcatgggaaccaatggacctatctaggttcagaatgagaagatgggtgcccccgcccatctgagttccactcagatgtccagtaccaggttgtagttccctgaaaaatgtggccctcagccaacccatctttcaccccacatatacccttcggcagtgcttttgctttctcaggcacttctggtttctgggagctggggtgctatcacactgggggacctgatccccaaaccttgcctttgtctgtcttctcaggaagaaatttgaactatttgtcttggacccagctggggattggtactactgctggctatttgtcattgccatgcccgtcctttacaactggtgcctgctggtggccaggtgagcagggtggggcccaggaggggtggccaaagcaacccagtcttcagaccccgggattgacggcgcagcagtccctggataccaatggcacctccaacttctctgttaaccccaaccctctccccatttaatatgccatgaagatttcttgtctgtcctgtgtctgggacaactacagtggttccacacacctagggtgcatcctccacatttgcaacaaacatgcttgatagcaaactaggatttggtgatgccattccctcctcacaaacccttaagtggctccccattgtccacaggaggaagttcaaggtctaagcatggccttcaaactcctctggacctgacctttttctcttgctacaccttctggatacaccccagccccagcattcaccactcttggatcagaacatgctgtttcctctagagaaaattccctttcccttccattttccacctatggagattcttctccttgcaggctaagttcaaaagccactatctacatgtagctttccttggcagcattccccatcctactccgtcccaatcccagtcattcattcagcaaggatttgactgagcacctcatgtgtgctcagtgctggggataatgtgatgagcacaacaaccatggtctctgctctcctggagctctcaggctagtggcggacagtgactgtaaacctgaaatgaaacaaatgaccagaatgatgccagggcctggtggctagagaaagggcagtcaggatcagcgtctctgaggaggtgatgccttagctcgtgggagggaggcagccaattagatacttgaggatggtggagggagcattctgggcagaagaaacagcaagtatgaaaaccctgtctcgggatggcctagtgtggctggaggctgtgagtgagccatcactggcatgggccagctctgcagtctcagtgggaaggggagggggctggagtttgagtctgaatgtgaccaagtagtcagacttaacggctctcccctttgactagtacactcactggacaatcatcctgggctgtgtccctgactctgctctctccccagtcctctccctactcagttgccaaatcctgccacttccttttaaaaagttctgcaacctccaaactttctccattcccactactattctccctctcacgtgtattggctagtgctgtttattgggtgctgaataagatgtatgttgaagagatgagcatggagatggttcagttgtgtgctgtagtttattcttccaatgacttgttcattcattcaactcacagccattgagtgctcaaatcctgttgccctaggtcaggcatggggcatgccgtaatgactaagaggggtccctgccttcctggagctcacagttcagagggtgagacagaaaattaatggttagtggtgctgtctatgtagtgatgttatgtaatgaggaggggtggggcagaagttacttgtagataaatatctcttggcatcaggctgactgtgactaaatgatgcccctggtagccatcccaagccctgcacacagtgaacactcagtttggggcctccaagggacctttggctggctttgggggtgaagcttagccctgtcctcccgcagagcctgcttcagtgacctacagaaaggctactacctggtgtggctggtgctggattatgtctcagatgtggtctacattgcggacctcttcatccgattgcgcacaggtcagtgagcaactgggatgcaggtaaatccgaaggcctgagtccaaatttttaggaagcccactggacatggtgttggactaaattgcttgggtgggactctggtaggtgagtacccttctttgaacctcatggtcccacatgcatagagaggttttgatctcggggtgttctcttagagtccttctggccagccctggtatgtgagctatatccttccttgggaaggaagtttcagtgagcagtagtttccttgcctagagatattagcctatagggaaggatatatatatatatatgtatatgtatatatatatgtatatatatatgtatatatatacatatatatgtgtatatatatatacacatatatatgtatatatatgcacatatatatgtatatatataccctgagggcagagatgacatgctggctttcatctctactaggtttcctggagcaggggctgctggtcaaagataccaagaaactgcgagacaactacatccacaccctgcagttcaagctggatgtggcttccatcatccccactgacctgatctattttgctgtggacatccacagccctgaggtgcgcttcaaccgcctgctgcactttgcccgcatgtttgagttctttgaccggacagagacacgcaccaactaccctaacatcttccgcatcagcaaccttgtcctctacatcttggtcatcatccactggaatgcctgcatctattatgccatctccaaatccataggctttggggtcgacacctgggtttacccaaacatcactgaccctgagtatggctacctggctagggaatacatctattgcctttactggtccacactgactctcactaccattggggagacaccaccccctgtaaaggatgaggagtacctatttgtcatctttgacttcctgattggcgtcctcatctttgccaccatcgtgggaaatgtgggctccatgatctccaacatgaatgccacccgggcagagttccaggctaagatcgatgccgtgaaacactacatgcagttccgaaaggtcagcaaggggatggaagccaaggtcattaggtggtttgactacttgtggaccaataagaagacagtggatgagcgagaaattctcaagaatctgccagccaagctcagggctgagatagccatcaatgtccacttgtccacactcaagaaagtgcgcatcttccatgattgtgaggctggcctgctggtagagctggtactgaaactccgtcctcaggtcttcagtcctggggattacatttgccgcaaaggggacatcggcaaggagatgtacatcattaaggagggcaaactggcagtggtggctgatgatggtgtgactcagtatgctctgctgtcggctggaagctgctttggcgagatcagtatccttaacattaagggcagtaaaatgggcaatcgacgcacagctaatatccgcagcctgggctactcagatctcttctgcttgtccaaggatgatcttatggaagctgtgactgagtaccctgatgccaagaaagtcctagaagagaggggtcgggagatcctcatgaaggagggactgctggatgagaacgaagtggcaaccagcatggaggtcgacgtgcaggagaagctagggcagctggagaccaacatggaaaccttgtacactcgctttggccgcctgctggctgagtacacgggggcccagcagaagctcaagcagcgcatcacagttctggaaaccaagatgaaacagaacaatgaagatgactacctgtctgatgggatgaacagccctgagctggctgctgctgacgagccataagacctggggcccaactgcctctccagcattggccttggccttgatcccagaagctagaggagctatttagatctccggatttacatgcattaccctcatgttccctgaattctcccaaaagcctctctgaccctgggtttttggcctaaacatccaagattccgcctccaagtttagcccaagtttgtggagagtacagactgcgttggctgggcttccgagagcttcggcctgcctaagtctgaggaagggagaagggggcagctgtctgccaggagtctggctcttttgctcatagcgacccctcccttggttctggcccccgctttttctaacatgtcttctgaatgcttcctttttccctgcacacgcatgtacttcgagcaccgactatagacatttagatcaggtacccagtgtctgtctcccacgacaggccaagggatgtgatagtgttgttgggagggggtagaagggtgcccactcagggttattcctcccccatcagatgctccagctcctgctctgtagattgatctgtctgtctgctagccaggatgggatctctgcagtcttctgtggaccaaggagatagacccggcttctggtccattccagggcagggagtgaggagcaaggcaactggcatttgtccacctggagacagaggtagctggcagctctggccatccctcccctatgaagagcattcctaaagaggccctgaaaactgctggtggtggggagactcttcaagttaatatctgcattagaggcacctatgagttaaaaaattcctttgaact

SEQ ID NO: 3976 - DNA, 59038 bp, human
agaagccctgctgaatcaagtgagaggagagctgcggagcaatcaccatgagtatctcagctcttggaggccgcaccaaaggtgaggcctgggctccctggtttcccaggctctgtttggggctgtttgcttccaagcctgcccctacaggccacaagcactgtcccagcagcaaagggagagcagcatactgggagaactggaaaggaggtcgagggtcctggggctgcattcctcttctgaggcggttggcttttcccaccacagggaagcctctgccaccaggcgaggaggagcgcaataacgttctcaagcagatgaaagtgcgaaccacgctgaagggggacaagagctggattaccaagcaggatgaatcggagggtcgcaccatgtaaggcaaggaggcggggagggaccgcagcaacgtgggggcgcgcaatccgtgggggaccgaccatacctggggatgcgaaggggcttccaccattcagagctccgccaggccatgtggagggcagagcgtgggaaaggctatccagcaatgtcacagggtgggagagcccctgggtgcctgggaaggagaatgtgtggcagaaatggcaggacttgctgggcagcctctaggatggaggccacaggatggcaggtgacagggagtctcggagccaatccttcaggatgcctctttcccccagagagctgccctcaggccggagtcgcgccacatccttttcatcagctggggaggttccgaagcctaggtaagaggtggtgctcaggtggctggtgggtcagccccagggactctcctgcagcttggggccagccctcaacagggaggggtgggcagtccacaggggacagggatgcagccccagccaagggtctgcaatgagtaatttgaaatctgcaggaaggaggggcttctccactgcaccttccttttgggaaggggagtgtaggagtcacttggtccaggcccttggcctggctgtgtggctgtggggcagctgacttccctgctgggcctccgtggctccagctgttaactgggattgaaattgtctttaagaagaagacgacctcccacccattccctgcagggagtgatactgcctctgagatgctttgggcagcttccagagtcacagtgactcactcctgcaggtcaccctgactgcttgagtgtacttgggactcagcatgcctgtagagaggcacgagtttgctctgactgtctcccaagtttaccgtgacatattttgtcagctgaccaaggagaactggcttctctctcttttgggggcttttccataacagtgtctaggggggctctgaagcgtgggcacaccctgctggcctctggaggaactgctcctgacagagaaagggaactgaaattcaggctcgctccttgctccaaacagccggcaggcggcttctcagggggtggtagaggcagtggcggcctctggaagggagggcctcaagtttacagccagcacacagggctacctttagtaactacggtctctctgtcacccctcgatgactcagcgcccactacctgccaggtcccatgctgggcacagaggatgcaggagtggtcaagacaaaggccctgtctttgggcaactgacgtcccagcaggggactcaggcaggaccctagtaaacagttcaatacaaaagcgagaacccccaagtgtgcctgcaacatggccacctctgggaggctgtcccctgttagagatggagattgtggggttggagactaccggaggctctgtgttgcccttgacccaaaccccgatgctccagcccacatcccctccactgcaggacagaagggtctaccctgaccccttgactcctcccctaactctgaggaggactctttgcaggggcccctaactcctgcccggaggccagaacttccaggctgaccacccctggctgtcagctccctgcccgctcgtcttggctgccccctgagttatctgagccccctcagttgctgccaagcaggaggtcccaagcacccagagcctaatgtttcccagccgctgaacaaggcctggccgcgccctctcgtctcaaacttccaccaagacttggggtgtgggcatgcaaggagctggagcaaagagggccccgagggacaggaagggggacagctggcttcggctggctgctgcctgggctctccccttcaagccctcatgcaccttcctggtggaggctgttgagggagatcaggtcagaccccgggctgaggggaagcctctggctctgactggggagcctccagcttgcactggttcagccccaagcacagaggatgggagggctgtcagctgagagcagtgctccgtcggcgcagcactgggaactggctggccaaggagaagctggactttggagaggccatcaagctgccttcctaggcacctgccatgaggagtcacctggggcacttttcctgggggagcatgagggaaataggcagagcatagcgggcacctgatcaggggcacagggggctggcacccctcgtttctgctgtactgggacacctggagcacttgccagccaatcttatttgctatcgttaagggcaggataaagtaggatgacctcagccctccagcaagcctcgcttcactccaccccttcttctcttcggcaggcctccgagcacaagggctcccactggctacatcatccggtaagtgaccgcaggactctgccggccttcctgtgcccactcacgccaagccctgacttcttacccctccagtccctccagggagctcaccggcatctcctgggctctctttcaggggagtgttcaccaagcccatagacagctcttcccagccccagcagcagttccccaaggccaacgggactccaaaaaggtatgtccatggggtgttggccagtcggccagtggggaggtgtgagggcctggtctgggctcctggcagagacagtgctctgcctatcaggactgtggggccttggaggtgccagctttcatcctgggtagggcaggaccctggagagcagggtggggtgaccagaggagatgggctggggtgggactggcagtcccaagtggatgtgtgggtctctgggaggtcctgggccactaacagtgtccttgtcctggggtcagtcctgactaggcctggctaatgggacagagaggtgcaggagtttgggaggggctgggtgtagagtccccctagcctggcagtgggcacccttgacttgacttgctgatggcattgagaaggctgaagttgcatgcaattcaagcaccttggcatcaggcattgcctgggactccgtcagactggaaaggccaaggggacccggaaacaggaagcaaagacacaggcaagagcccgctgggctgttccctgaagctcggtggggtttgcctacacagctgctctgagtggcgcagttccgggtgtctgtcagggccaaaagcaaagaggaaaggctcccaggcagctcctggtccacctctcatgtgtccactgggctgtgtggccaaatctggaggcaggagggagcctgcaggtagacacatggaaccttctcctctctagtgctgccagtctggtgagaacagctaacgctggtcctccccgcccctcctcctctggctacaagatgaccactgaggattacaagaagctgtgagtatgcaacgccaggctcagcgtggttccctcctccaaggaacaagtccaaactctgggtccactgaaggcagctgactacttgccaccgagcacagcccgggaagtcccgcctgcctgacactccctgccagttgcagctgtggcctggagcccaccagagggtaacaagccccagaaaactggatggctgtgcacattgcacgtctgatccgaggcagagcggagaccgcaggaagcttgtaggaggggccccacggatctggggaaagggtcatgggtcgtgaggctgctgctggctggctgtgcttcctgggcttggccctgcacccggccgagcctcaggtgctctgcctggctgcactgggctgggggcctggggatcctcagggtgctgctgtcagtctgagcattgtgtgcctaaatctgagctgcttcttggatagaaaccttcgggttttcccttagtgctccccttggggtccctttcaaagccccccaccccccactgcatgctcagggaggagggttctctggacagaggtgtgaattgtgtctctagttcccaggggaccacatctttccgttgtttgtcccttgcctccatcatccagggttggggagctgctgggtaacctttctggggaaggggagaggctcgaacagggagggaggggagagctggtctcagggaggaacaagtggcatgacctaaggcccaaaggcagagatattgacttgcctcgtcattgttgttgaaagccaggaagccaagctgctgagggtggcagcctatgacaggaaagcgcctctcccctctcttagggcaccctacaatatcaggcgcagctctacatcaggggacaccgaggaggaggaggaggaggaggtggtgccattctcctcagatgaacagaaacggaggtaatggaatggtgccttttgggcatcccggggggcagggcaggagcctgagtcttcgaagactgctggaatgaattgtactggttggggtgacaaaatgcacaacacgtaggccatcagcggtagcccacggagcatgagaataggtgtcattctctgagtgccagaaccacccactcagtgttggaccagctgaggggcccttgagaaccttctgtggggtagaacctaggtaatgtgggtccggggaaaagcctcctcatgtggaggctcttcagggctctaaatcggtttgttagaaagggccctgagacagttgaacaaaaatattcagggagaagccacctgcacagtgccctctatctgcatgatctgcatgccttgggggttctgaatgccccggaccccaaactgagctccaggcatgcacagcagtgggagtgtgccccatgctgctgaaattctaccctagtctctgcgccaagctgccctcgtccacacaggccagcaaagttccatggacccttgcccctcctcagtcctctgtccatggggactgaccacataccacccagtgctggtgaactatgacaggaagggtttgttaagcaccttttgtatgcctttggcttggggcctgtacagcagttgggccctgaggaaataaagccctcccctccctgggctcagccagccaccaggtccatatctgctgacccatctgtggcgcaggaatcacagcaaagccccattgccaaaggccctggcagattggctatcctcagggaacagttcacagtggcaggggcccccaggcctgggtggagcaaggaaaagagccagaagctaggagctgcctagcattgaatgccagctctgccacctgctaggtgagtgctcttgggcaaataatgaaagcttcttggactcagtttcctcatctgtaaatcacagaggatactagcgtctactttcctggattgagaagagcaataagccaatgcgaggatgttggcatctggcgcagagccgggcacatgccacatgctccataaacatgggctgcccttccttcaggttctacatttcctttgaatagtccttggagcaggtgcaaatctggtttctctcaccccttgcctccctggggtggccctaagtcaccccgagtccatcccaggctaggctggcagagcatgtccagcttggcacccatcagatgctcccccatcccgtgtcaccccaggtcagaggctgcaagcggtgttctgaggaggacagctccccgggagcactcctacgtcctgtcagcggccaagaagagcactgggtgagttgccaccaactggctccaggctctaggacagctctcctctcctcagagctccagccttctctggctgatgaaagggtgggtggagagatcacccccaagggccttcctagctgagccttctcagattctcagatgtactttctagaaaatggagaggtctggcggctaccaccagggacagtgaagtgccgggaatggagagggcccaggaccctctgaggtagagcggtcttgatgtcacctgcccacgggctctgcccaaagcattgcctttctgcttcctttccagcagtcctacccaggagacacaggcaccgtttatcgcgaagaggtaagtgtcatcaagggacaccttggaggcctgttactggccacaggaaggccttccgtcagcaggggtgtagtgtgggagctgtggagaggggatgtggatgtgggggactactgtccctgagcagggggagttgtgaggggctgggggcttctgtctggaggcctggcaagcacctgggtggctgtggtagcatatgtggtcaagctcttccatttgccaatggctaatggggctgggcccctgacccaacgtggagcatttccaaggccctctgggagttgttcccctgcccctgttgcttgcctgatgccttgccttctgctctcatccaggatcaaaacctgggccatcaggagaacttcccctgggaggtgactgtgacattggagatgggccctaaagggtgaacagggcttaacagggaatgatcagaacgtcgggatactccagctgaatgagggaggggtgtcaccattagttgagacagggcaccttctggaggaggaaaatattcgggggaaagcaagaaagaaacttctggaaacttgaatttgagggacttccagttgagtggacagggaaggcctctctctgtgctgaggtggctagctggggactgcaaacccaagagaagacagcatgccaactgccccaggcagagggccccagtgcacaggcccggggtgggactagcttgctgtgttggaagaccaggaagttggcaggaatacagagagcagggatggtggcagcacaaaggaagtgacagagaacggggggcggtgggggggtcttcctggctgcatttggttcctgtggtttctgtaacgcagtaccaaaaactgagtggcttaaaacatcagaaagggattctctcccggttctggagaccagaagtctagatcaaggtgttagcagggtgggttccttctggaggctttgagggagaaaccatcccaggccactctcctggcttctgctggtggttggtgatccttggtgttcctcggcttgtacctgcatcactccagtctgtgcgtctgtcttcacatggccttctcttctctgtgtgtctgtgtccagatttccctcttcttacaaggacagcggtcattggatttaggacccatcctactccagtatgacctcatcttacctgattacatctgcaaagaccctatttccaaataaggttacagtcacaggttccaggggacatgaattttggggggacactattcaacccagtatgctgtccttatcctgagctggagtcactgaacccccagcctgggccacctcttggccgtgatcctgaagggttgggtcagttagacgccactggaagcatgttctttgaggcctccaagctctagggcagccaagaagaccacgagcgctgtttctcttcttgctcaaagggtggaggtggtggaagaggacgggccttctgagaagagccaggacccacctgctctggcaagatccactcctggctcaaacaggtaatccattgcgctcatctctgcctggggctggtggctgccatacctgccactcagtcactgaggaacctcagtcagggcacctccatgctgggcttcgagatcagtgtccccatgtgcccagtgacaagacgggacaaagaaatcagtaagagcccatctggctggatgtcccagggctgaaaggagcaaaacagtccagccccccgggagagagcacctggctctggtctgatgagtacgtatctgtgtcaccttaacccttgcaccactgagcctggtggcaacttgaacaccccaagaaaaagtaccatccttggggtttgagagggccagccaccatggcagtagcatgccattgtcagacttgctccttgcactccaataagttagccacattcagcatgcccagggaggaggctctgacatctccagagcctctcacagccaccttctttgccagtgcggatggaggcaggaccaaagcgtctcgggcaatttggatcgagtgcctgccaagtatgcctagccccgctgggagccaggagctcaggtgggtgccgagagctgactctggcttgtgagtgggtgtgatggcttcccgccagcctggctggctggttctgccagctggggagggtctggcagtggggtgatggggcaaggacaggctgagcactggtgatctcactccaggaagggccgtgatttgtcttgatttctgatccctgagaatctgggcagataatggtgctctcttgtctgtggacaactaataccttcttgtactttgtgcagaatggtgctaagtcctgcagggagagccaccacctgctgttgctgctgtttaaagtgcctgcctggattgagacctttgctcaaatctaggtctcctaagagctgcatctctgtagcacccttggaagacccctgcatccagaaggggagagggcctgtccctaccggtcacttcccaggcccccaagggctgttcaggctctcctaataccatagcaatcccccaatttgagctccacagccatttatagacaggtgaccactgtcctcagggttacttcctcagtctgggagggagacagaaatgctggcagagggagccaggagcatgaggccagctccctccatggccccaggcagcagactgccagggtgcttctccttttcactctctccctctcttgatcttctctggttgtctgactctccccataagaactttggtccatagaagatgtggaaaggaagatttgagaattctttacaaggcaatatctagggcagagctccccagtctttttggcaccagggattggtttcgtgaaagacactttttccacgggacggagcaggggatggtttcaggatgaaactgttccaccttagatcatcaagcaccggattctcataaggagcgcacaatctagatctctcacatgtgcagttcacaatacggttcgcgctctcatgagaatctgctgatctgacaggaggcggagctaaggcagtaatgatctctagcttacctcctactgtgcagcctgattcccagcagaccacagactggtactgatcctcaggctggggttggggacccctgatctaggggacttggcaattgagggatatgggggcaaaggctgccacaacaaagtattgtaccacaccctggggcgcttaaaccacagaaacgtatcatctcccacttctggaggctagaagtgtgagatcaaggtgacggcaaggttggttcctcttgagtctctctccttggctggtagactccatcttctccctgggcccttatatgctcatccctgtctgtgtgtgcctgcgtcctaatcacttctgtttttttgagacagagtctcactccgtcgcccaggctggagtgcagtggcacagtcaccactcactgcagcctcgaccttccaggctcaagagagcctccagccttagcctcctgagtagctggggctacagtcacaggccaccatacccagctagttttttttttttaaatttttgtagagacagggtttcaccatgttgcccaggctggtctggaactctaggactcaaatgatcctcctgccttagcctcccaaagtgctgggattgcaggcatgagccaccgcgcccagaccctaatcacttcttataaggacattggtccaactggattagggcccaccctaacaactgtattttaacttagtcacttctttaaaggccccatctccaaatgcagtaacattctgaggtcatgggggagttaagacctcaacatatgaattttgggtggcacaagtcagcccataacagtatacagttctcatttctccttatttctcttttaaagaaaggcaataaatggtttcaggtgcctttctgtttgttcgtttgtttgttttgtttgtttttgagatggagtctcgctctgtcgcccaggctctgtcgagtacagtggtgtgatctcggctcaccgcagcctccgcctcccgggttcaagcgattcttctgcctcagcctcccgagtagctgggattacaggtgcacgcgaccacgcccggctaatttttgtatttttagtagagacgggtttcaccatattggccaggctggtctcaaactgctgaccttgtgatctgcccacctcaggctcccaaagtgctgggattacaggcgtgagccaccgcgcttggcctcaggtgccttttagaagataatataggaggctgggcatggtggctcatgcccgtaatcccagcactttgggaggccaaggcaggaggatggcttgaagccaggagtttgagaccaacctaggtaacatagcaagaccccatctctacaaaaaaataaaaaataaaaattaaaaattagttgggagcattgatgtacacctgtagtcccagctacttgggaggctgaggtgggaggactgcctgagcccaggagtttgaggctgcaatgagctgtgaccgcacccttacactctagcctgggtgacagagcaagaccctgtctctaaaacaagaaaaaaaagagagaaagaatggaggagaattagattgtgctgtattatagatttaaaaggcactttgacatttattccacaaaattcctttcgatgtttaatccccatcatatggttgtcattgcaaggtggctttttaagtttgctcaggttgccataacaaataaaggctagagattcagggtccggggcaagctcccaacaggaggctcagcttgatgcttctgatagttctttcctccaattctggtcactcaatatttggagctcacccaggcagcttccaggaaagctgctggctgatcctgaccctggagggccgtcttctctgaccctaccacgttaggtgctgcactggaccaagcagccaccatcagtactcccaggcccagctcctatctgcctggtgtctgagaagcccagcccgtgaggaacaatgactcaatcaaactcagggtcctgcagcacttcagaaaaggctggtttgtggcagagtggaagaggagaatgtcacagccttgtccccaggcacagacctatcgaggctaccctctccccaccccctgccctgccctgtttcccttagctacagtgcaaaggtcagctcctcataactcttgccccccttgcaacctgaacccagtttagggaccctctcttggagaaactggttctacacatgcaccccttctcggcccccaggcctggctgctttacccgaagcactggtcaagcttgcctcacctgaccagggcatggcctcctgggtcccggtcctaggctctgcccagcatgctgcctggcagagcgtctggggagcagggagtaggagcacagcttctggcacaggacaaaaccctggctttgcatcagactgactgtgtgaccttgagcaagtctcttcatctctccatgcatcagtttccccgtggataaaatagggagagcagtaatagctacttcccaaggctgtcccaaatgctaaatgagatcgtgcacctgaagtacttaccacagtgcctgggtgctggtatcctcgggggctcccagtcataggcgtgctgagctgcagggcccttattcaaatacaggaagagatcaatatctccacctgctggcatttgagggaaatgtggccaaaggcagtgaaaaggaggtatcccctcgccccacatccccgcctcctcgctctttggcagaatgagtcacacactgtttggcacaggccacagttggtcgcattcccacaggtggctgtgatcagttttgggcttcaggcttcagcagatgcctgcctctcttccttgggtgccttccaagggtgtgcagccttccagcgtggtcctggacttcagcttggactggagctgtctgtggttgagagtctggggagatggtagggtagcgggttgtgggggaggagagacccttgtattagtttactggagctgctgtaacaaggtaccagaaactgagtggcttaaaaccacacgcatttatcctctcacaattctggaggctggaagtctgagatcaaggtgtcggaagggccatgctccctccaaaggctctgggggaaaatctgttccatacctttctcttaccttttgttgcctgcaatccttggtgtttcctggcttgcgcccgcctcactcccatctcggcctctgtcttcgcgcagccgtcttccctctgtgtctgcccacattgccctagtctgacatcagtcactggagcaggctggggtgacactttgttcccatttcctctgtgacagagccagaaacgccagtgagaaaatatgttgtgcttgcctgtgacatccctgttccctggcaccacctgatttaaatgaggcagccaggggttttatactgtcatcataaatgacatcatcctcaacaacgatgtcatcgtcgttatcacgagaggagatggggagaagtcagagctgtctgtgtgtctagggcccctcctggctttcatgatgggagaggccttgtccttggtagcccttccatttccctctggtcactttgagcactccaggccctggccagggtggaagtggagggacagagatgagcagcccgctgacccagccctccatggctcattccttgctttcaccttggccactccatcccctacccctcctgggacccctgagtggcctctttaaagtgccagtctgaacctataaaccccccacctccacttcaagcccatcctgcatcttccctttgccataccagatctagtctgtacattcaggacccctgccagcctctacctcctcctcctcccccgatctcccttcagctggcctgggtcgggctatgcctccatgaagcttgtccactgctcccatggctaaacctgttctgggccctgcagcacagcaaggtcagtttccatgcctctctgcccctgcctgaccctgctgggcccagagcttcaccagggcaggcctggggctcaggcttgtctgcacttccagggcccagggacaaaggcaggagtgactgcaatgtggcttggaattaggctttgctccatggacctaaggaggtctggtttggggtgaagggtccacccccagaaagcctgggagctctatattctctctggccctggccacaccatggccaagcctgctgggcgtcatgccttgcagtacggccagagaatgcatcagacttggagggatgtgtgtccggggtggcctgtggtcatctgggggagggctctgagcgtggctggcaagaggaaagctcaaaggggccctttgtcctcatccccgagtctgcgacatcccctcccactggttttcattccatatttggtctgtgggttttctcagtctctcgtacccctcagtccccaccagtccatgaatgcagaactacccctggcctcacaaatggccactttggataccctggtggggtcacaggctgcggttgcccctgcaaatggttggtagaagcacgggttgggaggtttcatttctacccagaagggcccttgctgtgcctgagggagggctgggctcaggtcaggggtgggagaccggggaaggggcctacaggtcagtggcccgagctcagctgcagcaccaacaaggctcaaggccaaggaggagatgagagcacatcaaaagggggcagtgggtctgggcggcccaccgcactcaccagcccaagaagggggagacttttctcacctgcaacccactgggtctctcctttggcccgcagctcaagaggtgaggaaattgtccgcctgcagatcctgacacccagggcaggactccgcctggtggccccagacgtggaaggcatgaggtatgggggtcctgctgctgtcctggctccctggacaccattctagagatggaagcagcagcctcaggtggcaaatgatgaggcctagggccggctctgccactgtagggccaacaggttgatgggaggcatggtcgacctgggttttctgccccatctcattctttcactcagaaaaccattatggagcaagcgcttagtctgtgtaagggcacaggcccgaccctgggacacagtagtgaacaggaccccctggctggaattgccatctgcctggtgggggaggcagacgccgacatgagcatgaatgaggtcagccagagatgctgtgtgccaggagcccctgggaagtgacagctcaaccctgccaattgctgaagatgggaccagtcagccgtgctggggatgttggtgggggtgggaggaggattgggtctaaggagcccgtgaaggccactgaggccattgccctgcctgtgtgagagggccactgggaatagagtggggtcactgggtcagagtccacagctctccatgccactaggctctgtgctggggaggggtgggtcaaggaggccacaaccagcagggagcacgaggggctcagcctctgccctggggtgggggtcagacagccaggtgacatgcaggcaggattcgggggctggggtggaggctaggagagatccgagcagggagactgggcccctaccttgtgaaggccagggactggggagagaagcgggagtgtacactgaaggtcatcccttaatccctggggtggcaggaacttcgagcagaggcctctcaacagtgtggtgggtgggagtgcttggggagggcttcctggaggaattgacatccaagatgagtcctgagcgatctctaggtccctttaccctcctccttggctcctcccactttaattctgcccccaaggcaccaagtcctgtccactttattttagagatgtttccatccctattgctctgcccctggcccaggcctccactgctactcacccagttgtctgcgaccgtttcctactgtcccatccctggactcccttccacatctacctgggtgatgtttccaaagggcagaagtagttatgccagccccctgcagaaagccctgcaaagcccctcccactatgctctgcagcctgaactcagtacctggccccacctgcaggctcctccctccctgggcctttctctgtgcaggctggaggctctgcctgagatgccctttcccctcttcatctttctgttccacctcaaatgtcctgtcttctgggtcatgtccttctcctgagtttcttccccaggcagcatctgagggcttgtcgattctgcatggcagcatccattctgcatggatgtagatacaatcactatgcccattttacagattaagaaactgagaccctgaatggttaagtaacttgctcaaggtcacatggtccagagcaggcagatccgctcagcctgccctactcccaccttccaccttctgcaccatagctcattgtactagttggggcagggagcagggggacagagaggggtgatggaaagacttggcatttgctgagtgaactcatttgacgagtttattcgtaggcattgaagtcaaaatttccaggagggaggtattttaaggtttgtgattgaggtttgagagagtgattagggctcaagagatttccacgttatatgcagacagaatagagctgaaatcatgagcgtaaactagctttacatggggctcatggtgagccaatggaagctgggcaccgacctcagtatgcaggtggcagccacctggccagccctcctggggacagctgggcgagggcagtctcttctcgccatgttgagagtgggcctcctgagggccagttgggagttagtgggtgtgcaggccagtataaaggagaggcaggaacaagtggagatccctgcttcaagggtggcagttgacaccttgggaggggaggagacagcccagcaagtggtggagcacgccaaagggaggagaaaaaggcggagaccaggaaggtgtgtggccagggaggtaggcaggtggtgttgacaggatcaagggaggaggggtggtgagaaggctggagtggcccactgggtcagcagtactgaatggtggtttgaaataatgatgggactgtctctcctggatttgacaacatggggctccctgaggacctgaaggagaacagaagggggcttaaattaggagattaggatcagggatatagtccagaactcaaatcccagctactcctcttattacctgtgaaatttggggcaaatcacaggggctttgtgtgcctccgtttgctcatctgaaagatgggcatgggtgataacagtgcccatatcctggggttgatttgcagagttaatgcatataaagtcacgagaacaggctcaaatgctcaatcaacagtagctattgccaggcacagtggctcacacctgtaatcccagcacagtagctataaaacaacaacaacaaaaaacaaaaaacagtagctattagtaatgaagttttgataattggccaatctgtcaatcagcagggtttgtttgtttttggttctgttttttaagacagcatcttgctgtgtgtgcccaggctcaagtgcagtggtgccatcacagctcgctgcagcctcaaccttccaggttcaacctcccaagtagctgggaccacaggcacacaccaccactcctgactaactttcaaaaatatttttgtggagatggagtctagctgtgtttctcaggctggtcttgaactcctggctcaagtgatcctcttgcctcggcctctcaaaatgctgggttataggcgtgagccactgcacccggcccagtagcaggttttaagctccgtggagacagctggcgtttgaggatgaggtaacagcccacacctgagtgtgaatggctgctgcatggttaacttccatttctttcctccataggtcttccccaggcaacaaagacaaggaggccccctgctccagagagctccagagggacttggctggtgaggaggctttcagggcccccaacacagatgctgcaaggtaactcagtgcaggaagcagacacttcattcccagaacacggagcccacatacacccagctgaaggacttccatggcctccggtgcaatgtcaatggatgcagctggggccaggaaggtcctgttcccactgttcccccagtacctggggtactgcaggtctttaatgaacatctgttgaaagaaagaaagaatgaatgaatgaggcctggagggaggtaggcccctgccatgattcctcagggagccagttagagagcaggaccaaactccagggcaggctatccccagctcctggcctgtgctgagttccttccattcccctgaagcttccacactcactgtgcttttactgcaggacaaagcagccctgccaatggccagggcaaagcaaggccaccaagctggcagtctgggagagtcagtgaccaaagtatgtgggcccccatagagcatgtagcggagactttcaggatgacccgtggactaagggagacattgtggcaaggggtgaggggtccaggacgggaagttggagccatagcggtggatgatgagtccagatgggatgattgtccccagtcgctgcacagccagcccactgacctgtcctccaagccagaccagtgccaaatgtgtctggtgagcagtggctgcaggctgggcatttcttcagtgagaacctggtagccagttacagctaagaacccacacacccgtcttctcagtgtggatccctggagcccctagctggaaccctgagccctggaaatgaggaaaggaatccctctatggcttattaccagacccacatgtcttgccccttgctctgttggcaatcagctccccccaccaccaacgaactaacctcctcctgactttccaccttgctcccaaccaacccatcaggtttggaaaaaatacagaaatacttcctgttagagtcaacttgggcttggctcagctctggtcagagcagcacagagtagcagccaaaggcctgtgcttctggtcttgaggcccactctcatggcatctgggttagatgagatcaaaacgcaactagagtcagcaaatactccacttctcataacaggtcaagtgcacagttgagtgatggcaatgtgggatccggagccacgggctcccggcctgaaggcttggctgcagtagacatcggctccgagagaggaaggtgagctgcccgggggaggcaggttctctcatgcccctggtgacagaccagggtcaagctgccaggctgcttgggctgctatgggtggggcactggtcacttcctatggctcctgtctactgcttctcccacactcccacattccaccacatcctgtgtccttgggctttccactttttggaatcttgttcatttttctgatccctgccactggccctcaagctcctccagagtaggcactaggcccactcacagctggaggcccagccctcacatggtgctggtcttgggctggtcaaatgaacgtgtagggaatacatgaagggacaaattaatgagtgaatgactgaatgatggaagagtcggcaccttcttacttcttggttaagctctgaggaccagctaggaggccctttgctcctgctttctcccttctctccttttcctgccccatccctaccccaggcagctctgctctgaggttcagggagaggaaaagcggtagccctggagagaccagcgtgtccagctgggctctggcttcttggacctggagggagtcaggggccactttctcaggtgatttgcagagtggcaaggtccctcttgtccctaagtggttccaaaccaagcctgaatcattcttggggcaaaggctaggtatgcagatgttggcataaatagtttagctccaaactatgctagagtccttctggttcagagcagatggctagggaggagtggcaaagccagtgtctgcaaagagctacaaccgcaagatatcatctgcctcctgcatcctactgcagtctggccaaggagggaatcctgtggggaaggccctgctgatgctttcctacttccctcagcacacccagggcccctttccctcactaacttcaatagtttgcaattcatgccatggaaccagagcccgaattctaaatccaggcccacaagtcaacacaggaaggggacagcaggtcctggcctctgaaaccactgtctccgagcaggtccaaggagaggccaccagagactctgttctttaagctgccactaatggggaggactccgctagagccctgtccatgcagcctgcatctttttgccatctgcagaggcattggagggatctttttaaaaataagctagatcacatttctcccctgctaaaaccttctagtggctctccattttccttagaatgaagtccaaaccctttcccatggcccactgggtcctgcatggcagaatctttggccttctatccagtcggggctcctgctactctccccacagtggtgcagcttgactggctctgctgatggctgtcgcggaagagacttctggtctactgtgattgggtggctctggtctcctccatgtcaccccgcctgcttatacaccctcataacatgaagcctgtgctgtccactgtttccttaaaatgaaaccaagcctcaaagttacttgtaaagtcatctgaagaatcttctagattttcatgaattttaacccagtcttttacagttgtcttacctatatagtagtccctaggtatctgtgggggattggttccagaacctcactcatataccaaaatccatgcatgttgaagtccctgatataaaatggtgtagcatttgcatgtaacctatgcacatcctcctgtaccctttaaagcatctctagattattataatacctcatacaatgtaagtggtatgtaaatagttgttatactgtattgtttagggaatgatgacagaaaaaagcctgtacatggtcagtacagatgcagccatcctattttaattatttttcccacatctcatctcatcctctcctctcctctcctctcctttttcagacaggaccttgctctgtcaccagggctggagtgcagtgctgtgatcacagctcacagcagcctcaacctctggggctcaagggatcctcccacatcagcctcccaagtagctgggactacaggcgtggaccaccacgcctggctaacttttgtatttttggtagagacgaggttttaccaggttgcccaggctggtttggaactcctgggctcaagcagtccaccgacctcagcctcccaaagtgctgggattacaggcatgagccactgtacctggtcccaaatattttcaatctgaagttggttgaatccacagatgtggaacccacaacatagagggctgaccacacttagtttgactataattttcaacaaactcctttattgtttttcctttttttttttttttgagacggactcttgctctgtcccccaggctggagtgcactggtgcgatctcggctcactgcaagctccgcctcctgagttcatgccattgtcctgcctcagcctcccaagtagctgggactacaggcgcccgccaccacgcccggctaattttttgtattttttagtagagacggggtttcaccgtgttagccaggatggtctcgatctcctgaactcgtgatccacccgcctcagcctcccaaagtgctgggattacaggcgtgagccatcgcgtcctgccttgtttttccaaaggaaaggttgtttctcatggcaacaaccactctccttttccattcattttcatggatttacttaatcatcgaacttagtgattcttctccattagtggcagctcaaagaactgagttgctgccccaggggcctttccttggatctgctcagagacattggtttcagaggccagggtctgctgtccccttcttgtgcaaatacaactggcataaagaggtctgggaccaaacaagagcacctcttagtgagtgtgctggttagtggagggcacaggcttgtataggcagtgattgttcagcatgccgtgagcatcagtctgcctggtttacagagacacagagaatgtgactccaccctgagaaggttgggtaagacattccccactaaatccatattgagtgggtgaatacaggtggactgggaaggtgcactgcttctataaacagccactgggccctgtggtaacaggaacacattagcacatgttatggcccaggcattattcaaagtacttggcatctatgaactcatttacttttctcagaatacttacgagacagacatgattagcatccctatttcattgatggtaaaactgaggcccagaaaaaaaggtcaggtaacatgcccaatgtcacacagctgggagatagcaaagccatgatttgcaacgccagagggcaaccactatgccacagagccccaggtgtcaggctgccttgagatataaatattgttcctcaagcatccatttgagcagcttcttggtcctcatcatctgtggggggcaggatccactttctcgggagagggtagacatacagacacaaagtcctgaacctggaccaggtctggccttctttcacaggctgtgtgcagctgctagctttgcctctttcctggaagaccaggatgggcacagtgccaactctcagtcctgcaagcctagaccagcagccatcaggtaaggttagggccactgccctagtgccctatcccattgccagacacagcctttggggcccagcctcagctgcagcaccccaggatccccctcgaacttctcagctccatgccactttcacatcaggtgatcacagcaagacagggaactccagggggagctctgaccaggggcagtggaagaagagggatgggtgatatgtctgctcacccagagagcccagcaccaacctacatggacccaagctgaggtggcagagaggagggcatctgaaggcagagcctgggaagagatcctgctaggaggtctcagagaacctctgctgtagggactacagccaggtttagcaagcaggagtcagggagaagattcccaggggcagccagcattagagggctcagttcccaggagcacaggaccggtggctgggatgggcaaaaatggctcctggggcacaaaggtacaatgggaagaagctgtgcattcccatgctgtaagcgtctgccctgtttcacccaccaatccaccagtgggcatggccactttgctgtgggtgtgtggagcatttggcaagtcctagtaaggaacgatctttcttaactcccataaaccctacagaggtgtaggtcaggtaaggatacgtcatgctcagggtcaggttccagccgcagctgagggctaaggggaatgggtggacgtggggcagggagctggaagaacactcgagagatagcaggtaaatgagacatggctttactcagcagcagctctcttacacagctttctcaaactagctttctcattagcagcttactctcacaccgtctgccctgtcttggctgcttagtccggtggcccctacgcacagctgcgtggccagctctcccttgccttcagggtcagcagcttaattctttctctccctgggcacgggcaagccaagctgtgtcctggctcccctctgtcctggctcccctctgtccacctgcaaagacagacagctcttgctctctctctttctctaggttcccgtgcacccgccatgtcaagctatgttgagctgagccaagccccaagagacatgtcccccatacacagcgtcaacagggcagttataccttttacagacaatagtggtttagagccaagtatgaacttacataaacaggttatataagaagtggaggtgtgcacctgtgcaccagactcattgagtcatgcaggcctggatatccccctctgcctattccttgaacaaagcacatccaggtaccttacaggatactagaacccaaaaccaggagacttccccagggaacccaagttggtcaggggcagtgtttgctcttgaactcaggtgctaaggccatgtccaaagctgacatgaggttgtcacacacagtggcatcggtgccacactaatgccaggactgagacaccagcctttactggaagacacagttcctccctttctggtgagaaggcagcctggagggggaagacctgggccccagccttctttggtctgagatctcagcaggcctgtgtttccttcctcagctccagtgccacttcagtctctgctgtccctgctgataggaagagcaacagcacagcagcccaggaggatgcaaaggcagacccaaaggggtaaggcatgagcagacagtgctgaacttctggggtggagagaggcagcttgggctgtgtgtccattggcctttggctgggaaggtgaggccagcaaggtttgtgagctggcctgaggcacatagcaagggcagaagccccaaccagaaccctctggcttctggggccagggagctttccactaaactgttgccttggccaggaaatacatcatagtcagaaagggtctttcagtcagcaaccactctgacagcaactgccttttgctggaggctggagcatgcagacaaatcagaaacacctctgccctccaggaactctcaggcagggggtgggcaaaggctggtccagattagagcaatacatgagcgctagagcaggggaagggggcttcatggggactgtatgtagctggatgtggtcagcgatgagtgtccttgttggggagtgctggaagaggaggctcagtgaactaggtagggcttgattggcctcttgtactgtgatattggagtccactgtgtgcacagccctctactcacagtgtctcatacggttctcctcacagtctctcaaaggtttatgcctaattacaacaaaacccaaaagcctggagcctaggtctctgtgcctcctgggaaggatagtgctccgaagaaaacagccgcagctgagatagagtgatggcagtgaggagggtactacttaggtgggtggaaaaggcaactcaggcgatctcctctaaagaggagaaggagccaactctagaaagaacacggtggagagagctatagataaggaaccacaaaccaactaaccctgaggtgggaacatgcttagcatgttccaaaggacagagtggctggagcttggccagtgaggagggccacagatggagcagggccttggtaagccatggttaagagattggatcttatttcaagttttaagccaaaggggagtctcatgtgatttaggtgtttaaaaggtgaatgcatgtttgcattttcataccacattgctgttgcttttttacttaaaccaagatgctgggggctggggtgggcaatggatatctaaggtatgaggccttattgtgtttcttttctcattcgaattgcactgacaattaacaatcagagtgaaaacaacagctgacaccaatactgtgctgtgctaggtgccttacagccttcccagcaacttgtgagatgggtaaggtgggaaactgaagcatagaaagattaagtgacttagccaaggccttacaagtggcagaactgagttccaagggaagaggctctaagaaaatcctcaggagaaactacgaaaaactagtttatgaaatcttgtctttggagcctagtctcaagacccagaatcagtaacttacagctggttaacatggttaacatgctgtgtgatctcaccttaattttccccaaacgtggaaaaggataaggcttcttattatgcaacttgacagaggagaaaattgagggactcactcctgtaatgaacacacttaggaacagagcccagatccagccaactctagagccaggctcacgctactttcctctgatgtttaaacgtctgcaaaatcagaggtgttttttttttttttttttttttttgagacagagttttgctttgtcgccccagctggggtgcagtggcgcaatctcgactcactgcaacctctgcctcctgggttcaaacgattctcctgcctcagcctcctaagtagctgggattacaggcacatgccaccacgcccagctaatttttatatttttactagggatagggtttcactgtgttggccaggctggtctcaaactcctgacatcaagccatccacccatcttggcctcccaaattgctgggattacaggcgtgagccactgtgcctggccaatacaaactttcttgattacagtgtttcacaactctggctgtacttgagaatcacctaggaagtactgaaatacactgttgatgaaaaaggccatactctgtaaaatatttgaagaaattctgagccaaatgttaggactatgacccgtgacacagcctcaggaggtcctgagagcatgtgcccagggtggttcacttacagcttggttttttatgttctagggagacataagacatcaatcaatacatgtgaggtatacattagttaggtccagaaaggcctaggtatacattagttaggtccagaaaggccggacacctcaaagctgggagtgtggtgggggtgggggtgggggtggggttccaggtcataggtggattcagagattttctgattggcaattggttgaaagagttgttattctctaaagacctggaatcaatagaaaggagtgcctgggttaagataaggggttgtggagaccagagttcttatataggtgaagtctcataagtggccgcccttagaagcaatagatggccaatgtttcttattcagacctttaaaaggtgctagactctcagatcagaaaaagtcctggaaagggaaggagattctctacagaatgtaaatttcccccaggagagacagctttgccaggtcatttcaaaatatgtcaaaaaatatattttggtgtaaaatacttcaatttctttcattacctgctgtctgtcatgtgatgctatactagagtcaggttggaatttggcatattattgcttcaaggagtctgttttgtcagtctgaatatctctctcaatgttaatactggtcagttgggcatgaattccaaagggaggagaatatattgaggcatgtctgaccttcccctttctcatcatgacctgaactagtttttcacgttgtgtccccttggctgagagaagtgtccattcattcagctggggagcttagaattttatttttggtttacaacacaacaaaaacttcccgaagtcccaggtagagatttggattttatttttctggggtgggtctccatcatgtgtctttttcaaagctccccagtttgttctccttccaggctaggtcgagaaccatcgttctcaggtagtggttctgacccaggggcatctcccaaagcttccagcctgctacgatacaatgtctggagccatttttggttgtcaaaactgggagtgggagacactactggcttcttatatgcagagatctgggatgctgccccacatcccccaacacacaccatagaattatggggttcaaaatggtaatagtgctaaggttgacaaaccttgctgtagagccttgacgatctatttgggaagacagcagggacggaaaagaaaaagggatggcacagaaccacacccctcaccttccccgaaatctgggtagcgggcacaggacgtgtgcgcctgcgcgaatgcgcgctcgccaccagcgtacgcgacgcgtgcgcgcctgtgcacctcggcgagcacgcgcccgtagtgagtacgcctgcgtaggccgccatttcttgaagccccgaactcggtcgcagtgcccgccgggaaaatgcgaccgtccacaaagtgaaatggccgcccgggacgagctcggcctcggcggggattctcttgaggccatgcccgtgccggccgccagaggtcgcccgaggatcacgaatgggcccgaggagctggctgccccttcccccgcgtaaggtctgaagccgcggccagagtggctttggggtgaccgcgcgtggaccgtcgccggcgggaggaagcgcggtcccgcgaggggccgaacggggcccctgcggcttgagcttgtttcgcagggagccctggggccatggcctctgggacactggacacgggtcgtcagggctgcccagggggagggggtgtggacgtgcagacagggaaggcagctggaccctccaaccacgctgggccctcgggctgaccggggctggtctgtggggcagtgaggaggggcttcgttccctaggagtttgatgagggagcgccatgggggtggcgtcatcctgacatcccgcagggcagtggagccttactttccctaggttacaacacagttttaactgtcccaaactgtggggactccgccctattccatcttgggccgctccatcacactacagggagaggcggtatagtatagtggttgagagcctggactctggtgctttgggttccagtccaagctctgtcacttacaagcaccgtgaccttgggcatgttactcatcttctctgtgcctcaggttcctcacgtgcggaatagtggtaatcatacctcctaccatatagggttgttgaaatggccaaatcggtttgtatatgtaaagcctgtaggacatttaaacctgcgagctaagtgaagcagcaccagaggaatatctcctcctctcagaggtgttcagggacacctggaaagctaacttaaccagctttattggtttgatttcatttgacatgacacgatatctcatcttcttcctactaaacttttgtcatcaaattttccatctagaacatgctgttttcctcattatgttgcaagcatgggcttctcgtttatattttttctgcatgaggatcaggtgaagtttaggcaccacatttcctcaccactggcaaccgttgttggccagtggaggcagtacaagggtggaagtgtcagctgggtgcagtggctcatacccacctgtaatcctatactttgagaggccgaggcgggaagaccacttgagttccggggattgagatcagcgtgggcaacgtagtgagacctcatctctacaaatattatctatatctatatatgtatatgtatatgtatatcatatatatgatgtatatctcatatatatatgtttttgaaacaatgtttcacttctgtcgccccagactggagtgcaatggggtgatctcggcttactgcaacctctacctcctgggctcaagtgattctcctgccttaacctcccaagtagctgggactacaggcacacaccactgcacctggcttatttttgtagagaggagtttttgccatgttgcgcaggctggtctcaaactcctgacctcaactgatccacccacttctgcctgccaaagtactgaaattacaggcgtgaaccactacgccgggactacaatttccgttttttaaaagaatggaagtgtgtagattatggttgtgttaggagttgacagtggctgtattaggctactggatctttggtccaattacactcagaaggaaaggcttcagagaaattaatccaaaatccaaaatcccgttggtcaccatcccctatgttaccttgcctatctctaaccacttgacttccaggaagttcatgaggagctcggacaggatagctgggaagtaattcccctggatgttacattgtccagcagagcttcctgtgagtgtttgcctaagatttcctttttatgacccacataggtcatatgtcctaaaatcacagtggccctgccacaggcctaggaaagaagaagccttgttcatccatttgtccctgtgtcacaatagagcccaaatttctctttgtggataatcctggctctatccacagacttggtgagggcaacctctactagtgtatttctacagaggacgtgggacaggacgggactctgattaaatccatagtaaagctaactcagggctaccacagtagggagacaagctcttcaggccttgtatgtttgtctttggctcaagcaagcatgtcactgacagagattgaatgggtgtgtcagggcaccctgctggcaaccctgggactggtgttacctgtgcagaccacttttggatctgcatgggctgcagcagaccctaagggtggaagcagcacagagaagcacaggcccagtgggatggttccccacagttactgtgtggcgtcacactcacttgcctgcagttctgcctggtgcagctggaggtggcaattagcttgttgtgcctgctggagaattttagttcccttgacctccacctgaggctgaagaatcatgttgctttcagggcatactttccaaaaagtgtggcctctgttggccttgttattccagcttgaaggcaggaagcctgcctagacaaagttaactcctatatacaaagagtcccagggtagtttgtagcgtgttcttgtctcggggtagcccccaccagctattgaaggtaggctggtgatgttgggaaggttatattcagagtgagctaggatcgaggtgatggcgaagtagattttcattctgaaatgctgggctcactctcttagtagcccaacttggtgtttgcccctggcctagtagactctggaagcagtaccttgcacctcggtgtggggctggtgatgggaggggtgtggaagtggaggatcagctagcagcctctttcccacggtacccagattggagggtgcagtgcaatcatggggtgaggccagggaggacccctgaagagctcgatgcctgagacatctgggggaagccctgtccttcttgctggattcaggggtggcaaaagccaaaaattggagggccaggtgcaatggcacatgcctgtaatccctgcactttgggaggccaaggcaggaggatcgcttgagaccagcctgggcaacatggtgaaaccttgtctctacagaaaaaaaaaaaaatacaaaaattagctgggcgtggtagtgtagacctgtagtctctgctactcagaaggctgagacaggaggatggcttgagcccaggaggcagaggttgcagtgagccgagatgatgccactgcactccagcctgggcgacagagtgagaccctgcctccaaacaacaacaataaaaacatcggaggcttcggcttcatctattacacatggaggcctgttcagtgagaagggagcagcgatgctgggctcctgccaaggaggagactgtctgctccctggaattggggctgtgcctggctcctttctgccccgctttcagggatatgagtccctccaagtccacaggaggtgacagccagcttgcgtcctggggctgaggcagggttagtttcagagcacttttttcataagggtgcttattcttcttcagggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcaggtaagggctgagctgcagtgggctctgcctctggagcccatgtttttgttgaggtctgcgacccacatgggaaccacttccccacaccctgtgccaatacccgacacattgcacacccaggctcctgttctgtgagtgggtcatggtgattccctggtcctagagcagtgtcatcaggcttcttgtggctcaaggagctgggaggggactgtgataggaggatgtgtctgtccccaggtgtgagaagccctggctaattcccaatgcatggggcaggaaggaaggctgtctctcagagtacaggtgctctacaggtgggggtcctgggcagagtgagggctatttgtgtgggtaaaatgccattgtcagagaaggacagagtgtgaaagagcaaaaaaacaggagggtaaaagtgcaaaagtgacagagtgaagcagagagagagaggccagagggagagaaagggagcatgtgtgagcaggcatgagagagtgacacaggatgtgactggccatgtgttggtgtgtgccactgtgcatgagcaagaggacaaacgtgcctgttactggagctgaccatgtggcattggtgtgagagtttcaagtcaggctctcttgaaggcatcttgcctgccagcgcaaacactgcatgtccttgcagctctggacacgtcaacaggccagtgattccaggggtgcaaagcgaacagtttcttacacaagacagaaatgtagaaggagagagctaagactcatattgccccgagagaggagctagtggaatccagcagggcatctgctgtggggagcaggtggagcctggggttccttttgcagggatgaaagaaacacagtcatctgccttctttgttctggggcttcttgtaccacagaggttccataattattaatagttaggttatttttagggcctagctcaactgttagataacaagttttaccttctaagaatatctagcccatctttgattccttggctccaggccctggagggtcccagtccaaaaacagagtgaacaactttggacttgctgtcacattgtgtggcttctagaactagtcagtgttccatgcagaaggggtataaaaagtgaggcttgtggatgaaggaggaggcgagtggttctgggttttgttttcgttttgcgggggagtgtcaggaaaggctttctttacagggagagtgatgttggagctgggtttggaaggctgagggagattttgccagatgtgccagacgtgcttgggaaggcattccgagtggaggctcacaaagtgtatagggaacatccagtcaggtagccatcacaaaggagggttaatccagcctggcttggcaggaagcaccaagtaggggctgggcaggcacctgctcctaggctgaggagtgtgacccacatcctgagggccttgggagccaccgatggttttcctgcaggagagtgccacagccagactcgagtccaaagaagatccctccattgccctgtggaggaccaggccaggggagtatacgacgagacaaggcaggaggccatattggagactgtttgcttacaccaggggcaaggtgatgaggctgcaagtatttttgaattattaaaggtaaaagcgggcttggcgtggtggctcacacctgtcatcccagcactttgggaggccgaggtggcagtatcgcttgagcccaggagtttgagactagcctggggaacacagcaagaccccatttctacaaaaaatttaaaaacattagccaggtgtggtggcacatgcctgtagtaccagctacttgggaggctgaggtgggaggattgtttgagccttgcacgtcgaggatacagggagccatgttcctgccactgtactccagcctgggtaacaaaacaagatcctgtctccaaaataaaaataaaaaaaataaagataacggtgagggaaaagtggtagccaaggttgctccccagatttcagggctaggcaattggatgggtggtgacaggaactagctgagggtaaggagtttgggggcaggcccgctgagagatgcacagagatgagaaggtcactgggccatgccgaatgagaagtgcctgtaggggctccagccagtgatgtccagtaggctactgagtaaacaaatgtggagttgagcaaagatctgacctggggctagagagctgggagttgtcagctcataggaagtcactaaagagaatgcatgaggttgcctggagaatgcctttggaaggcagtgtgtacaaagcatgtattctcggcttttctctgcagacttccagggacagttgtccagccaggcccttggctgggtgggtgagtccacgtggttcagggatgctgagggaagctgcttcatcagctgacatttctctccattttctgctcttcttttgtctcaaaaagaaaaaaagaggggatattaattattgatcccctaaaaccctagctgaatatataaaatgaaaagaagtaaaaatatgagagaagcaaaggcagatggaccataattttggaaaataattccaaaaggtcttaaggaggaagaggagctacagagaggtattgagaaggaaaattttggataaatggaagaatcaggaaagactaccgtcatggaaaccaagccacgctgagctaactttccagtgctctgtagatgctgaaataggcccatcagatttggctatgtagaactcatgactgccttgaggggagtaggttggggcagtgggaaaggctgtagttggattataatggattgaggagggagcggaggataagcaggtgcagttgatggggtacacactctgaaactggctgtgacgtgatggatgtgggaggggtgagcagataattacagctacaagataatggggaaggtttcctataggtgaaagcaacgtgtgcatgttaggtaaaggctgggcagagggtgcctacgtgaccagtccccgataaaatccttggactctgagtctctcatgaattgccctggtcgacagcatttcacacttgttgtcacaactcactgctgaggggaactgagtgaatcctgtgtgacccactgggagaggactctggaagcttgtgcccgggttccctcagaaatttgccttgtgtgcttttccctttgctgattttgcttcgtatcttttcactataataaaccatagccttgagtgtgatgatgtgatgtgtcctgtgagttcttcttgtgaatcaccaagcctagggatggtcttggggacccctgacacagatgggcaggatcagaactttatgccataacaaggactttagattttctttcgagggcaaagaggagccaggaaggtttgaagcaggggagtgatatggcgagagtattgctttgcaatgggatctccagtggcagtgagaagagtgactgaagtgggcagagtggagcagggagaagaggaagtgcttacagcatcctccatgtaagaaatgatggggcctggactaggggactagctgtggagatggagacagaactgtaaaataagtagaagagatcccaaattggatgacaggtaagacttgggagagcagtgacggagagggaagtgacaatttagaaagccacatttctggtcgagtgagtggagtatgtgacccctcctggcttaggtggtggccaaagtatctctaacctgcctctatactgcctgcaactgactgagcaaatgcctggtccgtggagatcccaagctgacaagggcacctgaggcaagcctctggctttcaggtggaggccctacctaggctggcctggctggattgccctggcacactgctgttttgctgaggcagacagcagcactctgcaagtgctcttctcctgttcctcttagtggtctaaatcctgtagcatgctggggtgcgactgtagacaaatcccctttccgggccccctggggttctctatttgcagtctttgggtctggtcactggcatggcatctcagtaggctaggttcatcaggaagggtcaactatgtcatggcacctgatgggcagcatttagagtctgtgggccaggggcttaagggctgcttactgctaatagttctaagtagcaagcattccctcagccctagtctgggcacacgccaggaagaaagccactagatgtgctctcctagtggataactagcctggagttccaagaagggcagagacaggcagagtgagagccttcagagatgtaggcaacgatagtagcagaacttcgagggagagtagatggaaaaattaaaaaaaatccttgtcattatttttaaatgtctgaattgaccagattagaatctttgagagtctagacactagggagatctcatgggtgggccagttattatatcatatggagggagagtacgtatgacccagcacgagaggaccagaggacagtcagtgctaagggtaaaaccttaggccatgggagattgagtttttcatcagttggcaagttttcactttaatactccactgtttccatcatttcagacgactggggatgataaggacaatgtaatttgggggataaaggaagaactcattatatttcttggatgactttactggggaaatggattccttagtcatttgaaagaagcggtagaattccacatgtggggaatacttgttctaacaaaagcttaataacattagtggcaatgatccttttatataagggaaagcttcaagccagtgagaaaaacataaataaactagtaagaacatatttataaccatgagatttgggtgcagaataaaatcaaattggcagttcaggaaaggtcctaaacatctgtatattaacaatattccatcagtgagcaatgtgaatttcccataattgaaatgatgattgataaccttgtattgttcttatctaatataaggcaaagcagcactggggctttgataaagagcaatatctcatgtacactgaggacactgaaaccccgctaggaattctatggaatttctaaaatatttatattaaggacattttacccattatagactaatttagggaaggttctgcattttttttttgatttgacaatgtttccaatgcaatttatacaatattaaataagactaattagtttttgcacctttcttgttacaaggtgaaagaactaatcctttgagattttccagaaggtccctggcaaatcccaaagccagttttaggtataaaatatatttaagttttgattgtgggaaggcaaatgttaagagttgtcaggagttctcgaacatttgattgaatagcattatgggttagcgagaaatactacttggttagctagtgaatcagagttgtaaaaattttcaagtaaacatatgaggtaacatggttgtaaagaatcttcagttcctttaaaattgaaaagactttaaaaaaataactaaggacataataaactgaacatacagatagggcattacagtattttgataagacataaaatctttgcctcttaggcagatgactcagaagaaaaacagaccatttataactttttattagggacagaccaatgatcaagaattttttttttttttttttgagatggagtcttgctctgttgcccaggctggagtgcagtcgcgcgatcaccatgttggccaggctggtctcgaactcctgacctcaggtgaactgcccacctcagcctcccaaagtgctgggattacaggcgtgagccactgcacctagcctaagaaaattttgttattttaacagagaaaccaacattttaattttatacaagtataatatttgatattagttcttttttgaaaatcttataaatacactgaataaaagttttaaccatgacaaataaaattccttttctgtgaacattttctaattttaaagatatttgtttacattttgtctcacacatttttaaattatttgtcattttaatttgggacaaagctattctctttttccttaggaaaagcatatttgcatacaaagttgtttccctttgccatttttgccattattacttttagcagtttatatatatatatacacacacacttatttacttattataattttaaccattaataacttctctttcacagagaaaacaggaggtaggtaattttgaaatatcatataccagcattttgtagcagactagtaaagcttatgaatatacatctcataactttttatagttgttatatactttttatagtaccattttgcaatgtggacaaatgaacacatttaacagatccatatgtagtcacactgtaccataaaaaaagcaaaaagtatataaacttaaatttaggtctagtgactaagtattttatcttctttataaatgatatttaatgaatttagttaacttaattcagcataagtctaaggttttaagttaccaaaaagattttagaaactgcctttaagcttacatattataaaacataattactgttgaaataaagtttgccagaataatgactcagtttggttaaaagcaaatttaaatttttataatcttaaacatgtagtagatataatactagcttattcaacatgtaaacctgtttaagtttaggaggaacatacccaagtagagtaaaaatatatgcttgtattctgttgtattatatgtaatgctgataactcaaagacacataggtgtctattaaactaacaatattaaactagttttgtttgccaaaagtttacataaattctgtgaacttgagttttaaaagcatttgggttagtttttataagaatacttttttgttgtttacactgaaagtattagaagttgtttccttaatttatgagagctttataataatttatataagtacttatttatctctaagtcaattagaatagaggataagggattttgtaaattaatttggtaatgccatctggaggtactgaactattacacatatacaacatacatgtatactaaacatacagacagacacaaatagagatctaatggcgagccctcaatgggtgcagggggcctgaagctctactggctataggcagttgagagggctgagtgggaaggggaaagcctggtgaagagtagataggggtatgtaggaggtagaggcattgaaggggacagatgaaaagattcagggagctgaagggaaggtccaaggtggtgaaaagaagggaagagggatgcggtaggaagatgagaagggggaatcttagatgagcaggtttggggagaccccaggttccctaataaggtcactgaagttccaaattacccttcgtgattactttttttttttttttttgccagttttggaaatactggacagaatgagtgccataggggcagggcatgtagtcagcaagggaggaggaggaggatgaggaggaggaagggcacccagtagattgagagttacctgtgggaagaggcagatcaaatagagaaaggagccaggctggacagtctcattaggaagttctgcacacagtcgtcatctgggagccaaagtttctcttcagtcctcattgaggagctgaagggctttccttgtgcaatctctagacaaggtgtcaagggaaacaatgaggcctcacaaaagagccaggaatttggagtaaatctccactcaaaaggaaccaagaaaacttctatccaggacgattctggctaaaattgaaaaggaccaggaagagtcctgctcaacagagtcaggggttaaatccccactcaaaaagagctaggaagagttctgtctgcgaagattcttgctcaaacagaaaagaactgggaagagctcatttaacagaatcaaagtaactgaatcacagaaccataaaaagtgtccaataaaagcaaataccgtctctgggcagggtgcaatggctcacacctgtaatcccagcacttgagaagctgagggaggaagatcacttgagcccaagggttcgagaccagcctgggtaacatagcgagactcctatatctataaaaattttaaaaattagccaggcatggtggtgtgtgcctatagtcccagctacctgggaggctgaagtagtggaggattgcttgagcccaggagttgaggctgcagtgaactattattgcaccactgcactccagcttgggtgacagagcgagaccctgtctcaaaaacaaaaaacaaatatggatttagatagagacttttattttattttattttattatttttgagacagagcctttctctgtcacccaggctggagtgtaggtgccatctcagctcactgcaaccaccacctcccgggtttaagcaattctcccgcctcagccttctgagtagctggaattacaggcgtgcgccaccatgcccagctaatttttcaatttttaatagagatggggtttcgccatgctggccaggctggtcttgaactcctgaccccaagtgattcacccgccttggcctctcaaagtgctgggattacaggtgtgagccaccgtgcccgaccaatactttatttaaaaagactattgcaatagggacaatgctgcaacctcaggacttgcaaacatcacaaaataatacaaaaaacatcacaaaataataaaaaaaaaaaagcctttttttttcagtagggagtagtaagcacagctagcagctcagctactttcaagggccagtgggcaagcaaaggggaacctgtttggcatgatttgaccagaaatgtgtttccctgtggtcagccggttctcaggagaagctgctaagtggggcatgttctgcattgcagcacttacttaaccaggagcaagcaaaattcaggccctgtggggaggacagaagcctgcctaacattctgtcaaggcaaaggagagggtaaaaagcagacagctgtgaacacttgatcatccttcaggcaataatccattctgggtttctggcttaagactcttgagaaacaaggggaaacaactggtaggagcagcaggctcacctatatgtagttccgtgaggtagccttatggacttctgccaccttccaaaactcagcatgtcccaaaccatctttatcaacacagcttctcaccaaaaacaaccaaataaaacaaattaactaatgtactaattctgtatctccccctgtgttgttcatctcaaaaaactgttatcacctcattgactcagactctcaaccagcgaggtagaagaaatgtttgggggcatgttaaatgtaacacctatgagacatgtaagaggtgaggtgcaggacgcaggtacatggtgataaaagaaaaacctcagccggattaaatttaaaggagtttcattgagcaatgaactatttgtgaatcgggcagcccccagaatcacagcagattcacagagactccagtgcagctacatggtggaagatttatagattaaaaaaaaggtggagggggggaaatgacgtacagaaattggaagtgaggtacagaacggctggattggttacaggttgggggtatgccttatttgaacacagtttgaacactcaccagtgtatgaatggttgaagtatggccgctgggattggccaagagttagctattgttacaggtacacactcctaagttaggttttcaattttgtctgcctctaggttacagtttattgacaaagactcaaatatagaactatggagtccttctcaggccgtatttaatttgctttaacaattccccctttttggtcattttctcaactttgagagattgacaaaaaccttagttattgatatcactattacccttgtaaatgtacttatatggtcttgaaacccactgggaaacaggaggacagtgggttttgtaaggagagaataaggactgagtagaaggtacctctttatgctagaatgttctgtttacaggacaaaaacaaaacctggtctgttttaataactatttgtttccttaaagtcttagtttgattatgttacatttagcatgagcaactccattttgtttggtttggtctgttgggtcctagtgcatgagctcagtacacaacaatggcttgccagaattttgtttaaaaaattccccttggctgggcgtggtggctcatgcctgtaatcccagcacttagggaggctgaggcgggcagatcacgagctcaggagatcgagaccatcatggccaacatggtgaaaccctgtctctactaaaaatacaaaaattagccgggcgcggtggcatgcgcctgtaatcccagctactcgggaggctgaggcaagagaatcacttgaacctggcagtcagaggttgcagtgagccaagatcacgccactgcactccagcctggtgacagagcgagactccacctaaaaaaaaaaaaaaaaaatatttccccttattggccaggttctcacttaggtgagagtgtgaccaaaacttagggccttagcaccacttttagttacctagttaccatcattttaggtttccagtctcagcatgtcattcataggttatgatgtcctcataatcatacatttcaatcagttttgttattccagttgaagagagaccatttgacatttcagagatggctgcatgcaaacatttgaaacctttgagagaatacagtgcactggggagactactatgactaccagtaggataatacccagagtttgaagtatgctgtttacctgaggtccccataaaacaaactgcctaaattaaataaaataaagaatgagctagacgaagagtctactcacttcactaagtgatcttttcattaatcctgtatgactgaatttttataatctgcacttgatatacatattagaattttagaaaccccatataattttggaatatatattaatataattcactaaaaatataccctgaagattaaacattatttttattggccaagcgcggtggcttacacctgtaatcccagcactctcggaggccgaggcaggcggataacctgaggtcaggagttcaagagcagcctggccaacatggtgaaaccctgtctccactaaaaatagaaaaattagccaggcatggtggcatgcacctgtaatcccagctactcgggaggctaagactggagaatcgcctgaacccaggaggtggaggttgcagtgagcagagatcatgccattgcactccagcctgggcaacgagggcaaaactcagtctcaaaacaaaacaaaacagtatttttattttgacaatgcctcccatgatttttataccaaataagccaaatgtcactgttgcattagtgcattatcgatgtcaaacccaattcttaaataaaaccttatagacaaatgtattcaatcttaatcagtttgaacataaggtaagaattttataaaccttttataaccctttacaatttttgttgaagagcagattagtgctctaagaaaacctgttgtgcttttatgtccatgttcaatttatggaaaaacctaataatacccttttaaatttagtattatcatacataaaattttttacaaggttaattttttttttttttttgagacggagtcttgttctgtcgcctaggctgacagtggcatgatctcggctcactgcaacctctgtctccccagttcaagcagttctcctgcctcagcctctggagcagctgggactacaggcgtgtgccaccatgtctggctatttttttttttttgtatgttagtagagagggggtttcatcatgttggccaggctggtctcgaactcccaggtgctcaaaggaaaatttaagacagtccatggaggagaaaggtatagacaaggtcatgcagatattaaaccagaaaggacttatttcctaagccaggaatcgaacccagactgccactgtgaaagggcaaaaccttaactactgagcccagaaggagtctagagtagttaattttgagcttgcaaaggcttttaactagtcaagataatttttagaactaactatgatatgaaccctaaaattcctgttccctggaaggtagagacaaggagaaagtactgccacatggttacaaggtcaagctcccaaggacataaaacaggatggcgaccttgtccagttttttgttggtttcagggacctgcagcaaagtttgtcactgaccagcttgctgggccatcttgagcagcaagcttatgggggcccaagcccatgttttatcctaaggtacccctcgacacagaaaaacgactttatagcacaaaatataccagattgactacagcttaagactagacagcctcagaattcctttttgcattaattaaaattttacagaggagataaacagtgattttacaatcagtttgcacagagagagagaagcctgaaatctgactgggaagagatatttacccttttgctggcatgccaggcttctgggctccctttccctgagtggccctggtgatctggctctctgcaccattgccccgggagccaagccacaacacaaaagaatttttttttaaaatgcacttcagtgtgttgttgttcatttggaatgttccactgtaagttatctttcgtaagatgtcaccatttctgtaagaatttgctgcctcccgggcgtaatgtgtaacccagaaggaactcagttttccagaagcaattaataggttccatggaatgttgatggtaagaaaggaaggaaaaggtgacaagagtgagcgtagacagctctttctaaggagtttggctgctggaaggggaagagaagcagctggggttaggtgggaggaactaagtttagagacgctaaaagtgtatgtagcaggagtcacctgatcaggttgaactgcagcaggaacaaggaagttccattttgactactattagttgcaaattggacccttatgtcaactttttcatctgtaaaaaaaaagggatggccaggcacggtggctcacgcctgtaatcccagcagtttgagaggccgaggcgggcggattgcctgagttcaggagttcacaaccagcctggccaacaaggtgaagccccgtctctactaaaatacaaagaattagccacgcgtggcagcgggcgcctgtagtcccagaatctctggaacccgggaggcggaggttgcagtgagtcgagatcacaccactgcactccagcctgggcgacagaccgaaactccgtctcaaaaaaaaaaaaaggggggcaggggatgaaaatgctattgctttccaggaatagctatgactacttccaataaagaagacaagaaggttccacatgtgaaaactacgcggtcacaacgataagtgggcgggtgcacgcacgcgcgctgagatcgtgcgtgcacaggccggggtgcggccggcgtgagtacgcctgcgcgtgccgccatttcctgcagccgcagactctgcctgcggtgctcgccgggaaatgagacgatcaacaaagaaaatggttgttttgggcgagatcgaccgtggagaggctttttctgcagcagtcccggttcctgccgccagatggcgctcgaggatcacaaatgggtctagggttctcataatggccccgcctaagaaattttggattctcctggcccttcccccctttgtggggtcaacagcggatttgggaatctggtgaccaacacgtgcgcactcccctacccttgcccctaccgagccctccagggtagcttgggggagaagctcctccctagactgccgggtatttgatgagcctggccagcgcacaggtcttgagcaccatggtcagggaagaaggctgaatggcttaggtcttcctagagaggccggaggcgggaaagaactggagaaaggagagatggcagtgggaggatggggacaagaataccagtgtgtttccagccagaagacgatgtcttttaacacctcattgaagtcgtcaggtgactttgcccttgtcagaaaggagcagcactgcgggggtcctactgaggaggagactgactgctccttggggtggggattgtgcctccttcctgtctgccccactcttggggagatgagtccctccaagtccacgagacatgacagccagcctacctgccatgggagaacaaagtctagtctcagggcactcacttcataagggtcttattcttcctcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcaggtacgagccaaactgcactgggaccttacctgctagagccagtgtttttgtccagggcagcaacccaggacaaacccccacacactaggcatgcctgtttatcctctgcaggtgagtgtggttaggagccagagggaaggagagaaaccagcatctcaggggtagatattcatgggtttcagcttggagccatagcatcaaatctgttagactaagtctggcacagaaaggatgcacagagaaccaggttgtctggcagccagttcgaacctggaaacctgggtcaggggagggatataggttgctttttctgttaatggagatggaaactctctgagcaaggtgtgccatggtgtggatgtgattcactgccagaaataacaactgtaccagttggatgagctcttccactgccatcagcactgggatggccatggatttggacagtaatgtagctccacagtgctgactcagggttgctcattgattgcaagaagttggcagcagtagcctgaggaaacaggggctctgaattttctgagagagaccaagaaccaaggaacagccaggtactagggaacagacaacaccagatgcttgtgcttttctgtgagcagctcaggtctcccaaagtggtagtttcctggcttctggcctttgtagatcagtgtggatccacacccaattgtgatgtttgtggtagctgtaagaactttcccaattttgaaatcctaggtgacttgtagcatattttttcacatttgaaaataattgagttttgaaaatgtttttacaggcaatctagtatcagattttatatcatcctgaaacattctgtcaattgtcatttccaaaaatccatggaaaactggagttgttgaactggaaacagtgtggtctcaggaagtgcttcacagccattgcaacatgggcagggcctagagggcaggagagaatgccatgatttgatgacattttacccattcctgccaggtgaacttcatctccctctctgtgacagaattttctggctctcacatccagctttggtcactgggaacccacctattggctcttgcactggcaggacatgtggtagaggcttccagttcgaggcaggactggctgcattttcaagatgtccttatttctggtattttgtggcgatcgtcctgtccacttaactgattttgacccattgccttgctgtgatctctgtgctctctctgtctcccagttccaggtcattcccttgaccagcttccagtctttcctcatcttgtccctgccaatgaagtattctggctctgccttcactctcctgccatgatccattgctttgatagggtggcttcaggaacagggtgaggagagggctgtgctagctttatcttgccaaggaactcagcaaagaaaatttttgctgacctcttgcattcctcagcctggctctggtctctcaaacctaacacatgggatgcatgccagcagccagcctcagtttccctctggtccttttctgtgtgaggccagaggtccttgctttatcactgcctggagctgcagttgatgatggtgaaagaaggtgcacgtgtcttttgagagctccctttgttccccagagatttttttttcccaaagtggccatgagtttgggaataaccaggagccatgggccgccggctagagatgctgcatactaagagcctcctgtgagcagccatgtacacagtgaacacgatggctaaggccccatccagccgccctcaaagagcacatagtccactaaggaataagcatgatcgtaataaccattagcacctgctgtgtgctgagaatgtgcaggcactgttctgcatgccttatgtggactcactcatttaattctcacaccaactcaaggaggtgcttttattatggagaaactgaggcagatggaggttaagtaatttgctggcagttttgcagccaggaagtggcctaaccgagattagaatccagacagagatcagagcctgtactgttcatcgctgtggcatccatactgcccctccatttgtgataagcccaggaaggaaagaaaccaggtgctctgatggagaggggttagagcaaggatggttagggaaagcttttctatcgaggaggagacagttcggctgagacctgaaacatctggaggagcctgccttccaaagaacctggggagaggcattgtggacaaagaagatagggaggagggcctgaacaatgagccctgtgcttggagggtacggggtgaggtgagcagggggcaggagctgggccctgtagggtcttgtaggtgagggagaggaggctattgggagggctcctattgctcacattgcagtcctggggggatgcccagggcattttttcttttttttaagaggcggtgtttcactgtgttacccaggttgtttttgaattcctggcctcaagtgatcttcctgcctcagcttcccaagtagctccagggaatttctgttttaccttgcctcttcagttgcgccgtccccttcagtattctgctgacatggatcacaggataccagacacctggtagttgttcagtcagtaggaggtcttccttccttcctcttagaatcaatccttttctcacttgttggctctgcattttatcccccgtgtatcttttcagatttttgtggggcctcctctcccatccagtccaccttctccagtctctatggtatatttctttgtcatagggtgaagcaggaacaggtacaggatgattgggtacactgaggtgaggtaggagggcaggccctcaggaagggcttcccagaggaggtgatattgtctgcaaaggcatatgagagcctggaagtccaggggaactgcaggctggtctgtacggcttgagtggcacgtgatacagtttgagactatgaggcgagagagctaggcagatgctagaccatgattgttcttccctttccccactcttcaactagttgtaatcttaggcattggattctctggcaaggggacaatacccagtagcctgggccagatggaggcagccatatctggagtatgatctgagccacagcatgttggagaaaagccagaatcagcccagggcagtgtgcacccatagtgctggcctcaggcctttggagggtgagcagacttaagttggaaggtgcaaacaagtggtcagtggtgctgcccaacatcgtgccctgaactgcagttgacagctacggcagctttggtaatgaggctcatagcctgggggcaggcagagtgagagccgatattggcttggccagagaaaagcccttttgggctgccgaggaggttggattccaggccaagggccatatctggcagctgaagtgtggaggttcagaaaaacttcgacaccggtcagtttcccgcctctgctgggaatgaggtgcatctgactttcctcctcaatgatgcctaatttcatttggtcctctgccccttggccttgtgttctctagagagttccctgcagggtggcagaaggagctgatcctagtaagggaccgtcccatccagtgaggaggtgagctgggctgtgtcttccccttctgcaccctcctgactgtcacatccccgggagccccatgattccactctaactgagtgaatcacagaggccaaggcccttggctgcagtcaggagtactgagtggacactggaagattggggtcttgctactgactcacgatgtgacctgggacatgtctcaactcacctagcctgggtttgcttatctgtaaagtgagaagttccatttgttggtcttggaggaagcttcaagagcagtgctcaagggttaggctcagaaaagcctgtttgaccctggaaggtgtcagctcccaggttgacgtgcccacccctccctttatttctttcagggtgaggagcccctcgagctgcatggtcactgttactgtcactgccacatctgagcagcctcacatttatattccagcccccgcaagtgaattggactccagctctaccacgtaagaagggctatctagcaacctgggagatgttcctccgccacttcctccttggcggtaaaggacttggcttttgttccatgttgcttcccatttagtgccttccccagtttctagcaggccattagccaaggggccacacaggacagtgttagtcccctaatataaactcccatctaccgggcctagacattcccacacctcctttttcctatctctgtaagaggctgcagtggtacttcctagtgcactagtggatgtggctctgccattcatgggtccatgcctgggaagccagctccagtccgtgaaggccgggcctgtgagggcattcctgtgttactgtaaaggaatacctgaggctgggacatttataaaggaaagaggtttaattggctcacagtttggcaggctgcacaagcatggcaccagcagctgcttggcttctggcaaaggcctcgggaagcttataatcatggtggaagccgaagtgggagcaggaccatcacatggcacgagcaggaacaagagtgaggaaggggagggcccggactttgaaacaaccagatcttgtgtgaactaactgaatgagaactcacttttcactaaggggatggtgctagctgttcatgagggatccccccatgatcccgtcacctccctccaagccccacctccaacactgggaatcacatttcaacatgaggtttgtctgtctctgtcacatgcccactgcttcacctgcattcctggccacctgtcagggtgcaggaagggatgtcactgcaggaaggctgctcagtgaggtgtgtgtgttgggggcgggaggggggcatatccaagggggcctctgcagacatcaggtcagcaggctggagtgtgcagcatggaaatgggggaaaatttggggccatcctgagcccagcatgatgcagaccttgtttccagtcctgcagaggccagtccaggatgaggcaacctctaggcctctggactctaggagtgagaatggagaggttagatgtgaggtggagattgcacagtagctgagtaccttctgggaagtgctgagtggtaaagactgacagtgtaggattaaggcttggaggatatcttggttgtgggtagaggggaaagacgacgcagccctaaagtaggggtggaaagcccacaggactgaagtgtagaagtatagaagcctggggagaagatggggtcaccgaggtctgcatggaggaggacagcacattgtcattggttgcaggaagcccctttctggggccctcagtccaaacacaacaagagacgctcatggcctgggattgtagtctgagtccacagcagtgccagtgcctttatcctgggccttcccatgagctctttcacttccttcaaaccaggctgggtctccccagccctgaaccactcctgtgggccaggcctggttccctggaatcttctggtgtacctctgatttcttctgtgctccttctacagcaaagggattctcttcgtgaaggagtacgtgaatgctagtgaagtgtcttctgggaagccagtatctgcacgctatagcaagtaagagcgggtcccaaacccttccatgtcggccttctcctgccggctcccatattctcatccctgcatttccagttccttgtccaggacttggctcagagtagcttcggggtaattgtcgagtggatgagtgatgtagttgccctctgatgggattgatgcattttctactgaactgggcacctttgggttctcccttccggtgaattcatcctgcacaccattttcactgccattctgttctgcttgtctttgttattttattttgtaaaatgctgagaacacccctcttgacagagctggcagagccctagggaccaactagctcatcctatttcttttcagatcacagagctcttctcttctgccctcatgttcttttctgtcatgccaggctgcctcatttgaacacacatgtgactgcagttcctgatacatgtgtggctttgctttttaattttaattaattagttaattaattttaattaatttttttttgagatggagtcttgctctgttgcccaggctggagtgcagtggcgccatctcagctcaccacaacctctgcctcctgggttcaggcaattctcctgccttagcctccctagtagctgggattacaggcgcccaccaccatgcccagctagtttttgtattttagtagagatgaagtttcaccatgttggccaggctggtctcgaattcctgacctcaagcaatccacctgcctcggcctccccttttcattgatcatctcttcattttcttgctttgtgatgccatgtggaggggtacttccatgtcacctcggtgtattgctacctaccacactgaggtgaggtcccttagaatgtttcttatgacatgtcatctcactggaggattttagcaacagagaggagcatcctggccttatttcaggattgggcctctggggcttctggactggcttttattggtgctgtggaatgatgagcatggctgtgggggtcaagttcaagccccagctcaggcccccctgttaggatcacttcggacaagatgttcaacctctctgagctttgctttcacatctgtaggcccttagggtggtttttctcaacagcttattgagttataattcaccctttaaagtgtacagtcccgaggttttggtacattcacagagttatgcaaacatcattatccaattctggaacacctttgtctccccaaaaagaaactccaaacccgtctgcaccccctaattctaccccataactcaagcacaggtattataccagaatgatcccttctttcttctcattcccagtatctgatttctgctgagtgggctcctggtgactgtcacattatatcataggtggggaggaaagctctgctgttttcccactggtcagtggggtccccttggcatatacaacctcaggaatcctagccacccagccccgatcatctccctcattgtgaaaggtctcctttgcccccccatagaagggccctgtggcaccaagtcatgaatgacgactggcatcgtagttatgtctcagcttgtggccaaaggttaattagaaaattaactatgatagtgatttggctctcatctctgccctcctctcccctatcaaactccctgcagcgtcagcagcattgaggactcattcgccatggagaagaagcctccatgtggcagcactccatactctgagaggtatgttgactttcttagcacggagcttgcacttctacagaggagaatcagggaagggagagttcctgctgagtctgtttgcttttgtcttctgctttgcagcctccaatccatttgcagaaaggtgaaggacactaccgtagggtggtgcttcccttgttgggatatcacacttgtgacaactaaagcctttgaattgagctaagactagagggtagataccagcggtgactgagaagggaagtggtggcatctgacaacccagaggactcgtgtcagcaggaggggcccttcagattagaacctaatcaatcacttcattaacttgcaaatctaaccagaagtaaaaataaaatgactacaaaagagaggagtgggcagagaaggaagaaaaatgggctgctggcatcaagaagccagaaagacacacaaagccaagaatgcccagtgctgtggagccaccaaattgaaagcaggggcagagaacacctcgttcagcagttttgaaagctgtcactagatgatggcacagtcactagagagtcttaatgacaaagaaatcttatgttcagattcttggaatggggagaagagagtctcagagattgagttcactcaggcttctgtgaagaaaatggaataaatagccttcagtccacagtaagcaaatacggcagacccaggactaaaccccagggccctgactactcccaggttagggatgtttctactctgccatcttgcttctcattgatgggcagatcttaattcatgtggatgacattcagagaccaaagctacattggggaggaaaaggaaggaagtaagagggttaagataaagagaatcctaccgggccccagaggcaaacatataggagcagacaagcatatggggccagggaatctcctccactatagctgaagaagcaggtggttctgagtaactacagattacttggtgaggcacatcagcagatgaagtcttagcagagaagggcaggttggtcagaaacctgagagttaaccacttacataggagcaaatggaatgaggcttccaattctagtggagtgacaaaccagatactctagggacccccctttccattgcacaactactaaatccagaatcagtcattactgatccattgctaggcttggaggaaggaaggggactctctagggacaatctcagtcacttgcacacatgcatatgcacagacacacatgcacgcacacaaagaacagctgtgagctggtgctgctggtggtgaaagaagcaggaggagcagggctgcgctgagggcaaggatttcaagcagcactgctgtccagagtgaaccctgggccagcagcaggatggtgggccacacccaagctgcccgtgacacttctgggtcctccgacagagctaacgtggatctagattgttaatgtccccccgccccttgggcttctgtcagaagcagacccaaatctctggaagaaagtaccctgaattttggcttgtaggatcagatcaagcagttactttgaggaagtgcagtctgaggaagaaaagcagaggtgactctcagaaacaggcatcctggaactggaaagatgctcaacccaggagtcagtatctagaacttcagtgtcggatctgagtaggctctacagacagagcatgaagggtgggtccaggagtataggcaggggcagagctcagttggcccaggcgtgaggagaagggccatcaagacggggccaggcagggcacacaatgacatgtctcctgtaggagaaggcattggtcttcctgctctagagggtagcaggccccagcggataatctaagcagaaggtcagggggaggcaaactgtctggaataagtatcatatcaggacatctacaggagacatgtcattgtgagctggaaaaagatgcatgactagtttttggaaataatgcagaggtctacagcaggctgagaactgatctggcccagggctgtgctgcacaccacagaaaacagtggcatcctggggatcctgacagcaaacctgggcctggctgcaccaaattggaaggtctggctgtgtcacatcagaggtctgtacaccagcctgaccaccgggttattgttcttcatctcacaggacaactggagggatctgtacttactgcaaccgtgagatccgagactgtccaaagattaccctagaacatcttggtatctgctgccatgaatattgctttaaggtaaaaaagaggtggaagacaccttgagctaggcggtaactcctgatcacgtgctgctaagaacgttttgtagagtgcgggagtcttacgggttcagagactgtggaggaggcttgatctccatatacaattgcacatagtcgcagaggctttgcacaactgggagctgaatgagcttccaagtctaagacagtagatgagtgttggtggttctgcatgcttagtactgtagggaagacaaaagaggtcttttcaggaaagactatttctggcagagggccagcaagtgcaaaagccctggggcagaagcactagagtgttctagcttgcgtgggagaatgccaggagtgacagagtgggctagatcatgtaggccttggcgggcacagagtttggattttattctaagtgacattggggtccccattctccacagtgtgtggcactttgtaaccccaggttgttggttccaatccatttagggtgtcacctctgggtgcactgagaaaaacaaccctcccctttgccttgacagaatgttaggcaggcttctgtcctccccacagggcctgaactttgcttgctcctggttaagtaagtgctgcaatgcagaacatgccccacttagcagcttctcctgagaaccggctgaccacagggaaacacatttctggtcaaatcatgccaaacaggttcccctttgcttgcccactggcccttgaaagtagctgagctgctagctgtgcttactactccctactgaaaaaaaaggcttttttttgtattattttgtgatgttttttgtattattttgtgatgtttgcaagtcctgaggtccaggatgtgccacgggctcacagcatctgctcgcccaccttgttcaggcatccccttcccactccactcattcctcttgctttgctttgtgtgttgacctccagcttgcttttcttttcagtgtgggatttgcagtaaaccgatgggcgatctcctggatcagatcttcattcaccgtgacaccattcactgtgggaaatgctatgagaagctcttctaggtgggtgctggcactgcaaaggacaagtggccaagagactcattaaggagtagagatgcaccctggtctctcctggagtctcagccccagacacagctatctttcttggctcttccttatgttcagggggccttgtgtcctcatgtccctatgccttgtgatactttgagatcttaggtggcatggacaaaggccctcaatgaggacacttccaaatcacaccttccgtccagcacctgagccgagccctctagctaccctgggatactcgctcggccgctgttgttagccccattttgcaacaaggaaataaagatatagaaagggaggggacctggagaaacccaggtagaatcaggacctcaccccaggtctttggattcttgtccagggctctctgttcactgtcactcgcatagcttcagatcaggactgcatagccatggtgctcagtgaaacaagcctctgggccacattatgagaactgcctgaagatgtgtgtttgcatgctcatagccagtggaatttatcacggtgtctgagcacagagcagaatatatcccttgaaggcagtagcaaccaggctttccactagctccatgctgatggtcttctctccagaagacacaccttgagctaggtggtaactcctgatgactggagcagtcacccaccctgagggcctctagctgatgtgtttccagtctcatggctacttctgttttcttttagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcacatgtgtc

SEQ ID NO: 3977 - DNA, 59038 bp, human; identical to SEQ ID NO: 3976

SEQ ID NO: 3978 - DNA, 17814 bp, human
ctgaggaggacagctccccgggagcactcctacgtcctgtcagcggccaagaagagcactgggtgagttgccaccaactggctccaggctctaggacagctctcctctcctcagagctccagccttctctggctgatgaaagggtgggtggagagatcacccccaagggccttcctagctgagccttctcagattctcagatgtactttctagaaaatggagaggtctggcggctaccaccagggacagtgaagtgccgggaatggagagggcccaggaccctctgaggtagagcggtcttgatgtcacctgcccacgggctctgcccaaagcattgcctttctgcttcctttccagcagtcctacccaggagacacaggcaccgtttatcgcgaagaggtaagtgtcatcaagggacaccttggaggcctgttactggccacaggaaggccttccgtcagcaggggtgtagtgtgggagctgtggagaggggatgtggatgtgggggactactgtccctgagcagggggagttgtgaggggctgggggcttctgtctggaggcctggcaagcacctgggtggctgtggtagcatatgtggtcaagctcttccatttgccaatggctaatggggctgggcccctgacccaacgtggagcatttccaaggccctctgggagttgttcccctgcccctgttgcttgcctgatgccttgccttctgctctcatccaggatcaaaacctgggccatcaggagaacttcccctgggaggtgactgtgacattggagatgggccctaaagggtgaacagggcttaacagggaatgatcagaacgtcgggatactccagctgaatgagggaggggtgtcaccattagttgagacagggcaccttctggaggaggaaaatattcgggggaaagcaagaaagaaacttctggaaacttgaatttgagggacttccagttgagtggacagggaaggcctctctctgtgctgaggtggctagctggggactgcaaacccaagagaagacagcatgccaactgccccaggcagagggccccagtgcacaggcccggggtgggactagcttgctgtgttggaagaccaggaagttggcaggaatacagagagcagggatggtggcagcacaaaggaagtgacagagaacggggggcggtgggggggtcttcctggctgcatttggttcctgtggtttctgtaacgcagtaccaaaaactgagtggcttaaaacatcagaaagggattctctcccggttctggagaccagaagtctagatcaaggtgttagcagggtgggttccttctggaggctttgagggagaaaccatcccaggccactctcctggcttctgctggtggttggtgatccttggtgttcctcggcttgtacctgcatcactccagtctgtgcgtctgtcttcacatggccttctcttctctgtgtgtctgtgtccagatttccctcttcttacaaggacagcggtcattggatttaggacccatcctactccagtatgacctcatcttacctgattacatctgcaaagaccctatttccaaataaggttacagtcacaggttccaggggacatgaattttggggggacactattcaacccagtatgctgtccttatcctgagctggagtcactgaacccccagcctgggccacctcttggccgtgatcctgaagggttgggtcagttagacgccactggaagcatgttctttgaggcctccaagctctagggcagccaagaagaccacgagcgctgtttctcttcttgctcaaagggtggaggtggtggaagaggacgggccttctgagaagagccaggacccacctgctctggcaagatccactcctggctcaaacaggtaatccattgcgctcatctctgcctggggctggtggctgccatacctgccactcagtcactgaggaacctcagtcagggcacctccatgctgggcttcgagatcagtgtccccatgtgcccagtgacaagacgggacaaagaaatcagtaagagcccatctggctggatgtcccagggctgaaaggagcaaaacagtccagccccccgggagagagcacctggctctggtctgatgagtacgtatctgtgtcaccttaacccttgcaccactgagcctggtggcaacttgaacaccccaagaaaaagtaccatccttggggtttgagagggccagccaccatggcagtagcatgccattgtcagacttgctccttgcactccaataagttagccacattcagcatgcccagggaggaggctctgacatctccagagcctctcacagccaccttctttgccagtgcggatggaggcaggaccaaagcgtctcgggcaatttggatcgagtgcctgccaagtatgcctagccccgctgggagccaggagctcaggtgggtgccgagagctgactctggcttgtgagtgggtgtgatggcttcccgccagcctggctggctggttctgccagctggggagggtctggcagtggggtgatggggcaaggacaggctgagcactggtgatctcactccaggaagggccgtgatttgtcttgatttctgatccctgagaatctgggcagataatggtgctctcttgtctgtggacaactaataccttcttgtactttgtgcagaatggtgctaagtcctgcagggagagccaccacctgctgttgctgctgtttaaagtgcctgcctggattgagacctttgctcaaatctaggtctcctaagagctgcatctctgtagcacccttggaagacccctgcatccagaaggggagagggcctgtccctaccggtcacttcccaggcccccaagggctgttcaggctctcctaataccatagcaatcccccaatttgagctccacagccatttatagacaggtgaccactgtcctcagggttacttcctcagtctgggagggagacagaaatgctggcagagggagccaggagcatgaggccagctccctccatggccccaggcagcagactgccagggtgcttctccttttcactctctccctctcttgatcttctctggttgtctgactctccccataagaactttggtccatagaagatgtggaaaggaagatttgagaattctttacaaggcaatatctagggcagagctccccagtctttttggcaccagggattggtttcgtgaaagacactttttccacgggacggagcaggggatggtttcaggatgaaactgttccaccttagatcatcaagcaccggattctcataaggagcgcacaatctagatctctcacatgtgcagttcacaatacggttcgcgctctcatgagaatctgctgatctgacaggaggcggagctaaggcagtaatgatctctagcttacctcctactgtgcagcctgattcccagcagaccacagactggtactgatcctcaggctggggttggggacccctgatctaggggacttggcaattgagggatatgggggcaaaggctgccacaacaaagtattgtaccacaccctggggcgcttaaaccacagaaacgtatcatctcccacttctggaggctagaagtgtgagatcaaggtgacggcaaggttggttcctcttgagtctctctccttggctggtagactccatcttctccctgggcccttatatgctcatccctgtctgtgtgtgcctgcgtcctaatcacttctgtttttttgagacagagtctcactccgtcgcccaggctggagtgcagtggcacagtcaccactcactgcagcctcgaccttccaggctcaagagagcctccagccttagcctcctgagtagctggggctacagtcacaggccaccatacccagctagttttttttttttaaatttttgtagagacagggtttcaccatgttgcccaggctggtctggaactctaggactcaaatgatcctcctgccttagcctcccaaagtgctgggattgcaggcatgagccaccgcgcccagaccctaatcacttcttataaggacattggtccaactggattagggcccaccctaacaactgtattttaacttagtcacttctttaaaggccccatctccaaatgcagtaacattctgaggtcatgggggagttaagacctcaacatatgaattttgggtggcacaagtcagcccataacagtatacagttctcatttctccttatttctcttttaaagaaaggcaataaatggtttcaggtgcctttctgtttgttcgtttgtttgttttgtttgtttttgagatggagtctcgctctgtcgcccaggctctgtcgagtacagtggtgtgatctcggctcaccgcagcctccgcctcccgggttcaagcgattcttctgcctcagcctcccgagtagctgggattacaggtgcacgcgaccacgcccggctaatttttgtatttttagtagagacgggtttcaccatattggccaggctggtctcaaactgctgaccttgtgatctgcccacctcaggctcccaaagtgctgggattacaggcgtgagccaccgcgcttggcctcaggtgccttttagaagataatataggaggctgggcatggtggctcatgcccgtaatcccagcactttgggaggccaaggcaggaggatggcttgaagccaggagtttgagaccaacctaggtaacatagcaagaccccatctctacaaaaaaataaaaaataaaaattaaaaattagttgggagcattgatgtacacctgtagtcccagctacttgggaggctgaggtgggaggactgcctgagcccaggagtttgaggctgcaatgagctgtgaccgcacccttacactctagcctgggtgacagagcaagaccctgtctctaaaacaagaaaaaaaagagagaaagaatggaggagaattagattgtgctgtattatagatttaaaaggcactttgacatttattccacaaaattcctttcgatgtttaatccccatcatatggttgtcattgcaaggtggctttttaagtttgctcaggttgccataacaaataaaggctagagattcagggtccggggcaagctcccaacaggaggctcagcttgatgcttctgatagttctttcctccaattctggtcactcaatatttggagctcacccaggcagcttccaggaaagctgctggctgatcctgaccctggagggccgtcttctctgaccctaccacgttaggtgctgcactggaccaagcagccaccatcagtactcccaggcccagctcctatctgcctggtgtctgagaagcccagcccgtgaggaacaatgactcaatcaaactcagggtcctgcagcacttcagaaaaggctggtttgtggcagagtggaagaggagaatgtcacagccttgtccccaggcacagacctatcgaggctaccctctccccaccccctgccctgccctgtttcccttagctacagtgcaaaggtcagctcctcataactcttgccccccttgcaacctgaacccagtttagggaccctctcttggagaaactggttctacacatgcaccccttctcggcccccaggcctggctgctttacccgaagcactggtcaagcttgcctcacctgaccagggcatggcctcctgggtcccggtcctaggctctgcccagcatgctgcctggcagagcgtctggggagcagggagtaggagcacagcttctggcacaggacaaaaccctggctttgcatcagactgactgtgtgaccttgagcaagtctcttcatctctccatgcatcagtttccccgtggataaaatagggagagcagtaatagctacttcccaaggctgtcccaaatgctaaatgagatcgtgcacctgaagtacttaccacagtgcctgggtgctggtatcctcgggggctcccagtcataggcgtgctgagctgcagggcccttattcaaatacaggaagagatcaatatctccacctgctggcatttgagggaaatgtggccaaaggcagtgaaaaggaggtatcccctcgccccacatccccgcctcctcgctctttggcagaatgagtcacacactgtttggcacaggccacagttggtcgcattcccacaggtggctgtgatcagttttgggcttcaggcttcagcagatgcctgcctctcttccttgggtgccttccaagggtgtgcagccttccagcgtggtcctggacttcagcttggactggagctgtctgtggttgagagtctggggagatggtagggtagcgggttgtgggggaggagagacccttgtattagtttactggagctgctgtaacaaggtaccagaaactgagtggcttaaaaccacacgcatttatcctctcacaattctggaggctggaagtctgagatcaaggtgtcggaagggccatgctccctccaaaggctctgggggaaaatctgttccatacctttctcttaccttttgttgcctgcaatccttggtgtttcctggcttgcgcccgcctcactcccatctcggcctctgtcttcgcgcagccgtcttccctctgtgtctgcccacattgccctagtctgacatcagtcactggagcaggctggggtgacactttgttcccatttcctctgtgacagagccagaaacgccagtgagaaaatatgttgtgcttgcctgtgacatccctgttccctggcaccacctgatttaaatgaggcagccaggggttttatactgtcatcataaatgacatcatcctcaacaacgatgtcatcgtcgttatcacgagaggagatggggagaagtcagagctgtctgtgtgtctagggcccctcctggctttcatgatgggagaggccttgtccttggtagcccttccatttccctctggtcactttgagcactccaggccctggccagggtggaagtggagggacagagatgagcagcccgctgacccagccctccatggctcattccttgctttcaccttggccactccatcccctacccctcctgggacccctgagtggcctctttaaagtgccagtctgaacctataaaccccccacctccacttcaagcccatcctgcatcttccctttgccataccagatctagtctgtacattcaggacccctgccagcctctacctcctcctcctcccccgatctcccttcagctggcctgggtcgggctatgcctccatgaagcttgtccactgctcccatggctaaacctgttctgggccctgcagcacagcaaggtcagtttccatgcctctctgcccctgcctgaccctgctgggcccagagcttcaccagggcaggcctggggctcaggcttgtctgcacttccagggcccagggacaaaggcaggagtgactgcaatgtggcttggaattaggctttgctccatggacctaaggaggtctggtttggggtgaagggtccacccccagaaagcctgggagctctatattctctctggccctggccacaccatggccaagcctgctgggcgtcatgccttgcagtacggccagagaatgcatcagacttggagggatgtgtgtccggggtggcctgtggtcatctgggggagggctctgagcgtggctggcaagaggaaagctcaaaggggccctttgtcctcatccccgagtctgcgacatcccctcccactggttttcattccatatttggtctgtgggttttctcagtctctcgtacccctcagtccccaccagtccatgaatgcagaactacccctggcctcacaaatggccactttggataccctggtggggtcacaggctgcggttgcccctgcaaatggttggtagaagcacgggttgggaggtttcatttctacccagaagggcccttgctgtgcctgagggagggctgggctcaggtcaggggtgggagaccggggaaggggcctacaggtcagtggcccgagctcagctgcagcaccaacaaggctcaaggccaaggaggagatgagagcacatcaaaagggggcagtgggtctgggcggcccaccgcactcaccagcccaagaagggggagacttttctcacctgcaacccactgggtctctcctttggcccgcagctcaagaggtgaggaaattgtccgcctgcagatcctgacacccagggcaggactccgcctggtggccccagacgtggaaggcatgaggtatgggggtcctgctgctgtcctggctccctggacaccattctagagatggaagcagcagcctcaggtggcaaatgatgaggcctagggccggctctgccactgtagggccaacaggttgatgggaggcatggtcgacctgggttttctgccccatctcattctttcactcagaaaaccattatggagcaagcgcttagtctgtgtaagggcacaggcccgaccctgggacacagtagtgaacaggaccccctggctggaattgccatctgcctggtgggggaggcagacgccgacatgagcatgaatgaggtcagccagagatgctgtgtgccaggagcccctgggaagtgacagctcaaccctgccaattgctgaagatgggaccagtcagccgtgctggggatgttggtgggggtgggaggaggattgggtctaaggagcccgtgaaggccactgaggccattgccctgcctgtgtgagagggccactgggaatagagtggggtcactgggtcagagtccacagctctccatgccactaggctctgtgctggggaggggtgggtcaaggaggccacaaccagcagggagcacgaggggctcagcctctgccctggggtgggggtcagacagccaggtgacatgcaggcaggattcgggggctggggtggaggctaggagagatccgagcagggagactgggcccctaccttgtgaaggccagggactggggagagaagcgggagtgtacactgaaggtcatcccttaatccctggggtggcaggaacttcgagcagaggcctctcaacagtgtggtgggtgggagtgcttggggagggcttcctggaggaattgacatccaagatgagtcctgagcgatctctaggtccctttaccctcctccttggctcctcccactttaattctgcccccaaggcaccaagtcctgtccactttattttagagatgtttccatccctattgctctgcccctggcccaggcctccactgctactcacccagttgtctgcgaccgtttcctactgtcccatccctggactcccttccacatctacctgggtgatgtttccaaagggcagaagtagttatgccagccccctgcagaaagccctgcaaagcccctcccactatgctctgcagcctgaactcagtacctggccccacctgcaggctcctccctccctgggcctttctctgtgcaggctggaggctctgcctgagatgccctttcccctcttcatctttctgttccacctcaaatgtcctgtcttctgggtcatgtccttctcctgagtttcttccccaggcagcatctgagggcttgtcgattctgcatggcagcatccattctgcatggatgtagatacaatcactatgcccattttacagattaagaaactgagaccctgaatggttaagtaacttgctcaaggtcacatggtccagagcaggcagatccgctcagcctgccctactcccaccttccaccttctgcaccatagctcattgtactagttggggcagggagcagggggacagagaggggtgatggaaagacttggcatttgctgagtgaactcatttgacgagtttattcgtaggcattgaagtcaaaatttccaggagggaggtattttaaggtttgtgattgaggtttgagagagtgattagggctcaagagatttccacgttatatgcagacagaatagagctgaaatcatgagcgtaaactagctttacatggggctcatggtgagccaatggaagctgggcaccgacctcagtatgcaggtggcagccacctggccagccctcctggggacagctgggcgagggcagtctcttctcgccatgttgagagtgggcctcctgagggccagttgggagttagtgggtgtgcaggccagtataaaggagaggcaggaacaagtggagatccctgcttcaagggtggcagttgacaccttgggaggggaggagacagcccagcaagtggtggagcacgccaaagggaggagaaaaaggcggagaccaggaaggtgtgtggccagggaggtaggcaggtggtgttgacaggatcaagggaggaggggtggtgagaaggctggagtggcccactgggtcagcagtactgaatggtggtttgaaataatgatgggactgtctctcctggatttgacaacatggggctccctgaggacctgaaggagaacagaagggggcttaaattaggagattaggatcagggatatagtccagaactcaaatcccagctactcctcttattacctgtgaaatttggggcaaatcacaggggctttgtgtgcctccgtttgctcatctgaaagatgggcatgggtgataacagtgcccatatcctggggttgatttgcagagttaatgcatataaagtcacgagaacaggctcaaatgctcaatcaacagtagctattgccaggcacagtggctcacacctgtaatcccagcacagtagctataaaacaacaacaacaaaaaacaaaaaacagtagctattagtaatgaagttttgataattggccaatctgtcaatcagcagggtttgtttgtttttggttctgttttttaagacagcatcttgctgtgtgtgcccaggctcaagtgcagtggtgccatcacagctcgctgcagcctcaaccttccaggttcaacctcccaagtagctgggaccacaggcacacaccaccactcctgactaactttcaaaaatatttttgtggagatggagtctagctgtgtttctcaggctggtcttgaactcctggctcaagtgatcctcttgcctcggcctctcaaaatgctgggttataggcgtgagccactgcacccggcccagtagcaggttttaagctccgtggagacagctggcgtttgaggatgaggtaacagcccacacctgagtgtgaatggctgctgcatggttaacttccatttctttcctccataggtcttccccaggcaacaaagacaaggaggccccctgctccagagagctccagagggacttggctggtgaggaggctttcagggcccccaacacagatgctgcaaggtaactcagtgcaggaagcagacacttcattcccagaacacggagcccacatacacccagctgaaggacttccatggcctccggtgcaatgtcaatggatgcagctggggccaggaaggtcctgttcccactgttcccccagtacctggggtactgcaggtctttaatgaacatctgttgaaagaaagaaagaatgaatgaatgaggcctggagggaggtaggcccctgccatgattcctcagggagccagttagagagcaggaccaaactccagggcaggctatccccagctcctggcctgtgctgagttccttccattcccctgaagcttccacactcactgtgcttttactgcaggacaaagcagccctgccaatggccagggcaaagcaaggccaccaagctggcagtctgggagagtcagtgaccaaagtatgtgggcccccatagagcatgtagcggagactttcaggatgacccgtggactaagggagacattgtggcaaggggtgaggggtccaggacgggaagttggagccatagcggtggatgatgagtccagatgggatgattgtccccagtcgctgcacagccagcccactgacctgtcctccaagccagaccagtgccaaatgtgtctggtgagcagtggctgcaggctgggcatttcttcagtgagaacctggtagccagttacagctaagaacccacacacccgtcttctcagtgtggatccctggagcccctagctggaaccctgagccctggaaatgaggaaaggaatccctctatggcttattaccagacccacatgtcttgccccttgctctgttggcaatcagctccccccaccaccaacgaactaacctcctcctgactttccaccttgctcccaaccaacccatcaggtttggaaaaaatacagaaatacttcctgttagagtcaacttgggcttggctcagctctggtcagagcagcacagagtagcagccaaaggcctgtgcttctggtcttgaggcccactctcatggcatctgggttagatgagatcaaaacgcaactagagtcagcaaatactccacttctcataacaggtcaagtgcacagttgagtgatggcaatgtgggatccggagccacgggctcccggcctgaaggcttggctgcagtagacatcggctccgagagaggaaggtgagctgcccgggggaggcaggttctctcatgcccctggtgacagaccagggtcaagctgccaggctgcttgggctgctatgggtggggcactggtcacttcctatggctcctgtctactgcttctcccacactcccacattccaccacatcctgtgtccttgggctttccactttttggaatcttgttcatttttctgatccctgccactggccctcaagctcctccagagtaggcactaggcccactcacagctggaggcccagccctcacatggtgctggtcttgggctggtcaaatgaacgtgtagggaatacatgaagggacaaattaatgagtgaatgactgaatgatggaagagtcggcaccttcttacttcttggttaagctctgaggaccagctaggaggccctttgctcctgctttctcccttctctccttttcctgccccatccctaccccaggcagctctgctctgaggttcagggagaggaaaagcggtagccctggagagaccagcgtgtccagctgggctctggcttcttggacctggagggagtcaggggccactttctcaggtgatttgcagagtggcaaggtccctcttgtccctaagtggttccaaaccaagcctgaatcattcttggggcaaaggctaggtatgcagatgttggcataaatagtttagctccaaactatgctagagtccttctggttcagagcagatggctagggaggagtggcaaagccagtgtctgcaaagagctacaaccgcaagatatcatctgcctcctgcatcctactgcagtctggccaaggagggaatcctgtggggaaggccctgctgatgctttcctacttccctcagcacacccagggcccctttccctcactaacttcaatagtttgcaattcatgccatggaaccagagcccgaattctaaatccaggcccacaagtcaacacaggaaggggacagcaggtcctggcctctgaaaccactgtctccgagcaggtccaaggagaggccaccagagactctgttctttaagctgccactaatggggaggactccgctagagccctgtccatgcagcctgcatctttttgccatctgcagaggcattggagggatctttttaaaaataagctagatcacatttctcccctgctaaaaccttctagtggctctccattttccttagaatgaagtccaaaccctttcccatggcccactgggtcctgcatggcagaatctttggccttctatccagtcggggctcctgctactctccccacagtggtgcagcttgactggctctgctgatggctgtcgcggaagagacttctggtctactgtgattgggtggctctggtctcctccatgtcaccccgcctgcttatacaccctcataacatgaagcctgtgctgtccactgtttccttaaaatgaaaccaagcctcaaagttacttgtaaagtcatctgaagaatcttctagattttcatgaattttaacccagtcttttacagttgtcttacctatatagtagtccctaggtatctgtgggggattggttccagaacctcactcatataccaaaatccatgcatgttgaagtccctgatataaaatggtgtagcatttgcatgtaacctatgcacatcctcctgtaccctttaaagcatctctagattattataatacctcatacaatgtaagtggtatgtaaatagttgttatactgtattgtttagggaatgatgacagaaaaaagcctgtacatggtcagtacagatgcagccatcctattttaattatttttcccacatctcatctcatcctctcctctcctctcctctcctttttcagacaggaccttgctctgtcaccagggctggagtgcagtgctgtgatcacagctcacagcagcctcaacctctggggctcaagggatcctcccacatcagcctcccaagtagctgggactacaggcgtggaccaccacgcctggctaacttttgtatttttggtagagacgaggttttaccaggttgcccaggctggtttggaactcctgggctcaagcagtccaccgacctcagcctcccaaagtgctgggattacaggcatgagccactgtacctggtcccaaatattttcaatctgaagttggttgaatccacagatgtggaacccacaacatagagggctgaccacacttagtttgactataattttcaacaaactcctttattgtttttcctttttttttttttttgagacggactcttgctctgtcccccaggctggagtgcactggtgcgatctcggctcactgcaagctccgcctcctgagttcatgccattgtcctgcctcagcctcccaagtagctgggactacaggcgcccgccaccacgcccggctaattttttgtattttttagtagagacggggtttcaccgtgttagccaggatggtctcgatctcctgaactcgtgatccacccgcctcagcctcccaaagtgctgggattacaggcgtgagccatcgcgtcctgccttgtttttccaaaggaaaggttgtttctcatggcaacaaccactctccttttccattcattttcatggatttacttaatcatcgaacttagtgattcttctccattagtggcagctcaaagaactgagttgctgccccaggggcctttccttggatctgctcagagacattggtttcagaggccagggtctgctgtccccttcttgtgcaaatacaactggcataaagaggtctgggaccaaacaagagcacctcttagtgagtgtgctggttagtggagggcacaggcttgtataggcagtgattgttcagcatgccgtgagcatcagtctgcctggtttacagagacacagagaatgtgactccaccctgagaaggttgggtaagacattccccactaaatccatattgagtgggtgaatacaggtggactgggaaggtgcactgcttctataaacagccactgggccctgtggtaacaggaacacattagcacatgttatggcccaggcattattcaaagtacttggcatctatgaactcatttacttttctcagaatacttacgagacagacatgattagcatccctatttcattgatggtaaaactgaggcccagaaaaaaaggtcaggtaacatgcccaatgtcacacagctgggagatagcaaagccatgatttgcaacgccagagggcaaccactatgccacagagccccaggtgtcaggctgccttgagatataaatattgttcctcaagcatccatttgagcagcttcttggtcctcatcatctgtggggggcaggatccactttctcgggagagggtagacatacagacacaaagtcctgaacctggaccaggtctggccttctttcacaggctgtgtgcagctgctagctttgcctctttcctggaagaccaggatgggcacagtgccaactctcagtcctgcaagcctagaccagcagccatcaggtaaggttagggccactgccctagtgccctatcccattgccagacacagcctttggggcccagcctcagctgcagcaccccaggatccccctcgaacttctcagctccatgccactttcacatcaggtgatcacagcaagacagggaactccagggggagctctgaccaggggcagtggaagaagagggatgggtgatatgtctgctcacccagagagcccagcaccaacctacatggacccaagctgaggtggcagagaggagggcatctgaaggcagagcctgggaagagatcctgctaggaggtctcagagaacctctgctgtagggactacagccaggtttagcaagcaggagtcagggagaagattcccaggggcagccagcattagagggctcagttcccaggagcacaggaccggtggctgggatgggcaaaaatggctcctggggcacaaaggtacaatgggaagaagctgtgcattcccatgctgtaagcgtctgccctgtttcacccaccaatccaccagtgggcatggccactttgctgtgggtgtgtggagcatttggcaagtcctagtaaggaacgatctttcttaactcccataaaccctacagaggtgtaggtcaggtaaggatacgtcatgctcagggtcaggttccagccgcagctgagggctaaggggaatgggtggacgtggggcagggagctggaagaacactcgagagatagcaggtaaatgagacatggctttactcagcagcagctctcttacacagctttctcaaactagctttctcattagcagcttactctcacaccgtctgccctgtcttggctgcttagtccggtggcccctacgcacagctgcgtggccagctctcccttgccttcagggtcagcagcttaattctttctctccctgggcacgggcaagccaagctgtgtcctggctcccctctgtcctggctcccctctgtccacctgcaaagacagacagctcttgctctctctctttctctaggttcccgtgcacccgccatgtcaagctatgttgagctgagccaagccccaagagacatgtcccccatacacagcgtcaacagggcagttataccttttacagacaatagtggtttagagccaagtatgaacttacataaacaggttatataagaagtggaggtgtgcacctgtgcaccagactcattgagtcatgcaggcctggatatccccctctgcctattccttgaacaaagcacatccaggtaccttacaggatactagaacccaaaaccaggagacttccccagggaacccaagttggtcaggggcagtgtttgctcttgaactcaggtgctaaggccatgtccaaagctgacatgaggttgtcacacacagtggcatcggtgccacactaatgccaggactgagacaccagcctttactggaagacacagttcctccctttctggtgagaaggcagcctggagggggaagacctgggccccagccttctttggtctgagatctcagcaggcctgtgtttccttcctcagctccagtgccacttcagtctctgctgtccctgctgataggaagagcaacagcacagcagcccaggaggatgcaaaggcagacccaaaggg

SEQ ID NO: 3979 - DNA, 59038 bp, human; identical to SEQ ID NO: 3976

SEQ ID NO: 3980 - DNA, 28071 bp, human
aggaggctttcagggcccccaacacagatgctgcaaggtaactcagtgcaggaagcagacacttcattcccagaacacggagcccacatacacccagctgaaggacttccatggcctccggtgcaatgtcaatggatgcagctggggccaggaaggtcctgttcccactgttcccccagtacctggggtactgcaggtctttaatgaacatctgttgaaagaaagaaagaatgaatgaatgaggcctggagggaggtaggcccctgccatgattcctcagggagccagttagagagcaggaccaaactccagggcaggctatccccagctcctggcctgtgctgagttccttccattcccctgaagcttccacactcactgtgcttttactgcaggacaaagcagccctgccaatggccagggcaaagcaaggccaccaagctggcagtctgggagagtcagtgaccaaagtatgtgggcccccatagagcatgtagcggagactttcaggatgacccgtggactaagggagacattgtggcaaggggtgaggggtccaggacgggaagttggagccatagcggtggatgatgagtccagatgggatgattgtccccagtcgctgcacagccagcccactgacctgtcctccaagccagaccagtgccaaatgtgtctggtgagcagtggctgcaggctgggcatttcttcagtgagaacctggtagccagttacagctaagaacccacacacccgtcttctcagtgtggatccctggagcccctagctggaaccctgagccctggaaatgaggaaaggaatccctctatggcttattaccagacccacatgtcttgccccttgctctgttggcaatcagctccccccaccaccaacgaactaacctcctcctgactttccaccttgctcccaaccaacccatcaggtttggaaaaaatacagaaatacttcctgttagagtcaacttgggcttggctcagctctggtcagagcagcacagagtagcagccaaaggcctgtgcttctggtcttgaggcccactctcatggcatctgggttagatgagatcaaaacgcaactagagtcagcaaatactccacttctcataacaggtcaagtgcacagttgagtgatggcaatgtgggatccggagccacgggctcccggcctgaaggcttggctgcagtagacatcggctccgagagaggaaggtgagctgcccgggggaggcaggttctctcatgcccctggtgacagaccagggtcaagctgccaggctgcttgggctgctatgggtggggcactggtcacttcctatggctcctgtctactgcttctcccacactcccacattccaccacatcctgtgtccttgggctttccactttttggaatcttgttcatttttctgatccctgccactggccctcaagctcctccagagtaggcactaggcccactcacagctggaggcccagccctcacatggtgctggtcttgggctggtcaaatgaacgtgtagggaatacatgaagggacaaattaatgagtgaatgactgaatgatggaagagtcggcaccttcttacttcttggttaagctctgaggaccagctaggaggccctttgctcctgctttctcccttctctccttttcctgccccatccctaccccaggcagctctgctctgaggttcagggagaggaaaagcggtagccctggagagaccagcgtgtccagctgggctctggcttcttggacctggagggagtcaggggccactttctcaggtgatttgcagagtggcaaggtccctcttgtccctaagtggttccaaaccaagcctgaatcattcttggggcaaaggctaggtatgcagatgttggcataaatagtttagctccaaactatgctagagtccttctggttcagagcagatggctagggaggagtggcaaagccagtgtctgcaaagagctacaaccgcaagatatcatctgcctcctgcatcctactgcagtctggccaaggagggaatcctgtggggaaggccctgctgatgctttcctacttccctcagcacacccagggcccctttccctcactaacttcaatagtttgcaattcatgccatggaaccagagcccgaattctaaatccaggcccacaagtcaacacaggaaggggacagcaggtcctggcctctgaaaccactgtctccgagcaggtccaaggagaggccaccagagactctgttctttaagctgccactaatggggaggactccgctagagccctgtccatgcagcctgcatctttttgccatctgcagaggcattggagggatctttttaaaaataagctagatcacatttctcccctgctaaaaccttctagtggctctccattttccttagaatgaagtccaaaccctttcccatggcccactgggtcctgcatggcagaatctttggccttctatccagtcggggctcctgctactctccccacagtggtgcagcttgactggctctgctgatggctgtcgcggaagagacttctggtctactgtgattgggtggctctggtctcctccatgtcaccccgcctgcttatacaccctcataacatgaagcctgtgctgtccactgtttccttaaaatgaaaccaagcctcaaagttacttgtaaagtcatctgaagaatcttctagattttcatgaattttaacccagtcttttacagttgtcttacctatatagtagtccctaggtatctgtgggggattggttccagaacctcactcatataccaaaatccatgcatgttgaagtccctgatataaaatggtgtagcatttgcatgtaacctatgcacatcctcctgtaccctttaaagcatctctagattattataatacctcatacaatgtaagtggtatgtaaatagttgttatactgtattgtttagggaatgatgacagaaaaaagcctgtacatggtcagtacagatgcagccatcctattttaattatttttcccacatctcatctcatcctctcctctcctctcctctcctttttcagacaggaccttgctctgtcaccagggctggagtgcagtgctgtgatcacagctcacagcagcctcaacctctggggctcaagggatcctcccacatcagcctcccaagtagctgggactacaggcgtggaccaccacgcctggctaacttttgtatttttggtagagacgaggttttaccaggttgcccaggctggtttggaactcctgggctcaagcagtccaccgacctcagcctcccaaagtgctgggattacaggcatgagccactgtacctggtcccaaatattttcaatctgaagttggttgaatccacagatgtggaacccacaacatagagggctgaccacacttagtttgactataattttcaacaaactcctttattgtttttcctttttttttttttttgagacggactcttgctctgtcccccaggctggagtgcactggtgcgatctcggctcactgcaagctccgcctcctgagttcatgccattgtcctgcctcagcctcccaagtagctgggactacaggcgcccgccaccacgcccggctaattttttgtattttttagtagagacggggtttcaccgtgttagccaggatggtctcgatctcctgaactcgtgatccacccgcctcagcctcccaaagtgctgggattacaggcgtgagccatcgcgtcctgccttgtttttccaaaggaaaggttgtttctcatggcaacaaccactctccttttccattcattttcatggatttacttaatcatcgaacttagtgattcttctccattagtggcagctcaaagaactgagttgctgccccaggggcctttccttggatctgctcagagacattggtttcagaggccagggtctgctgtccccttcttgtgcaaatacaactggcataaagaggtctgggaccaaacaagagcacctcttagtgagtgtgctggttagtggagggcacaggcttgtataggcagtgattgttcagcatgccgtgagcatcagtctgcctggtttacagagacacagagaatgtgactccaccctgagaaggttgggtaagacattccccactaaatccatattgagtgggtgaatacaggtggactgggaaggtgcactgcttctataaacagccactgggccctgtggtaacaggaacacattagcacatgttatggcccaggcattattcaaagtacttggcatctatgaactcatttacttttctcagaatacttacgagacagacatgattagcatccctatttcattgatggtaaaactgaggcccagaaaaaaaggtcaggtaacatgcccaatgtcacacagctgggagatagcaaagccatgatttgcaacgccagagggcaaccactatgccacagagccccaggtgtcaggctgccttgagatataaatattgttcctcaagcatccatttgagcagcttcttggtcctcatcatctgtggggggcaggatccactttctcgggagagggtagacatacagacacaaagtcctgaacctggaccaggtctggccttctttcacaggctgtgtgcagctgctagctttgcctctttcctggaagaccaggatgggcacagtgccaactctcagtcctgcaagcctagaccagcagccatcaggtaaggttagggccactgccctagtgccctatcccattgccagacacagcctttggggcccagcctcagctgcagcaccccaggatccccctcgaacttctcagctccatgccactttcacatcaggtgatcacagcaagacagggaactccagggggagctctgaccaggggcagtggaagaagagggatgggtgatatgtctgctcacccagagagcccagcaccaacctacatggacccaagctgaggtggcagagaggagggcatctgaaggcagagcctgggaagagatcctgctaggaggtctcagagaacctctgctgtagggactacagccaggtttagcaagcaggagtcagggagaagattcccaggggcagccagcattagagggctcagttcccaggagcacaggaccggtggctgggatgggcaaaaatggctcctggggcacaaaggtacaatgggaagaagctgtgcattcccatgctgtaagcgtctgccctgtttcacccaccaatccaccagtgggcatggccactttgctgtgggtgtgtggagcatttggcaagtcctagtaaggaacgatctttcttaactcccataaaccctacagaggtgtaggtcaggtaaggatacgtcatgctcagggtcaggttccagccgcagctgagggctaaggggaatgggtggacgtggggcagggagctggaagaacactcgagagatagcaggtaaatgagacatggctttactcagcagcagctctcttacacagctttctcaaactagctttctcattagcagcttactctcacaccgtctgccctgtcttggctgcttagtccggtggcccctacgcacagctgcgtggccagctctcccttgccttcagggtcagcagcttaattctttctctccctgggcacgggcaagccaagctgtgtcctggctcccctctgtcctggctcccctctgtccacctgcaaagacagacagctcttgctctctctctttctctaggttcccgtgcacccgccatgtcaagctatgttgagctgagccaagccccaagagacatgtcccccatacacagcgtcaacagggcagttataccttttacagacaatagtggtttagagccaagtatgaacttacataaacaggttatataagaagtggaggtgtgcacctgtgcaccagactcattgagtcatgcaggcctggatatccccctctgcctattccttgaacaaagcacatccaggtaccttacaggatactagaacccaaaaccaggagacttccccagggaacccaagttggtcaggggcagtgtttgctcttgaactcaggtgctaaggccatgtccaaagctgacatgaggttgtcacacacagtggcatcggtgccacactaatgccaggactgagacaccagcctttactggaagacacagttcctccctttctggtgagaaggcagcctggagggggaagacctgggccccagccttctttggtctgagatctcagcaggcctgtgtttccttcctcagctccagtgccacttcagtctctgctgtccctgctgataggaagagcaacagcacagcagcccaggaggatgcaaaggcagacccaaaggggtaaggcatgagcagacagtgctgaacttctggggtggagagaggcagcttgggctgtgtgtccattggcctttggctgggaaggtgaggccagcaaggtttgtgagctggcctgaggcacatagcaagggcagaagccccaaccagaaccctctggcttctggggccagggagctttccactaaactgttgccttggccaggaaatacatcatagtcagaaagggtctttcagtcagcaaccactctgacagcaactgccttttgctggaggctggagcatgcagacaaatcagaaacacctctgccctccaggaactctcaggcagggggtgggcaaaggctggtccagattagagcaatacatgagcgctagagcaggggaagggggcttcatggggactgtatgtagctggatgtggtcagcgatgagtgtccttgttggggagtgctggaagaggaggctcagtgaactaggtagggcttgattggcctcttgtactgtgatattggagtccactgtgtgcacagccctctactcacagtgtctcatacggttctcctcacagtctctcaaaggtttatgcctaattacaacaaaacccaaaagcctggagcctaggtctctgtgcctcctgggaaggatagtgctccgaagaaaacagccgcagctgagatagagtgatggcagtgaggagggtactacttaggtgggtggaaaaggcaactcaggcgatctcctctaaagaggagaaggagccaactctagaaagaacacggtggagagagctatagataaggaaccacaaaccaactaaccctgaggtgggaacatgcttagcatgttccaaaggacagagtggctggagcttggccagtgaggagggccacagatggagcagggccttggtaagccatggttaagagattggatcttatttcaagttttaagccaaaggggagtctcatgtgatttaggtgtttaaaaggtgaatgcatgtttgcattttcataccacattgctgttgcttttttacttaaaccaagatgctgggggctggggtgggcaatggatatctaaggtatgaggccttattgtgtttcttttctcattcgaattgcactgacaattaacaatcagagtgaaaacaacagctgacaccaatactgtgctgtgctaggtgccttacagccttcccagcaacttgtgagatgggtaaggtgggaaactgaagcatagaaagattaagtgacttagccaaggccttacaagtggcagaactgagttccaagggaagaggctctaagaaaatcctcaggagaaactacgaaaaactagtttatgaaatcttgtctttggagcctagtctcaagacccagaatcagtaacttacagctggttaacatggttaacatgctgtgtgatctcaccttaattttccccaaacgtggaaaaggataaggcttcttattatgcaacttgacagaggagaaaattgagggactcactcctgtaatgaacacacttaggaacagagcccagatccagccaactctagagccaggctcacgctactttcctctgatgtttaaacgtctgcaaaatcagaggtgttttttttttttttttttttttttgagacagagttttgctttgtcgccccagctggggtgcagtggcgcaatctcgactcactgcaacctctgcctcctgggttcaaacgattctcctgcctcagcctcctaagtagctgggattacaggcacatgccaccacgcccagctaatttttatatttttactagggatagggtttcactgtgttggccaggctggtctcaaactcctgacatcaagccatccacccatcttggcctcccaaattgctgggattacaggcgtgagccactgtgcctggccaatacaaactttcttgattacagtgtttcacaactctggctgtacttgagaatcacctaggaagtactgaaatacactgttgatgaaaaaggccatactctgtaaaatatttgaagaaattctgagccaaatgttaggactatgacccgtgacacagcctcaggaggtcctgagagcatgtgcccagggtggttcacttacagcttggttttttatgttctagggagacataagacatcaatcaatacatgtgaggtatacattagttaggtccagaaaggcctaggtatacattagttaggtccagaaaggccggacacctcaaagctgggagtgtggtgggggtgggggtgggggtggggttccaggtcataggtggattcagagattttctgattggcaattggttgaaagagttgttattctctaaagacctggaatcaatagaaaggagtgcctgggttaagataaggggttgtggagaccagagttcttatataggtgaagtctcataagtggccgcccttagaagcaatagatggccaatgtttcttattcagacctttaaaaggtgctagactctcagatcagaaaaagtcctggaaagggaaggagattctctacagaatgtaaatttcccccaggagagacagctttgccaggtcatttcaaaatatgtcaaaaaatatattttggtgtaaaatacttcaatttctttcattacctgctgtctgtcatgtgatgctatactagagtcaggttggaatttggcatattattgcttcaaggagtctgttttgtcagtctgaatatctctctcaatgttaatactggtcagttgggcatgaattccaaagggaggagaatatattgaggcatgtctgaccttcccctttctcatcatgacctgaactagtttttcacgttgtgtccccttggctgagagaagtgtccattcattcagctggggagcttagaattttatttttggtttacaacacaacaaaaacttcccgaagtcccaggtagagatttggattttatttttctggggtgggtctccatcatgtgtctttttcaaagctccccagtttgttctccttccaggctaggtcgagaaccatcgttctcaggtagtggttctgacccaggggcatctcccaaagcttccagcctgctacgatacaatgtctggagccatttttggttgtcaaaactgggagtgggagacactactggcttcttatatgcagagatctgggatgctgccccacatcccccaacacacaccatagaattatggggttcaaaatggtaatagtgctaaggttgacaaaccttgctgtagagccttgacgatctatttgggaagacagcagggacggaaaagaaaaagggatggcacagaaccacacccctcaccttccccgaaatctgggtagcgggcacaggacgtgtgcgcctgcgcgaatgcgcgctcgccaccagcgtacgcgacgcgtgcgcgcctgtgcacctcggcgagcacgcgcccgtagtgagtacgcctgcgtaggccgccatttcttgaagccccgaactcggtcgcagtgcccgccgggaaaatgcgaccgtccacaaagtgaaatggccgcccgggacgagctcggcctcggcggggattctcttgaggccatgcccgtgccggccgccagaggtcgcccgaggatcacgaatgggcccgaggagctggctgccccttcccccgcgtaaggtctgaagccgcggccagagtggctttggggtgaccgcgcgtggaccgtcgccggcgggaggaagcgcggtcccgcgaggggccgaacggggcccctgcggcttgagcttgtttcgcagggagccctggggccatggcctctgggacactggacacgggtcgtcagggctgcccagggggagggggtgtggacgtgcagacagggaaggcagctggaccctccaaccacgctgggccctcgggctgaccggggctggtctgtggggcagtgaggaggggcttcgttccctaggagtttgatgagggagcgccatgggggtggcgtcatcctgacatcccgcagggcagtggagccttactttccctaggttacaacacagttttaactgtcccaaactgtggggactccgccctattccatcttgggccgctccatcacactacagggagaggcggtatagtatagtggttgagagcctggactctggtgctttgggttccagtccaagctctgtcacttacaagcaccgtgaccttgggcatgttactcatcttctctgtgcctcaggttcctcacgtgcggaatagtggtaatcatacctcctaccatatagggttgttgaaatggccaaatcggtttgtatatgtaaagcctgtaggacatttaaacctgcgagctaagtgaagcagcaccagaggaatatctcctcctctcagaggtgttcagggacacctggaaagctaacttaaccagctttattggtttgatttcatttgacatgacacgatatctcatcttcttcctactaaacttttgtcatcaaattttccatctagaacatgctgttttcctcattatgttgcaagcatgggcttctcgtttatattttttctgcatgaggatcaggtgaagtttaggcaccacatttcctcaccactggcaaccgttgttggccagtggaggcagtacaagggtggaagtgtcagctgggtgcagtggctcatacccacctgtaatcctatactttgagaggccgaggcgggaagaccacttgagttccggggattgagatcagcgtgggcaacgtagtgagacctcatctctacaaatattatctatatctatatatgtatatgtatatgtatatcatatatatgatgtatatctcatatatatatgtttttgaaacaatgtttcacttctgtcgccccagactggagtgcaatggggtgatctcggcttactgcaacctctacctcctgggctcaagtgattctcctgccttaacctcccaagtagctgggactacaggcacacaccactgcacctggcttatttttgtagagaggagtttttgccatgttgcgcaggctggtctcaaactcctgacctcaactgatccacccacttctgcctgccaaagtactgaaattacaggcgtgaaccactacgccgggactacaatttccgttttttaaaagaatggaagtgtgtagattatggttgtgttaggagttgacagtggctgtattaggctactggatctttggtccaattacactcagaaggaaaggcttcagagaaattaatccaaaatccaaaatcccgttggtcaccatcccctatgttaccttgcctatctctaaccacttgacttccaggaagttcatgaggagctcggacaggatagctgggaagtaattcccctggatgttacattgtccagcagagcttcctgtgagtgtttgcctaagatttcctttttatgacccacataggtcatatgtcctaaaatcacagtggccctgccacaggcctaggaaagaagaagccttgttcatccatttgtccctgtgtcacaatagagcccaaatttctctttgtggataatcctggctctatccacagacttggtgagggcaacctctactagtgtatttctacagaggacgtgggacaggacgggactctgattaaatccatagtaaagctaactcagggctaccacagtagggagacaagctcttcaggccttgtatgtttgtctttggctcaagcaagcatgtcactgacagagattgaatgggtgtgtcagggcaccctgctggcaaccctgggactggtgttacctgtgcagaccacttttggatctgcatgggctgcagcagaccctaagggtggaagcagcacagagaagcacaggcccagtgggatggttccccacagttactgtgtggcgtcacactcacttgcctgcagttctgcctggtgcagctggaggtggcaattagcttgttgtgcctgctggagaattttagttcccttgacctccacctgaggctgaagaatcatgttgctttcagggcatactttccaaaaagtgtggcctctgttggccttgttattccagcttgaaggcaggaagcctgcctagacaaagttaactcctatatacaaagagtcccagggtagtttgtagcgtgttcttgtctcggggtagcccccaccagctattgaaggtaggctggtgatgttgggaaggttatattcagagtgagctaggatcgaggtgatggcgaagtagattttcattctgaaatgctgggctcactctcttagtagcccaacttggtgtttgcccctggcctagtagactctggaagcagtaccttgcacctcggtgtggggctggtgatgggaggggtgtggaagtggaggatcagctagcagcctctttcccacggtacccagattggagggtgcagtgcaatcatggggtgaggccagggaggacccctgaagagctcgatgcctgagacatctgggggaagccctgtccttcttgctggattcaggggtggcaaaagccaaaaattggagggccaggtgcaatggcacatgcctgtaatccctgcactttgggaggccaaggcaggaggatcgcttgagaccagcctgggcaacatggtgaaaccttgtctctacagaaaaaaaaaaaaatacaaaaattagctgggcgtggtagtgtagacctgtagtctctgctactcagaaggctgagacaggaggatggcttgagcccaggaggcagaggttgcagtgagccgagatgatgccactgcactccagcctgggcgacagagtgagaccctgcctccaaacaacaacaataaaaacatcggaggcttcggcttcatctattacacatggaggcctgttcagtgagaagggagcagcgatgctgggctcctgccaaggaggagactgtctgctccctggaattggggctgtgcctggctcctttctgccccgctttcagggatatgagtccctccaagtccacaggaggtgacagccagcttgcgtcctggggctgaggcagggttagtttcagagcacttttttcataagggtgcttattcttcttcagggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcaggtaagggctgagctgcagtgggctctgcctctggagcccatgtttttgttgaggtctgcgacccacatgggaaccacttccccacaccctgtgccaatacccgacacattgcacacccaggctcctgttctgtgagtgggtcatggtgattccctggtcctagagcagtgtcatcaggcttcttgtggctcaaggagctgggaggggactgtgataggaggatgtgtctgtccccaggtgtgagaagccctggctaattcccaatgcatggggcaggaaggaaggctgtctctcagagtacaggtgctctacaggtgggggtcctgggcagagtgagggctatttgtgtgggtaaaatgccattgtcagagaaggacagagtgtgaaagagcaaaaaaacaggagggtaaaagtgcaaaagtgacagagtgaagcagagagagagaggccagagggagagaaagggagcatgtgtgagcaggcatgagagagtgacacaggatgtgactggccatgtgttggtgtgtgccactgtgcatgagcaagaggacaaacgtgcctgttactggagctgaccatgtggcattggtgtgagagtttcaagtcaggctctcttgaaggcatcttgcctgccagcgcaaacactgcatgtccttgcagctctggacacgtcaacaggccagtgattccaggggtgcaaagcgaacagtttcttacacaagacagaaatgtagaaggagagagctaagactcatattgccccgagagaggagctagtggaatccagcagggcatctgctgtggggagcaggtggagcctggggttccttttgcagggatgaaagaaacacagtcatctgccttctttgttctggggcttcttgtaccacagaggttccataattattaatagttaggttatttttagggcctagctcaactgttagataacaagttttaccttctaagaatatctagcccatctttgattccttggctccaggccctggagggtcccagtccaaaaacagagtgaacaactttggacttgctgtcacattgtgtggcttctagaactagtcagtgttccatgcagaaggggtataaaaagtgaggcttgtggatgaaggaggaggcgagtggttctgggttttgttttcgttttgcgggggagtgtcaggaaaggctttctttacagggagagtgatgttggagctgggtttggaaggctgagggagattttgccagatgtgccagacgtgcttgggaaggcattccgagtggaggctcacaaagtgtatagggaacatccagtcaggtagccatcacaaaggagggttaatccagcctggcttggcaggaagcaccaagtaggggctgggcaggcacctgctcctaggctgaggagtgtgacccacatcctgagggccttgggagccaccgatggttttcctgcaggagagtgccacagccagactcgagtccaaagaagatccctccattgccctgtggaggaccaggccaggggagtatacgacgagacaaggcaggaggccatattggagactgtttgcttacaccaggggcaaggtgatgaggctgcaagtatttttgaattattaaaggtaaaagcgggcttggcgtggtggctcacacctgtcatcccagcactttgggaggccgaggtggcagtatcgcttgagcccaggagtttgagactagcctggggaacacagcaagaccccatttctacaaaaaatttaaaaacattagccaggtgtggtggcacatgcctgtagtaccagctacttgggaggctgaggtgggaggattgtttgagccttgcacgtcgaggatacagggagccatgttcctgccactgtactccagcctgggtaacaaaacaagatcctgtctccaaaataaaaataaaaaaaataaagataacggtgagggaaaagtggtagccaaggttgctccccagatttcagggctaggcaattggatgggtggtgacaggaactagctgagggtaaggagtttgggggcaggcccgctgagagatgcacagagatgagaaggtcactgggccatgccgaatgagaagtgcctgtaggggctccagccagtgatgtccagtaggctactgagtaaacaaatgtggagttgagcaaagatctgacctggggctagagagctgggagttgtcagctcataggaagtcactaaagagaatgcatgaggttgcctggagaatgcctttggaaggcagtgtgtacaaagcatgtattctcggcttttctctgcagacttccagggacagttgtccagccaggcccttggctgggtgggtgagtccacgtggttcagggatgctgagggaagctgcttcatcagctgacatttctctccattttctgctcttcttttgtctcaaaaagaaaaaaagaggggatattaattattgatcccctaaaaccctagctgaatatataaaatgaaaagaagtaaaaatatgagagaagcaaaggcagatggaccataattttggaaaataattccaaaaggtcttaaggaggaagaggagctacagagaggtattgagaaggaaaattttggataaatggaagaatcaggaaagactaccgtcatggaaaccaagccacgctgagctaactttccagtgctctgtagatgctgaaataggcccatcagatttggctatgtagaactcatgactgccttgaggggagtaggttggggcagtgggaaaggctgtagttggattataatggattgaggagggagcggaggataagcaggtgcagttgatggggtacacactctgaaactggctgtgacgtgatggatgtgggaggggtgagcagataattacagctacaagataatggggaaggtttcctataggtgaaagcaacgtgtgcatgttaggtaaaggctgggcagagggtgcctacgtgaccagtccccgataaaatccttggactctgagtctctcatgaattgccctggtcgacagcatttcacacttgttgtcacaactcactgctgaggggaactgagtgaatcctgtgtgacccactgggagaggactctggaagcttgtgcccgggttccctcagaaatttgccttgtgtgcttttccctttgctgattttgcttcgtatcttttcactataataaaccatagccttgagtgtgatgatgtgatgtgtcctgtgagttcttcttgtgaatcaccaagcctagggatggtcttggggacccctgacacagatgggcaggatcagaactttatgccataacaaggactttagattttctttcgagggcaaagaggagccaggaaggtttgaagcaggggagtgatatggcgagagtattgctttgcaatgggatctccagtggcagtgagaagagtgactgaagtgggcagagtggagcagggagaagaggaagtgcttacagcatcctccatgtaagaaatgatggggcctggactaggggactagctgtggagatggagacagaactgtaaaataagtagaagagatcccaaattggatgacaggtaagacttgggagagcagtgacggagagggaagtgacaatttagaaagccacatttctggtcgagtgagtggagtatgtgacccctcctggcttaggtggtggccaaagtatctctaacctgcctctatactgcctgcaactgactgagcaaatgcctggtccgtggagatcccaagctgacaagggcacctgaggcaagcctctggctttcaggtggaggccctacctaggctggcctggctggattgccctggcacactgctgttttgctgaggcagacagcagcactctgcaagtgctcttctcctgttcctcttagtggtctaaatcctgtagcatgctggggtgcgactgtagacaaatcccctttccgggccccctggggttctctatttgcagtctttgggtctggtcactggcatggcatctcagtaggctaggttcatcaggaagggtcaactatgtcatggcacctgatgggcagcatttagagtctgtgggccaggggcttaagggctgcttactgctaatagttctaagtagcaagcattccctcagccctagtctgggcacacgccaggaagaaagccactagatgtgctctcctagtggataactagcctggagttccaagaagggcagagacaggcagagtgagagccttcagagatgtaggcaacgatagtagcagaacttcgagggagagtagatggaaaaattaaaaaaaatccttgtcattatttttaaatgtctgaattgaccagattagaatctttgagagtctagacactagggagatctcatgggtgggccagttattatatcatatggagggagagtacgtatgacccagcacgagaggaccagaggacagtcagtgctaagggtaaaaccttaggccatgggagattgagtttttcatcagttggcaagttttcactttaatactccactgtttccatcatttcagacgactggggatgataaggacaatgtaatttgggggataaaggaagaactcattatatttcttggatgactttactggggaaatggattccttagtcatttgaaagaagcggtagaattccacatgtggggaatacttgttctaacaaaagcttaataacattagtggcaatgatccttttatataagggaaagcttcaagccagtgagaaaaacataaataaactagtaagaacatatttataaccatgagatttgggtgcagaataaaatcaaattggcagttcaggaaaggtcctaaacatctgtatattaacaatattccatcagtgagcaatgtgaatttcccataattgaaatgatgattgataaccttgtattgttcttatctaatataaggcaaagcagcactggggctttgataaagagcaatatctcatgtacactgaggacactgaaaccccgctaggaattctatggaatttctaaaatatttatattaaggacattttacccattatagactaatttagggaaggttctgcattttttttttgatttgacaatgtttccaatgcaatttatacaatattaaataagactaattagtttttgcacctttcttgttacaaggtgaaagaactaatcctttgagattttccagaaggtccctggcaaatcccaaagccagttttaggtataaaatatatttaagttttgattgtgggaaggcaaatgttaagagttgtcaggagttctcgaacatttgattgaatagcattatgggttagcgagaaatactacttggttagctagtgaatcagagttgtaaaaattttcaagtaaacatatgaggtaacatggttgtaaagaatcttcagttcctttaaaattgaaaagactttaaaaaaataactaaggacataataaactgaacatacagatagggcattacagtattttgataagacataaaatctttgcctcttaggcagatgactcagaagaaaaacagaccatttataactttttattagggacagaccaatgatcaagaattttttttttttttttttgagatggagtcttgctctgttgcccaggctggagtgcagtcgcgcgatcaccatgttggccaggctggtctcgaactcctgacctcaggtgaactgcccacctcagcctcccaaagtgctgggattacaggcgtgagccactgcacctagcctaagaaaattttgttattttaacagagaaaccaacattttaattttatacaagtataatatttgatattagttcttttttgaaaatcttataaatacactgaataaaagttttaaccatgacaaataaaattccttttctgtgaacattttctaattttaaagatatttgtttacattttgtctcacacatttttaaattatttgtcattttaatttgggacaaagctattctctttttccttaggaaaagcatatttgcatacaaagttgtttccctttgccatttttgccattattacttttagcagtttatatatatatatacacacacacttatttacttattataattttaaccattaataacttctctttcacagagaaaacaggaggtaggtaattttgaaatatcatataccagcattttgtagcagactagtaaagcttatgaatatacatctcataactttttatagttgttatatactttttatagtaccattttgcaatgtggacaaatgaacacatttaacagatccatatgtagtcacactgtaccataaaaaaagcaaaaagtatataaacttaaatttaggtctagtgactaagtattttatcttctttataaatgatatttaatgaatttagttaacttaattcagcataagtctaaggttttaagttaccaaaaagattttagaaactgcctttaagcttacatattataaaacataattactgttgaaataaagtttgccagaataatgactcagtttggttaaaagcaaatttaaatttttataatcttaaacatgtagtagatataatactagcttattcaacatgtaaacctgtttaagtttaggaggaacatacccaagtagagtaaaaatatatgcttgtattctgttgtattatatgtaatgctgataactcaaagacacataggtgtctattaaactaacaatattaaactagttttgtttgccaaaagtttacataaattctgtgaacttgagttttaaaagcatttgggttagtttttataagaatacttttttgttgtttacactgaaagtattagaagttgtttccttaatttatgagagctttataataatttatataagtacttatttatctctaagtcaattagaatagaggataagggattttgtaaattaatttggtaatgccatctggaggtactgaactattacacatatacaacatacatgtatactaaacatacagacagacacaaatagagatctaatggcgagccctcaatgggtgcagggggcctgaagctctactggctataggcagttgagagggctgagtgggaaggggaaagcctggtgaagagtagataggggtatgtaggaggtagaggcattgaaggggacagatgaaaagattcagggagctgaagggaaggtccaaggtggtgaaaagaagggaagagggatgcggtaggaagatgagaagggggaatcttagatgagcaggtttggggagaccccaggttccctaataaggtcactgaagttccaaattacccttcgtgattactttttttttttttttttgccagttttggaaatactggacagaatgagtgccataggggcagggcatgtagtcagcaagggaggaggaggaggatgaggaggaggaagggcacccagtagattgagagttacctgtgggaagaggcagatcaaatagagaaaggagccaggctggacagtctcattaggaagttctgcacacagtcgtcatctgggagccaaagtttctcttcagtcctcattgaggagctgaagggctttccttgtgcaatctctagacaaggtgtcaagggaaacaatgaggcctcacaaaagagccaggaatttggagtaaatctccactcaaaaggaaccaagaaaacttctatccaggacgattctggctaaaattgaaaaggaccaggaagagtcctgctcaacagagtcaggggttaaatccccactcaaaaagagctaggaagagttctgtctgcgaagattcttgctcaaacagaaaagaactgggaagagctcatttaacagaatcaaagtaactgaatcacagaaccataaaaagtgtccaataaaagcaaataccgtctctgggcagggtgcaatggctcacacctgtaatcccagcacttgagaagctgagggaggaagatcacttgagcccaagggttcgagaccagcctgggtaacatagcgagactcctatatctataaaaattttaaaaattagccaggcatggtggtgtgtgcctatagtcccagctacctgggaggctgaagtagtggaggattgcttgagcccaggagttgaggctgcagtgaactattattgcaccactgcactccagcttgggtgacagagcgagaccctgtctcaaaaacaaaaaacaaatatggatttagatagagacttttattttattttattttattatttttgagacagagcctttctctgtcacccaggctggagtgtaggtgccatctcagctcactgcaaccaccacctcccgggtttaagcaattctcccgcctcagccttctgagtagctggaattacaggcgtgcgccaccatgcccagctaatttttcaatttttaatagagatggggtttcgccatgctggccaggctggtcttgaactcctgaccccaagtgattcacccgccttggcctctcaaagtgctgggattacaggtgtgagccaccgtgcccgaccaatactttatttaaaaagactattgcaatagggacaatgctgcaacctcaggacttgcaaacatcacaaaataatacaaaaaacatcacaaaataataaaaaaaaaaaagcctttttttttcagtagggagtagtaagcacagctagcagctcagctactttcaagggccagtgggcaagcaaaggggaacctgtttggcatgatttgaccagaaatgtgtttccctgtggtcagccggttctcaggagaagctgctaagtggggcatgttctgcattgcagcacttacttaaccaggagcaagcaaaattcaggccctgtggggaggacagaagcctgcctaacattctgtcaaggcaaaggagagggtaaaaagcagacagctgtgaacacttgatcatccttcaggcaataatccattctgggtttctggcttaagactcttgagaaacaaggggaaacaactggtaggagcagcaggctcacctatatgtagttccgtgaggtagccttatggacttctgccaccttccaaaactcagcatgtcccaaaccatctttatcaacacagcttctcaccaaaaacaaccaaataaaacaaattaactaatgtactaattctgtatctccccctgtgttgttcatctcaaaaaactgttatcacctcattgactcagactctcaaccagcgaggtagaagaaatgtttgggggcatgttaaatgtaacacctatgagacatgtaagaggtgaggtgcaggacgcaggtacatggtgataaaagaaaaacctcagccggattaaatttaaaggagtttcattgagcaatgaactatttgtgaatcgggcagcccccagaatcacagcagattcacagagactccagtgcagctacatggtggaagatttatagattaaaaaaaaggtggagggggggaaatgacgtacagaaattggaagtgaggtacagaacggctggattggttacaggttgggggtatgccttatttgaacacagtttgaacactcaccagtgtatgaatggttgaagtatggccgctgggattggccaagagttagctattgttacaggtacacactcctaagttaggttttcaattttgtctgcctctaggttacagtttattgacaaagactcaaatatagaactatggagtccttctcaggccgtatttaatttgctttaacaattccccctttttggtcattttctcaactttgagagattgacaaaaaccttagttattgatatcactattacccttgtaaatgtacttatatggtcttgaaacccactgggaaacaggaggacagtgggttttgtaaggagagaataaggactgagtagaaggtacctctttatgctagaatgttctgtttacaggacaaaaacaaaacctggtctgttttaataactatttgtttccttaaagtcttagtttgattatgttacatttagcatgagcaactccattttgtttggtttggtctgttgggtcctagtgcatgagctcagtacacaacaatggcttgccagaattttgtttaaaaaattccccttggctgggcgtggtggctcatgcctgtaatcccagcacttagggaggctgaggcgggcagatcacgagctcaggagatcgagaccatcatggccaacatggtgaaaccctgtctctactaaaaatacaaaaattagccgggcgcggtggcatgcgcctgtaatcccagctactcgggaggctgaggcaagagaatcacttgaacctggcagtcagaggttgcagtgagccaagatcacgccactgcactccagcctggtgacagagcgagactccacctaaaaaaaaaaaaaaaaaatatttccccttattggccaggttctcacttaggtgagagtgtgaccaaaacttagggccttagcaccacttttagttacctagttaccatcattttaggtttccagtctcagcatgtcattcataggttatgatgtcctcataatcatacatttcaatcagttttgttattccagttgaagagagaccatttgacatttcagagatggctgcatgcaaacatttgaaacctttgagagaatacagtgcactggggagactactatgactaccagtaggataatacccagagtttgaagtatgctgtttacctgaggtccccataaaacaaactgcctaaattaaataaaataaagaatgagctagacgaagagtctactcacttcactaagtgatcttttcattaatcctgtatgactgaatttttataatctgcacttgatatacatattagaattttagaaaccccatataattttggaatatatattaatataattcactaaaaatataccctgaagattaaacattatttttattggccaagcgcggtggcttacacctgtaatcccagcactctcggaggccgaggcaggcggataacctgaggtcaggagttcaagagcagcctggccaacatggtgaaaccctgtctccactaaaaatagaaaaattagccaggcatggtggcatgcacctgtaatcccagctactcgggaggctaagactggagaatcgcctgaacccaggaggtggaggttgcagtgagcagagatcatgccattgcactccagcctgggcaacgagggcaaaactcagtctcaaaacaaaacaaaacagtatttttattttgacaatgcctcccatgatttttataccaaataagccaaatgtcactgttgcattagtgcattatcgatgtcaaacccaattcttaaataaaaccttatagacaaatgtattcaatcttaatcagtttgaacataaggtaagaattttataaaccttttataaccctttacaatttttgttgaagagcagattagtgctctaagaaaacctgttgtgcttttatgtccatgttcaatttatggaaaaacctaataatacccttttaaatttagtattatcatacataaaattttttacaaggttaattttttttttttttttgagacggagtcttgttctgtcgcctaggctgacagtggcatgatctcggctcactgcaacctctgtctccccagttcaagcagttctcctgcctcagcctctggagcagctgggactacaggcgtgtgccaccatgtctggctatttttttttttttgtatgttagtagagagggggtttcatcatgttggccaggctggtctcgaactcccaggtgctcaaaggaaaatttaagacagtccatggaggagaaaggtatagacaaggtcatgcagatattaaaccagaaaggacttatttcctaagccaggaatcgaacccagactgccactgtgaaagggcaaaaccttaactactgagcccagaaggagtctagagtagttaattttgagcttgcaaaggcttttaactagtcaagataatttttagaactaactatgatatgaaccctaaaattcctgttccctggaaggtagagacaaggagaaagtactgccacatggttacaaggtcaagctcccaaggacataaaacaggatggcgaccttgtccagttttttgttggtttcagggacctgcagcaaagtttgtcactgaccagcttgctgggccatcttgagcagcaagcttatgggggcccaagcccatgttttatcctaaggtacccctcgacacagaaaaacgactttatagcacaaaatataccagattgactacagcttaagactagacagcctcagaattcctttttgcattaattaaaattttacagaggagataaacagtgattttacaatcagtttgcacagagagagagaagcctgaaatctgactgggaagagatatttacccttttgctggcatgccaggcttctgggctccctttccctgagtggccctggtgatctggctctctgcaccattgccccgggagccaagccacaacacaaaagaatttttttttaaaatgcacttcagtgtgttgttgttcatttggaatgttccactgtaagttatctttcgtaagatgtcaccatttctgtaagaatttgctgcctcccgggcgtaatgtgtaacccagaaggaactcagttttccagaagcaattaataggttccatggaatgttgatggtaagaaaggaaggaaaaggtgacaagagtgagcgtagacagctctttctaaggagtttggctgctggaaggggaagagaagcagctggggttaggtgggaggaactaagtttagagacgctaaaagtgtatgtagcaggagtcacctgatcaggttgaactgcagcaggaacaaggaagttccattttgactactattagttgcaaattggacccttatgtcaactttttcatctgtaaaaaaaaagggatggccaggcacggtggctcacgcctgtaatcccagcagtttgagaggccgaggcgggcggattgcctgagttcaggagttcacaaccagcctggccaacaaggtgaagccccgtctctactaaaatacaaagaattagccacgcgtggcagcgggcgcctgtagtcccagaatctctggaacccgggaggcggaggttgcagtgagtcgagatcacaccactgcactccagcctgggcgacagaccgaaactccgtctcaaaaaaaaaaaaaggggggcaggggatgaaaatgctattgctttccaggaatagctatgactacttccaataaagaagacaagaaggttccacatgtgaaaactacgcggtcacaacgataagtgggcgggtgcacgcacgcgcgctgagatcgtgcgtgcacaggccggggtgcggccggcgtgagtacgcctgcgcgtgccgccatttcctgcagccgcagactctgcctgcggtgctcgccgggaaatgagacgatcaacaaagaaaatggttgttttgggcgagatcgaccgtggagaggctttttctgcagcagtcccggttcctgccgccagatggcgctcgaggatcacaaatgggtctagggttctcataatggccccgcctaagaaattttggattctcctggcccttcccccctttgtggggtcaacagcggatttgggaatctggtgaccaacacgtgcgcactcccctacccttgcccctaccgagccctccagggtagcttgggggagaagctcctccctagactgccgggtatttgatgagcctggccagcgcacaggtcttgagcaccatggtcagggaagaaggctgaatggcttaggtcttcctagagaggccggaggcgggaaagaactggagaaaggagagatggcagtgggaggatggggacaagaataccagtgtgtttccagccagaagacgatgtcttttaacacctcattgaagtcgtcaggtgactttgcccttgtcagaaaggagcagcactgcgggggtcctactgaggaggagactgactgctccttggggtggggattgtgcctccttcctgtctgccccactcttggggagatgagtccctccaagtccacgagacatgacagccagcctacctgccatgggagaacaaagtctagtctcagggcactcacttcataagggtcttattcttcctcagcgtgttgactgattttgaggggaaggatgtggccaccaaggtcggagaggcctggcaggacaggcctggagccccaagaggtggccaaggagacccagctgtacccactcag

SEQ ID NO: 3981 - DNA, 55360 bp, human
ctacaagatgaccactgaggattacaagaagctgtgagtatgcaacgccaggctcagcgtggttccctcctccaaggaacaagtccaaactctgggtccactgaaggcagctgactacttgccaccgagcacagcccgggaagtcccgcctgcctgacactccctgccagttgcagctgtggcctggagcccaccagagggtaacaagccccagaaaactggatggctgtgcacattgcacgtctgatccgaggcagagcggagaccgcaggaagcttgtaggaggggccccacggatctggggaaagggtcatgggtcgtgaggctgctgctggctggctgtgcttcctgggcttggccctgcacccggccgagcctcaggtgctctgcctggctgcactgggctgggggcctggggatcctcagggtgctgctgtcagtctgagcattgtgtgcctaaatctgagctgcttcttggatagaaaccttcgggttttcccttagtgctccccttggggtccctttcaaagccccccaccccccactgcatgctcagggaggagggttctctggacagaggtgtgaattgtgtctctagttcccaggggaccacatctttccgttgtttgtcccttgcctccatcatccagggttggggagctgctgggtaacctttctggggaaggggagaggctcgaacagggagggaggggagagctggtctcagggaggaacaagtggcatgacctaaggcccaaaggcagagatattgacttgcctcgtcattgttgttgaaagccaggaagccaagctgctgagggtggcagcctatgacaggaaagcgcctctcccctctcttagggcaccctacaatatcaggcgcagctctacatcaggggacaccgaggaggaggaggaggaggaggtggtgccattctcctcagatgaacagaaacggaggtaatggaatggtgccttttgggcatcccggggggcagggcaggagcctgagtcttcgaagactgctggaatgaattgtactggttggggtgacaaaatgcacaacacgtaggccatcagcggtagcccacggagcatgagaataggtgtcattctctgagtgccagaaccacccactcagtgttggaccagctgaggggcccttgagaaccttctgtggggtagaacctaggtaatgtgggtccggggaaaagcctcctcatgtggaggctcttcagggctctaaatcggtttgttagaaagggccctgagacagttgaacaaaaatattcagggagaagccacctgcacagtgccctctatctgcatgatctgcatgccttgggggttctgaatgccccggaccccaaactgagctccaggcatgcacagcagtgggagtgtgccccatgctgctgaaattctaccctagtctctgcgccaagctgccctcgtccacacaggccagcaaagttccatggacccttgcccctcctcagtcctctgtccatggggactgaccacataccacccagtgctggtgaactatgacaggaagggtttgttaagcaccttttgtatgcctttggcttggggcctgtacagcagttgggccctgaggaaataaagccctcccctccctgggctcagccagccaccaggtccatatctgctgacccatctgtggcgcaggaatcacagcaaagccccattgccaaaggccctggcagattggctatcctcagggaacagttcacagtggcaggggcccccaggcctgggtggagcaaggaaaagagccagaagctaggagctgcctagcattgaatgccagctctgccacctgctaggtgagtgctcttgggcaaataatgaaagcttcttggactcagtttcctcatctgtaaatcacagaggatactagcgtctactttcctggattgagaagagcaataagccaatgcgaggatgttggcatctggcgcagagccgggcacatgccacatgctccataaacatgggctgcccttccttcaggttctacatttcctttgaatagtccttggagcaggtgcaaatctggtttctctcaccccttgcctccctggggtggccctaagtcaccccgagtccatcccaggctaggctggcagagcatgtccagcttggcacccatcagatgctcccccatcccgtgtcaccccaggtcagaggctgcaagcggtgttctgaggaggacagctccccgggagcactcctacgtcctgtcagcggccaagaagagcactgggtgagttgccaccaactggctccaggctctaggacagctctcctctcctcagagctccagccttctctggctgatgaaagggtgggtggagagatcacccccaagggccttcctagctgagccttctcagattctcagatgtactttctagaaaatggagaggtctggcggctaccaccagggacagtgaagtgccgggaatggagagggcccaggaccctctgaggtagagcggtcttgatgtcacctgcccacgggctctgcccaaagcattgcctttctgcttcctttccagcagtcctacccaggagacacaggcaccgtttatcgcgaagaggtaagtgtcatcaagggacaccttggaggcctgttactggccacaggaaggccttccgtcagcaggggtgtagtgtgggagctgtggagaggggatgtggatgtgggggactactgtccctgagcagggggagttgtgaggggctgggggcttctgtctggaggcctggcaagcacctgggtggctgtggtagcatatgtggtcaagctcttccatttgccaatggctaatggggctgggcccctgacccaacgtggagcatttccaaggccctctgggagttgttcccctgcccctgttgcttgcctgatgccttgccttctgctctcatccaggatcaaaacctgggccatcaggagaacttcccctgggaggtgactgtgacattggagatgggccctaaagggtgaacagggcttaacagggaatgatcagaacgtcgggatactccagctgaatgagggaggggtgtcaccattagttgagacagggcaccttctggaggaggaaaatattcgggggaaagcaagaaagaaacttctggaaacttgaatttgagggacttccagttgagtggacagggaaggcctctctctgtgctgaggtggctagctggggactgcaaacccaagagaagacagcatgccaactgccccaggcagagggccccagtgcacaggcccggggtgggactagcttgctgtgttggaagaccaggaagttggcaggaatacagagagcagggatggtggcagcacaaaggaagtgacagagaacggggggcggtgggggggtcttcctggctgcatttggttcctgtggtttctgtaacgcagtaccaaaaactgagtggcttaaaacatcagaaagggattctctcccggttctggagaccagaagtctagatcaaggtgttagcagggtgggttccttctggaggctttgagggagaaaccatcccaggccactctcctggcttctgctggtggttggtgatccttggtgttcctcggcttgtacctgcatcactccagtctgtgcgtctgtcttcacatggccttctcttctctgtgtgtctgtgtccagatttccctcttcttacaaggacagcggtcattggatttaggacccatcctactccagtatgacctcatcttacctgattacatctgcaaagaccctatttccaaataaggttacagtcacaggttccaggggacatgaattttggggggacactattcaacccagtatgctgtccttatcctgagctggagtcactgaacccccagcctgggccacctcttggccgtgatcctgaagggttgggtcagttagacgccactggaagcatgttctttgaggcctccaagctctagggcagccaagaagaccacgagcgctgtttctcttcttgctcaaagggtggaggtggtggaagaggacgggccttctgagaagagccaggacccacctgctctggcaagatccactcctggctcaaacaggtaatccattgcgctcatctctgcctggggctggtggctgccatacctgccactcagtcactgaggaacctcagtcagggcacctccatgctgggcttcgagatcagtgtccccatgtgcccagtgacaagacgggacaaagaaatcagtaagagcccatctggctggatgtcccagggctgaaaggagcaaaacagtccagccccccgggagagagcacctggctctggtctgatgagtacgtatctgtgtcaccttaacccttgcaccactgagcctggtggcaacttgaacaccccaagaaaaagtaccatccttggggtttgagagggccagccaccatggcagtagcatgccattgtcagacttgctccttgcactccaataagttagccacattcagcatgcccagggaggaggctctgacatctccagagcctctcacagccaccttctttgccagtgcggatggaggcaggaccaaagcgtctcgggcaatttggatcgagtgcctgccaagtatgcctagccccgctgggagccaggagctcaggtgggtgccgagagctgactctggcttgtgagtgggtgtgatggcttcccgccagcctggctggctggttctgccagctggggagggtctggcagtggggtgatggggcaaggacaggctgagcactggtgatctcactccaggaagggccgtgatttgtcttgatttctgatccctgagaatctgggcagataatggtgctctcttgtctgtggacaactaataccttcttgtactttgtgcagaatggtgctaagtcctgcagggagagccaccacctgctgttgctgctgtttaaagtgcctgcctggattgagacctttgctcaaatctaggtctcctaagagctgcatctctgtagcacccttggaagacccctgcatccagaaggggagagggcctgtccctaccggtcacttcccaggcccccaagggctgttcaggctctcctaataccatagcaatcccccaatttgagctccacagccatttatagacaggtgaccactgtcctcagggttacttcctcagtctgggagggagacagaaatgctggcagagggagccaggagcatgaggccagctccctccatggccccaggcagcagactgccagggtgcttctccttttcactctctccctctcttgatcttctctggttgtctgactctccccataagaactttggtccatagaagatgtggaaaggaagatttgagaattctttacaaggcaatatctagggcagagctccccagtctttttggcaccagggattggtttcgtgaaagacactttttccacgggacggagcaggggatggtttcaggatgaaactgttccaccttagatcatcaagcaccggattctcataaggagcgcacaatctagatctctcacatgtgcagttcacaatacggttcgcgctctcatgagaatctgctgatctgacaggaggcggagctaaggcagtaatgatctctagcttacctcctactgtgcagcctgattcccagcagaccacagactggtactgatcctcaggctggggttggggacccctgatctaggggacttggcaattgagggatatgggggcaaaggctgccacaacaaagtattgtaccacaccctggggcgcttaaaccacagaaacgtatcatctcccacttctggaggctagaagtgtgagatcaaggtgacggcaaggttggttcctcttgagtctctctccttggctggtagactccatcttctccctgggcccttatatgctcatccctgtctgtgtgtgcctgcgtcctaatcacttctgtttttttgagacagagtctcactccgtcgcccaggctggagtgcagtggcacagtcaccactcactgcagcctcgaccttccaggctcaagagagcctccagccttagcctcctgagtagctggggctacagtcacaggccaccatacccagctagttttttttttttaaatttttgtagagacagggtttcaccatgttgcccaggctggtctggaactctaggactcaaatgatcctcctgccttagcctcccaaagtgctgggattgcaggcatgagccaccgcgcccagaccctaatcacttcttataaggacattggtccaactggattagggcccaccctaacaactgtattttaacttagtcacttctttaaaggccccatctccaaatgcagtaacattctgaggtcatgggggagttaagacctcaacatatgaattttgggtggcacaagtcagcccataacagtatacagttctcatttctccttatttctcttttaaagaaaggcaataaatggtttcaggtgcctttctgtttgttcgtttgtttgttttgtttgtttttgagatggagtctcgctctgtcgcccaggctctgtcgagtacagtggtgtgatctcggctcaccgcagcctccgcctcccgggttcaagcgattcttctgcctcagcctcccgagtagctgggattacaggtgcacgcgaccacgcccggctaatttttgtatttttagtagagacgggtttcaccatattggccaggctggtctcaaactgctgaccttgtgatctgcccacctcaggctcccaaagtgctgggattacaggcgtgagccaccgcgcttggcctcaggtgccttttagaagataatataggaggctgggcatggtggctcatgcccgtaatcccagcactttgggaggccaaggcaggaggatggcttgaagccaggagtttgagaccaacctaggtaacatagcaagaccccatctctacaaaaaaataaaaaataaaaattaaaaattagttgggagcattgatgtacacctgtagtcccagctacttgggaggctgaggtgggaggactgcctgagcccaggagtttgaggctgcaatgagctgtgaccgcacccttacactctagcctgggtgacagagcaagaccctgtctctaaaacaagaaaaaaaagagagaaagaatggaggagaattagattgtgctgtattatagatttaaaaggcactttgacatttattccacaaaattcctttcgatgtttaatccccatcatatggttgtcattgcaaggtggctttttaagtttgctcaggttgccataacaaataaaggctagagattcagggtccggggcaagctcccaacaggaggctcagcttgatgcttctgatagttctttcctccaattctggtcactcaatatttggagctcacccaggcagcttccaggaaagctgctggctgatcctgaccctggagggccgtcttctctgaccctaccacgttaggtgctgcactggaccaagcagccaccatcagtactcccaggcccagctcctatctgcctggtgtctgagaagcccagcccgtgaggaacaatgactcaatcaaactcagggtcctgcagcacttcagaaaaggctggtttgtggcagagtggaagaggagaatgtcacagccttgtccccaggcacagacctatcgaggctaccctctccccaccccctgccctgccctgtttcccttagctacagtgcaaaggtcagctcctcataactcttgccccccttgcaacctgaacccagtttagggaccctctcttggagaaactggttctacacatgcaccccttctcggcccccaggcctggctgctttacccgaagcactggtcaagcttgcctcacctgaccagggcatggcctcctgggtcccggtcctaggctctgcccagcatgctgcctggcagagcgtctggggagcagggagtaggagcacagcttctggcacaggacaaaaccctggctttgcatcagactgactgtgtgaccttgagcaagtctcttcatctctccatgcatcagtttccccgtggataaaatagggagagcagtaatagctacttcccaaggctgtcccaaatgctaaatgagatcgtgcacctgaagtacttaccacagtgcctgggtgctggtatcctcgggggctcccagtcataggcgtgctgagctgcagggcccttattcaaatacaggaagagatcaatatctccacctgctggcatttgagggaaatgtggccaaaggcagtgaaaaggaggtatcccctcgccccacatccccgcctcctcgctctttggcagaatgagtcacacactgtttggcacaggccacagttggtcgcattcccacaggtggctgtgatcagttttgggcttcaggcttcagcagatgcctgcctctcttccttgggtgccttccaagggtgtgcagccttccagcgtggtcctggacttcagcttggactggagctgtctgtggttgagagtctggggagatggtagggtagcgggttgtgggggaggagagacccttgtattagtttactggagctgctgtaacaaggtaccagaaactgagtggcttaaaaccacacgcatttatcctctcacaattctggaggctggaagtctgagatcaaggtgtcggaagggccatgctccctccaaaggctctgggggaaaatctgttccatacctttctcttaccttttgttgcctgcaatccttggtgtttcctggcttgcgcccgcctcactcccatctcggcctctgtcttcgcgcagccgtcttccctctgtgtctgcccacattgccctagtctgacatcagtcactggagcaggctggggtgacactttgttcccatttcctctgtgacagagccagaaacgccagtgagaaaatatgttgtgcttgcctgtgacatccctgttccctggcaccacctgatttaaatgaggcagccaggggttttatactgtcatcataaatgacatcatcctcaacaacgatgtcatcgtcgttatcacgagaggagatggggagaagtcagagctgtctgtgtgtctagggcccctcctggctttcatgatgggagaggccttgtccttggtagcccttccatttccctctggtcactttgagcactccaggccctggccagggtggaagtggagggacagagatgagcagcccgctgacccagccctccatggctcattccttgctttcaccttggccactccatcccctacccctcctgggacccctgagtggcctctttaaagtgccagtctgaacctataaaccccccacctccacttcaagcccatcctgcatcttccctttgccataccagatctagtctgtacattcaggacccctgccagcctctacctcctcctcctcccccgatctcccttcagctggcctgggtcgggctatgcctccatgaagcttgtccactgctcccatggctaaacctgttctgggccctgcagcacagcaaggtcagtttccatgcctctctgcccctgcctgaccctgctgggcccagagcttcaccagggcaggcctggggctcaggcttgtctgcacttccagggcccagggacaaaggcaggagtgactgcaatgtggcttggaattaggctttgctccatggacctaaggaggtctggtttggggtgaagggtccacccccagaaagcctgggagctctatattctctctggccctggccacaccatggccaagcctgctgggcgtcatgccttgcagtacggccagagaatgcatcagacttggagggatgtgtgtccggggtggcctgtggtcatctgggggagggctctgagcgtggctggcaagaggaaagctcaaaggggccctttgtcctcatccccgagtctgcgacatcccctcccactggttttcattccatatttggtctgtgggttttctcagtctctcgtacccctcagtccccaccagtccatgaatgcagaactacccctggcctcacaaatggccactttggataccctggtggggtcacaggctgcggttgcccctgcaaatggttggtagaagcacgggttgggaggtttcatttctacccagaagggcccttgctgtgcctgagggagggctgggctcaggtcaggggtgggagaccggggaaggggcctacaggtcagtggcccgagctcagctgcagcaccaacaaggctcaaggccaaggaggagatgagagcacatcaaaagggggcagtgggtctgggcggcccaccgcactcaccagcccaagaagggggagacttttctcacctgcaacccactgggtctctcctttggcccgcagctcaagaggtgaggaaattgtccgcctgcagatcctgacacccagggcaggactccgcctggtggccccagacgtggaaggcatgaggtatgggggtcctgctgctgtcctggctccctggacaccattctagagatggaagcagcagcctcaggtggcaaatgatgaggcctagggccggctctgccactgtagggccaacaggttgatgggaggcatggtcgacctgggttttctgccccatctcattctttcactcagaaaaccattatggagcaagcgcttagtctgtgtaagggcacaggcccgaccctgggacacagtagtgaacaggaccccctggctggaattgccatctgcctggtgggggaggcagacgccgacatgagcatgaatgaggtcagccagagatgctgtgtgccaggagcccctgggaagtgacagctcaaccctgccaattgctgaagatgggaccagtcagccgtgctggggatgttggtgggggtgggaggaggattgggtctaaggagcccgtgaaggccactgaggccattgccctgcctgtgtgagagggccactgggaatagagtggggtcactgggtcagagtccacagctctccatgccactaggctctgtgctggggaggggtgggtcaaggaggccacaaccagcagggagcacgaggggctcagcctctgccctggggtgggggtcagacagccaggtgacatgcaggcaggattcgggggctggggtggaggctaggagagatccgagcagggagactgggcccctaccttgtgaaggccagggactggggagagaagcgggagtgtacactgaaggtcatcccttaatccctggggtggcaggaacttcgagcagaggcctctcaacagtgtggtgggtgggagtgcttggggagggcttcctggaggaattgacatccaagatgagtcctgagcgatctctaggtccctttaccctcctccttggctcctcccactttaattctgcccccaaggcaccaagtcctgtccactttattttagagatgtttccatccctattgctctgcccctggcccaggcctccactgctactcacccagttgtctgcgaccgtttcctactgtcccatccctggactcccttccacatctacctgggtgatgtttccaaagggcagaagtagttatgccagccccctgcagaaagccctgcaaagcccctcccactatgctctgcagcctgaactcagtacctggccccacctgcaggctcctccctccctgggcctttctctgtgcaggctggaggctctgcctgagatgccctttcccctcttcatctttctgttccacctcaaatgtcctgtcttctgggtcatgtccttctcctgagtttcttccccaggcagcatctgagggcttgtcgattctgcatggcagcatccattctgcatggatgtagatacaatcactatgcccattttacagattaagaaactgagaccctgaatggttaagtaacttgctcaaggtcacatggtccagagcaggcagatccgctcagcctgccctactcccaccttccaccttctgcaccatagctcattgtactagttggggcagggagcagggggacagagaggggtgatggaaagacttggcatttgctgagtgaactcatttgacgagtttattcgtaggcattgaagtcaaaatttccaggagggaggtattttaaggtttgtgattgaggtttgagagagtgattagggctcaagagatttccacgttatatgcagacagaatagagctgaaatcatgagcgtaaactagctttacatggggctcatggtgagccaatggaagctgggcaccgacctcagtatgcaggtggcagccacctggccagccctcctggggacagctgggcgagggcagtctcttctcgccatgttgagagtgggcctcctgagggccagttgggagttagtgggtgtgcaggccagtataaaggagaggcaggaacaagtggagatccctgcttcaagggtggcagttgacaccttgggaggggaggagacagcccagcaagtggtggagcacgccaaagggaggagaaaaaggcggagaccaggaaggtgtgtggccagggaggtaggcaggtggtgttgacaggatcaagggaggaggggtggtgagaaggctggagtggcccactgggtcagcagtactgaatggtggtttgaaataatgatgggactgtctctcctggatttgacaacatggggctccctgaggacctgaaggagaacagaagggggcttaaattaggagattaggatcagggatatagtccagaactcaaatcccagctactcctcttattacctgtgaaatttggggcaaatcacaggggctttgtgtgcctccgtttgctcatctgaaagatgggcatgggtgataacagtgcccatatcctggggttgatttgcagagttaatgcatataaagtcacgagaacaggctcaaatgctcaatcaacagtagctattgccaggcacagtggctcacacctgtaatcccagcacagtagctataaaacaacaacaacaaaaaacaaaaaacagtagctattagtaatgaagttttgataattggccaatctgtcaatcagcagggtttgtttgtttttggttctgttttttaagacagcatcttgctgtgtgtgcccaggctcaagtgcagtggtgccatcacagctcgctgcagcctcaaccttccaggttcaacctcccaagtagctgggaccacaggcacacaccaccactcctgactaactttcaaaaatatttttgtggagatggagtctagctgtgtttctcaggctggtcttgaactcctggctcaagtgatcctcttgcctcggcctctcaaaatgctgggttataggcgtgagccactgcacccggcccagtagcaggttttaagctccgtggagacagctggcgtttgaggatgaggtaacagcccacacctgagtgtgaatggctgctgcatggttaacttccatttctttcctccataggtcttccccaggcaacaaagacaaggaggccccctgctccagagagctccagagggacttggctggtgaggaggctttcagggcccccaacacagatgctgcaaggtaactcagtgcaggaagcagacacttcattcccagaacacggagcccacatacacccagctgaaggacttccatggcctccggtgcaatgtcaatggatgcagctggggccaggaaggtcctgttcccactgttcccccagtacctggggtactgcaggtctttaatgaacatctgttgaaagaaagaaagaatgaatgaatgaggcctggagggaggtaggcccctgccatgattcctcagggagccagttagagagcaggaccaaactccagggcaggctatccccagctcctggcctgtgctgagttccttccattcccctgaagcttccacactcactgtgcttttactgcaggacaaagcagccctgccaatggccagggcaaagcaaggccaccaagctggcagtctgggagagtcagtgaccaaagtatgtgggcccccatagagcatgtagcggagactttcaggatgacccgtggactaagggagacattgtggcaaggggtgaggggtccaggacgggaagttggagccatagcggtggatgatgagtccagatgggatgattgtccccagtcgctgcacagccagcccactgacctgtcctccaagccagaccagtgccaaatgtgtctggtgagcagtggctgcaggctgggcatttcttcagtgagaacctggtagccagttacagctaagaacccacacacccgtcttctcagtgtggatccctggagcccctagctggaaccctgagccctggaaatgaggaaaggaatccctctatggcttattaccagacccacatgtcttgccccttgctctgttggcaatcagctccccccaccaccaacgaactaacctcctcctgactttccaccttgctcccaaccaacccatcaggtttggaaaaaatacagaaatacttcctgttagagtcaacttgggcttggctcagctctggtcagagcagcacagagtagcagccaaaggcctgtgcttctggtcttgaggcccactctcatggcatctgggttagatgagatcaaaacgcaactagagtcagcaaatactccacttctcataacaggtcaagtgcacagttgagtgatggcaatgtgggatccggagccacgggctcccggcctgaaggcttggctgcagtagacatcggctccgagagaggaaggtgagctgcccgggggaggcaggttctctcatgcccctggtgacagaccagggtcaagctgccaggctgcttgggctgctatgggtggggcactggtcacttcctatggctcctgtctactgcttctcccacactcccacattccaccacatcctgtgtccttgggctttccactttttggaatcttgttcatttttctgatccctgccactggccctcaagctcctccagagtaggcactaggcccactcacagctggaggcccagccctcacatggtgctggtcttgggctggtcaaatgaacgtgtagggaatacatgaagggacaaattaatgagtgaatgactgaatgatggaagagtcggcaccttcttacttcttggttaagctctgaggaccagctaggaggccctttgctcctgctttctcccttctctccttttcctgccccatccctaccccaggcagctctgctctgaggttcagggagaggaaaagcggtagccctggagagaccagcgtgtccagctgggctctggcttcttggacctggagggagtcaggggccactttctcaggtgatttgcagagtggcaaggtccctcttgtccctaagtggttccaaaccaagcctgaatcattcttggggcaaaggctaggtatgcagatgttggcataaatagtttagctccaaactatgctagagtccttctggttcagagcagatggctagggaggagtggcaaagccagtgtctgcaaagagctacaaccgcaagatatcatctgcctcctgcatcctactgcagtctggccaaggagggaatcctgtggggaaggccctgctgatgctttcctacttccctcagcacacccagggcccctttccctcactaacttcaatagtttgcaattcatgccatggaaccagagcccgaattctaaatccaggcccacaagtcaacacaggaaggggacagcaggtcctggcctctgaaaccactgtctccgagcaggtccaaggagaggccaccagagactctgttctttaagctgccactaatggggaggactccgctagagccctgtccatgcagcctgcatctttttgccatctgcagaggcattggagggatctttttaaaaataagctagatcacatttctcccctgctaaaaccttctagtggctctccattttccttagaatgaagtccaaaccctttcccatggcccactgggtcctgcatggcagaatctttggccttctatccagtcggggctcctgctactctccccacagtggtgcagcttgactggctctgctgatggctgtcgcggaagagacttctggtctactgtgattgggtggctctggtctcctccatgtcaccccgcctgcttatacaccctcataacatgaagcctgtgctgtccactgtttccttaaaatgaaaccaagcctcaaagttacttgtaaagtcatctgaagaatcttctagattttcatgaattttaacccagtcttttacagttgtcttacctatatagtagtccctaggtatctgtgggggattggttccagaacctcactcatataccaaaatccatgcatgttgaagtccctgatataaaatggtgtagcatttgcatgtaacctatgcacatcctcctgtaccctttaaagcatctctagattattataatacctcatacaatgtaagtggtatgtaaatagttgttatactgtattgtttagggaatgatgacagaaaaaagcctgtacatggtcagtacagatgcagccatcctattttaattatttttcccacatctcatctcatcctctcctctcctctcctctcctttttcagacaggaccttgctctgtcaccagggctggagtgcagtgctgtgatcacagctcacagcagcctcaacctctggggctcaagggatcctcccacatcagcctcccaagtagctgggactacaggcgtggaccaccacgcctggctaacttttgtatttttggtagagacgaggttttaccaggttgcccaggctggtttggaactcctgggctcaagcagtccaccgacctcagcctcccaaagtgctgggattacaggcatgagccactgtacctggtcccaaatattttcaatctgaagttggttgaatccacagatgtggaacccacaacatagagggctgaccacacttagtttgactataattttcaacaaactcctttattgtttttcctttttttttttttttgagacggactcttgctctgtcccccaggctggagtgcactggtgcgatctcggctcactgcaagctccgcctcctgagttcatgccattgtcctgcctcagcctcccaagtagctgggactacaggcgcccgccaccacgcccggctaattttttgtattttttagtagagacggggtttcaccgtgttagccaggatggtctcgatctcctgaactcgtgatccacccgcctcagcctcccaaagtgctgggattacaggcgtgagccatcgcgtcctgccttgtttttccaaaggaaaggttgtttctcatggcaacaaccactctccttttccattcattttcatggatttacttaatcatcgaacttagtgattcttctccattagtggcagctcaaagaactgagttgctgccccaggggcctttccttggatctgctcagagacattggtttcagaggccagggtctgctgtccccttcttgtgcaaatacaactggcataaagaggtctgggaccaaacaagagcacctcttagtgagtgtgctggttagtggagggcacaggcttgtataggcagtgattgttcagcatgccgtgagcatcagtctgcctggtttacagagacacagagaatgtgactccaccctgagaaggttgggtaagacattccccactaaatccatattgagtgggtgaatacaggtggactgggaaggtgcactgcttctataaacagccactgggccctgtggtaacaggaacacattagcacatgttatggcccaggcattattcaaagtacttggcatctatgaactcatttacttttctcagaatacttacgagacagacatgattagcatccctatttcattgatggtaaaactgaggcccagaaaaaaaggtcaggtaacatgcccaatgtcacacagctgggagatagcaaagccatgatttgcaacgccagagggcaaccactatgccacagagccccaggtgtcaggctgccttgagatataaatattgttcctcaagcatccatttgagcagcttcttggtcctcatcatctgtggggggcaggatccactttctcgggagagggtagacatacagacacaaagtcctgaacctggaccaggtctggccttctttcacaggctgtgtgcagctgctagctttgcctctttcctggaagaccaggatgggcacagtgccaactctcagtcctgcaagcctagaccagcagccatcaggtaaggttagggccactgccctagtgccctatcccattgccagacacagcctttggggcccagcctcagctgcagcaccccaggatccccctcgaacttctcagctccatgccactttcacatcaggtgatcacagcaagacagggaactccagggggagctctgaccaggggcagtggaagaagagggatgggtgatatgtctgctcacccagagagcccagcaccaacctacatggacccaagctgaggtggcagagaggagggcatctgaaggcagagcctgggaagagatcctgctaggaggtctcagagaacctctgctgtagggactacagccaggtttagcaagcaggagtcagggagaagattcccaggggcagccagcattagagggctcagttcccaggagcacaggaccggtggctgggatgggcaaaaatggctcctggggcacaaaggtacaatgggaagaagctgtgcattcccatgctgtaagcgtctgccctgtttcacccaccaatccaccagtgggcatggccactttgctgtgggtgtgtggagcatttggcaagtcctagtaaggaacgatctttcttaactcccataaaccctacagaggtgtaggtcaggtaaggatacgtcatgctcagggtcaggttccagccgcagctgagggctaaggggaatgggtggacgtggggcagggagctggaagaacactcgagagatagcaggtaaatgagacatggctttactcagcagcagctctcttacacagctttctcaaactagctttctcattagcagcttactctcacaccgtctgccctgtcttggctgcttagtccggtggcccctacgcacagctgcgtggccagctctcccttgccttcagggtcagcagcttaattctttctctccctgggcacgggcaagccaagctgtgtcctggctcccctctgtcctggctcccctctgtccacctgcaaagacagacagctcttgctctctctctttctctaggttcccgtgcacccgccatgtcaagctatgttgagctgagccaagccccaagagacatgtcccccatacacagcgtcaacagggcagttataccttttacagacaatagtggtttagagccaagtatgaacttacataaacaggttatataagaagtggaggtgtgcacctgtgcaccagactcattgagtcatgcaggcctggatatccccctctgcctattccttgaacaaagcacatccaggtaccttacaggatactagaacccaaaaccaggagacttccccagggaacccaagttggtcaggggcagtgtttgctcttgaactcaggtgctaaggccatgtccaaagctgacatgaggttgtcacacacagtggcatcggtgccacactaatgccaggactgagacaccagcctttactggaagacacagttcctccctttctggtgagaaggcagcctggagggggaagacctgggccccagccttctttggtctgagatctcagcaggcctgtgtttccttcctcagctccagtgccacttcagtctctgctgtccctgctgataggaagagcaacagcacagcagcccaggaggatgcaaaggcagacccaaaggggtaaggcatgagcagacagtgctgaacttctggggtggagagaggcagcttgggctgtgtgtccattggcctttggctgggaaggtgaggccagcaaggtttgtgagctggcctgaggcacatagcaagggcagaagccccaaccagaaccctctggcttctggggccagggagctttccactaaactgttgccttggccaggaaatacatcatagtcagaaagggtctttcagtcagcaaccactctgacagcaactgccttttgctggaggctggagcatgcagacaaatcagaaacacctctgccctccaggaactctcaggcagggggtgggcaaaggctggtccagattagagcaatacatgagcgctagagcaggggaagggggcttcatggggactgtatgtagctggatgtggtcagcgatgagtgtccttgttggggagtgctggaagaggaggctcagtgaactaggtagggcttgattggcctcttgtactgtgatattggagtccactgtgtgcacagccctctactcacagtgtctcatacggttctcctcacagtctctcaaaggtttatgcctaattacaacaaaacccaaaagcctggagcctaggtctctgtgcctcctgggaaggatagtgctccgaagaaaacagccgcagctgagatagagtgatggcagtgaggagggtactacttaggtgggtggaaaaggcaactcaggcgatctcctctaaagaggagaaggagccaactctagaaagaacacggtggagagagctatagataaggaaccacaaaccaactaaccctgaggtgggaacatgcttagcatgttccaaaggacagagtggctggagcttggccagtgaggagggccacagatggagcagggccttggtaagccatggttaagagattggatcttatttcaagttttaagccaaaggggagtctcatgtgatttaggtgtttaaaaggtgaatgcatgtttgcattttcataccacattgctgttgcttttttacttaaaccaagatgctgggggctggggtgggcaatggatatctaaggtatgaggccttattgtgtttcttttctcattcgaattgcactgacaattaacaatcagagtgaaaacaacagctgacaccaatactgtgctgtgctaggtgccttacagccttcccagcaacttgtgagatgggtaaggtgggaaactgaagcatagaaagattaagtgacttagccaaggccttacaagtggcagaactgagttccaagggaagaggctctaagaaaatcctcaggagaaactacgaaaaactagtttatgaaatcttgtctttggagcctagtctcaagacccagaatcagtaacttacagctggttaacatggttaacatgctgtgtgatctcaccttaattttccccaaacgtggaaaaggataaggcttcttattatgcaacttgacagaggagaaaattgagggactcactcctgtaatgaacacacttaggaacagagcccagatccagccaactctagagccaggctcacgctactttcctctgatgtttaaacgtctgcaaaatcagaggtgttttttttttttttttttttttttgagacagagttttgctttgtcgccccagctggggtgcagtggcgcaatctcgactcactgcaacctctgcctcctgggttcaaacgattctcctgcctcagcctcctaagtagctgggattacaggcacatgccaccacgcccagctaatttttatatttttactagggatagggtttcactgtgttggccaggctggtctcaaactcctgacatcaagccatccacccatcttggcctcccaaattgctgggattacaggcgtgagccactgtgcctggccaatacaaactttcttgattacagtgtttcacaactctggctgtacttgagaatcacctaggaagtactgaaatacactgttgatgaaaaaggccatactctgtaaaatatttgaagaaattctgagccaaatgttaggactatgacccgtgacacagcctcaggaggtcctgagagcatgtgcccagggtggttcacttacagcttggttttttatgttctagggagacataagacatcaatcaatacatgtgaggtatacattagttaggtccagaaaggcctaggtatacattagttaggtccagaaaggccggacacctcaaagctgggagtgtggtgggggtgggggtgggggtggggttccaggtcataggtggattcagagattttctgattggcaattggttgaaagagttgttattctctaaagacctggaatcaatagaaaggagtgcctgggttaagataaggggttgtggagaccagagttcttatataggtgaagtctcataagtggccgcccttagaagcaatagatggccaatgtttcttattcagacctttaaaaggtgctagactctcagatcagaaaaagtcctggaaagggaaggagattctctacagaatgtaaatttcccccaggagagacagctttgccaggtcatttcaaaatatgtcaaaaaatatattttggtgtaaaatacttcaatttctttcattacctgctgtctgtcatgtgatgctatactagagtcaggttggaatttggcatattattgcttcaaggagtctgttttgtcagtctgaatatctctctcaatgttaatactggtcagttgggcatgaattccaaagggaggagaatatattgaggcatgtctgaccttcccctttctcatcatgacctgaactagtttttcacgttgtgtccccttggctgagagaagtgtccattcattcagctggggagcttagaattttatttttggtttacaacacaacaaaaacttcccgaagtcccaggtagagatttggattttatttttctggggtgggtctccatcatgtgtctttttcaaagctccccagtttgttctccttccaggctaggtcgagaaccatcgttctcaggtagtggttctgacccaggggcatctcccaaagcttccagcctgctacgatacaatgtctggagccatttttggttgtcaaaactgggagtgggagacactactggcttcttatatgcagagatctgggatgctgccccacatcccccaacacacaccatagaattatggggttcaaaatggtaatagtgctaaggttgacaaaccttgctgtagagccttgacgatctatttgggaagacagcagggacggaaaagaaaaagggatggcacagaaccacacccctcaccttccccgaaatctgggtagcgggcacaggacgtgtgcgcctgcgcgaatgcgcgctcgccaccagcgtacgcgacgcgtgcgcgcctgtgcacctcggcgagcacgcgcccgtagtgagtacgcctgcgtaggccgccatttcttgaagccccgaactcggtcgcagtgcccgccgggaaaatgcgaccgtccacaaagtgaaatggccgcccgggacgagctcggcctcggcggggattctcttgaggccatgcccgtgccggccgccagaggtcgcccgaggatcacgaatgggcccgaggagctggctgccccttcccccgcgtaaggtctgaagccgcggccagagtggctttggggtgaccgcgcgtggaccgtcgccggcgggaggaagcgcggtcccgcgaggggccgaacggggcccctgcggcttgagcttgtttcgcagggagccctggggccatggcctctgggacactggacacgggtcgtcagggctgcccagggggagggggtgtggacgtgcagacagggaaggcagctggaccctccaaccacgctgggccctcgggctgaccggggctggtctgtggggcagtgaggaggggcttcgttccctaggagtttgatgagggagcgccatgggggtggcgtcatcctgacatcccgcagggcagtggagccttactttccctaggttacaacacagttttaactgtcccaaactgtggggactccgccctattccatcttgggccgctccatcacactacagggagaggcggtatagtatagtggttgagagcctggactctggtgctttgggttccagtccaagctctgtcacttacaagcaccgtgaccttgggcatgttactcatcttctctgtgcctcaggttcctcacgtgcggaatagtggtaatcatacctcctaccatatagggttgttgaaatggccaaatcggtttgtatatgtaaagcctgtaggacatttaaacctgcgagctaagtgaagcagcaccagaggaatatctcctcctctcagaggtgttcagggacacctggaaagctaacttaaccagctttattggtttgatttcatttgacatgacacgatatctcatcttcttcctactaaacttttgtcatcaaattttccatctagaacatgctgttttcctcattatgttgcaagcatgggcttctcgtttatattttttctgcatgaggatcaggtgaagtttaggcaccacatttcctcaccactggcaaccgttgttggccagtggaggcagtacaagggtggaagtgtcagctgggtgcagtggctcatacccacctgtaatcctatactttgagaggccgaggcgggaagaccacttgagttccggggattgagatcagcgtgggcaacgtagtgagacctcatctctacaaatattatctatatctatatatgtatatgtatatgtatatcatatatatgatgtatatctcatatatatatgtttttgaaacaatgtttcacttctgtcgccccagactggagtgcaatggggtgatctcggcttactgcaacctctacctcctgggctcaagtgattctcctgccttaacctcccaagtagctgggactacaggcacacaccactgcacctggcttatttttgtagagaggagtttttgccatgttgcgcaggctggtctcaaactcctgacctcaactgatccacccacttctgcctgccaaagtactgaaattacaggcgtgaaccactacgccgggactacaatttccgttttttaaaagaatggaagtgtgtagattatggttgtgttaggagttgacagtggctgtattaggctactggatctttggtccaattacactcagaaggaaaggcttcagagaaattaatccaaaatccaaaatcccgttggtcaccatcccctatgttaccttgcctatctctaaccacttgacttccaggaagttcatgaggagctcggacaggatagctgggaagtaattcccctggatgttacattgtccagcagagcttcctgtgagtgtttgcctaagatttcctttttatgacccacataggtcatatgtcctaaaatcacagtggccctgccacaggcctaggaaagaagaagccttgttcatccatttgtccctgtgtcacaatagagcccaaatttctctttgtggataatcctggctctatccacagacttggtgagggcaacctctactagtgtatttctacagaggacgtgggacaggacgggactctgattaaatccatagtaaagctaactcagggctaccacagtagggagacaagctcttcaggccttgtatgtttgtctttggctcaagcaagcatgtcactgacagagattgaatgggtgtgtcagggcaccctgctggcaaccctgggactggtgttacctgtgcagaccacttttggatctgcatgggctgcagcagaccctaagggtggaagcagcacagagaagcacaggcccagtgggatggttccccacagttactgtgtggcgtcacactcacttgcctgcagttctgcctggtgcagctggaggtggcaattagcttgttgtgcctgctggagaattttagttcccttgacctccacctgaggctgaagaatcatgttgctttcagggcatactttccaaaaagtgtggcctctgttggccttgttattccagcttgaaggcaggaagcctgcctagacaaagttaactcctatatacaaagagtcccagggtagtttgtagcgtgttcttgtctcggggtagcccccaccagctattgaaggtaggctggtgatgttgggaaggttatattcagagtgagctaggatcgaggtgatggcgaagtagattttcattctgaaatgctgggctcactctcttagtagcccaacttggtgtttgcccctggcctagtagactctggaagcagtaccttgcacctcggtgtggggctggtgatgggaggggtgtggaagtggaggatcagctagcagcctctttcccacggtacccagattggagggtgcagtgcaatcatggggtgaggccagggaggacccctgaagagctcgatgcctgagacatctgggggaagccctgtccttcttgctggattcaggggtggcaaaagccaaaaattggagggccaggtgcaatggcacatgcctgtaatccctgcactttgggaggccaaggcaggaggatcgcttgagaccagcctgggcaacatggtgaaaccttgtctctacagaaaaaaaaaaaaatacaaaaattagctgggcgtggtagtgtagacctgtagtctctgctactcagaaggctgagacaggaggatggcttgagcccaggaggcagaggttgcagtgagccgagatgatgccactgcactccagcctgggcgacagagtgagaccctgcctccaaacaacaacaataaaaacatcggaggcttcggcttcatctattacacatggaggcctgttcagtgagaagggagcagcgatgctgggctcctgccaaggaggagactgtctgctccctggaattggggctgtgcctggctcctttctgccccgctttcagggatatgagtccctccaagtccacaggaggtgacagccagcttgcgtcctggggctgaggcagggttagtttcagagcacttttttcataagggtgcttattcttcttcagggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcaggtaagggctgagctgcagtgggctctgcctctggagcccatgtttttgttgaggtctgcgacccacatgggaaccacttccccacaccctgtgccaatacccgacacattgcacacccaggctcctgttctgtgagtgggtcatggtgattccctggtcctagagcagtgtcatcaggcttcttgtggctcaaggagctgggaggggactgtgataggaggatgtgtctgtccccaggtgtgagaagccctggctaattcccaatgcatggggcaggaaggaaggctgtctctcagagtacaggtgctctacaggtgggggtcctgggcagagtgagggctatttgtgtgggtaaaatgccattgtcagagaaggacagagtgtgaaagagcaaaaaaacaggagggtaaaagtgcaaaagtgacagagtgaagcagagagagagaggccagagggagagaaagggagcatgtgtgagcaggcatgagagagtgacacaggatgtgactggccatgtgttggtgtgtgccactgtgcatgagcaagaggacaaacgtgcctgttactggagctgaccatgtggcattggtgtgagagtttcaagtcaggctctcttgaaggcatcttgcctgccagcgcaaacactgcatgtccttgcagctctggacacgtcaacaggccagtgattccaggggtgcaaagcgaacagtttcttacacaagacagaaatgtagaaggagagagctaagactcatattgccccgagagaggagctagtggaatccagcagggcatctgctgtggggagcaggtggagcctggggttccttttgcagggatgaaagaaacacagtcatctgccttctttgttctggggcttcttgtaccacagaggttccataattattaatagttaggttatttttagggcctagctcaactgttagataacaagttttaccttctaagaatatctagcccatctttgattccttggctccaggccctggagggtcccagtccaaaaacagagtgaacaactttggacttgctgtcacattgtgtggcttctagaactagtcagtgttccatgcagaaggggtataaaaagtgaggcttgtggatgaaggaggaggcgagtggttctgggttttgttttcgttttgcgggggagtgtcaggaaaggctttctttacagggagagtgatgttggagctgggtttggaaggctgagggagattttgccagatgtgccagacgtgcttgggaaggcattccgagtggaggctcacaaagtgtatagggaacatccagtcaggtagccatcacaaaggagggttaatccagcctggcttggcaggaagcaccaagtaggggctgggcaggcacctgctcctaggctgaggagtgtgacccacatcctgagggccttgggagccaccgatggttttcctgcaggagagtgccacagccagactcgagtccaaagaagatccctccattgccctgtggaggaccaggccaggggagtatacgacgagacaaggcaggaggccatattggagactgtttgcttacaccaggggcaaggtgatgaggctgcaagtatttttgaattattaaaggtaaaagcgggcttggcgtggtggctcacacctgtcatcccagcactttgggaggccgaggtggcagtatcgcttgagcccaggagtttgagactagcctggggaacacagcaagaccccatttctacaaaaaatttaaaaacattagccaggtgtggtggcacatgcctgtagtaccagctacttgggaggctgaggtgggaggattgtttgagccttgcacgtcgaggatacagggagccatgttcctgccactgtactccagcctgggtaacaaaacaagatcctgtctccaaaataaaaataaaaaaaataaagataacggtgagggaaaagtggtagccaaggttgctccccagatttcagggctaggcaattggatgggtggtgacaggaactagctgagggtaaggagtttgggggcaggcccgctgagagatgcacagagatgagaaggtcactgggccatgccgaatgagaagtgcctgtaggggctccagccagtgatgtccagtaggctactgagtaaacaaatgtggagttgagcaaagatctgacctggggctagagagctgggagttgtcagctcataggaagtcactaaagagaatgcatgaggttgcctggagaatgcctttggaaggcagtgtgtacaaagcatgtattctcggcttttctctgcagacttccagggacagttgtccagccaggcccttggctgggtgggtgagtccacgtggttcagggatgctgagggaagctgcttcatcagctgacatttctctccattttctgctcttcttttgtctcaaaaagaaaaaaagaggggatattaattattgatcccctaaaaccctagctgaatatataaaatgaaaagaagtaaaaatatgagagaagcaaaggcagatggaccataattttggaaaataattccaaaaggtcttaaggaggaagaggagctacagagaggtattgagaaggaaaattttggataaatggaagaatcaggaaagactaccgtcatggaaaccaagccacgctgagctaactttccagtgctctgtagatgctgaaataggcccatcagatttggctatgtagaactcatgactgccttgaggggagtaggttggggcagtgggaaaggctgtagttggattataatggattgaggagggagcggaggataagcaggtgcagttgatggggtacacactctgaaactggctgtgacgtgatggatgtgggaggggtgagcagataattacagctacaagataatggggaaggtttcctataggtgaaagcaacgtgtgcatgttaggtaaaggctgggcagagggtgcctacgtgaccagtccccgataaaatccttggactctgagtctctcatgaattgccctggtcgacagcatttcacacttgttgtcacaactcactgctgaggggaactgagtgaatcctgtgtgacccactgggagaggactctggaagcttgtgcccgggttccctcagaaatttgccttgtgtgcttttccctttgctgattttgcttcgtatcttttcactataataaaccatagccttgagtgtgatgatgtgatgtgtcctgtgagttcttcttgtgaatcaccaagcctagggatggtcttggggacccctgacacagatgggcaggatcagaactttatgccataacaaggactttagattttctttcgagggcaaagaggagccaggaaggtttgaagcaggggagtgatatggcgagagtattgctttgcaatgggatctccagtggcagtgagaagagtgactgaagtgggcagagtggagcagggagaagaggaagtgcttacagcatcctccatgtaagaaatgatggggcctggactaggggactagctgtggagatggagacagaactgtaaaataagtagaagagatcccaaattggatgacaggtaagacttgggagagcagtgacggagagggaagtgacaatttagaaagccacatttctggtcgagtgagtggagtatgtgacccctcctggcttaggtggtggccaaagtatctctaacctgcctctatactgcctgcaactgactgagcaaatgcctggtccgtggagatcccaagctgacaagggcacctgaggcaagcctctggctttcaggtggaggccctacctaggctggcctggctggattgccctggcacactgctgttttgctgaggcagacagcagcactctgcaagtgctcttctcctgttcctcttagtggtctaaatcctgtagcatgctggggtgcgactgtagacaaatcccctttccgggccccctggggttctctatttgcagtctttgggtctggtcactggcatggcatctcagtaggctaggttcatcaggaagggtcaactatgtcatggcacctgatgggcagcatttagagtctgtgggccaggggcttaagggctgcttactgctaatagttctaagtagcaagcattccctcagccctagtctgggcacacgccaggaagaaagccactagatgtgctctcctagtggataactagcctggagttccaagaagggcagagacaggcagagtgagagccttcagagatgtaggcaacgatagtagcagaacttcgagggagagtagatggaaaaattaaaaaaaatccttgtcattatttttaaatgtctgaattgaccagattagaatctttgagagtctagacactagggagatctcatgggtgggccagttattatatcatatggagggagagtacgtatgacccagcacgagaggaccagaggacagtcagtgctaagggtaaaaccttaggccatgggagattgagtttttcatcagttggcaagttttcactttaatactccactgtttccatcatttcagacgactggggatgataaggacaatgtaatttgggggataaaggaagaactcattatatttcttggatgactttactggggaaatggattccttagtcatttgaaagaagcggtagaattccacatgtggggaatacttgttctaacaaaagcttaataacattagtggcaatgatccttttatataagggaaagcttcaagccagtgagaaaaacataaataaactagtaagaacatatttataaccatgagatttgggtgcagaataaaatcaaattggcagttcaggaaaggtcctaaacatctgtatattaacaatattccatcagtgagcaatgtgaatttcccataattgaaatgatgattgataaccttgtattgttcttatctaatataaggcaaagcagcactggggctttgataaagagcaatatctcatgtacactgaggacactgaaaccccgctaggaattctatggaatttctaaaatatttatattaaggacattttacccattatagactaatttagggaaggttctgcattttttttttgatttgacaatgtttccaatgcaatttatacaatattaaataagactaattagtttttgcacctttcttgttacaaggtgaaagaactaatcctttgagattttccagaaggtccctggcaaatcccaaagccagttttaggtataaaatatatttaagttttgattgtgggaaggcaaatgttaagagttgtcaggagttctcgaacatttgattgaatagcattatgggttagcgagaaatactacttggttagctagtgaatcagagttgtaaaaattttcaagtaaacatatgaggtaacatggttgtaaagaatcttcagttcctttaaaattgaaaagactttaaaaaaataactaaggacataataaactgaacatacagatagggcattacagtattttgataagacataaaatctttgcctcttaggcagatgactcagaagaaaaacagaccatttataactttttattagggacagaccaatgatcaagaattttttttttttttttttgagatggagtcttgctctgttgcccaggctggagtgcagtcgcgcgatcaccatgttggccaggctggtctcgaactcctgacctcaggtgaactgcccacctcagcctcccaaagtgctgggattacaggcgtgagccactgcacctagcctaagaaaattttgttattttaacagagaaaccaacattttaattttatacaagtataatatttgatattagttcttttttgaaaatcttataaatacactgaataaaagttttaaccatgacaaataaaattccttttctgtgaacattttctaattttaaagatatttgtttacattttgtctcacacatttttaaattatttgtcattttaatttgggacaaagctattctctttttccttaggaaaagcatatttgcatacaaagttgtttccctttgccatttttgccattattacttttagcagtttatatatatatatacacacacacttatttacttattataattttaaccattaataacttctctttcacagagaaaacaggaggtaggtaattttgaaatatcatataccagcattttgtagcagactagtaaagcttatgaatatacatctcataactttttatagttgttatatactttttatagtaccattttgcaatgtggacaaatgaacacatttaacagatccatatgtagtcacactgtaccataaaaaaagcaaaaagtatataaacttaaatttaggtctagtgactaagtattttatcttctttataaatgatatttaatgaatttagttaacttaattcagcataagtctaaggttttaagttaccaaaaagattttagaaactgcctttaagcttacatattataaaacataattactgttgaaataaagtttgccagaataatgactcagtttggttaaaagcaaatttaaatttttataatcttaaacatgtagtagatataatactagcttattcaacatgtaaacctgtttaagtttaggaggaacatacccaagtagagtaaaaatatatgcttgtattctgttgtattatatgtaatgctgataactcaaagacacataggtgtctattaaactaacaatattaaactagttttgtttgccaaaagtttacataaattctgtgaacttgagttttaaaagcatttgggttagtttttataagaatacttttttgttgtttacactgaaagtattagaagttgtttccttaatttatgagagctttataataatttatataagtacttatttatctctaagtcaattagaatagaggataagggattttgtaaattaatttggtaatgccatctggaggtactgaactattacacatatacaacatacatgtatactaaacatacagacagacacaaatagagatctaatggcgagccctcaatgggtgcagggggcctgaagctctactggctataggcagttgagagggctgagtgggaaggggaaagcctggtgaagagtagataggggtatgtaggaggtagaggcattgaaggggacagatgaaaagattcagggagctgaagggaaggtccaaggtggtgaaaagaagggaagagggatgcggtaggaagatgagaagggggaatcttagatgagcaggtttggggagaccccaggttccctaataaggtcactgaagttccaaattacccttcgtgattactttttttttttttttttgccagttttggaaatactggacagaatgagtgccataggggcagggcatgtagtcagcaagggaggaggaggaggatgaggaggaggaagggcacccagtagattgagagttacctgtgggaagaggcagatcaaatagagaaaggagccaggctggacagtctcattaggaagttctgcacacagtcgtcatctgggagccaaagtttctcttcagtcctcattgaggagctgaagggctttccttgtgcaatctctagacaaggtgtcaagggaaacaatgaggcctcacaaaagagccaggaatttggagtaaatctccactcaaaaggaaccaagaaaacttctatccaggacgattctggctaaaattgaaaaggaccaggaagagtcctgctcaacagagtcaggggttaaatccccactcaaaaagagctaggaagagttctgtctgcgaagattcttgctcaaacagaaaagaactgggaagagctcatttaacagaatcaaagtaactgaatcacagaaccataaaaagtgtccaataaaagcaaataccgtctctgggcagggtgcaatggctcacacctgtaatcccagcacttgagaagctgagggaggaagatcacttgagcccaagggttcgagaccagcctgggtaacatagcgagactcctatatctataaaaattttaaaaattagccaggcatggtggtgtgtgcctatagtcccagctacctgggaggctgaagtagtggaggattgcttgagcccaggagttgaggctgcagtgaactattattgcaccactgcactccagcttgggtgacagagcgagaccctgtctcaaaaacaaaaaacaaatatggatttagatagagacttttattttattttattttattatttttgagacagagcctttctctgtcacccaggctggagtgtaggtgccatctcagctcactgcaaccaccacctcccgggtttaagcaattctcccgcctcagccttctgagtagctggaattacaggcgtgcgccaccatgcccagctaatttttcaatttttaatagagatggggtttcgccatgctggccaggctggtcttgaactcctgaccccaagtgattcacccgccttggcctctcaaagtgctgggattacaggtgtgagccaccgtgcccgaccaatactttatttaaaaagactattgcaatagggacaatgctgcaacctcaggacttgcaaacatcacaaaataatacaaaaaacatcacaaaataataaaaaaaaaaaagcctttttttttcagtagggagtagtaagcacagctagcagctcagctactttcaagggccagtgggcaagcaaaggggaacctgtttggcatgatttgaccagaaatgtgtttccctgtggtcagccggttctcaggagaagctgctaagtggggcatgttctgcattgcagcacttacttaaccaggagcaagcaaaattcaggccctgtggggaggacagaagcctgcctaacattctgtcaaggcaaaggagagggtaaaaagcagacagctgtgaacacttgatcatccttcaggcaataatccattctgggtttctggcttaagactcttgagaaacaaggggaaacaactggtaggagcagcaggctcacctatatgtagttccgtgaggtagccttatggacttctgccaccttccaaaactcagcatgtcccaaaccatctttatcaacacagcttctcaccaaaaacaaccaaataaaacaaattaactaatgtactaattctgtatctccccctgtgttgttcatctcaaaaaactgttatcacctcattgactcagactctcaaccagcgaggtagaagaaatgtttgggggcatgttaaatgtaacacctatgagacatgtaagaggtgaggtgcaggacgcaggtacatggtgataaaagaaaaacctcagccggattaaatttaaaggagtttcattgagcaatgaactatttgtgaatcgggcagcccccagaatcacagcagattcacagagactccagtgcagctacatggtggaagatttatagattaaaaaaaaggtggagggggggaaatgacgtacagaaattggaagtgaggtacagaacggctggattggttacaggttgggggtatgccttatttgaacacagtttgaacactcaccagtgtatgaatggttgaagtatggccgctgggattggccaagagttagctattgttacaggtacacactcctaagttaggttttcaattttgtctgcctctaggttacagtttattgacaaagactcaaatatagaactatggagtccttctcaggccgtatttaatttgctttaacaattccccctttttggtcattttctcaactttgagagattgacaaaaaccttagttattgatatcactattacccttgtaaatgtacttatatggtcttgaaacccactgggaaacaggaggacagtgggttttgtaaggagagaataaggactgagtagaaggtacctctttatgctagaatgttctgtttacaggacaaaaacaaaacctggtctgttttaataactatttgtttccttaaagtcttagtttgattatgttacatttagcatgagcaactccattttgtttggtttggtctgttgggtcctagtgcatgagctcagtacacaacaatggcttgccagaattttgtttaaaaaattccccttggctgggcgtggtggctcatgcctgtaatcccagcacttagggaggctgaggcgggcagatcacgagctcaggagatcgagaccatcatggccaacatggtgaaaccctgtctctactaaaaatacaaaaattagccgggcgcggtggcatgcgcctgtaatcccagctactcgggaggctgaggcaagagaatcacttgaacctggcagtcagaggttgcagtgagccaagatcacgccactgcactccagcctggtgacagagcgagactccacctaaaaaaaaaaaaaaaaaatatttccccttattggccaggttctcacttaggtgagagtgtgaccaaaacttagggccttagcaccacttttagttacctagttaccatcattttaggtttccagtctcagcatgtcattcataggttatgatgtcctcataatcatacatttcaatcagttttgttattccagttgaagagagaccatttgacatttcagagatggctgcatgcaaacatttgaaacctttgagagaatacagtgcactggggagactactatgactaccagtaggataatacccagagtttgaagtatgctgtttacctgaggtccccataaaacaaactgcctaaattaaataaaataaagaatgagctagacgaagagtctactcacttcactaagtgatcttttcattaatcctgtatgactgaatttttataatctgcacttgatatacatattagaattttagaaaccccatataattttggaatatatattaatataattcactaaaaatataccctgaagattaaacattatttttattggccaagcgcggtggcttacacctgtaatcccagcactctcggaggccgaggcaggcggataacctgaggtcaggagttcaagagcagcctggccaacatggtgaaaccctgtctccactaaaaatagaaaaattagccaggcatggtggcatgcacctgtaatcccagctactcgggaggctaagactggagaatcgcctgaacccaggaggtggaggttgcagtgagcagagatcatgccattgcactccagcctgggcaacgagggcaaaactcagtctcaaaacaaaacaaaacagtatttttattttgacaatgcctcccatgatttttataccaaataagccaaatgtcactgttgcattagtgcattatcgatgtcaaacccaattcttaaataaaaccttatagacaaatgtattcaatcttaatcagtttgaacataaggtaagaattttataaaccttttataaccctttacaatttttgttgaagagcagattagtgctctaagaaaacctgttgtgcttttatgtccatgttcaatttatggaaaaacctaataatacccttttaaatttagtattatcatacataaaattttttacaaggttaattttttttttttttttgagacggagtcttgttctgtcgcctaggctgacagtggcatgatctcggctcactgcaacctctgtctccccagttcaagcagttctcctgcctcagcctctggagcagctgggactacaggcgtgtgccaccatgtctggctatttttttttttttgtatgttagtagagagggggtttcatcatgttggccaggctggtctcgaactcccaggtgctcaaaggaaaatttaagacagtccatggaggagaaaggtatagacaaggtcatgcagatattaaaccagaaaggacttatttcctaagccaggaatcgaacccagactgccactgtgaaagggcaaaaccttaactactgagcccagaaggagtctagagtagttaattttgagcttgcaaaggcttttaactagtcaagataatttttagaactaactatgatatgaaccctaaaattcctgttccctggaaggtagagacaaggagaaagtactgccacatggttacaaggtcaagctcccaaggacataaaacaggatggcgaccttgtccagttttttgttggtttcagggacctgcagcaaagtttgtcactgaccagcttgctgggccatcttgagcagcaagcttatgggggcccaagcccatgttttatcctaaggtacccctcgacacagaaaaacgactttatagcacaaaatataccagattgactacagcttaagactagacagcctcagaattcctttttgcattaattaaaattttacagaggagataaacagtgattttacaatcagtttgcacagagagagagaagcctgaaatctgactgggaagagatatttacccttttgctggcatgccaggcttctgggctccctttccctgagtggccctggtgatctggctctctgcaccattgccccgggagccaagccacaacacaaaagaatttttttttaaaatgcacttcagtgtgttgttgttcatttggaatgttccactgtaagttatctttcgtaagatgtcaccatttctgtaagaatttgctgcctcccgggcgtaatgtgtaacccagaaggaactcagttttccagaagcaattaataggttccatggaatgttgatggtaagaaaggaaggaaaaggtgacaagagtgagcgtagacagctctttctaaggagtttggctgctggaaggggaagagaagcagctggggttaggtgggaggaactaagtttagagacgctaaaagtgtatgtagcaggagtcacctgatcaggttgaactgcagcaggaacaaggaagttccattttgactactattagttgcaaattggacccttatgtcaactttttcatctgtaaaaaaaaagggatggccaggcacggtggctcacgcctgtaatcccagcagtttgagaggccgaggcgggcggattgcctgagttcaggagttcacaaccagcctggccaacaaggtgaagccccgtctctactaaaatacaaagaattagccacgcgtggcagcgggcgcctgtagtcccagaatctctggaacccgggaggcggaggttgcagtgagtcgagatcacaccactgcactccagcctgggcgacagaccgaaactccgtctcaaaaaaaaaaaaaggggggcaggggatgaaaatgctattgctttccaggaatagctatgactacttccaataaagaagacaagaaggttccacatgtgaaaactacgcggtcacaacgataagtgggcgggtgcacgcacgcgcgctgagatcgtgcgtgcacaggccggggtgcggccggcgtgagtacgcctgcgcgtgccgccatttcctgcagccgcagactctgcctgcggtgctcgccgggaaatgagacgatcaacaaagaaaatggttgttttgggcgagatcgaccgtggagaggctttttctgcagcagtcccggttcctgccgccagatggcgctcgaggatcacaaatgggtctagggttctcataatggccccgcctaagaaattttggattctcctggcccttcccccctttgtggggtcaacagcggatttgggaatctggtgaccaacacgtgcgcactcccctacccttgcccctaccgagccctccagggtagcttgggggagaagctcctccctagactgccgggtatttgatgagcctggccagcgcacaggtcttgagcaccatggtcagggaagaaggctgaatggcttaggtcttcctagagaggccggaggcgggaaagaactggagaaaggagagatggcagtgggaggatggggacaagaataccagtgtgtttccagccagaagacgatgtcttttaacacctcattgaagtcgtcaggtgactttgcccttgtcagaaaggagcagcactgcgggggtcctactgaggaggagactgactgctccttggggtggggattgtgcctccttcctgtctgccccactcttggggagatgagtccctccaagtccacgagacatgacagccagcctacctgccatgggagaacaaagtctagtctcagggcactcacttcataagggtcttattcttcctcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcaggtacgagccaaactgcactgggaccttacctgctagagccagtgtttttgtccagggcagcaacccaggacaaacccccacacactaggcatgcctgtttatcctctgcaggtgagtgtggttaggagccagagggaaggagagaaaccagcatctcaggggtagatattcatgggtttcagcttggagccatagcatcaaatctgttagactaagtctggcacagaaaggatgcacagagaaccaggttgtctggcagccagttcgaacctggaaacctgggtcaggggagggatataggttgctttttctgttaatggagatggaaactctctgagcaaggtgtgccatggtgtggatgtgattcactgccagaaataacaactgtaccagttggatgagctcttccactgccatcagcactgggatggccatggatttggacagtaatgtagctccacagtgctgactcagggttgctcattgattgcaagaagttggcagcagtagcctgaggaaacaggggctctgaattttctgagagagaccaagaaccaaggaacagccaggtactagggaacagacaacaccagatgcttgtgcttttctgtgagcagctcaggtctcccaaagtggtagtttcctggcttctggcctttgtagatcagtgtggatccacacccaattgtgatgtttgtggtagctgtaagaactttcccaattttgaaatcctaggtgacttgtagcatattttttcacatttgaaaataattgagttttgaaaatgtttttacaggcaatctagtatcagattttatatcatcctgaaacattctgtcaattgtcatttccaaaaatccatggaaaactggagttgttgaactggaaacagtgtggtctcaggaagtgcttcacagccattgcaacatgggcagggcctagagggcaggagagaatgccatgatttgatgacattttacccattcctgccaggtgaacttcatctccctctctgtgacagaattttctggctctcacatccagctttggtcactgggaacccacctattggctcttgcactggcaggacatgtggtagaggcttccagttcgaggcaggactggctgcattttcaagatgtccttatttctggtattttgtggcgatcgtcctgtccacttaactgattttgacccattgccttgctgtgatctctgtgctctctctgtctcccagttccaggtcattcccttgaccagcttccagtctttcctcatcttgtccctgccaatgaagtattctggctctgccttcactctcctgccatgatccattgctttgatagggtggcttcaggaacagggtgaggagagggctgtgctagctttatcttgccaaggaactcagcaaagaaaatttttgctgacctcttgcattcctcagcctggctctggtctctcaaacctaacacatgggatgcatgccagcagccagcctcagtttccctctggtccttttctgtgtgaggccagaggtccttgctttatcactgcctggagctgcagttgatgatggtgaaagaaggtgcacgtgtcttttgagagctccctttgttccccagagatttttttttcccaaagtggccatgagtttgggaataaccaggagccatgggccgccggctagagatgctgcatactaagagcctcctgtgagcagccatgtacacagtgaacacgatggctaaggccccatccagccgccctcaaagagcacatagtccactaaggaataagcatgatcgtaataaccattagcacctgctgtgtgctgagaatgtgcaggcactgttctgcatgccttatgtggactcactcatttaattctcacaccaactcaaggaggtgcttttattatggagaaactgaggcagatggaggttaagtaatttgctggcagttttgcagccaggaagtggcctaaccgagattagaatccagacagagatcagagcctgtactgttcatcgctgtggcatccatactgcccctccatttgtgataagcccaggaaggaaagaaaccaggtgctctgatggagaggggttagagcaaggatggttagggaaagcttttctatcgaggaggagacagttcggctgagacctgaaacatctggaggagcctgccttccaaagaacctggggagaggcattgtggacaaagaagatagggaggagggcctgaacaatgagccctgtgcttggagggtacggggtgaggtgagcagggggcaggagctgggccctgtagggtcttgtaggtgagggagaggaggctattgggagggctcctattgctcacattgcagtcctggggggatgcccagggcattttttcttttttttaagaggcggtgtttcactgtgttacccaggttgtttttgaattcctggcctcaagtgatcttcctgcctcagcttcccaagtagctccagggaatttctgttttaccttgcctcttcagttgcgccgtccccttcagtattctgctgacatggatcacaggataccagacacctggtagttgttcagtcagtaggaggtcttccttccttcctcttagaatcaatccttttctcacttgttggctctgcattttatcccccgtgtatcttttcagatttttgtggggcctcctctcccatccagtccaccttctccagtctctatggtatatttctttgtcatagggtgaagcaggaacaggtacaggatgattgggtacactgaggtgaggtaggagggcaggccctcaggaagggcttcccagaggaggtgatattgtctgcaaaggcatatgagagcctggaagtccaggggaactgcaggctggtctgtacggcttgagtggcacgtgatacagtttgagactatgaggcgagagagctaggcagatgctagaccatgattgttcttccctttccccactcttcaactagttgtaatcttaggcattggattctctggcaaggggacaatacccagtagcctgggccagatggaggcagccatatctggagtatgatctgagccacagcatgttggagaaaagccagaatcagcccagggcagtgtgcacccatagtgctggcctcaggcctttggagggtgagcagacttaagttggaaggtgcaaacaagtggtcagtggtgctgcccaacatcgtgccctgaactgcagttgacagctacggcagctttggtaatgaggctcatagcctgggggcaggcagagtgagagccgatattggcttggccagagaaaagcccttttgggctgccgaggaggttggattccaggccaagggccatatctggcagctgaagtgtggaggttcagaaaaacttcgacaccggtcagtttcccgcctctgctgggaatgaggtgcatctgactttcctcctcaatgatgcctaatttcatttggtcctctgccccttggccttgtgttctctagagagttccctgcagggtggcagaaggagctgatcctagtaagggaccgtcccatccagtgaggaggtgagctgggctgtgtcttccccttctgcaccctcctgactgtcacatccccgggagccccatgattccactctaactgagtgaatcacagaggccaaggcccttggctgcagtcaggagtactgagtggacactggaagattggggtcttgctactgactcacgatgtgacctgggacatgtctcaactcacctagcctgggtttgcttatctgtaaagtgagaagttccatttgttggtcttggaggaagcttcaagagcagtgctcaagggttaggctcagaaaagcctgtttgaccctggaaggtgtcagctcccaggttgacgtgcccacccctccctttatttctttcagggtgaggagcccctcgagctgcatggtcactgttactgtcactgccacatctgagcagcctcacatttatattccagcccccgcaagtgaattggactccagctctaccacgtaagaagggctatctagcaacctgggagatgttcctccgccacttcctccttggcggtaaaggacttggcttttgttccatgttgcttcccatttagtgccttccccagtttctagcaggccattagccaaggggccacacaggacagtgttagtcccctaatataaactcccatctaccgggcctagacattcccacacctcctttttcctatctctgtaagaggctgcagtggtacttcctagtgcactagtggatgtggctctgccattcatgggtccatgcctgggaagccagctccagtccgtgaaggccgggcctgtgagggcattcctgtgttactgtaaaggaatacctgaggctgggacatttataaaggaaagaggtttaattggctcacagtttggcaggctgcacaagcatggcaccagcagctgcttggcttctggcaaaggcctcgggaagcttataatcatggtggaagccgaagtgggagcaggaccatcacatggcacgagcaggaacaagagtgaggaaggggagggcccggactttgaaacaaccagatcttgtgtgaactaactgaatgagaactcacttttcactaaggggatggtgctagctgttcatgagggatccccccatgatcccgtcacctccctccaagccccacctccaacactgggaatcacatttcaacatgaggtttgtctgtctctgtcacatgcccactgcttcacctgcattcctggccacctgtcagggtgcaggaagggatgtcactgcaggaaggctgctcagtgaggtgtgtgtgttgggggcgggaggggggcatatccaagggggcctctgcagacatcaggtcagcaggctggagtgtgcagcatggaaatgggggaaaatttggggccatcctgagcccagcatgatgcagaccttgtttccagtcctgcagaggccagtccaggatgaggcaacctctaggcctctggactctaggagtgagaatggagaggttagatgtgaggtggagattgcacagtagctgagtaccttctgggaagtgctgagtggtaaagactgacagtgtaggattaaggcttggaggatatcttggttgtgggtagaggggaaagacgacgcagccctaaagtaggggtggaaagcccacaggactgaagtgtagaagtatagaagcctggggagaagatggggtcaccgaggtctgcatggaggaggacagcacattgtcattggttgcaggaagcccctttctggggccctcagtccaaacacaacaagagacgctcatggcctgggattgtagtctgagtccacagcagtgccagtgcctttatcctgggccttcccatgagctctttcacttccttcaaaccaggctgggtctccccagccctgaaccactcctgtgggccaggcctggttccctggaatcttctggtgtacctctgatttcttctgtgctccttctacagcaaagggattctcttcgtgaaggagtacgtgaatgctagtgaagtgtcttctgggaagccagtatctgcacgctatagcaagtaagagcgggtcccaaacccttccatgtcggccttctcctgccggctcccatattctcatccctgcatttccagttccttgtccaggacttggctcagagtagcttcggggtaattgtcgagtggatgagtgatgtagttgccctctgatgggattgatgcattttctactgaactgggcacctttgggttctcccttccggtgaattcatcctgcacaccattttcactgccattctgttctgcttgtctttgttattttattttgtaaaatgctgagaacacccctcttgacagagctggcagagccctagggaccaactagctcatcctatttcttttcagatcacagagctcttctcttctgccctcatgttcttttctgtcatgccaggctgcctcatttgaacacacatgtgactgcagttcctgatacatgtgtggctttgctttttaattttaattaattagttaattaattttaattaatttttttttgagatggagtcttgctctgttgcccaggctggagtgcagtggcgccatctcagctcaccacaacctctgcctcctgggttcaggcaattctcctgccttagcctccctagtagctgggattacaggcgcccaccaccatgcccagctagtttttgtattttagtagagatgaagtttcaccatgttggccaggctggtctcgaattcctgacctcaagcaatccacctgcctcggcctccccttttcattgatcatctcttcattttcttgctttgtgatgccatgtggaggggtacttccatgtcacctcggtgtattgctacctaccacactgaggtgaggtcccttagaatgtttcttatgacatgtcatctcactggaggattttagcaacagagaggagcatcctggccttatttcaggattgggcctctggggcttctggactggcttttattggtgctgtggaatgatgagcatggctgtgggggtcaagttcaagccccagctcaggcccccctgttaggatcacttcggacaagatgttcaacctctctgagctttgctttcacatctgtaggcccttagggtggtttttctcaacagcttattgagttataattcaccctttaaagtgtacagtcccgaggttttggtacattcacagagttatgcaaacatcattatccaattctggaacacctttgtctccccaaaaagaaactccaaacccgtctgcaccccctaattctaccccataactcaagcacaggtattataccagaatgatcccttctttcttctcattcccagtatctgatttctgctgagtgggctcctggtgactgtcacattatatcataggtggggaggaaagctctgctgttttcccactggtcagtggggtccccttggcatatacaacctcaggaatcctagccacccagccccgatcatctccctcattgtgaaaggtctcctttgcccccccatagaagggccctgtggcaccaagtcatgaatgacgactggcatcgtagttatgtctcagcttgtggccaaaggttaattagaaaattaactatgatagtgatttggctctcatctctgccctcctctcccctatcaaactccctgcagcgtcagcagcattgaggactcattcgccatggagaagaagcctccatgtggcagcactccatactctgagaggtatgttgactttcttagcacggagcttgcacttctacagaggagaatcagggaagggagagttcctgctgagtctgtttgcttttgtcttctgctttgcagcctccaatccatttgcagaaaggtgaaggacactaccgtagggtggtgcttcccttgttgggatatcacacttgtgacaactaaagcctttgaattgagctaagactagagggtagataccagcggtgactgagaagggaagtggtggcatctgacaacccagaggactcgtgtcagcaggaggggcccttcagattagaacctaatcaatcacttcattaacttgcaaatctaaccagaagtaaaaataaaatgactacaaaagagaggagtgggcagagaaggaagaaaaatgggctgctggcatcaagaagccagaaagacacacaaagccaagaatgcccagtgctgtggagccaccaaattgaaagcaggggcagagaacacctcgttcagcagttttgaaagctgtcactagatgatggcacagtcactagagagtcttaatgacaaagaaatcttatgttcagattcttggaatggggagaagagagtctcagagattgagttcactcaggcttctgtgaagaaaatggaataaatagccttcagtccacagtaagcaaatacggcagacccaggactaaaccccagggccctgactactcccaggttagggatgtttctactctgccatcttgcttctcattgatgggcagatcttaattcatgtggatgacattcagagaccaaagctacattggggaggaaaaggaaggaagtaagagggttaagataaagagaatcctaccgggccccagaggcaaacatataggagcagacaagcatatggggccagggaatctcctccactatagctgaagaagcaggtggttctgagtaactacagattacttggtgaggcacatcagcagatgaagtcttagcagagaagggcaggttggtcagaaacctgagagttaaccacttacataggagcaaatggaatgaggcttccaattctagtggagtgacaaaccagatactctagggacccccctttccattgcacaactactaaatccagaatcagtcattactgatccattgctaggcttggaggaaggaaggggactctctagggacaatctcagtcacttgcacacatgcatatgcacagacacacatgcacgcacacaaagaacagctgtgagctggtgctgctggtggtgaaagaagcaggaggagcagggctgcgctgagggcaaggatttcaagcagcactgctgtccagagtgaaccctgggccagcagcaggatggtgggccacacccaagctgcccgtgacacttctgggtcctccgacagagctaacgtggatctagattgttaatgtccccccgccccttgggcttctgtcagaagcagacccaaatctctggaagaaagtaccctgaattttggcttgtaggatcagatcaagcagttactttgaggaagtgcagtctgaggaagaaaagcagaggtgactctcagaaacaggcatcctggaactggaaagatgctcaacccaggagtcagtatctagaacttcagtgtcggatctgagtaggctctacagacagagcatgaagggtgggtccaggagtataggcaggggcagagctcagttggcccaggcgtgaggagaagggccatcaagacggggccaggcagggcacacaatgacatgtctcctgtaggagaaggcattggtcttcctgctctagagggtagcaggccccagcggataatctaagcagaaggtcagggggaggcaaactgtctggaataagtatcatatcaggacatctacaggagacatgtcattgtgagctggaaaaagatgcatgactagtttttggaaataatgcagaggtctacagcaggctgagaactgatctggcccagggctgtgctgcacaccacagaaaacagtggcatcctggggatcctgacagcaaacctgggcctggctgcaccaaattggaaggtctggctgtgtcacatcagaggtctgtacaccagcctgaccaccgggttattgttcttcatctcacaggacaactggagggatctgtacttactgcaaccgtgagatccgagactgtccaaagattaccctagaacatcttggtatctgctgccatgaatattgctttaaggtaaaaaagaggtggaagacaccttgagctaggcggtaactcctgatcacgtgctgctaagaacgttttgtagagtgcgggagtcttacgggttcagagactgtggaggaggcttgatctccatatacaattgcacatagtcgcagaggctttgcacaactgggagctgaatgagcttccaagtctaagacagtagatgagtgttggtggttctgcatgcttagtactgtagggaagacaaaagaggtcttttcaggaaagactatttctggcagagggccagcaagtgcaaaagccctggggcagaagcactagagtgttctagcttgcgtgggagaatgccaggagtgacagagtgggctagatcatgtaggccttggcgggcacagagtttggattttattctaagtgacattggggtccccattctccacagtgtgtggcactttgtaaccccaggttgttggttccaatccatttagggtgtcacctctgggtgcactgagaaaaacaaccctcccctttgccttgacagaatgttaggcaggcttctgtcctccccacagggcctgaactttgcttgctcctggttaagtaagtgctgcaatgcagaacatgccccacttagcagcttctcctgagaaccggctgaccacagggaaacacatttctggtcaaatcatgccaaacaggttcccctttgcttgcccactggcccttgaaagtagctgagctgctagctgtgcttactactccctactgaaaaaaaaggcttttttttgtattattttgtgatgttttttgtattattttgtgatgtttgcaagtcctgaggtccaggatgtgccacgggctcacagcatctgctcgcccaccttgttcaggcatccccttcccactccactcattcctcttgctttgctttgtgtgttgacctccagcttgcttttcttttcagtgtgggatttgcagtaaaccgatgggcgatctcctggatcagatcttcattcaccgtgacaccattcactgtgggaaatgctatgagaagctcttctaggtgggtgctggcactgcaaaggacaagtggccaagagactcattaaggagtagagatgcaccctggtctctcctggagtctcagccccagacacagctatctttcttggctcttccttatgttcagggggccttgtgtcctcatgtccctatgccttgtgatactttgagatcttaggtggcatggacaaaggccctcaatgaggacacttccaaatcacaccttccgtccagcacctgagccgagccctctagctaccctgggatactcgctcggccgctgttgttagccccattttgcaacaaggaaataaagatatagaaagggaggggacctggagaaacccaggtagaatcaggacctcaccccaggtctttggattcttgtccagggctctctgttcactgtcactcgcatagcttcagatcaggactgcatagccatggtgctcagtgaaacaagcctctgggccacattatgagaactgcctgaagatgtgtgtttgcatgctcatagccagtggaatttatcacggtgtctgagcacagagcagaatatatcccttgaaggcagtagcaaccaggctttccactagctccatgctgatggtcttctctccagaagacacaccttgagctaggtggtaactcctgatgactggagcagtcacccaccctgagggcctctagctgatgtgtttccagtctcatggctacttctgttttcttttagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcacatgtgtca

SEQ ID NO: 3982 - DNA, 59038 bp, human; identical to SEQ ID NO: 3976

SEQ ID NO: 3983 - DNA, 54472 bp, human
cgcagctctacatcaggggacaccgaggaggaggaggaggaggaggtggtgccattctcctcagatgaacagaaacggaggtaatggaatggtgccttttgggcatcccggggggcagggcaggagcctgagtcttcgaagactgctggaatgaattgtactggttggggtgacaaaatgcacaacacgtaggccatcagcggtagcccacggagcatgagaataggtgtcattctctgagtgccagaaccacccactcagtgttggaccagctgaggggcccttgagaaccttctgtggggtagaacctaggtaatgtgggtccggggaaaagcctcctcatgtggaggctcttcagggctctaaatcggtttgttagaaagggccctgagacagttgaacaaaaatattcagggagaagccacctgcacagtgccctctatctgcatgatctgcatgccttgggggttctgaatgccccggaccccaaactgagctccaggcatgcacagcagtgggagtgtgccccatgctgctgaaattctaccctagtctctgcgccaagctgccctcgtccacacaggccagcaaagttccatggacccttgcccctcctcagtcctctgtccatggggactgaccacataccacccagtgctggtgaactatgacaggaagggtttgttaagcaccttttgtatgcctttggcttggggcctgtacagcagttgggccctgaggaaataaagccctcccctccctgggctcagccagccaccaggtccatatctgctgacccatctgtggcgcaggaatcacagcaaagccccattgccaaaggccctggcagattggctatcctcagggaacagttcacagtggcaggggcccccaggcctgggtggagcaaggaaaagagccagaagctaggagctgcctagcattgaatgccagctctgccacctgctaggtgagtgctcttgggcaaataatgaaagcttcttggactcagtttcctcatctgtaaatcacagaggatactagcgtctactttcctggattgagaagagcaataagccaatgcgaggatgttggcatctggcgcagagccgggcacatgccacatgctccataaacatgggctgcccttccttcaggttctacatttcctttgaatagtccttggagcaggtgcaaatctggtttctctcaccccttgcctccctggggtggccctaagtcaccccgagtccatcccaggctaggctggcagagcatgtccagcttggcacccatcagatgctcccccatcccgtgtcaccccaggtcagaggctgcaagcggtgttctgaggaggacagctccccgggagcactcctacgtcctgtcagcggccaagaagagcactgggtgagttgccaccaactggctccaggctctaggacagctctcctctcctcagagctccagccttctctggctgatgaaagggtgggtggagagatcacccccaagggccttcctagctgagccttctcagattctcagatgtactttctagaaaatggagaggtctggcggctaccaccagggacagtgaagtgccgggaatggagagggcccaggaccctctgaggtagagcggtcttgatgtcacctgcccacgggctctgcccaaagcattgcctttctgcttcctttccagcagtcctacccaggagacacaggcaccgtttatcgcgaagaggtaagtgtcatcaagggacaccttggaggcctgttactggccacaggaaggccttccgtcagcaggggtgtagtgtgggagctgtggagaggggatgtggatgtgggggactactgtccctgagcagggggagttgtgaggggctgggggcttctgtctggaggcctggcaagcacctgggtggctgtggtagcatatgtggtcaagctcttccatttgccaatggctaatggggctgggcccctgacccaacgtggagcatttccaaggccctctgggagttgttcccctgcccctgttgcttgcctgatgccttgccttctgctctcatccaggatcaaaacctgggccatcaggagaacttcccctgggaggtgactgtgacattggagatgggccctaaagggtgaacagggcttaacagggaatgatcagaacgtcgggatactccagctgaatgagggaggggtgtcaccattagttgagacagggcaccttctggaggaggaaaatattcgggggaaagcaagaaagaaacttctggaaacttgaatttgagggacttccagttgagtggacagggaaggcctctctctgtgctgaggtggctagctggggactgcaaacccaagagaagacagcatgccaactgccccaggcagagggccccagtgcacaggcccggggtgggactagcttgctgtgttggaagaccaggaagttggcaggaatacagagagcagggatggtggcagcacaaaggaagtgacagagaacggggggcggtgggggggtcttcctggctgcatttggttcctgtggtttctgtaacgcagtaccaaaaactgagtggcttaaaacatcagaaagggattctctcccggttctggagaccagaagtctagatcaaggtgttagcagggtgggttccttctggaggctttgagggagaaaccatcccaggccactctcctggcttctgctggtggttggtgatccttggtgttcctcggcttgtacctgcatcactccagtctgtgcgtctgtcttcacatggccttctcttctctgtgtgtctgtgtccagatttccctcttcttacaaggacagcggtcattggatttaggacccatcctactccagtatgacctcatcttacctgattacatctgcaaagaccctatttccaaataaggttacagtcacaggttccaggggacatgaattttggggggacactattcaacccagtatgctgtccttatcctgagctggagtcactgaacccccagcctgggccacctcttggccgtgatcctgaagggttgggtcagttagacgccactggaagcatgttctttgaggcctccaagctctagggcagccaagaagaccacgagcgctgtttctcttcttgctcaaagggtggaggtggtggaagaggacgggccttctgagaagagccaggacccacctgctctggcaagatccactcctggctcaaacaggtaatccattgcgctcatctctgcctggggctggtggctgccatacctgccactcagtcactgaggaacctcagtcagggcacctccatgctgggcttcgagatcagtgtccccatgtgcccagtgacaagacgggacaaagaaatcagtaagagcccatctggctggatgtcccagggctgaaaggagcaaaacagtccagccccccgggagagagcacctggctctggtctgatgagtacgtatctgtgtcaccttaacccttgcaccactgagcctggtggcaacttgaacaccccaagaaaaagtaccatccttggggtttgagagggccagccaccatggcagtagcatgccattgtcagacttgctccttgcactccaataagttagccacattcagcatgcccagggaggaggctctgacatctccagagcctctcacagccaccttctttgccagtgcggatggaggcaggaccaaagcgtctcgggcaatttggatcgagtgcctgccaagtatgcctagccccgctgggagccaggagctcaggtgggtgccgagagctgactctggcttgtgagtgggtgtgatggcttcccgccagcctggctggctggttctgccagctggggagggtctggcagtggggtgatggggcaaggacaggctgagcactggtgatctcactccaggaagggccgtgatttgtcttgatttctgatccctgagaatctgggcagataatggtgctctcttgtctgtggacaactaataccttcttgtactttgtgcagaatggtgctaagtcctgcagggagagccaccacctgctgttgctgctgtttaaagtgcctgcctggattgagacctttgctcaaatctaggtctcctaagagctgcatctctgtagcacccttggaagacccctgcatccagaaggggagagggcctgtccctaccggtcacttcccaggcccccaagggctgttcaggctctcctaataccatagcaatcccccaatttgagctccacagccatttatagacaggtgaccactgtcctcagggttacttcctcagtctgggagggagacagaaatgctggcagagggagccaggagcatgaggccagctccctccatggccccaggcagcagactgccagggtgcttctccttttcactctctccctctcttgatcttctctggttgtctgactctccccataagaactttggtccatagaagatgtggaaaggaagatttgagaattctttacaaggcaatatctagggcagagctccccagtctttttggcaccagggattggtttcgtgaaagacactttttccacgggacggagcaggggatggtttcaggatgaaactgttccaccttagatcatcaagcaccggattctcataaggagcgcacaatctagatctctcacatgtgcagttcacaatacggttcgcgctctcatgagaatctgctgatctgacaggaggcggagctaaggcagtaatgatctctagcttacctcctactgtgcagcctgattcccagcagaccacagactggtactgatcctcaggctggggttggggacccctgatctaggggacttggcaattgagggatatgggggcaaaggctgccacaacaaagtattgtaccacaccctggggcgcttaaaccacagaaacgtatcatctcccacttctggaggctagaagtgtgagatcaaggtgacggcaaggttggttcctcttgagtctctctccttggctggtagactccatcttctccctgggcccttatatgctcatccctgtctgtgtgtgcctgcgtcctaatcacttctgtttttttgagacagagtctcactccgtcgcccaggctggagtgcagtggcacagtcaccactcactgcagcctcgaccttccaggctcaagagagcctccagccttagcctcctgagtagctggggctacagtcacaggccaccatacccagctagttttttttttttaaatttttgtagagacagggtttcaccatgttgcccaggctggtctggaactctaggactcaaatgatcctcctgccttagcctcccaaagtgctgggattgcaggcatgagccaccgcgcccagaccctaatcacttcttataaggacattggtccaactggattagggcccaccctaacaactgtattttaacttagtcacttctttaaaggccccatctccaaatgcagtaacattctgaggtcatgggggagttaagacctcaacatatgaattttgggtggcacaagtcagcccataacagtatacagttctcatttctccttatttctcttttaaagaaaggcaataaatggtttcaggtgcctttctgtttgttcgtttgtttgttttgtttgtttttgagatggagtctcgctctgtcgcccaggctctgtcgagtacagtggtgtgatctcggctcaccgcagcctccgcctcccgggttcaagcgattcttctgcctcagcctcccgagtagctgggattacaggtgcacgcgaccacgcccggctaatttttgtatttttagtagagacgggtttcaccatattggccaggctggtctcaaactgctgaccttgtgatctgcccacctcaggctcccaaagtgctgggattacaggcgtgagccaccgcgcttggcctcaggtgccttttagaagataatataggaggctgggcatggtggctcatgcccgtaatcccagcactttgggaggccaaggcaggaggatggcttgaagccaggagtttgagaccaacctaggtaacatagcaagaccccatctctacaaaaaaataaaaaataaaaattaaaaattagttgggagcattgatgtacacctgtagtcccagctacttgggaggctgaggtgggaggactgcctgagcccaggagtttgaggctgcaatgagctgtgaccgcacccttacactctagcctgggtgacagagcaagaccctgtctctaaaacaagaaaaaaaagagagaaagaatggaggagaattagattgtgctgtattatagatttaaaaggcactttgacatttattccacaaaattcctttcgatgtttaatccccatcatatggttgtcattgcaaggtggctttttaagtttgctcaggttgccataacaaataaaggctagagattcagggtccggggcaagctcccaacaggaggctcagcttgatgcttctgatagttctttcctccaattctggtcactcaatatttggagctcacccaggcagcttccaggaaagctgctggctgatcctgaccctggagggccgtcttctctgaccctaccacgttaggtgctgcactggaccaagcagccaccatcagtactcccaggcccagctcctatctgcctggtgtctgagaagcccagcccgtgaggaacaatgactcaatcaaactcagggtcctgcagcacttcagaaaaggctggtttgtggcagagtggaagaggagaatgtcacagccttgtccccaggcacagacctatcgaggctaccctctccccaccccctgccctgccctgtttcccttagctacagtgcaaaggtcagctcctcataactcttgccccccttgcaacctgaacccagtttagggaccctctcttggagaaactggttctacacatgcaccccttctcggcccccaggcctggctgctttacccgaagcactggtcaagcttgcctcacctgaccagggcatggcctcctgggtcccggtcctaggctctgcccagcatgctgcctggcagagcgtctggggagcagggagtaggagcacagcttctggcacaggacaaaaccctggctttgcatcagactgactgtgtgaccttgagcaagtctcttcatctctccatgcatcagtttccccgtggataaaatagggagagcagtaatagctacttcccaaggctgtcccaaatgctaaatgagatcgtgcacctgaagtacttaccacagtgcctgggtgctggtatcctcgggggctcccagtcataggcgtgctgagctgcagggcccttattcaaatacaggaagagatcaatatctccacctgctggcatttgagggaaatgtggccaaaggcagtgaaaaggaggtatcccctcgccccacatccccgcctcctcgctctttggcagaatgagtcacacactgtttggcacaggccacagttggtcgcattcccacaggtggctgtgatcagttttgggcttcaggcttcagcagatgcctgcctctcttccttgggtgccttccaagggtgtgcagccttccagcgtggtcctggacttcagcttggactggagctgtctgtggttgagagtctggggagatggtagggtagcgggttgtgggggaggagagacccttgtattagtttactggagctgctgtaacaaggtaccagaaactgagtggcttaaaaccacacgcatttatcctctcacaattctggaggctggaagtctgagatcaaggtgtcggaagggccatgctccctccaaaggctctgggggaaaatctgttccatacctttctcttaccttttgttgcctgcaatccttggtgtttcctggcttgcgcccgcctcactcccatctcggcctctgtcttcgcgcagccgtcttccctctgtgtctgcccacattgccctagtctgacatcagtcactggagcaggctggggtgacactttgttcccatttcctctgtgacagagccagaaacgccagtgagaaaatatgttgtgcttgcctgtgacatccctgttccctggcaccacctgatttaaatgaggcagccaggggttttatactgtcatcataaatgacatcatcctcaacaacgatgtcatcgtcgttatcacgagaggagatggggagaagtcagagctgtctgtgtgtctagggcccctcctggctttcatgatgggagaggccttgtccttggtagcccttccatttccctctggtcactttgagcactccaggccctggccagggtggaagtggagggacagagatgagcagcccgctgacccagccctccatggctcattccttgctttcaccttggccactccatcccctacccctcctgggacccctgagtggcctctttaaagtgccagtctgaacctataaaccccccacctccacttcaagcccatcctgcatcttccctttgccataccagatctagtctgtacattcaggacccctgccagcctctacctcctcctcctcccccgatctcccttcagctggcctgggtcgggctatgcctccatgaagcttgtccactgctcccatggctaaacctgttctgggccctgcagcacagcaaggtcagtttccatgcctctctgcccctgcctgaccctgctgggcccagagcttcaccagggcaggcctggggctcaggcttgtctgcacttccagggcccagggacaaaggcaggagtgactgcaatgtggcttggaattaggctttgctccatggacctaaggaggtctggtttggggtgaagggtccacccccagaaagcctgggagctctatattctctctggccctggccacaccatggccaagcctgctgggcgtcatgccttgcagtacggccagagaatgcatcagacttggagggatgtgtgtccggggtggcctgtggtcatctgggggagggctctgagcgtggctggcaagaggaaagctcaaaggggccctttgtcctcatccccgagtctgcgacatcccctcccactggttttcattccatatttggtctgtgggttttctcagtctctcgtacccctcagtccccaccagtccatgaatgcagaactacccctggcctcacaaatggccactttggataccctggtggggtcacaggctgcggttgcccctgcaaatggttggtagaagcacgggttgggaggtttcatttctacccagaagggcccttgctgtgcctgagggagggctgggctcaggtcaggggtgggagaccggggaaggggcctacaggtcagtggcccgagctcagctgcagcaccaacaaggctcaaggccaaggaggagatgagagcacatcaaaagggggcagtgggtctgggcggcccaccgcactcaccagcccaagaagggggagacttttctcacctgcaacccactgggtctctcctttggcccgcagctcaagaggtgaggaaattgtccgcctgcagatcctgacacccagggcaggactccgcctggtggccccagacgtggaaggcatgaggtatgggggtcctgctgctgtcctggctccctggacaccattctagagatggaagcagcagcctcaggtggcaaatgatgaggcctagggccggctctgccactgtagggccaacaggttgatgggaggcatggtcgacctgggttttctgccccatctcattctttcactcagaaaaccattatggagcaagcgcttagtctgtgtaagggcacaggcccgaccctgggacacagtagtgaacaggaccccctggctggaattgccatctgcctggtgggggaggcagacgccgacatgagcatgaatgaggtcagccagagatgctgtgtgccaggagcccctgggaagtgacagctcaaccctgccaattgctgaagatgggaccagtcagccgtgctggggatgttggtgggggtgggaggaggattgggtctaaggagcccgtgaaggccactgaggccattgccctgcctgtgtgagagggccactgggaatagagtggggtcactgggtcagagtccacagctctccatgccactaggctctgtgctggggaggggtgggtcaaggaggccacaaccagcagggagcacgaggggctcagcctctgccctggggtgggggtcagacagccaggtgacatgcaggcaggattcgggggctggggtggaggctaggagagatccgagcagggagactgggcccctaccttgtgaaggccagggactggggagagaagcgggagtgtacactgaaggtcatcccttaatccctggggtggcaggaacttcgagcagaggcctctcaacagtgtggtgggtgggagtgcttggggagggcttcctggaggaattgacatccaagatgagtcctgagcgatctctaggtccctttaccctcctccttggctcctcccactttaattctgcccccaaggcaccaagtcctgtccactttattttagagatgtttccatccctattgctctgcccctggcccaggcctccactgctactcacccagttgtctgcgaccgtttcctactgtcccatccctggactcccttccacatctacctgggtgatgtttccaaagggcagaagtagttatgccagccccctgcagaaagccctgcaaagcccctcccactatgctctgcagcctgaactcagtacctggccccacctgcaggctcctccctccctgggcctttctctgtgcaggctggaggctctgcctgagatgccctttcccctcttcatctttctgttccacctcaaatgtcctgtcttctgggtcatgtccttctcctgagtttcttccccaggcagcatctgagggcttgtcgattctgcatggcagcatccattctgcatggatgtagatacaatcactatgcccattttacagattaagaaactgagaccctgaatggttaagtaacttgctcaaggtcacatggtccagagcaggcagatccgctcagcctgccctactcccaccttccaccttctgcaccatagctcattgtactagttggggcagggagcagggggacagagaggggtgatggaaagacttggcatttgctgagtgaactcatttgacgagtttattcgtaggcattgaagtcaaaatttccaggagggaggtattttaaggtttgtgattgaggtttgagagagtgattagggctcaagagatttccacgttatatgcagacagaatagagctgaaatcatgagcgtaaactagctttacatggggctcatggtgagccaatggaagctgggcaccgacctcagtatgcaggtggcagccacctggccagccctcctggggacagctgggcgagggcagtctcttctcgccatgttgagagtgggcctcctgagggccagttgggagttagtgggtgtgcaggccagtataaaggagaggcaggaacaagtggagatccctgcttcaagggtggcagttgacaccttgggaggggaggagacagcccagcaagtggtggagcacgccaaagggaggagaaaaaggcggagaccaggaaggtgtgtggccagggaggtaggcaggtggtgttgacaggatcaagggaggaggggtggtgagaaggctggagtggcccactgggtcagcagtactgaatggtggtttgaaataatgatgggactgtctctcctggatttgacaacatggggctccctgaggacctgaaggagaacagaagggggcttaaattaggagattaggatcagggatatagtccagaactcaaatcccagctactcctcttattacctgtgaaatttggggcaaatcacaggggctttgtgtgcctccgtttgctcatctgaaagatgggcatgggtgataacagtgcccatatcctggggttgatttgcagagttaatgcatataaagtcacgagaacaggctcaaatgctcaatcaacagtagctattgccaggcacagtggctcacacctgtaatcccagcacagtagctataaaacaacaacaacaaaaaacaaaaaacagtagctattagtaatgaagttttgataattggccaatctgtcaatcagcagggtttgtttgtttttggttctgttttttaagacagcatcttgctgtgtgtgcccaggctcaagtgcagtggtgccatcacagctcgctgcagcctcaaccttccaggttcaacctcccaagtagctgggaccacaggcacacaccaccactcctgactaactttcaaaaatatttttgtggagatggagtctagctgtgtttctcaggctggtcttgaactcctggctcaagtgatcctcttgcctcggcctctcaaaatgctgggttataggcgtgagccactgcacccggcccagtagcaggttttaagctccgtggagacagctggcgtttgaggatgaggtaacagcccacacctgagtgtgaatggctgctgcatggttaacttccatttctttcctccataggtcttccccaggcaacaaagacaaggaggccccctgctccagagagctccagagggacttggctggtgaggaggctttcagggcccccaacacagatgctgcaaggtaactcagtgcaggaagcagacacttcattcccagaacacggagcccacatacacccagctgaaggacttccatggcctccggtgcaatgtcaatggatgcagctggggccaggaaggtcctgttcccactgttcccccagtacctggggtactgcaggtctttaatgaacatctgttgaaagaaagaaagaatgaatgaatgaggcctggagggaggtaggcccctgccatgattcctcagggagccagttagagagcaggaccaaactccagggcaggctatccccagctcctggcctgtgctgagttccttccattcccctgaagcttccacactcactgtgcttttactgcaggacaaagcagccctgccaatggccagggcaaagcaaggccaccaagctggcagtctgggagagtcagtgaccaaagtatgtgggcccccatagagcatgtagcggagactttcaggatgacccgtggactaagggagacattgtggcaaggggtgaggggtccaggacgggaagttggagccatagcggtggatgatgagtccagatgggatgattgtccccagtcgctgcacagccagcccactgacctgtcctccaagccagaccagtgccaaatgtgtctggtgagcagtggctgcaggctgggcatttcttcagtgagaacctggtagccagttacagctaagaacccacacacccgtcttctcagtgtggatccctggagcccctagctggaaccctgagccctggaaatgaggaaaggaatccctctatggcttattaccagacccacatgtcttgccccttgctctgttggcaatcagctccccccaccaccaacgaactaacctcctcctgactttccaccttgctcccaaccaacccatcaggtttggaaaaaatacagaaatacttcctgttagagtcaacttgggcttggctcagctctggtcagagcagcacagagtagcagccaaaggcctgtgcttctggtcttgaggcccactctcatggcatctgggttagatgagatcaaaacgcaactagagtcagcaaatactccacttctcataacaggtcaagtgcacagttgagtgatggcaatgtgggatccggagccacgggctcccggcctgaaggcttggctgcagtagacatcggctccgagagaggaaggtgagctgcccgggggaggcaggttctctcatgcccctggtgacagaccagggtcaagctgccaggctgcttgggctgctatgggtggggcactggtcacttcctatggctcctgtctactgcttctcccacactcccacattccaccacatcctgtgtccttgggctttccactttttggaatcttgttcatttttctgatccctgccactggccctcaagctcctccagagtaggcactaggcccactcacagctggaggcccagccctcacatggtgctggtcttgggctggtcaaatgaacgtgtagggaatacatgaagggacaaattaatgagtgaatgactgaatgatggaagagtcggcaccttcttacttcttggttaagctctgaggaccagctaggaggccctttgctcctgctttctcccttctctccttttcctgccccatccctaccccaggcagctctgctctgaggttcagggagaggaaaagcggtagccctggagagaccagcgtgtccagctgggctctggcttcttggacctggagggagtcaggggccactttctcaggtgatttgcagagtggcaaggtccctcttgtccctaagtggttccaaaccaagcctgaatcattcttggggcaaaggctaggtatgcagatgttggcataaatagtttagctccaaactatgctagagtccttctggttcagagcagatggctagggaggagtggcaaagccagtgtctgcaaagagctacaaccgcaagatatcatctgcctcctgcatcctactgcagtctggccaaggagggaatcctgtggggaaggccctgctgatgctttcctacttccctcagcacacccagggcccctttccctcactaacttcaatagtttgcaattcatgccatggaaccagagcccgaattctaaatccaggcccacaagtcaacacaggaaggggacagcaggtcctggcctctgaaaccactgtctccgagcaggtccaaggagaggccaccagagactctgttctttaagctgccactaatggggaggactccgctagagccctgtccatgcagcctgcatctttttgccatctgcagaggcattggagggatctttttaaaaataagctagatcacatttctcccctgctaaaaccttctagtggctctccattttccttagaatgaagtccaaaccctttcccatggcccactgggtcctgcatggcagaatctttggccttctatccagtcggggctcctgctactctccccacagtggtgcagcttgactggctctgctgatggctgtcgcggaagagacttctggtctactgtgattgggtggctctggtctcctccatgtcaccccgcctgcttatacaccctcataacatgaagcctgtgctgtccactgtttccttaaaatgaaaccaagcctcaaagttacttgtaaagtcatctgaagaatcttctagattttcatgaattttaacccagtcttttacagttgtcttacctatatagtagtccctaggtatctgtgggggattggttccagaacctcactcatataccaaaatccatgcatgttgaagtccctgatataaaatggtgtagcatttgcatgtaacctatgcacatcctcctgtaccctttaaagcatctctagattattataatacctcatacaatgtaagtggtatgtaaatagttgttatactgtattgtttagggaatgatgacagaaaaaagcctgtacatggtcagtacagatgcagccatcctattttaattatttttcccacatctcatctcatcctctcctctcctctcctctcctttttcagacaggaccttgctctgtcaccagggctggagtgcagtgctgtgatcacagctcacagcagcctcaacctctggggctcaagggatcctcccacatcagcctcccaagtagctgggactacaggcgtggaccaccacgcctggctaacttttgtatttttggtagagacgaggttttaccaggttgcccaggctggtttggaactcctgggctcaagcagtccaccgacctcagcctcccaaagtgctgggattacaggcatgagccactgtacctggtcccaaatattttcaatctgaagttggttgaatccacagatgtggaacccacaacatagagggctgaccacacttagtttgactataattttcaacaaactcctttattgtttttcctttttttttttttttgagacggactcttgctctgtcccccaggctggagtgcactggtgcgatctcggctcactgcaagctccgcctcctgagttcatgccattgtcctgcctcagcctcccaagtagctgggactacaggcgcccgccaccacgcccggctaattttttgtattttttagtagagacggggtttcaccgtgttagccaggatggtctcgatctcctgaactcgtgatccacccgcctcagcctcccaaagtgctgggattacaggcgtgagccatcgcgtcctgccttgtttttccaaaggaaaggttgtttctcatggcaacaaccactctccttttccattcattttcatggatttacttaatcatcgaacttagtgattcttctccattagtggcagctcaaagaactgagttgctgccccaggggcctttccttggatctgctcagagacattggtttcagaggccagggtctgctgtccccttcttgtgcaaatacaactggcataaagaggtctgggaccaaacaagagcacctcttagtgagtgtgctggttagtggagggcacaggcttgtataggcagtgattgttcagcatgccgtgagcatcagtctgcctggtttacagagacacagagaatgtgactccaccctgagaaggttgggtaagacattccccactaaatccatattgagtgggtgaatacaggtggactgggaaggtgcactgcttctataaacagccactgggccctgtggtaacaggaacacattagcacatgttatggcccaggcattattcaaagtacttggcatctatgaactcatttacttttctcagaatacttacgagacagacatgattagcatccctatttcattgatggtaaaactgaggcccagaaaaaaaggtcaggtaacatgcccaatgtcacacagctgggagatagcaaagccatgatttgcaacgccagagggcaaccactatgccacagagccccaggtgtcaggctgccttgagatataaatattgttcctcaagcatccatttgagcagcttcttggtcctcatcatctgtggggggcaggatccactttctcgggagagggtagacatacagacacaaagtcctgaacctggaccaggtctggccttctttcacaggctgtgtgcagctgctagctttgcctctttcctggaagaccaggatgggcacagtgccaactctcagtcctgcaagcctagaccagcagccatcaggtaaggttagggccactgccctagtgccctatcccattgccagacacagcctttggggcccagcctcagctgcagcaccccaggatccccctcgaacttctcagctccatgccactttcacatcaggtgatcacagcaagacagggaactccagggggagctctgaccaggggcagtggaagaagagggatgggtgatatgtctgctcacccagagagcccagcaccaacctacatggacccaagctgaggtggcagagaggagggcatctgaaggcagagcctgggaagagatcctgctaggaggtctcagagaacctctgctgtagggactacagccaggtttagcaagcaggagtcagggagaagattcccaggggcagccagcattagagggctcagttcccaggagcacaggaccggtggctgggatgggcaaaaatggctcctggggcacaaaggtacaatgggaagaagctgtgcattcccatgctgtaagcgtctgccctgtttcacccaccaatccaccagtgggcatggccactttgctgtgggtgtgtggagcatttggcaagtcctagtaaggaacgatctttcttaactcccataaaccctacagaggtgtaggtcaggtaaggatacgtcatgctcagggtcaggttccagccgcagctgagggctaaggggaatgggtggacgtggggcagggagctggaagaacactcgagagatagcaggtaaatgagacatggctttactcagcagcagctctcttacacagctttctcaaactagctttctcattagcagcttactctcacaccgtctgccctgtcttggctgcttagtccggtggcccctacgcacagctgcgtggccagctctcccttgccttcagggtcagcagcttaattctttctctccctgggcacgggcaagccaagctgtgtcctggctcccctctgtcctggctcccctctgtccacctgcaaagacagacagctcttgctctctctctttctctaggttcccgtgcacccgccatgtcaagctatgttgagctgagccaagccccaagagacatgtcccccatacacagcgtcaacagggcagttataccttttacagacaatagtggtttagagccaagtatgaacttacataaacaggttatataagaagtggaggtgtgcacctgtgcaccagactcattgagtcatgcaggcctggatatccccctctgcctattccttgaacaaagcacatccaggtaccttacaggatactagaacccaaaaccaggagacttccccagggaacccaagttggtcaggggcagtgtttgctcttgaactcaggtgctaaggccatgtccaaagctgacatgaggttgtcacacacagtggcatcggtgccacactaatgccaggactgagacaccagcctttactggaagacacagttcctccctttctggtgagaaggcagcctggagggggaagacctgggccccagccttctttggtctgagatctcagcaggcctgtgtttccttcctcagctccagtgccacttcagtctctgctgtccctgctgataggaagagcaacagcacagcagcccaggaggatgcaaaggcagacccaaaggggtaaggcatgagcagacagtgctgaacttctggggtggagagaggcagcttgggctgtgtgtccattggcctttggctgggaaggtgaggccagcaaggtttgtgagctggcctgaggcacatagcaagggcagaagccccaaccagaaccctctggcttctggggccagggagctttccactaaactgttgccttggccaggaaatacatcatagtcagaaagggtctttcagtcagcaaccactctgacagcaactgccttttgctggaggctggagcatgcagacaaatcagaaacacctctgccctccaggaactctcaggcagggggtgggcaaaggctggtccagattagagcaatacatgagcgctagagcaggggaagggggcttcatggggactgtatgtagctggatgtggtcagcgatgagtgtccttgttggggagtgctggaagaggaggctcagtgaactaggtagggcttgattggcctcttgtactgtgatattggagtccactgtgtgcacagccctctactcacagtgtctcatacggttctcctcacagtctctcaaaggtttatgcctaattacaacaaaacccaaaagcctggagcctaggtctctgtgcctcctgggaaggatagtgctccgaagaaaacagccgcagctgagatagagtgatggcagtgaggagggtactacttaggtgggtggaaaaggcaactcaggcgatctcctctaaagaggagaaggagccaactctagaaagaacacggtggagagagctatagataaggaaccacaaaccaactaaccctgaggtgggaacatgcttagcatgttccaaaggacagagtggctggagcttggccagtgaggagggccacagatggagcagggccttggtaagccatggttaagagattggatcttatttcaagttttaagccaaaggggagtctcatgtgatttaggtgtttaaaaggtgaatgcatgtttgcattttcataccacattgctgttgcttttttacttaaaccaagatgctgggggctggggtgggcaatggatatctaaggtatgaggccttattgtgtttcttttctcattcgaattgcactgacaattaacaatcagagtgaaaacaacagctgacaccaatactgtgctgtgctaggtgccttacagccttcccagcaacttgtgagatgggtaaggtgggaaactgaagcatagaaagattaagtgacttagccaaggccttacaagtggcagaactgagttccaagggaagaggctctaagaaaatcctcaggagaaactacgaaaaactagtttatgaaatcttgtctttggagcctagtctcaagacccagaatcagtaacttacagctggttaacatggttaacatgctgtgtgatctcaccttaattttccccaaacgtggaaaaggataaggcttcttattatgcaacttgacagaggagaaaattgagggactcactcctgtaatgaacacacttaggaacagagcccagatccagccaactctagagccaggctcacgctactttcctctgatgtttaaacgtctgcaaaatcagaggtgttttttttttttttttttttttttgagacagagttttgctttgtcgccccagctggggtgcagtggcgcaatctcgactcactgcaacctctgcctcctgggttcaaacgattctcctgcctcagcctcctaagtagctgggattacaggcacatgccaccacgcccagctaatttttatatttttactagggatagggtttcactgtgttggccaggctggtctcaaactcctgacatcaagccatccacccatcttggcctcccaaattgctgggattacaggcgtgagccactgtgcctggccaatacaaactttcttgattacagtgtttcacaactctggctgtacttgagaatcacctaggaagtactgaaatacactgttgatgaaaaaggccatactctgtaaaatatttgaagaaattctgagccaaatgttaggactatgacccgtgacacagcctcaggaggtcctgagagcatgtgcccagggtggttcacttacagcttggttttttatgttctagggagacataagacatcaatcaatacatgtgaggtatacattagttaggtccagaaaggcctaggtatacattagttaggtccagaaaggccggacacctcaaagctgggagtgtggtgggggtgggggtgggggtggggttccaggtcataggtggattcagagattttctgattggcaattggttgaaagagttgttattctctaaagacctggaatcaatagaaaggagtgcctgggttaagataaggggttgtggagaccagagttcttatataggtgaagtctcataagtggccgcccttagaagcaatagatggccaatgtttcttattcagacctttaaaaggtgctagactctcagatcagaaaaagtcctggaaagggaaggagattctctacagaatgtaaatttcccccaggagagacagctttgccaggtcatttcaaaatatgtcaaaaaatatattttggtgtaaaatacttcaatttctttcattacctgctgtctgtcatgtgatgctatactagagtcaggttggaatttggcatattattgcttcaaggagtctgttttgtcagtctgaatatctctctcaatgttaatactggtcagttgggcatgaattccaaagggaggagaatatattgaggcatgtctgaccttcccctttctcatcatgacctgaactagtttttcacgttgtgtccccttggctgagagaagtgtccattcattcagctggggagcttagaattttatttttggtttacaacacaacaaaaacttcccgaagtcccaggtagagatttggattttatttttctggggtgggtctccatcatgtgtctttttcaaagctccccagtttgttctccttccaggctaggtcgagaaccatcgttctcaggtagtggttctgacccaggggcatctcccaaagcttccagcctgctacgatacaatgtctggagccatttttggttgtcaaaactgggagtgggagacactactggcttcttatatgcagagatctgggatgctgccccacatcccccaacacacaccatagaattatggggttcaaaatggtaatagtgctaaggttgacaaaccttgctgtagagccttgacgatctatttgggaagacagcagggacggaaaagaaaaagggatggcacagaaccacacccctcaccttccccgaaatctgggtagcgggcacaggacgtgtgcgcctgcgcgaatgcgcgctcgccaccagcgtacgcgacgcgtgcgcgcctgtgcacctcggcgagcacgcgcccgtagtgagtacgcctgcgtaggccgccatttcttgaagccccgaactcggtcgcagtgcccgccgggaaaatgcgaccgtccacaaagtgaaatggccgcccgggacgagctcggcctcggcggggattctcttgaggccatgcccgtgccggccgccagaggtcgcccgaggatcacgaatgggcccgaggagctggctgccccttcccccgcgtaaggtctgaagccgcggccagagtggctttggggtgaccgcgcgtggaccgtcgccggcgggaggaagcgcggtcccgcgaggggccgaacggggcccctgcggcttgagcttgtttcgcagggagccctggggccatggcctctgggacactggacacgggtcgtcagggctgcccagggggagggggtgtggacgtgcagacagggaaggcagctggaccctccaaccacgctgggccctcgggctgaccggggctggtctgtggggcagtgaggaggggcttcgttccctaggagtttgatgagggagcgccatgggggtggcgtcatcctgacatcccgcagggcagtggagccttactttccctaggttacaacacagttttaactgtcccaaactgtggggactccgccctattccatcttgggccgctccatcacactacagggagaggcggtatagtatagtggttgagagcctggactctggtgctttgggttccagtccaagctctgtcacttacaagcaccgtgaccttgggcatgttactcatcttctctgtgcctcaggttcctcacgtgcggaatagtggtaatcatacctcctaccatatagggttgttgaaatggccaaatcggtttgtatatgtaaagcctgtaggacatttaaacctgcgagctaagtgaagcagcaccagaggaatatctcctcctctcagaggtgttcagggacacctggaaagctaacttaaccagctttattggtttgatttcatttgacatgacacgatatctcatcttcttcctactaaacttttgtcatcaaattttccatctagaacatgctgttttcctcattatgttgcaagcatgggcttctcgtttatattttttctgcatgaggatcaggtgaagtttaggcaccacatttcctcaccactggcaaccgttgttggccagtggaggcagtacaagggtggaagtgtcagctgggtgcagtggctcatacccacctgtaatcctatactttgagaggccgaggcgggaagaccacttgagttccggggattgagatcagcgtgggcaacgtagtgagacctcatctctacaaatattatctatatctatatatgtatatgtatatgtatatcatatatatgatgtatatctcatatatatatgtttttgaaacaatgtttcacttctgtcgccccagactggagtgcaatggggtgatctcggcttactgcaacctctacctcctgggctcaagtgattctcctgccttaacctcccaagtagctgggactacaggcacacaccactgcacctggcttatttttgtagagaggagtttttgccatgttgcgcaggctggtctcaaactcctgacctcaactgatccacccacttctgcctgccaaagtactgaaattacaggcgtgaaccactacgccgggactacaatttccgttttttaaaagaatggaagtgtgtagattatggttgtgttaggagttgacagtggctgtattaggctactggatctttggtccaattacactcagaaggaaaggcttcagagaaattaatccaaaatccaaaatcccgttggtcaccatcccctatgttaccttgcctatctctaaccacttgacttccaggaagttcatgaggagctcggacaggatagctgggaagtaattcccctggatgttacattgtccagcagagcttcctgtgagtgtttgcctaagatttcctttttatgacccacataggtcatatgtcctaaaatcacagtggccctgccacaggcctaggaaagaagaagccttgttcatccatttgtccctgtgtcacaatagagcccaaatttctctttgtggataatcctggctctatccacagacttggtgagggcaacctctactagtgtatttctacagaggacgtgggacaggacgggactctgattaaatccatagtaaagctaactcagggctaccacagtagggagacaagctcttcaggccttgtatgtttgtctttggctcaagcaagcatgtcactgacagagattgaatgggtgtgtcagggcaccctgctggcaaccctgggactggtgttacctgtgcagaccacttttggatctgcatgggctgcagcagaccctaagggtggaagcagcacagagaagcacaggcccagtgggatggttccccacagttactgtgtggcgtcacactcacttgcctgcagttctgcctggtgcagctggaggtggcaattagcttgttgtgcctgctggagaattttagttcccttgacctccacctgaggctgaagaatcatgttgctttcagggcatactttccaaaaagtgtggcctctgttggccttgttattccagcttgaaggcaggaagcctgcctagacaaagttaactcctatatacaaagagtcccagggtagtttgtagcgtgttcttgtctcggggtagcccccaccagctattgaaggtaggctggtgatgttgggaaggttatattcagagtgagctaggatcgaggtgatggcgaagtagattttcattctgaaatgctgggctcactctcttagtagcccaacttggtgtttgcccctggcctagtagactctggaagcagtaccttgcacctcggtgtggggctggtgatgggaggggtgtggaagtggaggatcagctagcagcctctttcccacggtacccagattggagggtgcagtgcaatcatggggtgaggccagggaggacccctgaagagctcgatgcctgagacatctgggggaagccctgtccttcttgctggattcaggggtggcaaaagccaaaaattggagggccaggtgcaatggcacatgcctgtaatccctgcactttgggaggccaaggcaggaggatcgcttgagaccagcctgggcaacatggtgaaaccttgtctctacagaaaaaaaaaaaaatacaaaaattagctgggcgtggtagtgtagacctgtagtctctgctactcagaaggctgagacaggaggatggcttgagcccaggaggcagaggttgcagtgagccgagatgatgccactgcactccagcctgggcgacagagtgagaccctgcctccaaacaacaacaataaaaacatcggaggcttcggcttcatctattacacatggaggcctgttcagtgagaagggagcagcgatgctgggctcctgccaaggaggagactgtctgctccctggaattggggctgtgcctggctcctttctgccccgctttcagggatatgagtccctccaagtccacaggaggtgacagccagcttgcgtcctggggctgaggcagggttagtttcagagcacttttttcataagggtgcttattcttcttcagggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcaggtaagggctgagctgcagtgggctctgcctctggagcccatgtttttgttgaggtctgcgacccacatgggaaccacttccccacaccctgtgccaatacccgacacattgcacacccaggctcctgttctgtgagtgggtcatggtgattccctggtcctagagcagtgtcatcaggcttcttgtggctcaaggagctgggaggggactgtgataggaggatgtgtctgtccccaggtgtgagaagccctggctaattcccaatgcatggggcaggaaggaaggctgtctctcagagtacaggtgctctacaggtgggggtcctgggcagagtgagggctatttgtgtgggtaaaatgccattgtcagagaaggacagagtgtgaaagagcaaaaaaacaggagggtaaaagtgcaaaagtgacagagtgaagcagagagagagaggccagagggagagaaagggagcatgtgtgagcaggcatgagagagtgacacaggatgtgactggccatgtgttggtgtgtgccactgtgcatgagcaagaggacaaacgtgcctgttactggagctgaccatgtggcattggtgtgagagtttcaagtcaggctctcttgaaggcatcttgcctgccagcgcaaacactgcatgtccttgcagctctggacacgtcaacaggccagtgattccaggggtgcaaagcgaacagtttcttacacaagacagaaatgtagaaggagagagctaagactcatattgccccgagagaggagctagtggaatccagcagggcatctgctgtggggagcaggtggagcctggggttccttttgcagggatgaaagaaacacagtcatctgccttctttgttctggggcttcttgtaccacagaggttccataattattaatagttaggttatttttagggcctagctcaactgttagataacaagttttaccttctaagaatatctagcccatctttgattccttggctccaggccctggagggtcccagtccaaaaacagagtgaacaactttggacttgctgtcacattgtgtggcttctagaactagtcagtgttccatgcagaaggggtataaaaagtgaggcttgtggatgaaggaggaggcgagtggttctgggttttgttttcgttttgcgggggagtgtcaggaaaggctttctttacagggagagtgatgttggagctgggtttggaaggctgagggagattttgccagatgtgccagacgtgcttgggaaggcattccgagtggaggctcacaaagtgtatagggaacatccagtcaggtagccatcacaaaggagggttaatccagcctggcttggcaggaagcaccaagtaggggctgggcaggcacctgctcctaggctgaggagtgtgacccacatcctgagggccttgggagccaccgatggttttcctgcaggagagtgccacagccagactcgagtccaaagaagatccctccattgccctgtggaggaccaggccaggggagtatacgacgagacaaggcaggaggccatattggagactgtttgcttacaccaggggcaaggtgatgaggctgcaagtatttttgaattattaaaggtaaaagcgggcttggcgtggtggctcacacctgtcatcccagcactttgggaggccgaggtggcagtatcgcttgagcccaggagtttgagactagcctggggaacacagcaagaccccatttctacaaaaaatttaaaaacattagccaggtgtggtggcacatgcctgtagtaccagctacttgggaggctgaggtgggaggattgtttgagccttgcacgtcgaggatacagggagccatgttcctgccactgtactccagcctgggtaacaaaacaagatcctgtctccaaaataaaaataaaaaaaataaagataacggtgagggaaaagtggtagccaaggttgctccccagatttcagggctaggcaattggatgggtggtgacaggaactagctgagggtaaggagtttgggggcaggcccgctgagagatgcacagagatgagaaggtcactgggccatgccgaatgagaagtgcctgtaggggctccagccagtgatgtccagtaggctactgagtaaacaaatgtggagttgagcaaagatctgacctggggctagagagctgggagttgtcagctcataggaagtcactaaagagaatgcatgaggttgcctggagaatgcctttggaaggcagtgtgtacaaagcatgtattctcggcttttctctgcagacttccagggacagttgtccagccaggcccttggctgggtgggtgagtccacgtggttcagggatgctgagggaagctgcttcatcagctgacatttctctccattttctgctcttcttttgtctcaaaaagaaaaaaagaggggatattaattattgatcccctaaaaccctagctgaatatataaaatgaaaagaagtaaaaatatgagagaagcaaaggcagatggaccataattttggaaaataattccaaaaggtcttaaggaggaagaggagctacagagaggtattgagaaggaaaattttggataaatggaagaatcaggaaagactaccgtcatggaaaccaagccacgctgagctaactttccagtgctctgtagatgctgaaataggcccatcagatttggctatgtagaactcatgactgccttgaggggagtaggttggggcagtgggaaaggctgtagttggattataatggattgaggagggagcggaggataagcaggtgcagttgatggggtacacactctgaaactggctgtgacgtgatggatgtgggaggggtgagcagataattacagctacaagataatggggaaggtttcctataggtgaaagcaacgtgtgcatgttaggtaaaggctgggcagagggtgcctacgtgaccagtccccgataaaatccttggactctgagtctctcatgaattgccctggtcgacagcatttcacacttgttgtcacaactcactgctgaggggaactgagtgaatcctgtgtgacccactgggagaggactctggaagcttgtgcccgggttccctcagaaatttgccttgtgtgcttttccctttgctgattttgcttcgtatcttttcactataataaaccatagccttgagtgtgatgatgtgatgtgtcctgtgagttcttcttgtgaatcaccaagcctagggatggtcttggggacccctgacacagatgggcaggatcagaactttatgccataacaaggactttagattttctttcgagggcaaagaggagccaggaaggtttgaagcaggggagtgatatggcgagagtattgctttgcaatgggatctccagtggcagtgagaagagtgactgaagtgggcagagtggagcagggagaagaggaagtgcttacagcatcctccatgtaagaaatgatggggcctggactaggggactagctgtggagatggagacagaactgtaaaataagtagaagagatcccaaattggatgacaggtaagacttgggagagcagtgacggagagggaagtgacaatttagaaagccacatttctggtcgagtgagtggagtatgtgacccctcctggcttaggtggtggccaaagtatctctaacctgcctctatactgcctgcaactgactgagcaaatgcctggtccgtggagatcccaagctgacaagggcacctgaggcaagcctctggctttcaggtggaggccctacctaggctggcctggctggattgccctggcacactgctgttttgctgaggcagacagcagcactctgcaagtgctcttctcctgttcctcttagtggtctaaatcctgtagcatgctggggtgcgactgtagacaaatcccctttccgggccccctggggttctctatttgcagtctttgggtctggtcactggcatggcatctcagtaggctaggttcatcaggaagggtcaactatgtcatggcacctgatgggcagcatttagagtctgtgggccaggggcttaagggctgcttactgctaatagttctaagtagcaagcattccctcagccctagtctgggcacacgccaggaagaaagccactagatgtgctctcctagtggataactagcctggagttccaagaagggcagagacaggcagagtgagagccttcagagatgtaggcaacgatagtagcagaacttcgagggagagtagatggaaaaattaaaaaaaatccttgtcattatttttaaatgtctgaattgaccagattagaatctttgagagtctagacactagggagatctcatgggtgggccagttattatatcatatggagggagagtacgtatgacccagcacgagaggaccagaggacagtcagtgctaagggtaaaaccttaggccatgggagattgagtttttcatcagttggcaagttttcactttaatactccactgtttccatcatttcagacgactggggatgataaggacaatgtaatttgggggataaaggaagaactcattatatttcttggatgactttactggggaaatggattccttagtcatttgaaagaagcggtagaattccacatgtggggaatacttgttctaacaaaagcttaataacattagtggcaatgatccttttatataagggaaagcttcaagccagtgagaaaaacataaataaactagtaagaacatatttataaccatgagatttgggtgcagaataaaatcaaattggcagttcaggaaaggtcctaaacatctgtatattaacaatattccatcagtgagcaatgtgaatttcccataattgaaatgatgattgataaccttgtattgttcttatctaatataaggcaaagcagcactggggctttgataaagagcaatatctcatgtacactgaggacactgaaaccccgctaggaattctatggaatttctaaaatatttatattaaggacattttacccattatagactaatttagggaaggttctgcattttttttttgatttgacaatgtttccaatgcaatttatacaatattaaataagactaattagtttttgcacctttcttgttacaaggtgaaagaactaatcctttgagattttccagaaggtccctggcaaatcccaaagccagttttaggtataaaatatatttaagttttgattgtgggaaggcaaatgttaagagttgtcaggagttctcgaacatttgattgaatagcattatgggttagcgagaaatactacttggttagctagtgaatcagagttgtaaaaattttcaagtaaacatatgaggtaacatggttgtaaagaatcttcagttcctttaaaattgaaaagactttaaaaaaataactaaggacataataaactgaacatacagatagggcattacagtattttgataagacataaaatctttgcctcttaggcagatgactcagaagaaaaacagaccatttataactttttattagggacagaccaatgatcaagaattttttttttttttttttgagatggagtcttgctctgttgcccaggctggagtgcagtcgcgcgatcaccatgttggccaggctggtctcgaactcctgacctcaggtgaactgcccacctcagcctcccaaagtgctgggattacaggcgtgagccactgcacctagcctaagaaaattttgttattttaacagagaaaccaacattttaattttatacaagtataatatttgatattagttcttttttgaaaatcttataaatacactgaataaaagttttaaccatgacaaataaaattccttttctgtgaacattttctaattttaaagatatttgtttacattttgtctcacacatttttaaattatttgtcattttaatttgggacaaagctattctctttttccttaggaaaagcatatttgcatacaaagttgtttccctttgccatttttgccattattacttttagcagtttatatatatatatacacacacacttatttacttattataattttaaccattaataacttctctttcacagagaaaacaggaggtaggtaattttgaaatatcatataccagcattttgtagcagactagtaaagcttatgaatatacatctcataactttttatagttgttatatactttttatagtaccattttgcaatgtggacaaatgaacacatttaacagatccatatgtagtcacactgtaccataaaaaaagcaaaaagtatataaacttaaatttaggtctagtgactaagtattttatcttctttataaatgatatttaatgaatttagttaacttaattcagcataagtctaaggttttaagttaccaaaaagattttagaaactgcctttaagcttacatattataaaacataattactgttgaaataaagtttgccagaataatgactcagtttggttaaaagcaaatttaaatttttataatcttaaacatgtagtagatataatactagcttattcaacatgtaaacctgtttaagtttaggaggaacatacccaagtagagtaaaaatatatgcttgtattctgttgtattatatgtaatgctgataactcaaagacacataggtgtctattaaactaacaatattaaactagttttgtttgccaaaagtttacataaattctgtgaacttgagttttaaaagcatttgggttagtttttataagaatacttttttgttgtttacactgaaagtattagaagttgtttccttaatttatgagagctttataataatttatataagtacttatttatctctaagtcaattagaatagaggataagggattttgtaaattaatttggtaatgccatctggaggtactgaactattacacatatacaacatacatgtatactaaacatacagacagacacaaatagagatctaatggcgagccctcaatgggtgcagggggcctgaagctctactggctataggcagttgagagggctgagtgggaaggggaaagcctggtgaagagtagataggggtatgtaggaggtagaggcattgaaggggacagatgaaaagattcagggagctgaagggaaggtccaaggtggtgaaaagaagggaagagggatgcggtaggaagatgagaagggggaatcttagatgagcaggtttggggagaccccaggttccctaataaggtcactgaagttccaaattacccttcgtgattactttttttttttttttttgccagttttggaaatactggacagaatgagtgccataggggcagggcatgtagtcagcaagggaggaggaggaggatgaggaggaggaagggcacccagtagattgagagttacctgtgggaagaggcagatcaaatagagaaaggagccaggctggacagtctcattaggaagttctgcacacagtcgtcatctgggagccaaagtttctcttcagtcctcattgaggagctgaagggctttccttgtgcaatctctagacaaggtgtcaagggaaacaatgaggcctcacaaaagagccaggaatttggagtaaatctccactcaaaaggaaccaagaaaacttctatccaggacgattctggctaaaattgaaaaggaccaggaagagtcctgctcaacagagtcaggggttaaatccccactcaaaaagagctaggaagagttctgtctgcgaagattcttgctcaaacagaaaagaactgggaagagctcatttaacagaatcaaagtaactgaatcacagaaccataaaaagtgtccaataaaagcaaataccgtctctgggcagggtgcaatggctcacacctgtaatcccagcacttgagaagctgagggaggaagatcacttgagcccaagggttcgagaccagcctgggtaacatagcgagactcctatatctataaaaattttaaaaattagccaggcatggtggtgtgtgcctatagtcccagctacctgggaggctgaagtagtggaggattgcttgagcccaggagttgaggctgcagtgaactattattgcaccactgcactccagcttgggtgacagagcgagaccctgtctcaaaaacaaaaaacaaatatggatttagatagagacttttattttattttattttattatttttgagacagagcctttctctgtcacccaggctggagtgtaggtgccatctcagctcactgcaaccaccacctcccgggtttaagcaattctcccgcctcagccttctgagtagctggaattacaggcgtgcgccaccatgcccagctaatttttcaatttttaatagagatggggtttcgccatgctggccaggctggtcttgaactcctgaccccaagtgattcacccgccttggcctctcaaagtgctgggattacaggtgtgagccaccgtgcccgaccaatactttatttaaaaagactattgcaatagggacaatgctgcaacctcaggacttgcaaacatcacaaaataatacaaaaaacatcacaaaataataaaaaaaaaaaagcctttttttttcagtagggagtagtaagcacagctagcagctcagctactttcaagggccagtgggcaagcaaaggggaacctgtttggcatgatttgaccagaaatgtgtttccctgtggtcagccggttctcaggagaagctgctaagtggggcatgttctgcattgcagcacttacttaaccaggagcaagcaaaattcaggccctgtggggaggacagaagcctgcctaacattctgtcaaggcaaaggagagggtaaaaagcagacagctgtgaacacttgatcatccttcaggcaataatccattctgggtttctggcttaagactcttgagaaacaaggggaaacaactggtaggagcagcaggctcacctatatgtagttccgtgaggtagccttatggacttctgccaccttccaaaactcagcatgtcccaaaccatctttatcaacacagcttctcaccaaaaacaaccaaataaaacaaattaactaatgtactaattctgtatctccccctgtgttgttcatctcaaaaaactgttatcacctcattgactcagactctcaaccagcgaggtagaagaaatgtttgggggcatgttaaatgtaacacctatgagacatgtaagaggtgaggtgcaggacgcaggtacatggtgataaaagaaaaacctcagccggattaaatttaaaggagtttcattgagcaatgaactatttgtgaatcgggcagcccccagaatcacagcagattcacagagactccagtgcagctacatggtggaagatttatagattaaaaaaaaggtggagggggggaaatgacgtacagaaattggaagtgaggtacagaacggctggattggttacaggttgggggtatgccttatttgaacacagtttgaacactcaccagtgtatgaatggttgaagtatggccgctgggattggccaagagttagctattgttacaggtacacactcctaagttaggttttcaattttgtctgcctctaggttacagtttattgacaaagactcaaatatagaactatggagtccttctcaggccgtatttaatttgctttaacaattccccctttttggtcattttctcaactttgagagattgacaaaaaccttagttattgatatcactattacccttgtaaatgtacttatatggtcttgaaacccactgggaaacaggaggacagtgggttttgtaaggagagaataaggactgagtagaaggtacctctttatgctagaatgttctgtttacaggacaaaaacaaaacctggtctgttttaataactatttgtttccttaaagtcttagtttgattatgttacatttagcatgagcaactccattttgtttggtttggtctgttgggtcctagtgcatgagctcagtacacaacaatggcttgccagaattttgtttaaaaaattccccttggctgggcgtggtggctcatgcctgtaatcccagcacttagggaggctgaggcgggcagatcacgagctcaggagatcgagaccatcatggccaacatggtgaaaccctgtctctactaaaaatacaaaaattagccgggcgcggtggcatgcgcctgtaatcccagctactcgggaggctgaggcaagagaatcacttgaacctggcagtcagaggttgcagtgagccaagatcacgccactgcactccagcctggtgacagagcgagactccacctaaaaaaaaaaaaaaaaaatatttccccttattggccaggttctcacttaggtgagagtgtgaccaaaacttagggccttagcaccacttttagttacctagttaccatcattttaggtttccagtctcagcatgtcattcataggttatgatgtcctcataatcatacatttcaatcagttttgttattccagttgaagagagaccatttgacatttcagagatggctgcatgcaaacatttgaaacctttgagagaatacagtgcactggggagactactatgactaccagtaggataatacccagagtttgaagtatgctgtttacctgaggtccccataaaacaaactgcctaaattaaataaaataaagaatgagctagacgaagagtctactcacttcactaagtgatcttttcattaatcctgtatgactgaatttttataatctgcacttgatatacatattagaattttagaaaccccatataattttggaatatatattaatataattcactaaaaatataccctgaagattaaacattatttttattggccaagcgcggtggcttacacctgtaatcccagcactctcggaggccgaggcaggcggataacctgaggtcaggagttcaagagcagcctggccaacatggtgaaaccctgtctccactaaaaatagaaaaattagccaggcatggtggcatgcacctgtaatcccagctactcgggaggctaagactggagaatcgcctgaacccaggaggtggaggttgcagtgagcagagatcatgccattgcactccagcctgggcaacgagggcaaaactcagtctcaaaacaaaacaaaacagtatttttattttgacaatgcctcccatgatttttataccaaataagccaaatgtcactgttgcattagtgcattatcgatgtcaaacccaattcttaaataaaaccttatagacaaatgtattcaatcttaatcagtttgaacataaggtaagaattttataaaccttttataaccctttacaatttttgttgaagagcagattagtgctctaagaaaacctgttgtgcttttatgtccatgttcaatttatggaaaaacctaataatacccttttaaatttagtattatcatacataaaattttttacaaggttaattttttttttttttttgagacggagtcttgttctgtcgcctaggctgacagtggcatgatctcggctcactgcaacctctgtctccccagttcaagcagttctcctgcctcagcctctggagcagctgggactacaggcgtgtgccaccatgtctggctatttttttttttttgtatgttagtagagagggggtttcatcatgttggccaggctggtctcgaactcccaggtgctcaaaggaaaatttaagacagtccatggaggagaaaggtatagacaaggtcatgcagatattaaaccagaaaggacttatttcctaagccaggaatcgaacccagactgccactgtgaaagggcaaaaccttaactactgagcccagaaggagtctagagtagttaattttgagcttgcaaaggcttttaactagtcaagataatttttagaactaactatgatatgaaccctaaaattcctgttccctggaaggtagagacaaggagaaagtactgccacatggttacaaggtcaagctcccaaggacataaaacaggatggcgaccttgtccagttttttgttggtttcagggacctgcagcaaagtttgtcactgaccagcttgctgggccatcttgagcagcaagcttatgggggcccaagcccatgttttatcctaaggtacccctcgacacagaaaaacgactttatagcacaaaatataccagattgactacagcttaagactagacagcctcagaattcctttttgcattaattaaaattttacagaggagataaacagtgattttacaatcagtttgcacagagagagagaagcctgaaatctgactgggaagagatatttacccttttgctggcatgccaggcttctgggctccctttccctgagtggccctggtgatctggctctctgcaccattgccccgggagccaagccacaacacaaaagaatttttttttaaaatgcacttcagtgtgttgttgttcatttggaatgttccactgtaagttatctttcgtaagatgtcaccatttctgtaagaatttgctgcctcccgggcgtaatgtgtaacccagaaggaactcagttttccagaagcaattaataggttccatggaatgttgatggtaagaaaggaaggaaaaggtgacaagagtgagcgtagacagctctttctaaggagtttggctgctggaaggggaagagaagcagctggggttaggtgggaggaactaagtttagagacgctaaaagtgtatgtagcaggagtcacctgatcaggttgaactgcagcaggaacaaggaagttccattttgactactattagttgcaaattggacccttatgtcaactttttcatctgtaaaaaaaaagggatggccaggcacggtggctcacgcctgtaatcccagcagtttgagaggccgaggcgggcggattgcctgagttcaggagttcacaaccagcctggccaacaaggtgaagccccgtctctactaaaatacaaagaattagccacgcgtggcagcgggcgcctgtagtcccagaatctctggaacccgggaggcggaggttgcagtgagtcgagatcacaccactgcactccagcctgggcgacagaccgaaactccgtctcaaaaaaaaaaaaaggggggcaggggatgaaaatgctattgctttccaggaatagctatgactacttccaataaagaagacaagaaggttccacatgtgaaaactacgcggtcacaacgataagtgggcgggtgcacgcacgcgcgctgagatcgtgcgtgcacaggccggggtgcggccggcgtgagtacgcctgcgcgtgccgccatttcctgcagccgcagactctgcctgcggtgctcgccgggaaatgagacgatcaacaaagaaaatggttgttttgggcgagatcgaccgtggagaggctttttctgcagcagtcccggttcctgccgccagatggcgctcgaggatcacaaatgggtctagggttctcataatggccccgcctaagaaattttggattctcctggcccttcccccctttgtggggtcaacagcggatttgggaatctggtgaccaacacgtgcgcactcccctacccttgcccctaccgagccctccagggtagcttgggggagaagctcctccctagactgccgggtatttgatgagcctggccagcgcacaggtcttgagcaccatggtcagggaagaaggctgaatggcttaggtcttcctagagaggccggaggcgggaaagaactggagaaaggagagatggcagtgggaggatggggacaagaataccagtgtgtttccagccagaagacgatgtcttttaacacctcattgaagtcgtcaggtgactttgcccttgtcagaaaggagcagcactgcgggggtcctactgaggaggagactgactgctccttggggtggggattgtgcctccttcctgtctgccccactcttggggagatgagtccctccaagtccacgagacatgacagccagcctacctgccatgggagaacaaagtctagtctcagggcactcacttcataagggtcttattcttcctcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcaggtacgagccaaactgcactgggaccttacctgctagagccagtgtttttgtccagggcagcaacccaggacaaacccccacacactaggcatgcctgtttatcctctgcaggtgagtgtggttaggagccagagggaaggagagaaaccagcatctcaggggtagatattcatgggtttcagcttggagccatagcatcaaatctgttagactaagtctggcacagaaaggatgcacagagaaccaggttgtctggcagccagttcgaacctggaaacctgggtcaggggagggatataggttgctttttctgttaatggagatggaaactctctgagcaaggtgtgccatggtgtggatgtgattcactgccagaaataacaactgtaccagttggatgagctcttccactgccatcagcactgggatggccatggatttggacagtaatgtagctccacagtgctgactcagggttgctcattgattgcaagaagttggcagcagtagcctgaggaaacaggggctctgaattttctgagagagaccaagaaccaaggaacagccaggtactagggaacagacaacaccagatgcttgtgcttttctgtgagcagctcaggtctcccaaagtggtagtttcctggcttctggcctttgtagatcagtgtggatccacacccaattgtgatgtttgtggtagctgtaagaactttcccaattttgaaatcctaggtgacttgtagcatattttttcacatttgaaaataattgagttttgaaaatgtttttacaggcaatctagtatcagattttatatcatcctgaaacattctgtcaattgtcatttccaaaaatccatggaaaactggagttgttgaactggaaacagtgtggtctcaggaagtgcttcacagccattgcaacatgggcagggcctagagggcaggagagaatgccatgatttgatgacattttacccattcctgccaggtgaacttcatctccctctctgtgacagaattttctggctctcacatccagctttggtcactgggaacccacctattggctcttgcactggcaggacatgtggtagaggcttccagttcgaggcaggactggctgcattttcaagatgtccttatttctggtattttgtggcgatcgtcctgtccacttaactgattttgacccattgccttgctgtgatctctgtgctctctctgtctcccagttccaggtcattcccttgaccagcttccagtctttcctcatcttgtccctgccaatgaagtattctggctctgccttcactctcctgccatgatccattgctttgatagggtggcttcaggaacagggtgaggagagggctgtgctagctttatcttgccaaggaactcagcaaagaaaatttttgctgacctcttgcattcctcagcctggctctggtctctcaaacctaacacatgggatgcatgccagcagccagcctcagtttccctctggtccttttctgtgtgaggccagaggtccttgctttatcactgcctggagctgcagttgatgatggtgaaagaaggtgcacgtgtcttttgagagctccctttgttccccagagatttttttttcccaaagtggccatgagtttgggaataaccaggagccatgggccgccggctagagatgctgcatactaagagcctcctgtgagcagccatgtacacagtgaacacgatggctaaggccccatccagccgccctcaaagagcacatagtccactaaggaataagcatgatcgtaataaccattagcacctgctgtgtgctgagaatgtgcaggcactgttctgcatgccttatgtggactcactcatttaattctcacaccaactcaaggaggtgcttttattatggagaaactgaggcagatggaggttaagtaatttgctggcagttttgcagccaggaagtggcctaaccgagattagaatccagacagagatcagagcctgtactgttcatcgctgtggcatccatactgcccctccatttgtgataagcccaggaaggaaagaaaccaggtgctctgatggagaggggttagagcaaggatggttagggaaagcttttctatcgaggaggagacagttcggctgagacctgaaacatctggaggagcctgccttccaaagaacctggggagaggcattgtggacaaagaagatagggaggagggcctgaacaatgagccctgtgcttggagggtacggggtgaggtgagcagggggcaggagctgggccctgtagggtcttgtaggtgagggagaggaggctattgggagggctcctattgctcacattgcagtcctggggggatgcccagggcattttttcttttttttaagaggcggtgtttcactgtgttacccaggttgtttttgaattcctggcctcaagtgatcttcctgcctcagcttcccaagtagctccagggaatttctgttttaccttgcctcttcagttgcgccgtccccttcagtattctgctgacatggatcacaggataccagacacctggtagttgttcagtcagtaggaggtcttccttccttcctcttagaatcaatccttttctcacttgttggctctgcattttatcccccgtgtatcttttcagatttttgtggggcctcctctcccatccagtccaccttctccagtctctatggtatatttctttgtcatagggtgaagcaggaacaggtacaggatgattgggtacactgaggtgaggtaggagggcaggccctcaggaagggcttcccagaggaggtgatattgtctgcaaaggcatatgagagcctggaagtccaggggaactgcaggctggtctgtacggcttgagtggcacgtgatacagtttgagactatgaggcgagagagctaggcagatgctagaccatgattgttcttccctttccccactcttcaactagttgtaatcttaggcattggattctctggcaaggggacaatacccagtagcctgggccagatggaggcagccatatctggagtatgatctgagccacagcatgttggagaaaagccagaatcagcccagggcagtgtgcacccatagtgctggcctcaggcctttggagggtgagcagacttaagttggaaggtgcaaacaagtggtcagtggtgctgcccaacatcgtgccctgaactgcagttgacagctacggcagctttggtaatgaggctcatagcctgggggcaggcagagtgagagccgatattggcttggccagagaaaagcccttttgggctgccgaggaggttggattccaggccaagggccatatctggcagctgaagtgtggaggttcagaaaaacttcgacaccggtcagtttcccgcctctgctgggaatgaggtgcatctgactttcctcctcaatgatgcctaatttcatttggtcctctgccccttggccttgtgttctctagagagttccctgcagggtggcagaaggagctgatcctagtaagggaccgtcccatccagtgaggaggtgagctgggctgtgtcttccccttctgcaccctcctgactgtcacatccccgggagccccatgattccactctaactgagtgaatcacagaggccaaggcccttggctgcagtcaggagtactgagtggacactggaagattggggtcttgctactgactcacgatgtgacctgggacatgtctcaactcacctagcctgggtttgcttatctgtaaagtgagaagttccatttgttggtcttggaggaagcttcaagagcagtgctcaagggttaggctcagaaaagcctgtttgaccctggaaggtgtcagctcccaggttgacgtgcccacccctccctttatttctttcagggtgaggagcccctcgagctgcatggtcactgttactgtcactgccacatctgagcagcctcacatttatattccagcccccgcaagtgaattggactccagctctaccacgtaagaagggctatctagcaacctgggagatgttcctccgccacttcctccttggcggtaaaggacttggcttttgttccatgttgcttcccatttagtgccttccccagtttctagcaggccattagccaaggggccacacaggacagtgttagtcccctaatataaactcccatctaccgggcctagacattcccacacctcctttttcctatctctgtaagaggctgcagtggtacttcctagtgcactagtggatgtggctctgccattcatgggtccatgcctgggaagccagctccagtccgtgaaggccgggcctgtgagggcattcctgtgttactgtaaaggaatacctgaggctgggacatttataaaggaaagaggtttaattggctcacagtttggcaggctgcacaagcatggcaccagcagctgcttggcttctggcaaaggcctcgggaagcttataatcatggtggaagccgaagtgggagcaggaccatcacatggcacgagcaggaacaagagtgaggaaggggagggcccggactttgaaacaaccagatcttgtgtgaactaactgaatgagaactcacttttcactaaggggatggtgctagctgttcatgagggatccccccatgatcccgtcacctccctccaagccccacctccaacactgggaatcacatttcaacatgaggtttgtctgtctctgtcacatgcccactgcttcacctgcattcctggccacctgtcagggtgcaggaagggatgtcactgcaggaaggctgctcagtgaggtgtgtgtgttgggggcgggaggggggcatatccaagggggcctctgcagacatcaggtcagcaggctggagtgtgcagcatggaaatgggggaaaatttggggccatcctgagcccagcatgatgcagaccttgtttccagtcctgcagaggccagtccaggatgaggcaacctctaggcctctggactctaggagtgagaatggagaggttagatgtgaggtggagattgcacagtagctgagtaccttctgggaagtgctgagtggtaaagactgacagtgtaggattaaggcttggaggatatcttggttgtgggtagaggggaaagacgacgcagccctaaagtaggggtggaaagcccacaggactgaagtgtagaagtatagaagcctggggagaagatggggtcaccgaggtctgcatggaggaggacagcacattgtcattggttgcaggaagcccctttctggggccctcagtccaaacacaacaagagacgctcatggcctgggattgtagtctgagtccacagcagtgccagtgcctttatcctgggccttcccatgagctctttcacttccttcaaaccaggctgggtctccccagccctgaaccactcctgtgggccaggcctggttccctggaatcttctggtgtacctctgatttcttctgtgctccttctacagcaaagggattctcttcgtgaaggagtacgtgaatgctagtgaagtgtcttctgggaagccagtatctgcacgctatagcaagtaagagcgggtcccaaacccttccatgtcggccttctcctgccggctcccatattctcatccctgcatttccagttccttgtccaggacttggctcagagtagcttcggggtaattgtcgagtggatgagtgatgtagttgccctctgatgggattgatgcattttctactgaactgggcacctttgggttctcccttccggtgaattcatcctgcacaccattttcactgccattctgttctgcttgtctttgttattttattttgtaaaatgctgagaacacccctcttgacagagctggcagagccctagggaccaactagctcatcctatttcttttcagatcacagagctcttctcttctgccctcatgttcttttctgtcatgccaggctgcctcatttgaacacacatgtgactgcagttcctgatacatgtgtggctttgctttttaattttaattaattagttaattaattttaattaatttttttttgagatggagtcttgctctgttgcccaggctggagtgcagtggcgccatctcagctcaccacaacctctgcctcctgggttcaggcaattctcctgccttagcctccctagtagctgggattacaggcgcccaccaccatgcccagctagtttttgtattttagtagagatgaagtttcaccatgttggccaggctggtctcgaattcctgacctcaagcaatccacctgcctcggcctccccttttcattgatcatctcttcattttcttgctttgtgatgccatgtggaggggtacttccatgtcacctcggtgtattgctacctaccacactgaggtgaggtcccttagaatgtttcttatgacatgtcatctcactggaggattttagcaacagagaggagcatcctggccttatttcaggattgggcctctggggcttctggactggcttttattggtgctgtggaatgatgagcatggctgtgggggtcaagttcaagccccagctcaggcccccctgttaggatcacttcggacaagatgttcaacctctctgagctttgctttcacatctgtaggcccttagggtggtttttctcaacagcttattgagttataattcaccctttaaagtgtacagtcccgaggttttggtacattcacagagttatgcaaacatcattatccaattctggaacacctttgtctccccaaaaagaaactccaaacccgtctgcaccccctaattctaccccataactcaagcacaggtattataccagaatgatcccttctttcttctcattcccagtatctgatttctgctgagtgggctcctggtgactgtcacattatatcataggtggggaggaaagctctgctgttttcccactggtcagtggggtccccttggcatatacaacctcaggaatcctagccacccagccccgatcatctccctcattgtgaaaggtctcctttgcccccccatagaagggccctgtggcaccaagtcatgaatgacgactggcatcgtagttatgtctcagcttgtggccaaaggttaattagaaaattaactatgatagtgatttggctctcatctctgccctcctctcccctatcaaactccctgcagcgtcagcagcattgaggactcattcgccatggagaagaagcctccatgtggcagcactccatactctgagaggtatgttgactttcttagcacggagcttgcacttctacagaggagaatcagggaagggagagttcctgctgagtctgtttgcttttgtcttctgctttgcagcctccaatccatttgcagaaaggtgaaggacactaccgtagggtggtgcttcccttgttgggatatcacacttgtgacaactaaagcctttgaattgagctaagactagagggtagataccagcggtgactgagaagggaagtggtggcatctgacaacccagaggactcgtgtcagcaggaggggcccttcagattagaacctaatcaatcacttcattaacttgcaaatctaaccagaagtaaaaataaaatgactacaaaagagaggagtgggcagagaaggaagaaaaatgggctgctggcatcaagaagccagaaagacacacaaagccaagaatgcccagtgctgtggagccaccaaattgaaagcaggggcagagaacacctcgttcagcagttttgaaagctgtcactagatgatggcacagtcactagagagtcttaatgacaaagaaatcttatgttcagattcttggaatggggagaagagagtctcagagattgagttcactcaggcttctgtgaagaaaatggaataaatagccttcagtccacagtaagcaaatacggcagacccaggactaaaccccagggccctgactactcccaggttagggatgtttctactctgccatcttgcttctcattgatgggcagatcttaattcatgtggatgacattcagagaccaaagctacattggggaggaaaaggaaggaagtaagagggttaagataaagagaatcctaccgggccccagaggcaaacatataggagcagacaagcatatggggccagggaatctcctccactatagctgaagaagcaggtggttctgagtaactacagattacttggtgaggcacatcagcagatgaagtcttagcagagaagggcaggttggtcagaaacctgagagttaaccacttacataggagcaaatggaatgaggcttccaattctagtggagtgacaaaccagatactctagggacccccctttccattgcacaactactaaatccagaatcagtcattactgatccattgctaggcttggaggaaggaaggggactctctagggacaatctcagtcacttgcacacatgcatatgcacagacacacatgcacgcacacaaagaacagctgtgagctggtgctgctggtggtgaaagaagcaggaggagcagggctgcgctgagggcaaggatttcaagcagcactgctgtccagagtgaaccctgggccagcagcaggatggtgggccacacccaagctgcccgtgacacttctgggtcctccgacagagctaacgtggatctagattgttaatgtccccccgccccttgggcttctgtcagaagcagacccaaatctctggaagaaagtaccctgaattttggcttgtaggatcagatcaagcagttactttgaggaagtgcagtctgaggaagaaaagcagaggtgactctcagaaacaggcatcctggaactggaaagatgctcaacccaggagtcagtatctagaacttcagtgtcggatctgagtaggctctacagacagagcatgaagggtgggtccaggagtataggcaggggcagagctcagttggcccaggcgtgaggagaagggccatcaagacggggccaggcagggcacacaatgacatgtctcctgtaggagaaggcattggtcttcctgctctagagggtagcaggccccagcggataatctaagcagaaggtcagggggaggcaaactgtctggaataagtatcatatcaggacatctacaggagacatgtcattgtgagctggaaaaagatgcatgactagtttttggaaataatgcagaggtctacagcaggctgagaactgatctggcccagggctgtgctgcacaccacagaaaacagtggcatcctggggatcctgacagcaaacctgggcctggctgcaccaaattggaaggtctggctgtgtcacatcagaggtctgtacaccagcctgaccaccgggttattgttcttcatctcacaggacaactggagggatctgtacttactgcaaccgtgagatccgagactgtccaaagattaccctagaacatcttggtatctgctgccatgaatattgctttaaggtaaaaaagaggtggaagacaccttgagctaggcggtaactcctgatcacgtgctgctaagaacgttttgtagagtgcgggagtcttacgggttcagagactgtggaggaggcttgatctccatatacaattgcacatagtcgcagaggctttgcacaactgggagctgaatgagcttccaagtctaagacagtagatgagtgttggtggttctgcatgcttagtactgtagggaagacaaaagaggtcttttcaggaaagactatttctggcagagggccagcaagtgcaaaagccctggggcagaagcactagagtgttctagcttgcgtgggagaatgccaggagtgacagagtgggctagatcatgtaggccttggcgggcacagagtttggattttattctaagtgacattggggtccccattctccacagtgtgtggcactttgtaaccccaggttgttggttccaatccatttagggtgtcacctctgggtgcactgagaaaaacaaccctcccctttgccttgacagaatgttaggcaggcttctgtcctccccacagggcctgaactttgcttgctcctggttaagtaagtgctgcaatgcagaacatgccccacttagcagcttctcctgagaaccggctgaccacagggaaacacatttctggtcaaatcatgccaaacaggttcccctttgcttgcccactggcccttgaaagtagctgagctgctagctgtgcttactactccctactgaaaaaaaaggcttttttttgtattattttgtgatgttttttgtattattttgtgatgtttgcaagtcctgaggtccaggatgtgccacgggctcacagcatctgctcgcccaccttgttcaggcatccccttcccactccactcattcctcttgctttgctttgtgtgttgacctccagcttgcttttcttttcagtgtgggatttgcagtaaaccgatgggcgatctcctggatcagatcttcattcaccgtgacaccattcactgtgggaaatgctatgagaagctcttctaggtgggtgctggcactgcaaaggacaagtggccaagagactcattaaggagtagagatgcaccctggtctctcctggagtctcagccccagacacagctatctttcttggctcttccttatgttcagggggccttgtgtcctcatgtccctatgccttgtgatactttgagatcttaggtggcatggacaaaggccctcaatgaggacacttccaaatcacaccttccgtccagcacctgagccgagccctctagctaccctgggatactcgctcggccgctgttgttagccccattttgcaacaaggaaataaagatatagaaagggaggggacctggagaaacccaggtagaatcaggacctcaccccaggtctttggattcttgtccagggctctctgttcactgtcactcgcatagcttcagatcaggactgcatagccatggtgctcagtgaaacaagcctctgggccacattatgagaactgcctgaagatgtgtgtttgcatgctcatagccagtggaatttatcacggtgtctgagcacagagcagaatatatcccttgaaggcagtagcaaccaggctttccactagctccatgctgatggtcttctctccagaagacacaccttgagctaggtggtaactcctgatgactggagcagtcacccaccctgagggcctctagctgatgtgtttccagtctcatggctacttctgttttcttttagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcac

SEQ ID NO: 3984 - DNA, 17456 bp, human
agtcctacccaggagacacaggcaccgtttatcgcgaagaggtaagtgtcatcaagggacaccttggaggcctgttactggccacaggaaggccttccgtcagcaggggtgtagtgtgggagctgtggagaggggatgtggatgtgggggactactgtccctgagcagggggagttgtgaggggctgggggcttctgtctggaggcctggcaagcacctgggtggctgtggtagcatatgtggtcaagctcttccatttgccaatggctaatggggctgggcccctgacccaacgtggagcatttccaaggccctctgggagttgttcccctgcccctgttgcttgcctgatgccttgccttctgctctcatccaggatcaaaacctgggccatcaggagaacttcccctgggaggtgactgtgacattggagatgggccctaaagggtgaacagggcttaacagggaatgatcagaacgtcgggatactccagctgaatgagggaggggtgtcaccattagttgagacagggcaccttctggaggaggaaaatattcgggggaaagcaagaaagaaacttctggaaacttgaatttgagggacttccagttgagtggacagggaaggcctctctctgtgctgaggtggctagctggggactgcaaacccaagagaagacagcatgccaactgccccaggcagagggccccagtgcacaggcccggggtgggactagcttgctgtgttggaagaccaggaagttggcaggaatacagagagcagggatggtggcagcacaaaggaagtgacagagaacggggggcggtgggggggtcttcctggctgcatttggttcctgtggtttctgtaacgcagtaccaaaaactgagtggcttaaaacatcagaaagggattctctcccggttctggagaccagaagtctagatcaaggtgttagcagggtgggttccttctggaggctttgagggagaaaccatcccaggccactctcctggcttctgctggtggttggtgatccttggtgttcctcggcttgtacctgcatcactccagtctgtgcgtctgtcttcacatggccttctcttctctgtgtgtctgtgtccagatttccctcttcttacaaggacagcggtcattggatttaggacccatcctactccagtatgacctcatcttacctgattacatctgcaaagaccctatttccaaataaggttacagtcacaggttccaggggacatgaattttggggggacactattcaacccagtatgctgtccttatcctgagctggagtcactgaacccccagcctgggccacctcttggccgtgatcctgaagggttgggtcagttagacgccactggaagcatgttctttgaggcctccaagctctagggcagccaagaagaccacgagcgctgtttctcttcttgctcaaagggtggaggtggtggaagaggacgggccttctgagaagagccaggacccacctgctctggcaagatccactcctggctcaaacaggtaatccattgcgctcatctctgcctggggctggtggctgccatacctgccactcagtcactgaggaacctcagtcagggcacctccatgctgggcttcgagatcagtgtccccatgtgcccagtgacaagacgggacaaagaaatcagtaagagcccatctggctggatgtcccagggctgaaaggagcaaaacagtccagccccccgggagagagcacctggctctggtctgatgagtacgtatctgtgtcaccttaacccttgcaccactgagcctggtggcaacttgaacaccccaagaaaaagtaccatccttggggtttgagagggccagccaccatggcagtagcatgccattgtcagacttgctccttgcactccaataagttagccacattcagcatgcccagggaggaggctctgacatctccagagcctctcacagccaccttctttgccagtgcggatggaggcaggaccaaagcgtctcgggcaatttggatcgagtgcctgccaagtatgcctagccccgctgggagccaggagctcaggtgggtgccgagagctgactctggcttgtgagtgggtgtgatggcttcccgccagcctggctggctggttctgccagctggggagggtctggcagtggggtgatggggcaaggacaggctgagcactggtgatctcactccaggaagggccgtgatttgtcttgatttctgatccctgagaatctgggcagataatggtgctctcttgtctgtggacaactaataccttcttgtactttgtgcagaatggtgctaagtcctgcagggagagccaccacctgctgttgctgctgtttaaagtgcctgcctggattgagacctttgctcaaatctaggtctcctaagagctgcatctctgtagcacccttggaagacccctgcatccagaaggggagagggcctgtccctaccggtcacttcccaggcccccaagggctgttcaggctctcctaataccatagcaatcccccaatttgagctccacagccatttatagacaggtgaccactgtcctcagggttacttcctcagtctgggagggagacagaaatgctggcagagggagccaggagcatgaggccagctccctccatggccccaggcagcagactgccagggtgcttctccttttcactctctccctctcttgatcttctctggttgtctgactctccccataagaactttggtccatagaagatgtggaaaggaagatttgagaattctttacaaggcaatatctagggcagagctccccagtctttttggcaccagggattggtttcgtgaaagacactttttccacgggacggagcaggggatggtttcaggatgaaactgttccaccttagatcatcaagcaccggattctcataaggagcgcacaatctagatctctcacatgtgcagttcacaatacggttcgcgctctcatgagaatctgctgatctgacaggaggcggagctaaggcagtaatgatctctagcttacctcctactgtgcagcctgattcccagcagaccacagactggtactgatcctcaggctggggttggggacccctgatctaggggacttggcaattgagggatatgggggcaaaggctgccacaacaaagtattgtaccacaccctggggcgcttaaaccacagaaacgtatcatctcccacttctggaggctagaagtgtgagatcaaggtgacggcaaggttggttcctcttgagtctctctccttggctggtagactccatcttctccctgggcccttatatgctcatccctgtctgtgtgtgcctgcgtcctaatcacttctgtttttttgagacagagtctcactccgtcgcccaggctggagtgcagtggcacagtcaccactcactgcagcctcgaccttccaggctcaagagagcctccagccttagcctcctgagtagctggggctacagtcacaggccaccatacccagctagttttttttttttaaatttttgtagagacagggtttcaccatgttgcccaggctggtctggaactctaggactcaaatgatcctcctgccttagcctcccaaagtgctgggattgcaggcatgagccaccgcgcccagaccctaatcacttcttataaggacattggtccaactggattagggcccaccctaacaactgtattttaacttagtcacttctttaaaggccccatctccaaatgcagtaacattctgaggtcatgggggagttaagacctcaacatatgaattttgggtggcacaagtcagcccataacagtatacagttctcatttctccttatttctcttttaaagaaaggcaataaatggtttcaggtgcctttctgtttgttcgtttgtttgttttgtttgtttttgagatggagtctcgctctgtcgcccaggctctgtcgagtacagtggtgtgatctcggctcaccgcagcctccgcctcccgggttcaagcgattcttctgcctcagcctcccgagtagctgggattacaggtgcacgcgaccacgcccggctaatttttgtatttttagtagagacgggtttcaccatattggccaggctggtctcaaactgctgaccttgtgatctgcccacctcaggctcccaaagtgctgggattacaggcgtgagccaccgcgcttggcctcaggtgccttttagaagataatataggaggctgggcatggtggctcatgcccgtaatcccagcactttgggaggccaaggcaggaggatggcttgaagccaggagtttgagaccaacctaggtaacatagcaagaccccatctctacaaaaaaataaaaaataaaaattaaaaattagttgggagcattgatgtacacctgtagtcccagctacttgggaggctgaggtgggaggactgcctgagcccaggagtttgaggctgcaatgagctgtgaccgcacccttacactctagcctgggtgacagagcaagaccctgtctctaaaacaagaaaaaaaagagagaaagaatggaggagaattagattgtgctgtattatagatttaaaaggcactttgacatttattccacaaaattcctttcgatgtttaatccccatcatatggttgtcattgcaaggtggctttttaagtttgctcaggttgccataacaaataaaggctagagattcagggtccggggcaagctcccaacaggaggctcagcttgatgcttctgatagttctttcctccaattctggtcactcaatatttggagctcacccaggcagcttccaggaaagctgctggctgatcctgaccctggagggccgtcttctctgaccctaccacgttaggtgctgcactggaccaagcagccaccatcagtactcccaggcccagctcctatctgcctggtgtctgagaagcccagcccgtgaggaacaatgactcaatcaaactcagggtcctgcagcacttcagaaaaggctggtttgtggcagagtggaagaggagaatgtcacagccttgtccccaggcacagacctatcgaggctaccctctccccaccccctgccctgccctgtttcccttagctacagtgcaaaggtcagctcctcataactcttgccccccttgcaacctgaacccagtttagggaccctctcttggagaaactggttctacacatgcaccccttctcggcccccaggcctggctgctttacccgaagcactggtcaagcttgcctcacctgaccagggcatggcctcctgggtcccggtcctaggctctgcccagcatgctgcctggcagagcgtctggggagcagggagtaggagcacagcttctggcacaggacaaaaccctggctttgcatcagactgactgtgtgaccttgagcaagtctcttcatctctccatgcatcagtttccccgtggataaaatagggagagcagtaatagctacttcccaaggctgtcccaaatgctaaatgagatcgtgcacctgaagtacttaccacagtgcctgggtgctggtatcctcgggggctcccagtcataggcgtgctgagctgcagggcccttattcaaatacaggaagagatcaatatctccacctgctggcatttgagggaaatgtggccaaaggcagtgaaaaggaggtatcccctcgccccacatccccgcctcctcgctctttggcagaatgagtcacacactgtttggcacaggccacagttggtcgcattcccacaggtggctgtgatcagttttgggcttcaggcttcagcagatgcctgcctctcttccttgggtgccttccaagggtgtgcagccttccagcgtggtcctggacttcagcttggactggagctgtctgtggttgagagtctggggagatggtagggtagcgggttgtgggggaggagagacccttgtattagtttactggagctgctgtaacaaggtaccagaaactgagtggcttaaaaccacacgcatttatcctctcacaattctggaggctggaagtctgagatcaaggtgtcggaagggccatgctccctccaaaggctctgggggaaaatctgttccatacctttctcttaccttttgttgcctgcaatccttggtgtttcctggcttgcgcccgcctcactcccatctcggcctctgtcttcgcgcagccgtcttccctctgtgtctgcccacattgccctagtctgacatcagtcactggagcaggctggggtgacactttgttcccatttcctctgtgacagagccagaaacgccagtgagaaaatatgttgtgcttgcctgtgacatccctgttccctggcaccacctgatttaaatgaggcagccaggggttttatactgtcatcataaatgacatcatcctcaacaacgatgtcatcgtcgttatcacgagaggagatggggagaagtcagagctgtctgtgtgtctagggcccctcctggctttcatgatgggagaggccttgtccttggtagcccttccatttccctctggtcactttgagcactccaggccctggccagggtggaagtggagggacagagatgagcagcccgctgacccagccctccatggctcattccttgctttcaccttggccactccatcccctacccctcctgggacccctgagtggcctctttaaagtgccagtctgaacctataaaccccccacctccacttcaagcccatcctgcatcttccctttgccataccagatctagtctgtacattcaggacccctgccagcctctacctcctcctcctcccccgatctcccttcagctggcctgggtcgggctatgcctccatgaagcttgtccactgctcccatggctaaacctgttctgggccctgcagcacagcaaggtcagtttccatgcctctctgcccctgcctgaccctgctgggcccagagcttcaccagggcaggcctggggctcaggcttgtctgcacttccagggcccagggacaaaggcaggagtgactgcaatgtggcttggaattaggctttgctccatggacctaaggaggtctggtttggggtgaagggtccacccccagaaagcctgggagctctatattctctctggccctggccacaccatggccaagcctgctgggcgtcatgccttgcagtacggccagagaatgcatcagacttggagggatgtgtgtccggggtggcctgtggtcatctgggggagggctctgagcgtggctggcaagaggaaagctcaaaggggccctttgtcctcatccccgagtctgcgacatcccctcccactggttttcattccatatttggtctgtgggttttctcagtctctcgtacccctcagtccccaccagtccatgaatgcagaactacccctggcctcacaaatggccactttggataccctggtggggtcacaggctgcggttgcccctgcaaatggttggtagaagcacgggttgggaggtttcatttctacccagaagggcccttgctgtgcctgagggagggctgggctcaggtcaggggtgggagaccggggaaggggcctacaggtcagtggcccgagctcagctgcagcaccaacaaggctcaaggccaaggaggagatgagagcacatcaaaagggggcagtgggtctgggcggcccaccgcactcaccagcccaagaagggggagacttttctcacctgcaacccactgggtctctcctttggcccgcagctcaagaggtgaggaaattgtccgcctgcagatcctgacacccagggcaggactccgcctggtggccccagacgtggaaggcatgaggtatgggggtcctgctgctgtcctggctccctggacaccattctagagatggaagcagcagcctcaggtggcaaatgatgaggcctagggccggctctgccactgtagggccaacaggttgatgggaggcatggtcgacctgggttttctgccccatctcattctttcactcagaaaaccattatggagcaagcgcttagtctgtgtaagggcacaggcccgaccctgggacacagtagtgaacaggaccccctggctggaattgccatctgcctggtgggggaggcagacgccgacatgagcatgaatgaggtcagccagagatgctgtgtgccaggagcccctgggaagtgacagctcaaccctgccaattgctgaagatgggaccagtcagccgtgctggggatgttggtgggggtgggaggaggattgggtctaaggagcccgtgaaggccactgaggccattgccctgcctgtgtgagagggccactgggaatagagtggggtcactgggtcagagtccacagctctccatgccactaggctctgtgctggggaggggtgggtcaaggaggccacaaccagcagggagcacgaggggctcagcctctgccctggggtgggggtcagacagccaggtgacatgcaggcaggattcgggggctggggtggaggctaggagagatccgagcagggagactgggcccctaccttgtgaaggccagggactggggagagaagcgggagtgtacactgaaggtcatcccttaatccctggggtggcaggaacttcgagcagaggcctctcaacagtgtggtgggtgggagtgcttggggagggcttcctggaggaattgacatccaagatgagtcctgagcgatctctaggtccctttaccctcctccttggctcctcccactttaattctgcccccaaggcaccaagtcctgtccactttattttagagatgtttccatccctattgctctgcccctggcccaggcctccactgctactcacccagttgtctgcgaccgtttcctactgtcccatccctggactcccttccacatctacctgggtgatgtttccaaagggcagaagtagttatgccagccccctgcagaaagccctgcaaagcccctcccactatgctctgcagcctgaactcagtacctggccccacctgcaggctcctccctccctgggcctttctctgtgcaggctggaggctctgcctgagatgccctttcccctcttcatctttctgttccacctcaaatgtcctgtcttctgggtcatgtccttctcctgagtttcttccccaggcagcatctgagggcttgtcgattctgcatggcagcatccattctgcatggatgtagatacaatcactatgcccattttacagattaagaaactgagaccctgaatggttaagtaacttgctcaaggtcacatggtccagagcaggcagatccgctcagcctgccctactcccaccttccaccttctgcaccatagctcattgtactagttggggcagggagcagggggacagagaggggtgatggaaagacttggcatttgctgagtgaactcatttgacgagtttattcgtaggcattgaagtcaaaatttccaggagggaggtattttaaggtttgtgattgaggtttgagagagtgattagggctcaagagatttccacgttatatgcagacagaatagagctgaaatcatgagcgtaaactagctttacatggggctcatggtgagccaatggaagctgggcaccgacctcagtatgcaggtggcagccacctggccagccctcctggggacagctgggcgagggcagtctcttctcgccatgttgagagtgggcctcctgagggccagttgggagttagtgggtgtgcaggccagtataaaggagaggcaggaacaagtggagatccctgcttcaagggtggcagttgacaccttgggaggggaggagacagcccagcaagtggtggagcacgccaaagggaggagaaaaaggcggagaccaggaaggtgtgtggccagggaggtaggcaggtggtgttgacaggatcaagggaggaggggtggtgagaaggctggagtggcccactgggtcagcagtactgaatggtggtttgaaataatgatgggactgtctctcctggatttgacaacatggggctccctgaggacctgaaggagaacagaagggggcttaaattaggagattaggatcagggatatagtccagaactcaaatcccagctactcctcttattacctgtgaaatttggggcaaatcacaggggctttgtgtgcctccgtttgctcatctgaaagatgggcatgggtgataacagtgcccatatcctggggttgatttgcagagttaatgcatataaagtcacgagaacaggctcaaatgctcaatcaacagtagctattgccaggcacagtggctcacacctgtaatcccagcacagtagctataaaacaacaacaacaaaaaacaaaaaacagtagctattagtaatgaagttttgataattggccaatctgtcaatcagcagggtttgtttgtttttggttctgttttttaagacagcatcttgctgtgtgtgcccaggctcaagtgcagtggtgccatcacagctcgctgcagcctcaaccttccaggttcaacctcccaagtagctgggaccacaggcacacaccaccactcctgactaactttcaaaaatatttttgtggagatggagtctagctgtgtttctcaggctggtcttgaactcctggctcaagtgatcctcttgcctcggcctctcaaaatgctgggttataggcgtgagccactgcacccggcccagtagcaggttttaagctccgtggagacagctggcgtttgaggatgaggtaacagcccacacctgagtgtgaatggctgctgcatggttaacttccatttctttcctccataggtcttccccaggcaacaaagacaaggaggccccctgctccagagagctccagagggacttggctggtgaggaggctttcagggcccccaacacagatgctgcaaggtaactcagtgcaggaagcagacacttcattcccagaacacggagcccacatacacccagctgaaggacttccatggcctccggtgcaatgtcaatggatgcagctggggccaggaaggtcctgttcccactgttcccccagtacctggggtactgcaggtctttaatgaacatctgttgaaagaaagaaagaatgaatgaatgaggcctggagggaggtaggcccctgccatgattcctcagggagccagttagagagcaggaccaaactccagggcaggctatccccagctcctggcctgtgctgagttccttccattcccctgaagcttccacactcactgtgcttttactgcaggacaaagcagccctgccaatggccagggcaaagcaaggccaccaagctggcagtctgggagagtcagtgaccaaagtatgtgggcccccatagagcatgtagcggagactttcaggatgacccgtggactaagggagacattgtggcaaggggtgaggggtccaggacgggaagttggagccatagcggtggatgatgagtccagatgggatgattgtccccagtcgctgcacagccagcccactgacctgtcctccaagccagaccagtgccaaatgtgtctggtgagcagtggctgcaggctgggcatttcttcagtgagaacctggtagccagttacagctaagaacccacacacccgtcttctcagtgtggatccctggagcccctagctggaaccctgagccctggaaatgaggaaaggaatccctctatggcttattaccagacccacatgtcttgccccttgctctgttggcaatcagctccccccaccaccaacgaactaacctcctcctgactttccaccttgctcccaaccaacccatcaggtttggaaaaaatacagaaatacttcctgttagagtcaacttgggcttggctcagctctggtcagagcagcacagagtagcagccaaaggcctgtgcttctggtcttgaggcccactctcatggcatctgggttagatgagatcaaaacgcaactagagtcagcaaatactccacttctcataacaggtcaagtgcacagttgagtgatggcaatgtgggatccggagccacgggctcccggcctgaaggcttggctgcagtagacatcggctccgagagaggaaggtgagctgcccgggggaggcaggttctctcatgcccctggtgacagaccagggtcaagctgccaggctgcttgggctgctatgggtggggcactggtcacttcctatggctcctgtctactgcttctcccacactcccacattccaccacatcctgtgtccttgggctttccactttttggaatcttgttcatttttctgatccctgccactggccctcaagctcctccagagtaggcactaggcccactcacagctggaggcccagccctcacatggtgctggtcttgggctggtcaaatgaacgtgtagggaatacatgaagggacaaattaatgagtgaatgactgaatgatggaagagtcggcaccttcttacttcttggttaagctctgaggaccagctaggaggccctttgctcctgctttctcccttctctccttttcctgccccatccctaccccaggcagctctgctctgaggttcagggagaggaaaagcggtagccctggagagaccagcgtgtccagctgggctctggcttcttggacctggagggagtcaggggccactttctcaggtgatttgcagagtggcaaggtccctcttgtccctaagtggttccaaaccaagcctgaatcattcttggggcaaaggctaggtatgcagatgttggcataaatagtttagctccaaactatgctagagtccttctggttcagagcagatggctagggaggagtggcaaagccagtgtctgcaaagagctacaaccgcaagatatcatctgcctcctgcatcctactgcagtctggccaaggagggaatcctgtggggaaggccctgctgatgctttcctacttccctcagcacacccagggcccctttccctcactaacttcaatagtttgcaattcatgccatggaaccagagcccgaattctaaatccaggcccacaagtcaacacaggaaggggacagcaggtcctggcctctgaaaccactgtctccgagcaggtccaaggagaggccaccagagactctgttctttaagctgccactaatggggaggactccgctagagccctgtccatgcagcctgcatctttttgccatctgcagaggcattggagggatctttttaaaaataagctagatcacatttctcccctgctaaaaccttctagtggctctccattttccttagaatgaagtccaaaccctttcccatggcccactgggtcctgcatggcagaatctttggccttctatccagtcggggctcctgctactctccccacagtggtgcagcttgactggctctgctgatggctgtcgcggaagagacttctggtctactgtgattgggtggctctggtctcctccatgtcaccccgcctgcttatacaccctcataacatgaagcctgtgctgtccactgtttccttaaaatgaaaccaagcctcaaagttacttgtaaagtcatctgaagaatcttctagattttcatgaattttaacccagtcttttacagttgtcttacctatatagtagtccctaggtatctgtgggggattggttccagaacctcactcatataccaaaatccatgcatgttgaagtccctgatataaaatggtgtagcatttgcatgtaacctatgcacatcctcctgtaccctttaaagcatctctagattattataatacctcatacaatgtaagtggtatgtaaatagttgttatactgtattgtttagggaatgatgacagaaaaaagcctgtacatggtcagtacagatgcagccatcctattttaattatttttcccacatctcatctcatcctctcctctcctctcctctcctttttcagacaggaccttgctctgtcaccagggctggagtgcagtgctgtgatcacagctcacagcagcctcaacctctggggctcaagggatcctcccacatcagcctcccaagtagctgggactacaggcgtggaccaccacgcctggctaacttttgtatttttggtagagacgaggttttaccaggttgcccaggctggtttggaactcctgggctcaagcagtccaccgacctcagcctcccaaagtgctgggattacaggcatgagccactgtacctggtcccaaatattttcaatctgaagttggttgaatccacagatgtggaacccacaacatagagggctgaccacacttagtttgactataattttcaacaaactcctttattgtttttcctttttttttttttttgagacggactcttgctctgtcccccaggctggagtgcactggtgcgatctcggctcactgcaagctccgcctcctgagttcatgccattgtcctgcctcagcctcccaagtagctgggactacaggcgcccgccaccacgcccggctaattttttgtattttttagtagagacggggtttcaccgtgttagccaggatggtctcgatctcctgaactcgtgatccacccgcctcagcctcccaaagtgctgggattacaggcgtgagccatcgcgtcctgccttgtttttccaaaggaaaggttgtttctcatggcaacaaccactctccttttccattcattttcatggatttacttaatcatcgaacttagtgattcttctccattagtggcagctcaaagaactgagttgctgccccaggggcctttccttggatctgctcagagacattggtttcagaggccagggtctgctgtccccttcttgtgcaaatacaactggcataaagaggtctgggaccaaacaagagcacctcttagtgagtgtgctggttagtggagggcacaggcttgtataggcagtgattgttcagcatgccgtgagcatcagtctgcctggtttacagagacacagagaatgtgactccaccctgagaaggttgggtaagacattccccactaaatccatattgagtgggtgaatacaggtggactgggaaggtgcactgcttctataaacagccactgggccctgtggtaacaggaacacattagcacatgttatggcccaggcattattcaaagtacttggcatctatgaactcatttacttttctcagaatacttacgagacagacatgattagcatccctatttcattgatggtaaaactgaggcccagaaaaaaaggtcaggtaacatgcccaatgtcacacagctgggagatagcaaagccatgatttgcaacgccagagggcaaccactatgccacagagccccaggtgtcaggctgccttgagatataaatattgttcctcaagcatccatttgagcagcttcttggtcctcatcatctgtggggggcaggatccactttctcgggagagggtagacatacagacacaaagtcctgaacctggaccaggtctggccttctttcacaggctgtgtgcagctgctagctttgcctctttcctggaagaccaggatgggcacagtgccaactctcagtcctgcaagcctagaccagcagccatcaggtaaggttagggccactgccctagtgccctatcccattgccagacacagcctttggggcccagcctcagctgcagcaccccaggatccccctcgaacttctcagctccatgccactttcacatcaggtgatcacagcaagacagggaactccagggggagctctgaccaggggcagtggaagaagagggatgggtgatatgtctgctcacccagagagcccagcaccaacctacatggacccaagctgaggtggcagagaggagggcatctgaaggcagagcctgggaagagatcctgctaggaggtctcagagaacctctgctgtagggactacagccaggtttagcaagcaggagtcagggagaagattcccaggggcagccagcattagagggctcagttcccaggagcacaggaccggtggctgggatgggcaaaaatggctcctggggcacaaaggtacaatgggaagaagctgtgcattcccatgctgtaagcgtctgccctgtttcacccaccaatccaccagtgggcatggccactttgctgtgggtgtgtggagcatttggcaagtcctagtaaggaacgatctttcttaactcccataaaccctacagaggtgtaggtcaggtaaggatacgtcatgctcagggtcaggttccagccgcagctgagggctaaggggaatgggtggacgtggggcagggagctggaagaacactcgagagatagcaggtaaatgagacatggctttactcagcagcagctctcttacacagctttctcaaactagctttctcattagcagcttactctcacaccgtctgccctgtcttggctgcttagtccggtggcccctacgcacagctgcgtggccagctctcccttgccttcagggtcagcagcttaattctttctctccctgggcacgggcaagccaagctgtgtcctggctcccctctgtcctggctcccctctgtccacctgcaaagacagacagctcttgctctctctctttctctaggttcccgtgcacccgccatgtcaagctatgttgagctgagccaagccccaagagacatgtcccccatacacagcgtcaacagggcagttataccttttacagacaatagtggtttagagccaagtatgaacttacataaacaggttatataagaagtggaggtgtgcacctgtgcaccagactcattgagtcatgcaggcctggatatccccctctgcctattccttgaacaaagcacatccaggtaccttacaggatactagaacccaaaaccaggagacttccccagggaacccaagttggtcaggggcagtgtttgctcttgaactcaggtgctaaggccatgtccaaagctgacatgaggttgtcacacacagtggcatcggtgccacactaatgccaggactgagacaccagcctttactggaagacacagttcctccctttctggtgagaaggcagcctggagggggaagacctgggccccagccttctttggtctgagatctcagcaggcctgtgtttccttcctcagctccagtgccacttcagtctctgctgtccctgctgataggaagagcaacagcacagcagcccaggaggatgcaaaggcagacccaaaggg

SEQ ID NO: 3985 - DNA, 59038 bp, human; identical to SEQ ID NO: 3976

SEQ ID NO: 3986 - DNA, 55615 bp, human
ttccctgaagctcggtggggtttgcctacacagctgctctgagtggcgcagttccgggtgtctgtcagggccaaaagcaaagaggaaaggctcccaggcagctcctggtccacctctcatgtgtccactgggctgtgtggccaaatctggaggcaggagggagcctgcaggtagacacatggaaccttctcctctctagtgctgccagtctggtgagaacagctaacgctggtcctccccgcccctcctcctctggctacaagatgaccactgaggattacaagaagctgtgagtatgcaacgccaggctcagcgtggttccctcctccaaggaacaagtccaaactctgggtccactgaaggcagctgactacttgccaccgagcacagcccgggaagtcccgcctgcctgacactccctgccagttgcagctgtggcctggagcccaccagagggtaacaagccccagaaaactggatggctgtgcacattgcacgtctgatccgaggcagagcggagaccgcaggaagcttgtaggaggggccccacggatctggggaaagggtcatgggtcgtgaggctgctgctggctggctgtgcttcctgggcttggccctgcacccggccgagcctcaggtgctctgcctggctgcactgggctgggggcctggggatcctcagggtgctgctgtcagtctgagcattgtgtgcctaaatctgagctgcttcttggatagaaaccttcgggttttcccttagtgctccccttggggtccctttcaaagccccccaccccccactgcatgctcagggaggagggttctctggacagaggtgtgaattgtgtctctagttcccaggggaccacatctttccgttgtttgtcccttgcctccatcatccagggttggggagctgctgggtaacctttctggggaaggggagaggctcgaacagggagggaggggagagctggtctcagggaggaacaagtggcatgacctaaggcccaaaggcagagatattgacttgcctcgtcattgttgttgaaagccaggaagccaagctgctgagggtggcagcctatgacaggaaagcgcctctcccctctcttagggcaccctacaatatcaggcgcagctctacatcaggggacaccgaggaggaggaggaggaggaggtggtgccattctcctcagatgaacagaaacggaggtaatggaatggtgccttttgggcatcccggggggcagggcaggagcctgagtcttcgaagactgctggaatgaattgtactggttggggtgacaaaatgcacaacacgtaggccatcagcggtagcccacggagcatgagaataggtgtcattctctgagtgccagaaccacccactcagtgttggaccagctgaggggcccttgagaaccttctgtggggtagaacctaggtaatgtgggtccggggaaaagcctcctcatgtggaggctcttcagggctctaaatcggtttgttagaaagggccctgagacagttgaacaaaaatattcagggagaagccacctgcacagtgccctctatctgcatgatctgcatgccttgggggttctgaatgccccggaccccaaactgagctccaggcatgcacagcagtgggagtgtgccccatgctgctgaaattctaccctagtctctgcgccaagctgccctcgtccacacaggccagcaaagttccatggacccttgcccctcctcagtcctctgtccatggggactgaccacataccacccagtgctggtgaactatgacaggaagggtttgttaagcaccttttgtatgcctttggcttggggcctgtacagcagttgggccctgaggaaataaagccctcccctccctgggctcagccagccaccaggtccatatctgctgacccatctgtggcgcaggaatcacagcaaagccccattgccaaaggccctggcagattggctatcctcagggaacagttcacagtggcaggggcccccaggcctgggtggagcaaggaaaagagccagaagctaggagctgcctagcattgaatgccagctctgccacctgctaggtgagtgctcttgggcaaataatgaaagcttcttggactcagtttcctcatctgtaaatcacagaggatactagcgtctactttcctggattgagaagagcaataagccaatgcgaggatgttggcatctggcgcagagccgggcacatgccacatgctccataaacatgggctgcccttccttcaggttctacatttcctttgaatagtccttggagcaggtgcaaatctggtttctctcaccccttgcctccctggggtggccctaagtcaccccgagtccatcccaggctaggctggcagagcatgtccagcttggcacccatcagatgctcccccatcccgtgtcaccccaggtcagaggctgcaagcggtgttctgaggaggacagctccccgggagcactcctacgtcctgtcagcggccaagaagagcactgggtgagttgccaccaactggctccaggctctaggacagctctcctctcctcagagctccagccttctctggctgatgaaagggtgggtggagagatcacccccaagggccttcctagctgagccttctcagattctcagatgtactttctagaaaatggagaggtctggcggctaccaccagggacagtgaagtgccgggaatggagagggcccaggaccctctgaggtagagcggtcttgatgtcacctgcccacgggctctgcccaaagcattgcctttctgcttcctttccagcagtcctacccaggagacacaggcaccgtttatcgcgaagaggtaagtgtcatcaagggacaccttggaggcctgttactggccacaggaaggccttccgtcagcaggggtgtagtgtgggagctgtggagaggggatgtggatgtgggggactactgtccctgagcagggggagttgtgaggggctgggggcttctgtctggaggcctggcaagcacctgggtggctgtggtagcatatgtggtcaagctcttccatttgccaatggctaatggggctgggcccctgacccaacgtggagcatttccaaggccctctgggagttgttcccctgcccctgttgcttgcctgatgccttgccttctgctctcatccaggatcaaaacctgggccatcaggagaacttcccctgggaggtgactgtgacattggagatgggccctaaagggtgaacagggcttaacagggaatgatcagaacgtcgggatactccagctgaatgagggaggggtgtcaccattagttgagacagggcaccttctggaggaggaaaatattcgggggaaagcaagaaagaaacttctggaaacttgaatttgagggacttccagttgagtggacagggaaggcctctctctgtgctgaggtggctagctggggactgcaaacccaagagaagacagcatgccaactgccccaggcagagggccccagtgcacaggcccggggtgggactagcttgctgtgttggaagaccaggaagttggcaggaatacagagagcagggatggtggcagcacaaaggaagtgacagagaacggggggcggtgggggggtcttcctggctgcatttggttcctgtggtttctgtaacgcagtaccaaaaactgagtggcttaaaacatcagaaagggattctctcccggttctggagaccagaagtctagatcaaggtgttagcagggtgggttccttctggaggctttgagggagaaaccatcccaggccactctcctggcttctgctggtggttggtgatccttggtgttcctcggcttgtacctgcatcactccagtctgtgcgtctgtcttcacatggccttctcttctctgtgtgtctgtgtccagatttccctcttcttacaaggacagcggtcattggatttaggacccatcctactccagtatgacctcatcttacctgattacatctgcaaagaccctatttccaaataaggttacagtcacaggttccaggggacatgaattttggggggacactattcaacccagtatgctgtccttatcctgagctggagtcactgaacccccagcctgggccacctcttggccgtgatcctgaagggttgggtcagttagacgccactggaagcatgttctttgaggcctccaagctctagggcagccaagaagaccacgagcgctgtttctcttcttgctcaaagggtggaggtggtggaagaggacgggccttctgagaagagccaggacccacctgctctggcaagatccactcctggctcaaacaggtaatccattgcgctcatctctgcctggggctggtggctgccatacctgccactcagtcactgaggaacctcagtcagggcacctccatgctgggcttcgagatcagtgtccccatgtgcccagtgacaagacgggacaaagaaatcagtaagagcccatctggctggatgtcccagggctgaaaggagcaaaacagtccagccccccgggagagagcacctggctctggtctgatgagtacgtatctgtgtcaccttaacccttgcaccactgagcctggtggcaacttgaacaccccaagaaaaagtaccatccttggggtttgagagggccagccaccatggcagtagcatgccattgtcagacttgctccttgcactccaataagttagccacattcagcatgcccagggaggaggctctgacatctccagagcctctcacagccaccttctttgccagtgcggatggaggcaggaccaaagcgtctcgggcaatttggatcgagtgcctgccaagtatgcctagccccgctgggagccaggagctcaggtgggtgccgagagctgactctggcttgtgagtgggtgtgatggcttcccgccagcctggctggctggttctgccagctggggagggtctggcagtggggtgatggggcaaggacaggctgagcactggtgatctcactccaggaagggccgtgatttgtcttgatttctgatccctgagaatctgggcagataatggtgctctcttgtctgtggacaactaataccttcttgtactttgtgcagaatggtgctaagtcctgcagggagagccaccacctgctgttgctgctgtttaaagtgcctgcctggattgagacctttgctcaaatctaggtctcctaagagctgcatctctgtagcacccttggaagacccctgcatccagaaggggagagggcctgtccctaccggtcacttcccaggcccccaagggctgttcaggctctcctaataccatagcaatcccccaatttgagctccacagccatttatagacaggtgaccactgtcctcagggttacttcctcagtctgggagggagacagaaatgctggcagagggagccaggagcatgaggccagctccctccatggccccaggcagcagactgccagggtgcttctccttttcactctctccctctcttgatcttctctggttgtctgactctccccataagaactttggtccatagaagatgtggaaaggaagatttgagaattctttacaaggcaatatctagggcagagctccccagtctttttggcaccagggattggtttcgtgaaagacactttttccacgggacggagcaggggatggtttcaggatgaaactgttccaccttagatcatcaagcaccggattctcataaggagcgcacaatctagatctctcacatgtgcagttcacaatacggttcgcgctctcatgagaatctgctgatctgacaggaggcggagctaaggcagtaatgatctctagcttacctcctactgtgcagcctgattcccagcagaccacagactggtactgatcctcaggctggggttggggacccctgatctaggggacttggcaattgagggatatgggggcaaaggctgccacaacaaagtattgtaccacaccctggggcgcttaaaccacagaaacgtatcatctcccacttctggaggctagaagtgtgagatcaaggtgacggcaaggttggttcctcttgagtctctctccttggctggtagactccatcttctccctgggcccttatatgctcatccctgtctgtgtgtgcctgcgtcctaatcacttctgtttttttgagacagagtctcactccgtcgcccaggctggagtgcagtggcacagtcaccactcactgcagcctcgaccttccaggctcaagagagcctccagccttagcctcctgagtagctggggctacagtcacaggccaccatacccagctagttttttttttttaaatttttgtagagacagggtttcaccatgttgcccaggctggtctggaactctaggactcaaatgatcctcctgccttagcctcccaaagtgctgggattgcaggcatgagccaccgcgcccagaccctaatcacttcttataaggacattggtccaactggattagggcccaccctaacaactgtattttaacttagtcacttctttaaaggccccatctccaaatgcagtaacattctgaggtcatgggggagttaagacctcaacatatgaattttgggtggcacaagtcagcccataacagtatacagttctcatttctccttatttctcttttaaagaaaggcaataaatggtttcaggtgcctttctgtttgttcgtttgtttgttttgtttgtttttgagatggagtctcgctctgtcgcccaggctctgtcgagtacagtggtgtgatctcggctcaccgcagcctccgcctcccgggttcaagcgattcttctgcctcagcctcccgagtagctgggattacaggtgcacgcgaccacgcccggctaatttttgtatttttagtagagacgggtttcaccatattggccaggctggtctcaaactgctgaccttgtgatctgcccacctcaggctcccaaagtgctgggattacaggcgtgagccaccgcgcttggcctcaggtgccttttagaagataatataggaggctgggcatggtggctcatgcccgtaatcccagcactttgggaggccaaggcaggaggatggcttgaagccaggagtttgagaccaacctaggtaacatagcaagaccccatctctacaaaaaaataaaaaataaaaattaaaaattagttgggagcattgatgtacacctgtagtcccagctacttgggaggctgaggtgggaggactgcctgagcccaggagtttgaggctgcaatgagctgtgaccgcacccttacactctagcctgggtgacagagcaagaccctgtctctaaaacaagaaaaaaaagagagaaagaatggaggagaattagattgtgctgtattatagatttaaaaggcactttgacatttattccacaaaattcctttcgatgtttaatccccatcatatggttgtcattgcaaggtggctttttaagtttgctcaggttgccataacaaataaaggctagagattcagggtccggggcaagctcccaacaggaggctcagcttgatgcttctgatagttctttcctccaattctggtcactcaatatttggagctcacccaggcagcttccaggaaagctgctggctgatcctgaccctggagggccgtcttctctgaccctaccacgttaggtgctgcactggaccaagcagccaccatcagtactcccaggcccagctcctatctgcctggtgtctgagaagcccagcccgtgaggaacaatgactcaatcaaactcagggtcctgcagcacttcagaaaaggctggtttgtggcagagtggaagaggagaatgtcacagccttgtccccaggcacagacctatcgaggctaccctctccccaccccctgccctgccctgtttcccttagctacagtgcaaaggtcagctcctcataactcttgccccccttgcaacctgaacccagtttagggaccctctcttggagaaactggttctacacatgcaccccttctcggcccccaggcctggctgctttacccgaagcactggtcaagcttgcctcacctgaccagggcatggcctcctgggtcccggtcctaggctctgcccagcatgctgcctggcagagcgtctggggagcagggagtaggagcacagcttctggcacaggacaaaaccctggctttgcatcagactgactgtgtgaccttgagcaagtctcttcatctctccatgcatcagtttccccgtggataaaatagggagagcagtaatagctacttcccaaggctgtcccaaatgctaaatgagatcgtgcacctgaagtacttaccacagtgcctgggtgctggtatcctcgggggctcccagtcataggcgtgctgagctgcagggcccttattcaaatacaggaagagatcaatatctccacctgctggcatttgagggaaatgtggccaaaggcagtgaaaaggaggtatcccctcgccccacatccccgcctcctcgctctttggcagaatgagtcacacactgtttggcacaggccacagttggtcgcattcccacaggtggctgtgatcagttttgggcttcaggcttcagcagatgcctgcctctcttccttgggtgccttccaagggtgtgcagccttccagcgtggtcctggacttcagcttggactggagctgtctgtggttgagagtctggggagatggtagggtagcgggttgtgggggaggagagacccttgtattagtttactggagctgctgtaacaaggtaccagaaactgagtggcttaaaaccacacgcatttatcctctcacaattctggaggctggaagtctgagatcaaggtgtcggaagggccatgctccctccaaaggctctgggggaaaatctgttccatacctttctcttaccttttgttgcctgcaatccttggtgtttcctggcttgcgcccgcctcactcccatctcggcctctgtcttcgcgcagccgtcttccctctgtgtctgcccacattgccctagtctgacatcagtcactggagcaggctggggtgacactttgttcccatttcctctgtgacagagccagaaacgccagtgagaaaatatgttgtgcttgcctgtgacatccctgttccctggcaccacctgatttaaatgaggcagccaggggttttatactgtcatcataaatgacatcatcctcaacaacgatgtcatcgtcgttatcacgagaggagatggggagaagtcagagctgtctgtgtgtctagggcccctcctggctttcatgatgggagaggccttgtccttggtagcccttccatttccctctggtcactttgagcactccaggccctggccagggtggaagtggagggacagagatgagcagcccgctgacccagccctccatggctcattccttgctttcaccttggccactccatcccctacccctcctgggacccctgagtggcctctttaaagtgccagtctgaacctataaaccccccacctccacttcaagcccatcctgcatcttccctttgccataccagatctagtctgtacattcaggacccctgccagcctctacctcctcctcctcccccgatctcccttcagctggcctgggtcgggctatgcctccatgaagcttgtccactgctcccatggctaaacctgttctgggccctgcagcacagcaaggtcagtttccatgcctctctgcccctgcctgaccctgctgggcccagagcttcaccagggcaggcctggggctcaggcttgtctgcacttccagggcccagggacaaaggcaggagtgactgcaatgtggcttggaattaggctttgctccatggacctaaggaggtctggtttggggtgaagggtccacccccagaaagcctgggagctctatattctctctggccctggccacaccatggccaagcctgctgggcgtcatgccttgcagtacggccagagaatgcatcagacttggagggatgtgtgtccggggtggcctgtggtcatctgggggagggctctgagcgtggctggcaagaggaaagctcaaaggggccctttgtcctcatccccgagtctgcgacatcccctcccactggttttcattccatatttggtctgtgggttttctcagtctctcgtacccctcagtccccaccagtccatgaatgcagaactacccctggcctcacaaatggccactttggataccctggtggggtcacaggctgcggttgcccctgcaaatggttggtagaagcacgggttgggaggtttcatttctacccagaagggcccttgctgtgcctgagggagggctgggctcaggtcaggggtgggagaccggggaaggggcctacaggtcagtggcccgagctcagctgcagcaccaacaaggctcaaggccaaggaggagatgagagcacatcaaaagggggcagtgggtctgggcggcccaccgcactcaccagcccaagaagggggagacttttctcacctgcaacccactgggtctctcctttggcccgcagctcaagaggtgaggaaattgtccgcctgcagatcctgacacccagggcaggactccgcctggtggccccagacgtggaaggcatgaggtatgggggtcctgctgctgtcctggctccctggacaccattctagagatggaagcagcagcctcaggtggcaaatgatgaggcctagggccggctctgccactgtagggccaacaggttgatgggaggcatggtcgacctgggttttctgccccatctcattctttcactcagaaaaccattatggagcaagcgcttagtctgtgtaagggcacaggcccgaccctgggacacagtagtgaacaggaccccctggctggaattgccatctgcctggtgggggaggcagacgccgacatgagcatgaatgaggtcagccagagatgctgtgtgccaggagcccctgggaagtgacagctcaaccctgccaattgctgaagatgggaccagtcagccgtgctggggatgttggtgggggtgggaggaggattgggtctaaggagcccgtgaaggccactgaggccattgccctgcctgtgtgagagggccactgggaatagagtggggtcactgggtcagagtccacagctctccatgccactaggctctgtgctggggaggggtgggtcaaggaggccacaaccagcagggagcacgaggggctcagcctctgccctggggtgggggtcagacagccaggtgacatgcaggcaggattcgggggctggggtggaggctaggagagatccgagcagggagactgggcccctaccttgtgaaggccagggactggggagagaagcgggagtgtacactgaaggtcatcccttaatccctggggtggcaggaacttcgagcagaggcctctcaacagtgtggtgggtgggagtgcttggggagggcttcctggaggaattgacatccaagatgagtcctgagcgatctctaggtccctttaccctcctccttggctcctcccactttaattctgcccccaaggcaccaagtcctgtccactttattttagagatgtttccatccctattgctctgcccctggcccaggcctccactgctactcacccagttgtctgcgaccgtttcctactgtcccatccctggactcccttccacatctacctgggtgatgtttccaaagggcagaagtagttatgccagccccctgcagaaagccctgcaaagcccctcccactatgctctgcagcctgaactcagtacctggccccacctgcaggctcctccctccctgggcctttctctgtgcaggctggaggctctgcctgagatgccctttcccctcttcatctttctgttccacctcaaatgtcctgtcttctgggtcatgtccttctcctgagtttcttccccaggcagcatctgagggcttgtcgattctgcatggcagcatccattctgcatggatgtagatacaatcactatgcccattttacagattaagaaactgagaccctgaatggttaagtaacttgctcaaggtcacatggtccagagcaggcagatccgctcagcctgccctactcccaccttccaccttctgcaccatagctcattgtactagttggggcagggagcagggggacagagaggggtgatggaaagacttggcatttgctgagtgaactcatttgacgagtttattcgtaggcattgaagtcaaaatttccaggagggaggtattttaaggtttgtgattgaggtttgagagagtgattagggctcaagagatttccacgttatatgcagacagaatagagctgaaatcatgagcgtaaactagctttacatggggctcatggtgagccaatggaagctgggcaccgacctcagtatgcaggtggcagccacctggccagccctcctggggacagctgggcgagggcagtctcttctcgccatgttgagagtgggcctcctgagggccagttgggagttagtgggtgtgcaggccagtataaaggagaggcaggaacaagtggagatccctgcttcaagggtggcagttgacaccttgggaggggaggagacagcccagcaagtggtggagcacgccaaagggaggagaaaaaggcggagaccaggaaggtgtgtggccagggaggtaggcaggtggtgttgacaggatcaagggaggaggggtggtgagaaggctggagtggcccactgggtcagcagtactgaatggtggtttgaaataatgatgggactgtctctcctggatttgacaacatggggctccctgaggacctgaaggagaacagaagggggcttaaattaggagattaggatcagggatatagtccagaactcaaatcccagctactcctcttattacctgtgaaatttggggcaaatcacaggggctttgtgtgcctccgtttgctcatctgaaagatgggcatgggtgataacagtgcccatatcctggggttgatttgcagagttaatgcatataaagtcacgagaacaggctcaaatgctcaatcaacagtagctattgccaggcacagtggctcacacctgtaatcccagcacagtagctataaaacaacaacaacaaaaaacaaaaaacagtagctattagtaatgaagttttgataattggccaatctgtcaatcagcagggtttgtttgtttttggttctgttttttaagacagcatcttgctgtgtgtgcccaggctcaagtgcagtggtgccatcacagctcgctgcagcctcaaccttccaggttcaacctcccaagtagctgggaccacaggcacacaccaccactcctgactaactttcaaaaatatttttgtggagatggagtctagctgtgtttctcaggctggtcttgaactcctggctcaagtgatcctcttgcctcggcctctcaaaatgctgggttataggcgtgagccactgcacccggcccagtagcaggttttaagctccgtggagacagctggcgtttgaggatgaggtaacagcccacacctgagtgtgaatggctgctgcatggttaacttccatttctttcctccataggtcttccccaggcaacaaagacaaggaggccccctgctccagagagctccagagggacttggctggtgaggaggctttcagggcccccaacacagatgctgcaaggtaactcagtgcaggaagcagacacttcattcccagaacacggagcccacatacacccagctgaaggacttccatggcctccggtgcaatgtcaatggatgcagctggggccaggaaggtcctgttcccactgttcccccagtacctggggtactgcaggtctttaatgaacatctgttgaaagaaagaaagaatgaatgaatgaggcctggagggaggtaggcccctgccatgattcctcagggagccagttagagagcaggaccaaactccagggcaggctatccccagctcctggcctgtgctgagttccttccattcccctgaagcttccacactcactgtgcttttactgcaggacaaagcagccctgccaatggccagggcaaagcaaggccaccaagctggcagtctgggagagtcagtgaccaaagtatgtgggcccccatagagcatgtagcggagactttcaggatgacccgtggactaagggagacattgtggcaaggggtgaggggtccaggacgggaagttggagccatagcggtggatgatgagtccagatgggatgattgtccccagtcgctgcacagccagcccactgacctgtcctccaagccagaccagtgccaaatgtgtctggtgagcagtggctgcaggctgggcatttcttcagtgagaacctggtagccagttacagctaagaacccacacacccgtcttctcagtgtggatccctggagcccctagctggaaccctgagccctggaaatgaggaaaggaatccctctatggcttattaccagacccacatgtcttgccccttgctctgttggcaatcagctccccccaccaccaacgaactaacctcctcctgactttccaccttgctcccaaccaacccatcaggtttggaaaaaatacagaaatacttcctgttagagtcaacttgggcttggctcagctctggtcagagcagcacagagtagcagccaaaggcctgtgcttctggtcttgaggcccactctcatggcatctgggttagatgagatcaaaacgcaactagagtcagcaaatactccacttctcataacaggtcaagtgcacagttgagtgatggcaatgtgggatccggagccacgggctcccggcctgaaggcttggctgcagtagacatcggctccgagagaggaaggtgagctgcccgggggaggcaggttctctcatgcccctggtgacagaccagggtcaagctgccaggctgcttgggctgctatgggtggggcactggtcacttcctatggctcctgtctactgcttctcccacactcccacattccaccacatcctgtgtccttgggctttccactttttggaatcttgttcatttttctgatccctgccactggccctcaagctcctccagagtaggcactaggcccactcacagctggaggcccagccctcacatggtgctggtcttgggctggtcaaatgaacgtgtagggaatacatgaagggacaaattaatgagtgaatgactgaatgatggaagagtcggcaccttcttacttcttggttaagctctgaggaccagctaggaggccctttgctcctgctttctcccttctctccttttcctgccccatccctaccccaggcagctctgctctgaggttcagggagaggaaaagcggtagccctggagagaccagcgtgtccagctgggctctggcttcttggacctggagggagtcaggggccactttctcaggtgatttgcagagtggcaaggtccctcttgtccctaagtggttccaaaccaagcctgaatcattcttggggcaaaggctaggtatgcagatgttggcataaatagtttagctccaaactatgctagagtccttctggttcagagcagatggctagggaggagtggcaaagccagtgtctgcaaagagctacaaccgcaagatatcatctgcctcctgcatcctactgcagtctggccaaggagggaatcctgtggggaaggccctgctgatgctttcctacttccctcagcacacccagggcccctttccctcactaacttcaatagtttgcaattcatgccatggaaccagagcccgaattctaaatccaggcccacaagtcaacacaggaaggggacagcaggtcctggcctctgaaaccactgtctccgagcaggtccaaggagaggccaccagagactctgttctttaagctgccactaatggggaggactccgctagagccctgtccatgcagcctgcatctttttgccatctgcagaggcattggagggatctttttaaaaataagctagatcacatttctcccctgctaaaaccttctagtggctctccattttccttagaatgaagtccaaaccctttcccatggcccactgggtcctgcatggcagaatctttggccttctatccagtcggggctcctgctactctccccacagtggtgcagcttgactggctctgctgatggctgtcgcggaagagacttctggtctactgtgattgggtggctctggtctcctccatgtcaccccgcctgcttatacaccctcataacatgaagcctgtgctgtccactgtttccttaaaatgaaaccaagcctcaaagttacttgtaaagtcatctgaagaatcttctagattttcatgaattttaacccagtcttttacagttgtcttacctatatagtagtccctaggtatctgtgggggattggttccagaacctcactcatataccaaaatccatgcatgttgaagtccctgatataaaatggtgtagcatttgcatgtaacctatgcacatcctcctgtaccctttaaagcatctctagattattataatacctcatacaatgtaagtggtatgtaaatagttgttatactgtattgtttagggaatgatgacagaaaaaagcctgtacatggtcagtacagatgcagccatcctattttaattatttttcccacatctcatctcatcctctcctctcctctcctctcctttttcagacaggaccttgctctgtcaccagggctggagtgcagtgctgtgatcacagctcacagcagcctcaacctctggggctcaagggatcctcccacatcagcctcccaagtagctgggactacaggcgtggaccaccacgcctggctaacttttgtatttttggtagagacgaggttttaccaggttgcccaggctggtttggaactcctgggctcaagcagtccaccgacctcagcctcccaaagtgctgggattacaggcatgagccactgtacctggtcccaaatattttcaatctgaagttggttgaatccacagatgtggaacccacaacatagagggctgaccacacttagtttgactataattttcaacaaactcctttattgtttttcctttttttttttttttgagacggactcttgctctgtcccccaggctggagtgcactggtgcgatctcggctcactgcaagctccgcctcctgagttcatgccattgtcctgcctcagcctcccaagtagctgggactacaggcgcccgccaccacgcccggctaattttttgtattttttagtagagacggggtttcaccgtgttagccaggatggtctcgatctcctgaactcgtgatccacccgcctcagcctcccaaagtgctgggattacaggcgtgagccatcgcgtcctgccttgtttttccaaaggaaaggttgtttctcatggcaacaaccactctccttttccattcattttcatggatttacttaatcatcgaacttagtgattcttctccattagtggcagctcaaagaactgagttgctgccccaggggcctttccttggatctgctcagagacattggtttcagaggccagggtctgctgtccccttcttgtgcaaatacaactggcataaagaggtctgggaccaaacaagagcacctcttagtgagtgtgctggttagtggagggcacaggcttgtataggcagtgattgttcagcatgccgtgagcatcagtctgcctggtttacagagacacagagaatgtgactccaccctgagaaggttgggtaagacattccccactaaatccatattgagtgggtgaatacaggtggactgggaaggtgcactgcttctataaacagccactgggccctgtggtaacaggaacacattagcacatgttatggcccaggcattattcaaagtacttggcatctatgaactcatttacttttctcagaatacttacgagacagacatgattagcatccctatttcattgatggtaaaactgaggcccagaaaaaaaggtcaggtaacatgcccaatgtcacacagctgggagatagcaaagccatgatttgcaacgccagagggcaaccactatgccacagagccccaggtgtcaggctgccttgagatataaatattgttcctcaagcatccatttgagcagcttcttggtcctcatcatctgtggggggcaggatccactttctcgggagagggtagacatacagacacaaagtcctgaacctggaccaggtctggccttctttcacaggctgtgtgcagctgctagctttgcctctttcctggaagaccaggatgggcacagtgccaactctcagtcctgcaagcctagaccagcagccatcaggtaaggttagggccactgccctagtgccctatcccattgccagacacagcctttggggcccagcctcagctgcagcaccccaggatccccctcgaacttctcagctccatgccactttcacatcaggtgatcacagcaagacagggaactccagggggagctctgaccaggggcagtggaagaagagggatgggtgatatgtctgctcacccagagagcccagcaccaacctacatggacccaagctgaggtggcagagaggagggcatctgaaggcagagcctgggaagagatcctgctaggaggtctcagagaacctctgctgtagggactacagccaggtttagcaagcaggagtcagggagaagattcccaggggcagccagcattagagggctcagttcccaggagcacaggaccggtggctgggatgggcaaaaatggctcctggggcacaaaggtacaatgggaagaagctgtgcattcccatgctgtaagcgtctgccctgtttcacccaccaatccaccagtgggcatggccactttgctgtgggtgtgtggagcatttggcaagtcctagtaaggaacgatctttcttaactcccataaaccctacagaggtgtaggtcaggtaaggatacgtcatgctcagggtcaggttccagccgcagctgagggctaaggggaatgggtggacgtggggcagggagctggaagaacactcgagagatagcaggtaaatgagacatggctttactcagcagcagctctcttacacagctttctcaaactagctttctcattagcagcttactctcacaccgtctgccctgtcttggctgcttagtccggtggcccctacgcacagctgcgtggccagctctcccttgccttcagggtcagcagcttaattctttctctccctgggcacgggcaagccaagctgtgtcctggctcccctctgtcctggctcccctctgtccacctgcaaagacagacagctcttgctctctctctttctctaggttcccgtgcacccgccatgtcaagctatgttgagctgagccaagccccaagagacatgtcccccatacacagcgtcaacagggcagttataccttttacagacaatagtggtttagagccaagtatgaacttacataaacaggttatataagaagtggaggtgtgcacctgtgcaccagactcattgagtcatgcaggcctggatatccccctctgcctattccttgaacaaagcacatccaggtaccttacaggatactagaacccaaaaccaggagacttccccagggaacccaagttggtcaggggcagtgtttgctcttgaactcaggtgctaaggccatgtccaaagctgacatgaggttgtcacacacagtggcatcggtgccacactaatgccaggactgagacaccagcctttactggaagacacagttcctccctttctggtgagaaggcagcctggagggggaagacctgggccccagccttctttggtctgagatctcagcaggcctgtgtttccttcctcagctccagtgccacttcagtctctgctgtccctgctgataggaagagcaacagcacagcagcccaggaggatgcaaaggcagacccaaaggggtaaggcatgagcagacagtgctgaacttctggggtggagagaggcagcttgggctgtgtgtccattggcctttggctgggaaggtgaggccagcaaggtttgtgagctggcctgaggcacatagcaagggcagaagccccaaccagaaccctctggcttctggggccagggagctttccactaaactgttgccttggccaggaaatacatcatagtcagaaagggtctttcagtcagcaaccactctgacagcaactgccttttgctggaggctggagcatgcagacaaatcagaaacacctctgccctccaggaactctcaggcagggggtgggcaaaggctggtccagattagagcaatacatgagcgctagagcaggggaagggggcttcatggggactgtatgtagctggatgtggtcagcgatgagtgtccttgttggggagtgctggaagaggaggctcagtgaactaggtagggcttgattggcctcttgtactgtgatattggagtccactgtgtgcacagccctctactcacagtgtctcatacggttctcctcacagtctctcaaaggtttatgcctaattacaacaaaacccaaaagcctggagcctaggtctctgtgcctcctgggaaggatagtgctccgaagaaaacagccgcagctgagatagagtgatggcagtgaggagggtactacttaggtgggtggaaaaggcaactcaggcgatctcctctaaagaggagaaggagccaactctagaaagaacacggtggagagagctatagataaggaaccacaaaccaactaaccctgaggtgggaacatgcttagcatgttccaaaggacagagtggctggagcttggccagtgaggagggccacagatggagcagggccttggtaagccatggttaagagattggatcttatttcaagttttaagccaaaggggagtctcatgtgatttaggtgtttaaaaggtgaatgcatgtttgcattttcataccacattgctgttgcttttttacttaaaccaagatgctgggggctggggtgggcaatggatatctaaggtatgaggccttattgtgtttcttttctcattcgaattgcactgacaattaacaatcagagtgaaaacaacagctgacaccaatactgtgctgtgctaggtgccttacagccttcccagcaacttgtgagatgggtaaggtgggaaactgaagcatagaaagattaagtgacttagccaaggccttacaagtggcagaactgagttccaagggaagaggctctaagaaaatcctcaggagaaactacgaaaaactagtttatgaaatcttgtctttggagcctagtctcaagacccagaatcagtaacttacagctggttaacatggttaacatgctgtgtgatctcaccttaattttccccaaacgtggaaaaggataaggcttcttattatgcaacttgacagaggagaaaattgagggactcactcctgtaatgaacacacttaggaacagagcccagatccagccaactctagagccaggctcacgctactttcctctgatgtttaaacgtctgcaaaatcagaggtgttttttttttttttttttttttttgagacagagttttgctttgtcgccccagctggggtgcagtggcgcaatctcgactcactgcaacctctgcctcctgggttcaaacgattctcctgcctcagcctcctaagtagctgggattacaggcacatgccaccacgcccagctaatttttatatttttactagggatagggtttcactgtgttggccaggctggtctcaaactcctgacatcaagccatccacccatcttggcctcccaaattgctgggattacaggcgtgagccactgtgcctggccaatacaaactttcttgattacagtgtttcacaactctggctgtacttgagaatcacctaggaagtactgaaatacactgttgatgaaaaaggccatactctgtaaaatatttgaagaaattctgagccaaatgttaggactatgacccgtgacacagcctcaggaggtcctgagagcatgtgcccagggtggttcacttacagcttggttttttatgttctagggagacataagacatcaatcaatacatgtgaggtatacattagttaggtccagaaaggcctaggtatacattagttaggtccagaaaggccggacacctcaaagctgggagtgtggtgggggtgggggtgggggtggggttccaggtcataggtggattcagagattttctgattggcaattggttgaaagagttgttattctctaaagacctggaatcaatagaaaggagtgcctgggttaagataaggggttgtggagaccagagttcttatataggtgaagtctcataagtggccgcccttagaagcaatagatggccaatgtttcttattcagacctttaaaaggtgctagactctcagatcagaaaaagtcctggaaagggaaggagattctctacagaatgtaaatttcccccaggagagacagctttgccaggtcatttcaaaatatgtcaaaaaatatattttggtgtaaaatacttcaatttctttcattacctgctgtctgtcatgtgatgctatactagagtcaggttggaatttggcatattattgcttcaaggagtctgttttgtcagtctgaatatctctctcaatgttaatactggtcagttgggcatgaattccaaagggaggagaatatattgaggcatgtctgaccttcccctttctcatcatgacctgaactagtttttcacgttgtgtccccttggctgagagaagtgtccattcattcagctggggagcttagaattttatttttggtttacaacacaacaaaaacttcccgaagtcccaggtagagatttggattttatttttctggggtgggtctccatcatgtgtctttttcaaagctccccagtttgttctccttccaggctaggtcgagaaccatcgttctcaggtagtggttctgacccaggggcatctcccaaagcttccagcctgctacgatacaatgtctggagccatttttggttgtcaaaactgggagtgggagacactactggcttcttatatgcagagatctgggatgctgccccacatcccccaacacacaccatagaattatggggttcaaaatggtaatagtgctaaggttgacaaaccttgctgtagagccttgacgatctatttgggaagacagcagggacggaaaagaaaaagggatggcacagaaccacacccctcaccttccccgaaatctgggtagcgggcacaggacgtgtgcgcctgcgcgaatgcgcgctcgccaccagcgtacgcgacgcgtgcgcgcctgtgcacctcggcgagcacgcgcccgtagtgagtacgcctgcgtaggccgccatttcttgaagccccgaactcggtcgcagtgcccgccgggaaaatgcgaccgtccacaaagtgaaatggccgcccgggacgagctcggcctcggcggggattctcttgaggccatgcccgtgccggccgccagaggtcgcccgaggatcacgaatgggcccgaggagctggctgccccttcccccgcgtaaggtctgaagccgcggccagagtggctttggggtgaccgcgcgtggaccgtcgccggcgggaggaagcgcggtcccgcgaggggccgaacggggcccctgcggcttgagcttgtttcgcagggagccctggggccatggcctctgggacactggacacgggtcgtcagggctgcccagggggagggggtgtggacgtgcagacagggaaggcagctggaccctccaaccacgctgggccctcgggctgaccggggctggtctgtggggcagtgaggaggggcttcgttccctaggagtttgatgagggagcgccatgggggtggcgtcatcctgacatcccgcagggcagtggagccttactttccctaggttacaacacagttttaactgtcccaaactgtggggactccgccctattccatcttgggccgctccatcacactacagggagaggcggtatagtatagtggttgagagcctggactctggtgctttgggttccagtccaagctctgtcacttacaagcaccgtgaccttgggcatgttactcatcttctctgtgcctcaggttcctcacgtgcggaatagtggtaatcatacctcctaccatatagggttgttgaaatggccaaatcggtttgtatatgtaaagcctgtaggacatttaaacctgcgagctaagtgaagcagcaccagaggaatatctcctcctctcagaggtgttcagggacacctggaaagctaacttaaccagctttattggtttgatttcatttgacatgacacgatatctcatcttcttcctactaaacttttgtcatcaaattttccatctagaacatgctgttttcctcattatgttgcaagcatgggcttctcgtttatattttttctgcatgaggatcaggtgaagtttaggcaccacatttcctcaccactggcaaccgttgttggccagtggaggcagtacaagggtggaagtgtcagctgggtgcagtggctcatacccacctgtaatcctatactttgagaggccgaggcgggaagaccacttgagttccggggattgagatcagcgtgggcaacgtagtgagacctcatctctacaaatattatctatatctatatatgtatatgtatatgtatatcatatatatgatgtatatctcatatatatatgtttttgaaacaatgtttcacttctgtcgccccagactggagtgcaatggggtgatctcggcttactgcaacctctacctcctgggctcaagtgattctcctgccttaacctcccaagtagctgggactacaggcacacaccactgcacctggcttatttttgtagagaggagtttttgccatgttgcgcaggctggtctcaaactcctgacctcaactgatccacccacttctgcctgccaaagtactgaaattacaggcgtgaaccactacgccgggactacaatttccgttttttaaaagaatggaagtgtgtagattatggttgtgttaggagttgacagtggctgtattaggctactggatctttggtccaattacactcagaaggaaaggcttcagagaaattaatccaaaatccaaaatcccgttggtcaccatcccctatgttaccttgcctatctctaaccacttgacttccaggaagttcatgaggagctcggacaggatagctgggaagtaattcccctggatgttacattgtccagcagagcttcctgtgagtgtttgcctaagatttcctttttatgacccacataggtcatatgtcctaaaatcacagtggccctgccacaggcctaggaaagaagaagccttgttcatccatttgtccctgtgtcacaatagagcccaaatttctctttgtggataatcctggctctatccacagacttggtgagggcaacctctactagtgtatttctacagaggacgtgggacaggacgggactctgattaaatccatagtaaagctaactcagggctaccacagtagggagacaagctcttcaggccttgtatgtttgtctttggctcaagcaagcatgtcactgacagagattgaatgggtgtgtcagggcaccctgctggcaaccctgggactggtgttacctgtgcagaccacttttggatctgcatgggctgcagcagaccctaagggtggaagcagcacagagaagcacaggcccagtgggatggttccccacagttactgtgtggcgtcacactcacttgcctgcagttctgcctggtgcagctggaggtggcaattagcttgttgtgcctgctggagaattttagttcccttgacctccacctgaggctgaagaatcatgttgctttcagggcatactttccaaaaagtgtggcctctgttggccttgttattccagcttgaaggcaggaagcctgcctagacaaagttaactcctatatacaaagagtcccagggtagtttgtagcgtgttcttgtctcggggtagcccccaccagctattgaaggtaggctggtgatgttgggaaggttatattcagagtgagctaggatcgaggtgatggcgaagtagattttcattctgaaatgctgggctcactctcttagtagcccaacttggtgtttgcccctggcctagtagactctggaagcagtaccttgcacctcggtgtggggctggtgatgggaggggtgtggaagtggaggatcagctagcagcctctttcccacggtacccagattggagggtgcagtgcaatcatggggtgaggccagggaggacccctgaagagctcgatgcctgagacatctgggggaagccctgtccttcttgctggattcaggggtggcaaaagccaaaaattggagggccaggtgcaatggcacatgcctgtaatccctgcactttgggaggccaaggcaggaggatcgcttgagaccagcctgggcaacatggtgaaaccttgtctctacagaaaaaaaaaaaaatacaaaaattagctgggcgtggtagtgtagacctgtagtctctgctactcagaaggctgagacaggaggatggcttgagcccaggaggcagaggttgcagtgagccgagatgatgccactgcactccagcctgggcgacagagtgagaccctgcctccaaacaacaacaataaaaacatcggaggcttcggcttcatctattacacatggaggcctgttcagtgagaagggagcagcgatgctgggctcctgccaaggaggagactgtctgctccctggaattggggctgtgcctggctcctttctgccccgctttcagggatatgagtccctccaagtccacaggaggtgacagccagcttgcgtcctggggctgaggcagggttagtttcagagcacttttttcataagggtgcttattcttcttcagggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcaggtaagggctgagctgcagtgggctctgcctctggagcccatgtttttgttgaggtctgcgacccacatgggaaccacttccccacaccctgtgccaatacccgacacattgcacacccaggctcctgttctgtgagtgggtcatggtgattccctggtcctagagcagtgtcatcaggcttcttgtggctcaaggagctgggaggggactgtgataggaggatgtgtctgtccccaggtgtgagaagccctggctaattcccaatgcatggggcaggaaggaaggctgtctctcagagtacaggtgctctacaggtgggggtcctgggcagagtgagggctatttgtgtgggtaaaatgccattgtcagagaaggacagagtgtgaaagagcaaaaaaacaggagggtaaaagtgcaaaagtgacagagtgaagcagagagagagaggccagagggagagaaagggagcatgtgtgagcaggcatgagagagtgacacaggatgtgactggccatgtgttggtgtgtgccactgtgcatgagcaagaggacaaacgtgcctgttactggagctgaccatgtggcattggtgtgagagtttcaagtcaggctctcttgaaggcatcttgcctgccagcgcaaacactgcatgtccttgcagctctggacacgtcaacaggccagtgattccaggggtgcaaagcgaacagtttcttacacaagacagaaatgtagaaggagagagctaagactcatattgccccgagagaggagctagtggaatccagcagggcatctgctgtggggagcaggtggagcctggggttccttttgcagggatgaaagaaacacagtcatctgccttctttgttctggggcttcttgtaccacagaggttccataattattaatagttaggttatttttagggcctagctcaactgttagataacaagttttaccttctaagaatatctagcccatctttgattccttggctccaggccctggagggtcccagtccaaaaacagagtgaacaactttggacttgctgtcacattgtgtggcttctagaactagtcagtgttccatgcagaaggggtataaaaagtgaggcttgtggatgaaggaggaggcgagtggttctgggttttgttttcgttttgcgggggagtgtcaggaaaggctttctttacagggagagtgatgttggagctgggtttggaaggctgagggagattttgccagatgtgccagacgtgcttgggaaggcattccgagtggaggctcacaaagtgtatagggaacatccagtcaggtagccatcacaaaggagggttaatccagcctggcttggcaggaagcaccaagtaggggctgggcaggcacctgctcctaggctgaggagtgtgacccacatcctgagggccttgggagccaccgatggttttcctgcaggagagtgccacagccagactcgagtccaaagaagatccctccattgccctgtggaggaccaggccaggggagtatacgacgagacaaggcaggaggccatattggagactgtttgcttacaccaggggcaaggtgatgaggctgcaagtatttttgaattattaaaggtaaaagcgggcttggcgtggtggctcacacctgtcatcccagcactttgggaggccgaggtggcagtatcgcttgagcccaggagtttgagactagcctggggaacacagcaagaccccatttctacaaaaaatttaaaaacattagccaggtgtggtggcacatgcctgtagtaccagctacttgggaggctgaggtgggaggattgtttgagccttgcacgtcgaggatacagggagccatgttcctgccactgtactccagcctgggtaacaaaacaagatcctgtctccaaaataaaaataaaaaaaataaagataacggtgagggaaaagtggtagccaaggttgctccccagatttcagggctaggcaattggatgggtggtgacaggaactagctgagggtaaggagtttgggggcaggcccgctgagagatgcacagagatgagaaggtcactgggccatgccgaatgagaagtgcctgtaggggctccagccagtgatgtccagtaggctactgagtaaacaaatgtggagttgagcaaagatctgacctggggctagagagctgggagttgtcagctcataggaagtcactaaagagaatgcatgaggttgcctggagaatgcctttggaaggcagtgtgtacaaagcatgtattctcggcttttctctgcagacttccagggacagttgtccagccaggcccttggctgggtgggtgagtccacgtggttcagggatgctgagggaagctgcttcatcagctgacatttctctccattttctgctcttcttttgtctcaaaaagaaaaaaagaggggatattaattattgatcccctaaaaccctagctgaatatataaaatgaaaagaagtaaaaatatgagagaagcaaaggcagatggaccataattttggaaaataattccaaaaggtcttaaggaggaagaggagctacagagaggtattgagaaggaaaattttggataaatggaagaatcaggaaagactaccgtcatggaaaccaagccacgctgagctaactttccagtgctctgtagatgctgaaataggcccatcagatttggctatgtagaactcatgactgccttgaggggagtaggttggggcagtgggaaaggctgtagttggattataatggattgaggagggagcggaggataagcaggtgcagttgatggggtacacactctgaaactggctgtgacgtgatggatgtgggaggggtgagcagataattacagctacaagataatggggaaggtttcctataggtgaaagcaacgtgtgcatgttaggtaaaggctgggcagagggtgcctacgtgaccagtccccgataaaatccttggactctgagtctctcatgaattgccctggtcgacagcatttcacacttgttgtcacaactcactgctgaggggaactgagtgaatcctgtgtgacccactgggagaggactctggaagcttgtgcccgggttccctcagaaatttgccttgtgtgcttttccctttgctgattttgcttcgtatcttttcactataataaaccatagccttgagtgtgatgatgtgatgtgtcctgtgagttcttcttgtgaatcaccaagcctagggatggtcttggggacccctgacacagatgggcaggatcagaactttatgccataacaaggactttagattttctttcgagggcaaagaggagccaggaaggtttgaagcaggggagtgatatggcgagagtattgctttgcaatgggatctccagtggcagtgagaagagtgactgaagtgggcagagtggagcagggagaagaggaagtgcttacagcatcctccatgtaagaaatgatggggcctggactaggggactagctgtggagatggagacagaactgtaaaataagtagaagagatcccaaattggatgacaggtaagacttgggagagcagtgacggagagggaagtgacaatttagaaagccacatttctggtcgagtgagtggagtatgtgacccctcctggcttaggtggtggccaaagtatctctaacctgcctctatactgcctgcaactgactgagcaaatgcctggtccgtggagatcccaagctgacaagggcacctgaggcaagcctctggctttcaggtggaggccctacctaggctggcctggctggattgccctggcacactgctgttttgctgaggcagacagcagcactctgcaagtgctcttctcctgttcctcttagtggtctaaatcctgtagcatgctggggtgcgactgtagacaaatcccctttccgggccccctggggttctctatttgcagtctttgggtctggtcactggcatggcatctcagtaggctaggttcatcaggaagggtcaactatgtcatggcacctgatgggcagcatttagagtctgtgggccaggggcttaagggctgcttactgctaatagttctaagtagcaagcattccctcagccctagtctgggcacacgccaggaagaaagccactagatgtgctctcctagtggataactagcctggagttccaagaagggcagagacaggcagagtgagagccttcagagatgtaggcaacgatagtagcagaacttcgagggagagtagatggaaaaattaaaaaaaatccttgtcattatttttaaatgtctgaattgaccagattagaatctttgagagtctagacactagggagatctcatgggtgggccagttattatatcatatggagggagagtacgtatgacccagcacgagaggaccagaggacagtcagtgctaagggtaaaaccttaggccatgggagattgagtttttcatcagttggcaagttttcactttaatactccactgtttccatcatttcagacgactggggatgataaggacaatgtaatttgggggataaaggaagaactcattatatttcttggatgactttactggggaaatggattccttagtcatttgaaagaagcggtagaattccacatgtggggaatacttgttctaacaaaagcttaataacattagtggcaatgatccttttatataagggaaagcttcaagccagtgagaaaaacataaataaactagtaagaacatatttataaccatgagatttgggtgcagaataaaatcaaattggcagttcaggaaaggtcctaaacatctgtatattaacaatattccatcagtgagcaatgtgaatttcccataattgaaatgatgattgataaccttgtattgttcttatctaatataaggcaaagcagcactggggctttgataaagagcaatatctcatgtacactgaggacactgaaaccccgctaggaattctatggaatttctaaaatatttatattaaggacattttacccattatagactaatttagggaaggttctgcattttttttttgatttgacaatgtttccaatgcaatttatacaatattaaataagactaattagtttttgcacctttcttgttacaaggtgaaagaactaatcctttgagattttccagaaggtccctggcaaatcccaaagccagttttaggtataaaatatatttaagttttgattgtgggaaggcaaatgttaagagttgtcaggagttctcgaacatttgattgaatagcattatgggttagcgagaaatactacttggttagctagtgaatcagagttgtaaaaattttcaagtaaacatatgaggtaacatggttgtaaagaatcttcagttcctttaaaattgaaaagactttaaaaaaataactaaggacataataaactgaacatacagatagggcattacagtattttgataagacataaaatctttgcctcttaggcagatgactcagaagaaaaacagaccatttataactttttattagggacagaccaatgatcaagaattttttttttttttttttgagatggagtcttgctctgttgcccaggctggagtgcagtcgcgcgatcaccatgttggccaggctggtctcgaactcctgacctcaggtgaactgcccacctcagcctcccaaagtgctgggattacaggcgtgagccactgcacctagcctaagaaaattttgttattttaacagagaaaccaacattttaattttatacaagtataatatttgatattagttcttttttgaaaatcttataaatacactgaataaaagttttaaccatgacaaataaaattccttttctgtgaacattttctaattttaaagatatttgtttacattttgtctcacacatttttaaattatttgtcattttaatttgggacaaagctattctctttttccttaggaaaagcatatttgcatacaaagttgtttccctttgccatttttgccattattacttttagcagtttatatatatatatacacacacacttatttacttattataattttaaccattaataacttctctttcacagagaaaacaggaggtaggtaattttgaaatatcatataccagcattttgtagcagactagtaaagcttatgaatatacatctcataactttttatagttgttatatactttttatagtaccattttgcaatgtggacaaatgaacacatttaacagatccatatgtagtcacactgtaccataaaaaaagcaaaaagtatataaacttaaatttaggtctagtgactaagtattttatcttctttataaatgatatttaatgaatttagttaacttaattcagcataagtctaaggttttaagttaccaaaaagattttagaaactgcctttaagcttacatattataaaacataattactgttgaaataaagtttgccagaataatgactcagtttggttaaaagcaaatttaaatttttataatcttaaacatgtagtagatataatactagcttattcaacatgtaaacctgtttaagtttaggaggaacatacccaagtagagtaaaaatatatgcttgtattctgttgtattatatgtaatgctgataactcaaagacacataggtgtctattaaactaacaatattaaactagttttgtttgccaaaagtttacataaattctgtgaacttgagttttaaaagcatttgggttagtttttataagaatacttttttgttgtttacactgaaagtattagaagttgtttccttaatttatgagagctttataataatttatataagtacttatttatctctaagtcaattagaatagaggataagggattttgtaaattaatttggtaatgccatctggaggtactgaactattacacatatacaacatacatgtatactaaacatacagacagacacaaatagagatctaatggcgagccctcaatgggtgcagggggcctgaagctctactggctataggcagttgagagggctgagtgggaaggggaaagcctggtgaagagtagataggggtatgtaggaggtagaggcattgaaggggacagatgaaaagattcagggagctgaagggaaggtccaaggtggtgaaaagaagggaagagggatgcggtaggaagatgagaagggggaatcttagatgagcaggtttggggagaccccaggttccctaataaggtcactgaagttccaaattacccttcgtgattactttttttttttttttttgccagttttggaaatactggacagaatgagtgccataggggcagggcatgtagtcagcaagggaggaggaggaggatgaggaggaggaagggcacccagtagattgagagttacctgtgggaagaggcagatcaaatagagaaaggagccaggctggacagtctcattaggaagttctgcacacagtcgtcatctgggagccaaagtttctcttcagtcctcattgaggagctgaagggctttccttgtgcaatctctagacaaggtgtcaagggaaacaatgaggcctcacaaaagagccaggaatttggagtaaatctccactcaaaaggaaccaagaaaacttctatccaggacgattctggctaaaattgaaaaggaccaggaagagtcctgctcaacagagtcaggggttaaatccccactcaaaaagagctaggaagagttctgtctgcgaagattcttgctcaaacagaaaagaactgggaagagctcatttaacagaatcaaagtaactgaatcacagaaccataaaaagtgtccaataaaagcaaataccgtctctgggcagggtgcaatggctcacacctgtaatcccagcacttgagaagctgagggaggaagatcacttgagcccaagggttcgagaccagcctgggtaacatagcgagactcctatatctataaaaattttaaaaattagccaggcatggtggtgtgtgcctatagtcccagctacctgggaggctgaagtagtggaggattgcttgagcccaggagttgaggctgcagtgaactattattgcaccactgcactccagcttgggtgacagagcgagaccctgtctcaaaaacaaaaaacaaatatggatttagatagagacttttattttattttattttattatttttgagacagagcctttctctgtcacccaggctggagtgtaggtgccatctcagctcactgcaaccaccacctcccgggtttaagcaattctcccgcctcagccttctgagtagctggaattacaggcgtgcgccaccatgcccagctaatttttcaatttttaatagagatggggtttcgccatgctggccaggctggtcttgaactcctgaccccaagtgattcacccgccttggcctctcaaagtgctgggattacaggtgtgagccaccgtgcccgaccaatactttatttaaaaagactattgcaatagggacaatgctgcaacctcaggacttgcaaacatcacaaaataatacaaaaaacatcacaaaataataaaaaaaaaaaagcctttttttttcagtagggagtagtaagcacagctagcagctcagctactttcaagggccagtgggcaagcaaaggggaacctgtttggcatgatttgaccagaaatgtgtttccctgtggtcagccggttctcaggagaagctgctaagtggggcatgttctgcattgcagcacttacttaaccaggagcaagcaaaattcaggccctgtggggaggacagaagcctgcctaacattctgtcaaggcaaaggagagggtaaaaagcagacagctgtgaacacttgatcatccttcaggcaataatccattctgggtttctggcttaagactcttgagaaacaaggggaaacaactggtaggagcagcaggctcacctatatgtagttccgtgaggtagccttatggacttctgccaccttccaaaactcagcatgtcccaaaccatctttatcaacacagcttctcaccaaaaacaaccaaataaaacaaattaactaatgtactaattctgtatctccccctgtgttgttcatctcaaaaaactgttatcacctcattgactcagactctcaaccagcgaggtagaagaaatgtttgggggcatgttaaatgtaacacctatgagacatgtaagaggtgaggtgcaggacgcaggtacatggtgataaaagaaaaacctcagccggattaaatttaaaggagtttcattgagcaatgaactatttgtgaatcgggcagcccccagaatcacagcagattcacagagactccagtgcagctacatggtggaagatttatagattaaaaaaaaggtggagggggggaaatgacgtacagaaattggaagtgaggtacagaacggctggattggttacaggttgggggtatgccttatttgaacacagtttgaacactcaccagtgtatgaatggttgaagtatggccgctgggattggccaagagttagctattgttacaggtacacactcctaagttaggttttcaattttgtctgcctctaggttacagtttattgacaaagactcaaatatagaactatggagtccttctcaggccgtatttaatttgctttaacaattccccctttttggtcattttctcaactttgagagattgacaaaaaccttagttattgatatcactattacccttgtaaatgtacttatatggtcttgaaacccactgggaaacaggaggacagtgggttttgtaaggagagaataaggactgagtagaaggtacctctttatgctagaatgttctgtttacaggacaaaaacaaaacctggtctgttttaataactatttgtttccttaaagtcttagtttgattatgttacatttagcatgagcaactccattttgtttggtttggtctgttgggtcctagtgcatgagctcagtacacaacaatggcttgccagaattttgtttaaaaaattccccttggctgggcgtggtggctcatgcctgtaatcccagcacttagggaggctgaggcgggcagatcacgagctcaggagatcgagaccatcatggccaacatggtgaaaccctgtctctactaaaaatacaaaaattagccgggcgcggtggcatgcgcctgtaatcccagctactcgggaggctgaggcaagagaatcacttgaacctggcagtcagaggttgcagtgagccaagatcacgccactgcactccagcctggtgacagagcgagactccacctaaaaaaaaaaaaaaaaaatatttccccttattggccaggttctcacttaggtgagagtgtgaccaaaacttagggccttagcaccacttttagttacctagttaccatcattttaggtttccagtctcagcatgtcattcataggttatgatgtcctcataatcatacatttcaatcagttttgttattccagttgaagagagaccatttgacatttcagagatggctgcatgcaaacatttgaaacctttgagagaatacagtgcactggggagactactatgactaccagtaggataatacccagagtttgaagtatgctgtttacctgaggtccccataaaacaaactgcctaaattaaataaaataaagaatgagctagacgaagagtctactcacttcactaagtgatcttttcattaatcctgtatgactgaatttttataatctgcacttgatatacatattagaattttagaaaccccatataattttggaatatatattaatataattcactaaaaatataccctgaagattaaacattatttttattggccaagcgcggtggcttacacctgtaatcccagcactctcggaggccgaggcaggcggataacctgaggtcaggagttcaagagcagcctggccaacatggtgaaaccctgtctccactaaaaatagaaaaattagccaggcatggtggcatgcacctgtaatcccagctactcgggaggctaagactggagaatcgcctgaacccaggaggtggaggttgcagtgagcagagatcatgccattgcactccagcctgggcaacgagggcaaaactcagtctcaaaacaaaacaaaacagtatttttattttgacaatgcctcccatgatttttataccaaataagccaaatgtcactgttgcattagtgcattatcgatgtcaaacccaattcttaaataaaaccttatagacaaatgtattcaatcttaatcagtttgaacataaggtaagaattttataaaccttttataaccctttacaatttttgttgaagagcagattagtgctctaagaaaacctgttgtgcttttatgtccatgttcaatttatggaaaaacctaataatacccttttaaatttagtattatcatacataaaattttttacaaggttaattttttttttttttttgagacggagtcttgttctgtcgcctaggctgacagtggcatgatctcggctcactgcaacctctgtctccccagttcaagcagttctcctgcctcagcctctggagcagctgggactacaggcgtgtgccaccatgtctggctatttttttttttttgtatgttagtagagagggggtttcatcatgttggccaggctggtctcgaactcccaggtgctcaaaggaaaatttaagacagtccatggaggagaaaggtatagacaaggtcatgcagatattaaaccagaaaggacttatttcctaagccaggaatcgaacccagactgccactgtgaaagggcaaaaccttaactactgagcccagaaggagtctagagtagttaattttgagcttgcaaaggcttttaactagtcaagataatttttagaactaactatgatatgaaccctaaaattcctgttccctggaaggtagagacaaggagaaagtactgccacatggttacaaggtcaagctcccaaggacataaaacaggatggcgaccttgtccagttttttgttggtttcagggacctgcagcaaagtttgtcactgaccagcttgctgggccatcttgagcagcaagcttatgggggcccaagcccatgttttatcctaaggtacccctcgacacagaaaaacgactttatagcacaaaatataccagattgactacagcttaagactagacagcctcagaattcctttttgcattaattaaaattttacagaggagataaacagtgattttacaatcagtttgcacagagagagagaagcctgaaatctgactgggaagagatatttacccttttgctggcatgccaggcttctgggctccctttccctgagtggccctggtgatctggctctctgcaccattgccccgggagccaagccacaacacaaaagaatttttttttaaaatgcacttcagtgtgttgttgttcatttggaatgttccactgtaagttatctttcgtaagatgtcaccatttctgtaagaatttgctgcctcccgggcgtaatgtgtaacccagaaggaactcagttttccagaagcaattaataggttccatggaatgttgatggtaagaaaggaaggaaaaggtgacaagagtgagcgtagacagctctttctaaggagtttggctgctggaaggggaagagaagcagctggggttaggtgggaggaactaagtttagagacgctaaaagtgtatgtagcaggagtcacctgatcaggttgaactgcagcaggaacaaggaagttccattttgactactattagttgcaaattggacccttatgtcaactttttcatctgtaaaaaaaaagggatggccaggcacggtggctcacgcctgtaatcccagcagtttgagaggccgaggcgggcggattgcctgagttcaggagttcacaaccagcctggccaacaaggtgaagccccgtctctactaaaatacaaagaattagccacgcgtggcagcgggcgcctgtagtcccagaatctctggaacccgggaggcggaggttgcagtgagtcgagatcacaccactgcactccagcctgggcgacagaccgaaactccgtctcaaaaaaaaaaaaaggggggcaggggatgaaaatgctattgctttccaggaatagctatgactacttccaataaagaagacaagaaggttccacatgtgaaaactacgcggtcacaacgataagtgggcgggtgcacgcacgcgcgctgagatcgtgcgtgcacaggccggggtgcggccggcgtgagtacgcctgcgcgtgccgccatttcctgcagccgcagactctgcctgcggtgctcgccgggaaatgagacgatcaacaaagaaaatggttgttttgggcgagatcgaccgtggagaggctttttctgcagcagtcccggttcctgccgccagatggcgctcgaggatcacaaatgggtctagggttctcataatggccccgcctaagaaattttggattctcctggcccttcccccctttgtggggtcaacagcggatttgggaatctggtgaccaacacgtgcgcactcccctacccttgcccctaccgagccctccagggtagcttgggggagaagctcctccctagactgccgggtatttgatgagcctggccagcgcacaggtcttgagcaccatggtcagggaagaaggctgaatggcttaggtcttcctagagaggccggaggcgggaaagaactggagaaaggagagatggcagtgggaggatggggacaagaataccagtgtgtttccagccagaagacgatgtcttttaacacctcattgaagtcgtcaggtgactttgcccttgtcagaaaggagcagcactgcgggggtcctactgaggaggagactgactgctccttggggtggggattgtgcctccttcctgtctgccccactcttggggagatgagtccctccaagtccacgagacatgacagccagcctacctgccatgggagaacaaagtctagtctcagggcactcacttcataagggtcttattcttcctcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcaggtacgagccaaactgcactgggaccttacctgctagagccagtgtttttgtccagggcagcaacccaggacaaacccccacacactaggcatgcctgtttatcctctgcaggtgagtgtggttaggagccagagggaaggagagaaaccagcatctcaggggtagatattcatgggtttcagcttggagccatagcatcaaatctgttagactaagtctggcacagaaaggatgcacagagaaccaggttgtctggcagccagttcgaacctggaaacctgggtcaggggagggatataggttgctttttctgttaatggagatggaaactctctgagcaaggtgtgccatggtgtggatgtgattcactgccagaaataacaactgtaccagttggatgagctcttccactgccatcagcactgggatggccatggatttggacagtaatgtagctccacagtgctgactcagggttgctcattgattgcaagaagttggcagcagtagcctgaggaaacaggggctctgaattttctgagagagaccaagaaccaaggaacagccaggtactagggaacagacaacaccagatgcttgtgcttttctgtgagcagctcaggtctcccaaagtggtagtttcctggcttctggcctttgtagatcagtgtggatccacacccaattgtgatgtttgtggtagctgtaagaactttcccaattttgaaatcctaggtgacttgtagcatattttttcacatttgaaaataattgagttttgaaaatgtttttacaggcaatctagtatcagattttatatcatcctgaaacattctgtcaattgtcatttccaaaaatccatggaaaactggagttgttgaactggaaacagtgtggtctcaggaagtgcttcacagccattgcaacatgggcagggcctagagggcaggagagaatgccatgatttgatgacattttacccattcctgccaggtgaacttcatctccctctctgtgacagaattttctggctctcacatccagctttggtcactgggaacccacctattggctcttgcactggcaggacatgtggtagaggcttccagttcgaggcaggactggctgcattttcaagatgtccttatttctggtattttgtggcgatcgtcctgtccacttaactgattttgacccattgccttgctgtgatctctgtgctctctctgtctcccagttccaggtcattcccttgaccagcttccagtctttcctcatcttgtccctgccaatgaagtattctggctctgccttcactctcctgccatgatccattgctttgatagggtggcttcaggaacagggtgaggagagggctgtgctagctttatcttgccaaggaactcagcaaagaaaatttttgctgacctcttgcattcctcagcctggctctggtctctcaaacctaacacatgggatgcatgccagcagccagcctcagtttccctctggtccttttctgtgtgaggccagaggtccttgctttatcactgcctggagctgcagttgatgatggtgaaagaaggtgcacgtgtcttttgagagctccctttgttccccagagatttttttttcccaaagtggccatgagtttgggaataaccaggagccatgggccgccggctagagatgctgcatactaagagcctcctgtgagcagccatgtacacagtgaacacgatggctaaggccccatccagccgccctcaaagagcacatagtccactaaggaataagcatgatcgtaataaccattagcacctgctgtgtgctgagaatgtgcaggcactgttctgcatgccttatgtggactcactcatttaattctcacaccaactcaaggaggtgcttttattatggagaaactgaggcagatggaggttaagtaatttgctggcagttttgcagccaggaagtggcctaaccgagattagaatccagacagagatcagagcctgtactgttcatcgctgtggcatccatactgcccctccatttgtgataagcccaggaaggaaagaaaccaggtgctctgatggagaggggttagagcaaggatggttagggaaagcttttctatcgaggaggagacagttcggctgagacctgaaacatctggaggagcctgccttccaaagaacctggggagaggcattgtggacaaagaagatagggaggagggcctgaacaatgagccctgtgcttggagggtacggggtgaggtgagcagggggcaggagctgggccctgtagggtcttgtaggtgagggagaggaggctattgggagggctcctattgctcacattgcagtcctggggggatgcccagggcattttttcttttttttaagaggcggtgtttcactgtgttacccaggttgtttttgaattcctggcctcaagtgatcttcctgcctcagcttcccaagtagctccagggaatttctgttttaccttgcctcttcagttgcgccgtccccttcagtattctgctgacatggatcacaggataccagacacctggtagttgttcagtcagtaggaggtcttccttccttcctcttagaatcaatccttttctcacttgttggctctgcattttatcccccgtgtatcttttcagatttttgtggggcctcctctcccatccagtccaccttctccagtctctatggtatatttctttgtcatagggtgaagcaggaacaggtacaggatgattgggtacactgaggtgaggtaggagggcaggccctcaggaagggcttcccagaggaggtgatattgtctgcaaaggcatatgagagcctggaagtccaggggaactgcaggctggtctgtacggcttgagtggcacgtgatacagtttgagactatgaggcgagagagctaggcagatgctagaccatgattgttcttccctttccccactcttcaactagttgtaatcttaggcattggattctctggcaaggggacaatacccagtagcctgggccagatggaggcagccatatctggagtatgatctgagccacagcatgttggagaaaagccagaatcagcccagggcagtgtgcacccatagtgctggcctcaggcctttggagggtgagcagacttaagttggaaggtgcaaacaagtggtcagtggtgctgcccaacatcgtgccctgaactgcagttgacagctacggcagctttggtaatgaggctcatagcctgggggcaggcagagtgagagccgatattggcttggccagagaaaagcccttttgggctgccgaggaggttggattccaggccaagggccatatctggcagctgaagtgtggaggttcagaaaaacttcgacaccggtcagtttcccgcctctgctgggaatgaggtgcatctgactttcctcctcaatgatgcctaatttcatttggtcctctgccccttggccttgtgttctctagagagttccctgcagggtggcagaaggagctgatcctagtaagggaccgtcccatccagtgaggaggtgagctgggctgtgtcttccccttctgcaccctcctgactgtcacatccccgggagccccatgattccactctaactgagtgaatcacagaggccaaggcccttggctgcagtcaggagtactgagtggacactggaagattggggtcttgctactgactcacgatgtgacctgggacatgtctcaactcacctagcctgggtttgcttatctgtaaagtgagaagttccatttgttggtcttggaggaagcttcaagagcagtgctcaagggttaggctcagaaaagcctgtttgaccctggaaggtgtcagctcccaggttgacgtgcccacccctccctttatttctttcagggtgaggagcccctcgagctgcatggtcactgttactgtcactgccacatctgagcagcctcacatttatattccagcccccgcaagtgaattggactccagctctaccacgtaagaagggctatctagcaacctgggagatgttcctccgccacttcctccttggcggtaaaggacttggcttttgttccatgttgcttcccatttagtgccttccccagtttctagcaggccattagccaaggggccacacaggacagtgttagtcccctaatataaactcccatctaccgggcctagacattcccacacctcctttttcctatctctgtaagaggctgcagtggtacttcctagtgcactagtggatgtggctctgccattcatgggtccatgcctgggaagccagctccagtccgtgaaggccgggcctgtgagggcattcctgtgttactgtaaaggaatacctgaggctgggacatttataaaggaaagaggtttaattggctcacagtttggcaggctgcacaagcatggcaccagcagctgcttggcttctggcaaaggcctcgggaagcttataatcatggtggaagccgaagtgggagcaggaccatcacatggcacgagcaggaacaagagtgaggaaggggagggcccggactttgaaacaaccagatcttgtgtgaactaactgaatgagaactcacttttcactaaggggatggtgctagctgttcatgagggatccccccatgatcccgtcacctccctccaagccccacctccaacactgggaatcacatttcaacatgaggtttgtctgtctctgtcacatgcccactgcttcacctgcattcctggccacctgtcagggtgcaggaagggatgtcactgcaggaaggctgctcagtgaggtgtgtgtgttgggggcgggaggggggcatatccaagggggcctctgcagacatcaggtcagcaggctggagtgtgcagcatggaaatgggggaaaatttggggccatcctgagcccagcatgatgcagaccttgtttccagtcctgcagaggccagtccaggatgaggcaacctctaggcctctggactctaggagtgagaatggagaggttagatgtgaggtggagattgcacagtagctgagtaccttctgggaagtgctgagtggtaaagactgacagtgtaggattaaggcttggaggatatcttggttgtgggtagaggggaaagacgacgcagccctaaagtaggggtggaaagcccacaggactgaagtgtagaagtatagaagcctggggagaagatggggtcaccgaggtctgcatggaggaggacagcacattgtcattggttgcaggaagcccctttctggggccctcagtccaaacacaacaagagacgctcatggcctgggattgtagtctgagtccacagcagtgccagtgcctttatcctgggccttcccatgagctctttcacttccttcaaaccaggctgggtctccccagccctgaaccactcctgtgggccaggcctggttccctggaatcttctggtgtacctctgatttcttctgtgctccttctacagcaaagggattctcttcgtgaaggagtacgtgaatgctagtgaagtgtcttctgggaagccagtatctgcacgctatagcaagtaagagcgggtcccaaacccttccatgtcggccttctcctgccggctcccatattctcatccctgcatttccagttccttgtccaggacttggctcagagtagcttcggggtaattgtcgagtggatgagtgatgtagttgccctctgatgggattgatgcattttctactgaactgggcacctttgggttctcccttccggtgaattcatcctgcacaccattttcactgccattctgttctgcttgtctttgttattttattttgtaaaatgctgagaacacccctcttgacagagctggcagagccctagggaccaactagctcatcctatttcttttcagatcacagagctcttctcttctgccctcatgttcttttctgtcatgccaggctgcctcatttgaacacacatgtgactgcagttcctgatacatgtgtggctttgctttttaattttaattaattagttaattaattttaattaatttttttttgagatggagtcttgctctgttgcccaggctggagtgcagtggcgccatctcagctcaccacaacctctgcctcctgggttcaggcaattctcctgccttagcctccctagtagctgggattacaggcgcccaccaccatgcccagctagtttttgtattttagtagagatgaagtttcaccatgttggccaggctggtctcgaattcctgacctcaagcaatccacctgcctcggcctccccttttcattgatcatctcttcattttcttgctttgtgatgccatgtggaggggtacttccatgtcacctcggtgtattgctacctaccacactgaggtgaggtcccttagaatgtttcttatgacatgtcatctcactggaggattttagcaacagagaggagcatcctggccttatttcaggattgggcctctggggcttctggactggcttttattggtgctgtggaatgatgagcatggctgtgggggtcaagttcaagccccagctcaggcccccctgttaggatcacttcggacaagatgttcaacctctctgagctttgctttcacatctgtaggcccttagggtggtttttctcaacagcttattgagttataattcaccctttaaagtgtacagtcccgaggttttggtacattcacagagttatgcaaacatcattatccaattctggaacacctttgtctccccaaaaagaaactccaaacccgtctgcaccccctaattctaccccataactcaagcacaggtattataccagaatgatcccttctttcttctcattcccagtatctgatttctgctgagtgggctcctggtgactgtcacattatatcataggtggggaggaaagctctgctgttttcccactggtcagtggggtccccttggcatatacaacctcaggaatcctagccacccagccccgatcatctccctcattgtgaaaggtctcctttgcccccccatagaagggccctgtggcaccaagtcatgaatgacgactggcatcgtagttatgtctcagcttgtggccaaaggttaattagaaaattaactatgatagtgatttggctctcatctctgccctcctctcccctatcaaactccctgcagcgtcagcagcattgaggactcattcgccatggagaagaagcctccatgtggcagcactccatactctgagaggtatgttgactttcttagcacggagcttgcacttctacagaggagaatcagggaagggagagttcctgctgagtctgtttgcttttgtcttctgctttgcagcctccaatccatttgcagaaaggtgaaggacactaccgtagggtggtgcttcccttgttgggatatcacacttgtgacaactaaagcctttgaattgagctaagactagagggtagataccagcggtgactgagaagggaagtggtggcatctgacaacccagaggactcgtgtcagcaggaggggcccttcagattagaacctaatcaatcacttcattaacttgcaaatctaaccagaagtaaaaataaaatgactacaaaagagaggagtgggcagagaaggaagaaaaatgggctgctggcatcaagaagccagaaagacacacaaagccaagaatgcccagtgctgtggagccaccaaattgaaagcaggggcagagaacacctcgttcagcagttttgaaagctgtcactagatgatggcacagtcactagagagtcttaatgacaaagaaatcttatgttcagattcttggaatggggagaagagagtctcagagattgagttcactcaggcttctgtgaagaaaatggaataaatagccttcagtccacagtaagcaaatacggcagacccaggactaaaccccagggccctgactactcccaggttagggatgtttctactctgccatcttgcttctcattgatgggcagatcttaattcatgtggatgacattcagagaccaaagctacattggggaggaaaaggaaggaagtaagagggttaagataaagagaatcctaccgggccccagaggcaaacatataggagcagacaagcatatggggccagggaatctcctccactatagctgaagaagcaggtggttctgagtaactacagattacttggtgaggcacatcagcagatgaagtcttagcagagaagggcaggttggtcagaaacctgagagttaaccacttacataggagcaaatggaatgaggcttccaattctagtggagtgacaaaccagatactctagggacccccctttccattgcacaactactaaatccagaatcagtcattactgatccattgctaggcttggaggaaggaaggggactctctagggacaatctcagtcacttgcacacatgcatatgcacagacacacatgcacgcacacaaagaacagctgtgagctggtgctgctggtggtgaaagaagcaggaggagcagggctgcgctgagggcaaggatttcaagcagcactgctgtccagagtgaaccctgggccagcagcaggatggtgggccacacccaagctgcccgtgacacttctgggtcctccgacagagctaacgtggatctagattgttaatgtccccccgccccttgggcttctgtcagaagcagacccaaatctctggaagaaagtaccctgaattttggcttgtaggatcagatcaagcagttactttgaggaagtgcagtctgaggaagaaaagcagaggtgactctcagaaacaggcatcctggaactggaaagatgctcaacccaggagtcagtatctagaacttcagtgtcggatctgagtaggctctacagacagagcatgaagggtgggtccaggagtataggcaggggcagagctcagttggcccaggcgtgaggagaagggccatcaagacggggccaggcagggcacacaatgacatgtctcctgtaggagaaggcattggtcttcctgctctagagggtagcaggccccagcggataatctaagcagaaggtcagggggaggcaaactgtctggaataagtatcatatcaggacatctacaggagacatgtcattgtgagctggaaaaagatgcatgactagtttttggaaataatgcagaggtctacagcaggctgagaactgatctggcccagggctgtgctgcacaccacagaaaacagtggcatcctggggatcctgacagcaaacctgggcctggctgcaccaaattggaaggtctggctgtgtcacatcagaggtctgtacaccagcctgaccaccgggttattgttcttcatctcacaggacaactggagggatctgtacttactgcaaccgtgagatccgagactgtccaaagattaccctagaacatcttggtatctgctgccatgaatattgctttaaggtaaaaaagaggtggaagacaccttgagctaggcggtaactcctgatcacgtgctgctaagaacgttttgtagagtgcgggagtcttacgggttcagagactgtggaggaggcttgatctccatatacaattgcacatagtcgcagaggctttgcacaactgggagctgaatgagcttccaagtctaagacagtagatgagtgttggtggttctgcatgcttagtactgtagggaagacaaaagaggtcttttcaggaaagactatttctggcagagggccagcaagtgcaaaagccctggggcagaagcactagagtgttctagcttgcgtgggagaatgccaggagtgacagagtgggctagatcatgtaggccttggcgggcacagagtttggattttattctaagtgacattggggtccccattctccacagtgtgtggcactttgtaaccccaggttgttggttccaatccatttagggtgtcacctctgggtgcactgagaaaaacaaccctcccctttgccttgacagaatgttaggcaggcttctgtcctccccacagggcctgaactttgcttgctcctggttaagtaagtgctgcaatgcagaacatgccccacttagcagcttctcctgagaaccggctgaccacagggaaacacatttctggtcaaatcatgccaaacaggttcccctttgcttgcccactggcccttgaaagtagctgagctgctagctgtgcttactactccctactgaaaaaaaaggcttttttttgtattattttgtgatgttttttgtattattttgtgatgtttgcaagtcctgaggtccaggatgtgccacgggctcacagcatctgctcgcccaccttgttcaggcatccccttcccactccactcattcctcttgctttgctttgtgtgttgacctccagcttgcttttcttttcagtgtgggatttgcagtaaaccgatgggcgatctcctggatcagatcttcattcaccgtgacaccattcactgtgggaaatgctatgagaagctcttctaggtgggtgctggcactgcaaaggacaagtggccaagagactcattaaggagtagagatgcaccctggtctctcctggagtctcagccccagacacagctatctttcttggctcttccttatgttcagggggccttgtgtcctcatgtccctatgccttgtgatactttgagatcttaggtggcatggacaaaggccctcaatgaggacacttccaaatcacaccttccgtccagcacctgagccgagccctctagctaccctgggatactcgctcggccgctgttgttagccccattttgcaacaaggaaataaagatatagaaagggaggggacctggagaaacccaggtagaatcaggacctcaccccaggtctttggattcttgtccagggctctctgttcactgtcactcgcatagcttcagatcaggactgcatagccatggtgctcagtgaaacaagcctctgggccacattatgagaactgcctgaagatgtgtgtttgcatgctcatagccagtggaatttatcacggtgtctgagcacagagcagaatatatcccttgaaggcagtagcaaccaggctttccactagctccatgctgatggtcttctctccagaagacacaccttgagctaggtggtaactcctgatgactggagcagtcacccaccctgagggcctctagctgatgtgtttccagtctcatggctacttctgttttcttttagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcacatgtgtc

SEQ ID NO: 3987 - DNA, 59038 bp, human; identical to SEQ ID NO: 3976

SEQ ID NO: 3988 - DNA, 45421 bp, human
agaagccctgctgaatcaagtgagaggagagctgcggagcaatcaccatgagtatctcagctcttggaggccgcaccaaaggtgaggcctgggctccctggtttcccaggctctgtttggggctgtttgcttccaagcctgcccctacaggccacaagcactgtcccagcagcaaagggagagcagcatactgggagaactggaaaggaggtcgagggtcctggggctgcattcctcttctgaggcggttggcttttcccaccacagggaagcctctgccaccaggcgaggaggagcgcaataacgttctcaagcagatgaaagtgcgaaccacgctgaagggggacaagagctggattaccaagcaggatgaatcggagggtcgcaccatgtaaggcaaggaggcggggagggaccgcagcaacgtgggggcgcgcaatccgtgggggaccgaccatacctggggatgcgaaggggcttccaccattcagagctccgccaggccatgtggagggcagagcgtgggaaaggctatccagcaatgtcacagggtgggagagcccctgggtgcctgggaaggagaatgtgtggcagaaatggcaggacttgctgggcagcctctaggatggaggccacaggatggcaggtgacagggagtctcggagccaatccttcaggatgcctctttcccccagagagctgccctcaggccggagtcgcgccacatccttttcatcagctggggaggttccgaagcctaggtaagaggtggtgctcaggtggctggtgggtcagccccagggactctcctgcagcttggggccagccctcaacagggaggggtgggcagtccacaggggacagggatgcagccccagccaagggtctgcaatgagtaatttgaaatctgcaggaaggaggggcttctccactgcaccttccttttgggaaggggagtgtaggagtcacttggtccaggcccttggcctggctgtgtggctgtggggcagctgacttccctgctgggcctccgtggctccagctgttaactgggattgaaattgtctttaagaagaagacgacctcccacccattccctgcagggagtgatactgcctctgagatgctttgggcagcttccagagtcacagtgactcactcctgcaggtcaccctgactgcttgagtgtacttgggactcagcatgcctgtagagaggcacgagtttgctctgactgtctcccaagtttaccgtgacatattttgtcagctgaccaaggagaactggcttctctctcttttgggggcttttccataacagtgtctaggggggctctgaagcgtgggcacaccctgctggcctctggaggaactgctcctgacagagaaagggaactgaaattcaggctcgctccttgctccaaacagccggcaggcggcttctcagggggtggtagaggcagtggcggcctctggaagggagggcctcaagtttacagccagcacacagggctacctttagtaactacggtctctctgtcacccctcgatgactcagcgcccactacctgccaggtcccatgctgggcacagaggatgcaggagtggtcaagacaaaggccctgtctttgggcaactgacgtcccagcaggggactcaggcaggaccctagtaaacagttcaatacaaaagcgagaacccccaagtgtgcctgcaacatggccacctctgggaggctgtcccctgttagagatggagattgtggggttggagactaccggaggctctgtgttgcccttgacccaaaccccgatgctccagcccacatcccctccactgcaggacagaagggtctaccctgaccccttgactcctcccctaactctgaggaggactctttgcaggggcccctaactcctgcccggaggccagaacttccaggctgaccacccctggctgtcagctccctgcccgctcgtcttggctgccccctgagttatctgagccccctcagttgctgccaagcaggaggtcccaagcacccagagcctaatgtttcccagccgctgaacaaggcctggccgcgccctctcgtctcaaacttccaccaagacttggggtgtgggcatgcaaggagctggagcaaagagggccccgagggacaggaagggggacagctggcttcggctggctgctgcctgggctctccccttcaagccctcatgcaccttcctggtggaggctgttgagggagatcaggtcagaccccgggctgaggggaagcctctggctctgactggggagcctccagcttgcactggttcagccccaagcacagaggatgggagggctgtcagctgagagcagtgctccgtcggcgcagcactgggaactggctggccaaggagaagctggactttggagaggccatcaagctgccttcctaggcacctgccatgaggagtcacctggggcacttttcctgggggagcatgagggaaataggcagagcatagcgggcacctgatcaggggcacagggggctggcacccctcgtttctgctgtactgggacacctggagcacttgccagccaatcttatttgctatcgttaagggcaggataaagtaggatgacctcagccctccagcaagcctcgcttcactccaccccttcttctcttcggcaggcctccgagcacaagggctcccactggctacatcatccggtaagtgaccgcaggactctgccggccttcctgtgcccactcacgccaagccctgacttcttacccctccagtccctccagggagctcaccggcatctcctgggctctctttcaggggagtgttcaccaagcccatagacagctcttcccagccccagcagcagttccccaaggccaacgggactccaaaaaggtatgtccatggggtgttggccagtcggccagtggggaggtgtgagggcctggtctgggctcctggcagagacagtgctctgcctatcaggactgtggggccttggaggtgccagctttcatcctgggtagggcaggaccctggagagcagggtggggtgaccagaggagatgggctggggtgggactggcagtcccaagtggatgtgtgggtctctgggaggtcctgggccactaacagtgtccttgtcctggggtcagtcctgactaggcctggctaatgggacagagaggtgcaggagtttgggaggggctgggtgtagagtccccctagcctggcagtgggcacccttgacttgacttgctgatggcattgagaaggctgaagttgcatgcaattcaagcaccttggcatcaggcattgcctgggactccgtcagactggaaaggccaaggggacccggaaacaggaagcaaagacacaggcaagagcccgctgggctgttccctgaagctcggtggggtttgcctacacagctgctctgagtggcgcagttccgggtgtctgtcagggccaaaagcaaagaggaaaggctcccaggcagctcctggtccacctctcatgtgtccactgggctgtgtggccaaatctggaggcaggagggagcctgcaggtagacacatggaaccttctcctctctagtgctgccagtctggtgagaacagctaacgctggtcctccccgcccctcctcctctggctacaagatgaccactgaggattacaagaagctgtgagtatgcaacgccaggctcagcgtggttccctcctccaaggaacaagtccaaactctgggtccactgaaggcagctgactacttgccaccgagcacagcccgggaagtcccgcctgcctgacactccctgccagttgcagctgtggcctggagcccaccagagggtaacaagccccagaaaactggatggctgtgcacattgcacgtctgatccgaggcagagcggagaccgcaggaagcttgtaggaggggccccacggatctggggaaagggtcatgggtcgtgaggctgctgctggctggctgtgcttcctgggcttggccctgcacccggccgagcctcaggtgctctgcctggctgcactgggctgggggcctggggatcctcagggtgctgctgtcagtctgagcattgtgtgcctaaatctgagctgcttcttggatagaaaccttcgggttttcccttagtgctccccttggggtccctttcaaagccccccaccccccactgcatgctcagggaggagggttctctggacagaggtgtgaattgtgtctctagttcccaggggaccacatctttccgttgtttgtcccttgcctccatcatccagggttggggagctgctgggtaacctttctggggaaggggagaggctcgaacagggagggaggggagagctggtctcagggaggaacaagtggcatgacctaaggcccaaaggcagagatattgacttgcctcgtcattgttgttgaaagccaggaagccaagctgctgagggtggcagcctatgacaggaaagcgcctctcccctctcttagggcaccctacaatatcaggcgcagctctacatcaggggacaccgaggaggaggaggaggaggaggtggtgccattctcctcagatgaacagaaacggaggtaatggaatggtgccttttgggcatcccggggggcagggcaggagcctgagtcttcgaagactgctggaatgaattgtactggttggggtgacaaaatgcacaacacgtaggccatcagcggtagcccacggagcatgagaataggtgtcattctctgagtgccagaaccacccactcagtgttggaccagctgaggggcccttgagaaccttctgtggggtagaacctaggtaatgtgggtccggggaaaagcctcctcatgtggaggctcttcagggctctaaatcggtttgttagaaagggccctgagacagttgaacaaaaatattcagggagaagccacctgcacagtgccctctatctgcatgatctgcatgccttgggggttctgaatgccccggaccccaaactgagctccaggcatgcacagcagtgggagtgtgccccatgctgctgaaattctaccctagtctctgcgccaagctgccctcgtccacacaggccagcaaagttccatggacccttgcccctcctcagtcctctgtccatggggactgaccacataccacccagtgctggtgaactatgacaggaagggtttgttaagcaccttttgtatgcctttggcttggggcctgtacagcagttgggccctgaggaaataaagccctcccctccctgggctcagccagccaccaggtccatatctgctgacccatctgtggcgcaggaatcacagcaaagccccattgccaaaggccctggcagattggctatcctcagggaacagttcacagtggcaggggcccccaggcctgggtggagcaaggaaaagagccagaagctaggagctgcctagcattgaatgccagctctgccacctgctaggtgagtgctcttgggcaaataatgaaagcttcttggactcagtttcctcatctgtaaatcacagaggatactagcgtctactttcctggattgagaagagcaataagccaatgcgaggatgttggcatctggcgcagagccgggcacatgccacatgctccataaacatgggctgcccttccttcaggttctacatttcctttgaatagtccttggagcaggtgcaaatctggtttctctcaccccttgcctccctggggtggccctaagtcaccccgagtccatcccaggctaggctggcagagcatgtccagcttggcacccatcagatgctcccccatcccgtgtcaccccaggtcagaggctgcaagcggtgttctgaggaggacagctccccgggagcactcctacgtcctgtcagcggccaagaagagcactgggtgagttgccaccaactggctccaggctctaggacagctctcctctcctcagagctccagccttctctggctgatgaaagggtgggtggagagatcacccccaagggccttcctagctgagccttctcagattctcagatgtactttctagaaaatggagaggtctggcggctaccaccagggacagtgaagtgccgggaatggagagggcccaggaccctctgaggtagagcggtcttgatgtcacctgcccacgggctctgcccaaagcattgcctttctgcttcctttccagcagtcctacccaggagacacaggcaccgtttatcgcgaagaggtaagtgtcatcaagggacaccttggaggcctgttactggccacaggaaggccttccgtcagcaggggtgtagtgtgggagctgtggagaggggatgtggatgtgggggactactgtccctgagcagggggagttgtgaggggctgggggcttctgtctggaggcctggcaagcacctgggtggctgtggtagcatatgtggtcaagctcttccatttgccaatggctaatggggctgggcccctgacccaacgtggagcatttccaaggccctctgggagttgttcccctgcccctgttgcttgcctgatgccttgccttctgctctcatccaggatcaaaacctgggccatcaggagaacttcccctgggaggtgactgtgacattggagatgggccctaaagggtgaacagggcttaacagggaatgatcagaacgtcgggatactccagctgaatgagggaggggtgtcaccattagttgagacagggcaccttctggaggaggaaaatattcgggggaaagcaagaaagaaacttctggaaacttgaatttgagggacttccagttgagtggacagggaaggcctctctctgtgctgaggtggctagctggggactgcaaacccaagagaagacagcatgccaactgccccaggcagagggccccagtgcacaggcccggggtgggactagcttgctgtgttggaagaccaggaagttggcaggaatacagagagcagggatggtggcagcacaaaggaagtgacagagaacggggggcggtgggggggtcttcctggctgcatttggttcctgtggtttctgtaacgcagtaccaaaaactgagtggcttaaaacatcagaaagggattctctcccggttctggagaccagaagtctagatcaaggtgttagcagggtgggttccttctggaggctttgagggagaaaccatcccaggccactctcctggcttctgctggtggttggtgatccttggtgttcctcggcttgtacctgcatcactccagtctgtgcgtctgtcttcacatggccttctcttctctgtgtgtctgtgtccagatttccctcttcttacaaggacagcggtcattggatttaggacccatcctactccagtatgacctcatcttacctgattacatctgcaaagaccctatttccaaataaggttacagtcacaggttccaggggacatgaattttggggggacactattcaacccagtatgctgtccttatcctgagctggagtcactgaacccccagcctgggccacctcttggccgtgatcctgaagggttgggtcagttagacgccactggaagcatgttctttgaggcctccaagctctagggcagccaagaagaccacgagcgctgtttctcttcttgctcaaagggtggaggtggtggaagaggacgggccttctgagaagagccaggacccacctgctctggcaagatccactcctggctcaaacaggtaatccattgcgctcatctctgcctggggctggtggctgccatacctgccactcagtcactgaggaacctcagtcagggcacctccatgctgggcttcgagatcagtgtccccatgtgcccagtgacaagacgggacaaagaaatcagtaagagcccatctggctggatgtcccagggctgaaaggagcaaaacagtccagccccccgggagagagcacctggctctggtctgatgagtacgtatctgtgtcaccttaacccttgcaccactgagcctggtggcaacttgaacaccccaagaaaaagtaccatccttggggtttgagagggccagccaccatggcagtagcatgccattgtcagacttgctccttgcactccaataagttagccacattcagcatgcccagggaggaggctctgacatctccagagcctctcacagccaccttctttgccagtgcggatggaggcaggaccaaagcgtctcgggcaatttggatcgagtgcctgccaagtatgcctagccccgctgggagccaggagctcaggtgggtgccgagagctgactctggcttgtgagtgggtgtgatggcttcccgccagcctggctggctggttctgccagctggggagggtctggcagtggggtgatggggcaaggacaggctgagcactggtgatctcactccaggaagggccgtgatttgtcttgatttctgatccctgagaatctgggcagataatggtgctctcttgtctgtggacaactaataccttcttgtactttgtgcagaatggtgctaagtcctgcagggagagccaccacctgctgttgctgctgtttaaagtgcctgcctggattgagacctttgctcaaatctaggtctcctaagagctgcatctctgtagcacccttggaagacccctgcatccagaaggggagagggcctgtccctaccggtcacttcccaggcccccaagggctgttcaggctctcctaataccatagcaatcccccaatttgagctccacagccatttatagacaggtgaccactgtcctcagggttacttcctcagtctgggagggagacagaaatgctggcagagggagccaggagcatgaggccagctccctccatggccccaggcagcagactgccagggtgcttctccttttcactctctccctctcttgatcttctctggttgtctgactctccccataagaactttggtccatagaagatgtggaaaggaagatttgagaattctttacaaggcaatatctagggcagagctccccagtctttttggcaccagggattggtttcgtgaaagacactttttccacgggacggagcaggggatggtttcaggatgaaactgttccaccttagatcatcaagcaccggattctcataaggagcgcacaatctagatctctcacatgtgcagttcacaatacggttcgcgctctcatgagaatctgctgatctgacaggaggcggagctaaggcagtaatgatctctagcttacctcctactgtgcagcctgattcccagcagaccacagactggtactgatcctcaggctggggttggggacccctgatctaggggacttggcaattgagggatatgggggcaaaggctgccacaacaaagtattgtaccacaccctggggcgcttaaaccacagaaacgtatcatctcccacttctggaggctagaagtgtgagatcaaggtgacggcaaggttggttcctcttgagtctctctccttggctggtagactccatcttctccctgggcccttatatgctcatccctgtctgtgtgtgcctgcgtcctaatcacttctgtttttttgagacagagtctcactccgtcgcccaggctggagtgcagtggcacagtcaccactcactgcagcctcgaccttccaggctcaagagagcctccagccttagcctcctgagtagctggggctacagtcacaggccaccatacccagctagttttttttttttaaatttttgtagagacagggtttcaccatgttgcccaggctggtctggaactctaggactcaaatgatcctcctgccttagcctcccaaagtgctgggattgcaggcatgagccaccgcgcccagaccctaatcacttcttataaggacattggtccaactggattagggcccaccctaacaactgtattttaacttagtcacttctttaaaggccccatctccaaatgcagtaacattctgaggtcatgggggagttaagacctcaacatatgaattttgggtggcacaagtcagcccataacagtatacagttctcatttctccttatttctcttttaaagaaaggcaataaatggtttcaggtgcctttctgtttgttcgtttgtttgttttgtttgtttttgagatggagtctcgctctgtcgcccaggctctgtcgagtacagtggtgtgatctcggctcaccgcagcctccgcctcccgggttcaagcgattcttctgcctcagcctcccgagtagctgggattacaggtgcacgcgaccacgcccggctaatttttgtatttttagtagagacgggtttcaccatattggccaggctggtctcaaactgctgaccttgtgatctgcccacctcaggctcccaaagtgctgggattacaggcgtgagccaccgcgcttggcctcaggtgccttttagaagataatataggaggctgggcatggtggctcatgcccgtaatcccagcactttgggaggccaaggcaggaggatggcttgaagccaggagtttgagaccaacctaggtaacatagcaagaccccatctctacaaaaaaataaaaaataaaaattaaaaattagttgggagcattgatgtacacctgtagtcccagctacttgggaggctgaggtgggaggactgcctgagcccaggagtttgaggctgcaatgagctgtgaccgcacccttacactctagcctgggtgacagagcaagaccctgtctctaaaacaagaaaaaaaagagagaaagaatggaggagaattagattgtgctgtattatagatttaaaaggcactttgacatttattccacaaaattcctttcgatgtttaatccccatcatatggttgtcattgcaaggtggctttttaagtttgctcaggttgccataacaaataaaggctagagattcagggtccggggcaagctcccaacaggaggctcagcttgatgcttctgatagttctttcctccaattctggtcactcaatatttggagctcacccaggcagcttccaggaaagctgctggctgatcctgaccctggagggccgtcttctctgaccctaccacgttaggtgctgcactggaccaagcagccaccatcagtactcccaggcccagctcctatctgcctggtgtctgagaagcccagcccgtgaggaacaatgactcaatcaaactcagggtcctgcagcacttcagaaaaggctggtttgtggcagagtggaagaggagaatgtcacagccttgtccccaggcacagacctatcgaggctaccctctccccaccccctgccctgccctgtttcccttagctacagtgcaaaggtcagctcctcataactcttgccccccttgcaacctgaacccagtttagggaccctctcttggagaaactggttctacacatgcaccccttctcggcccccaggcctggctgctttacccgaagcactggtcaagcttgcctcacctgaccagggcatggcctcctgggtcccggtcctaggctctgcccagcatgctgcctggcagagcgtctggggagcagggagtaggagcacagcttctggcacaggacaaaaccctggctttgcatcagactgactgtgtgaccttgagcaagtctcttcatctctccatgcatcagtttccccgtggataaaatagggagagcagtaatagctacttcccaaggctgtcccaaatgctaaatgagatcgtgcacctgaagtacttaccacagtgcctgggtgctggtatcctcgggggctcccagtcataggcgtgctgagctgcagggcccttattcaaatacaggaagagatcaatatctccacctgctggcatttgagggaaatgtggccaaaggcagtgaaaaggaggtatcccctcgccccacatccccgcctcctcgctctttggcagaatgagtcacacactgtttggcacaggccacagttggtcgcattcccacaggtggctgtgatcagttttgggcttcaggcttcagcagatgcctgcctctcttccttgggtgccttccaagggtgtgcagccttccagcgtggtcctggacttcagcttggactggagctgtctgtggttgagagtctggggagatggtagggtagcgggttgtgggggaggagagacccttgtattagtttactggagctgctgtaacaaggtaccagaaactgagtggcttaaaaccacacgcatttatcctctcacaattctggaggctggaagtctgagatcaaggtgtcggaagggccatgctccctccaaaggctctgggggaaaatctgttccatacctttctcttaccttttgttgcctgcaatccttggtgtttcctggcttgcgcccgcctcactcccatctcggcctctgtcttcgcgcagccgtcttccctctgtgtctgcccacattgccctagtctgacatcagtcactggagcaggctggggtgacactttgttcccatttcctctgtgacagagccagaaacgccagtgagaaaatatgttgtgcttgcctgtgacatccctgttccctggcaccacctgatttaaatgaggcagccaggggttttatactgtcatcataaatgacatcatcctcaacaacgatgtcatcgtcgttatcacgagaggagatggggagaagtcagagctgtctgtgtgtctagggcccctcctggctttcatgatgggagaggccttgtccttggtagcccttccatttccctctggtcactttgagcactccaggccctggccagggtggaagtggagggacagagatgagcagcccgctgacccagccctccatggctcattccttgctttcaccttggccactccatcccctacccctcctgggacccctgagtggcctctttaaagtgccagtctgaacctataaaccccccacctccacttcaagcccatcctgcatcttccctttgccataccagatctagtctgtacattcaggacccctgccagcctctacctcctcctcctcccccgatctcccttcagctggcctgggtcgggctatgcctccatgaagcttgtccactgctcccatggctaaacctgttctgggccctgcagcacagcaaggtcagtttccatgcctctctgcccctgcctgaccctgctgggcccagagcttcaccagggcaggcctggggctcaggcttgtctgcacttccagggcccagggacaaaggcaggagtgactgcaatgtggcttggaattaggctttgctccatggacctaaggaggtctggtttggggtgaagggtccacccccagaaagcctgggagctctatattctctctggccctggccacaccatggccaagcctgctgggcgtcatgccttgcagtacggccagagaatgcatcagacttggagggatgtgtgtccggggtggcctgtggtcatctgggggagggctctgagcgtggctggcaagaggaaagctcaaaggggccctttgtcctcatccccgagtctgcgacatcccctcccactggttttcattccatatttggtctgtgggttttctcagtctctcgtacccctcagtccccaccagtccatgaatgcagaactacccctggcctcacaaatggccactttggataccctggtggggtcacaggctgcggttgcccctgcaaatggttggtagaagcacgggttgggaggtttcatttctacccagaagggcccttgctgtgcctgagggagggctgggctcaggtcaggggtgggagaccggggaaggggcctacaggtcagtggcccgagctcagctgcagcaccaacaaggctcaaggccaaggaggagatgagagcacatcaaaagggggcagtgggtctgggcggcccaccgcactcaccagcccaagaagggggagacttttctcacctgcaacccactgggtctctcctttggcccgcagctcaagaggtgaggaaattgtccgcctgcagatcctgacacccagggcaggactccgcctggtggccccagacgtggaaggcatgaggtatgggggtcctgctgctgtcctggctccctggacaccattctagagatggaagcagcagcctcaggtggcaaatgatgaggcctagggccggctctgccactgtagggccaacaggttgatgggaggcatggtcgacctgggttttctgccccatctcattctttcactcagaaaaccattatggagcaagcgcttagtctgtgtaagggcacaggcccgaccctgggacacagtagtgaacaggaccccctggctggaattgccatctgcctggtgggggaggcagacgccgacatgagcatgaatgaggtcagccagagatgctgtgtgccaggagcccctgggaagtgacagctcaaccctgccaattgctgaagatgggaccagtcagccgtgctggggatgttggtgggggtgggaggaggattgggtctaaggagcccgtgaaggccactgaggccattgccctgcctgtgtgagagggccactgggaatagagtggggtcactgggtcagagtccacagctctccatgccactaggctctgtgctggggaggggtgggtcaaggaggccacaaccagcagggagcacgaggggctcagcctctgccctggggtgggggtcagacagccaggtgacatgcaggcaggattcgggggctggggtggaggctaggagagatccgagcagggagactgggcccctaccttgtgaaggccagggactggggagagaagcgggagtgtacactgaaggtcatcccttaatccctggggtggcaggaacttcgagcagaggcctctcaacagtgtggtgggtgggagtgcttggggagggcttcctggaggaattgacatccaagatgagtcctgagcgatctctaggtccctttaccctcctccttggctcctcccactttaattctgcccccaaggcaccaagtcctgtccactttattttagagatgtttccatccctattgctctgcccctggcccaggcctccactgctactcacccagttgtctgcgaccgtttcctactgtcccatccctggactcccttccacatctacctgggtgatgtttccaaagggcagaagtagttatgccagccccctgcagaaagccctgcaaagcccctcccactatgctctgcagcctgaactcagtacctggccccacctgcaggctcctccctccctgggcctttctctgtgcaggctggaggctctgcctgagatgccctttcccctcttcatctttctgttccacctcaaatgtcctgtcttctgggtcatgtccttctcctgagtttcttccccaggcagcatctgagggcttgtcgattctgcatggcagcatccattctgcatggatgtagatacaatcactatgcccattttacagattaagaaactgagaccctgaatggttaagtaacttgctcaaggtcacatggtccagagcaggcagatccgctcagcctgccctactcccaccttccaccttctgcaccatagctcattgtactagttggggcagggagcagggggacagagaggggtgatggaaagacttggcatttgctgagtgaactcatttgacgagtttattcgtaggcattgaagtcaaaatttccaggagggaggtattttaaggtttgtgattgaggtttgagagagtgattagggctcaagagatttccacgttatatgcagacagaatagagctgaaatcatgagcgtaaactagctttacatggggctcatggtgagccaatggaagctgggcaccgacctcagtatgcaggtggcagccacctggccagccctcctggggacagctgggcgagggcagtctcttctcgccatgttgagagtgggcctcctgagggccagttgggagttagtgggtgtgcaggccagtataaaggagaggcaggaacaagtggagatccctgcttcaagggtggcagttgacaccttgggaggggaggagacagcccagcaagtggtggagcacgccaaagggaggagaaaaaggcggagaccaggaaggtgtgtggccagggaggtaggcaggtggtgttgacaggatcaagggaggaggggtggtgagaaggctggagtggcccactgggtcagcagtactgaatggtggtttgaaataatgatgggactgtctctcctggatttgacaacatggggctccctgaggacctgaaggagaacagaagggggcttaaattaggagattaggatcagggatatagtccagaactcaaatcccagctactcctcttattacctgtgaaatttggggcaaatcacaggggctttgtgtgcctccgtttgctcatctgaaagatgggcatgggtgataacagtgcccatatcctggggttgatttgcagagttaatgcatataaagtcacgagaacaggctcaaatgctcaatcaacagtagctattgccaggcacagtggctcacacctgtaatcccagcacagtagctataaaacaacaacaacaaaaaacaaaaaacagtagctattagtaatgaagttttgataattggccaatctgtcaatcagcagggtttgtttgtttttggttctgttttttaagacagcatcttgctgtgtgtgcccaggctcaagtgcagtggtgccatcacagctcgctgcagcctcaaccttccaggttcaacctcccaagtagctgggaccacaggcacacaccaccactcctgactaactttcaaaaatatttttgtggagatggagtctagctgtgtttctcaggctggtcttgaactcctggctcaagtgatcctcttgcctcggcctctcaaaatgctgggttataggcgtgagccactgcacccggcccagtagcaggttttaagctccgtggagacagctggcgtttgaggatgaggtaacagcccacacctgagtgtgaatggctgctgcatggttaacttccatttctttcctccataggtcttccccaggcaacaaagacaaggaggccccctgctccagagagctccagagggacttggctggtgaggaggctttcagggcccccaacacagatgctgcaaggtaactcagtgcaggaagcagacacttcattcccagaacacggagcccacatacacccagctgaaggacttccatggcctccggtgcaatgtcaatggatgcagctggggccaggaaggtcctgttcccactgttcccccagtacctggggtactgcaggtctttaatgaacatctgttgaaagaaagaaagaatgaatgaatgaggcctggagggaggtaggcccctgccatgattcctcagggagccagttagagagcaggaccaaactccagggcaggctatccccagctcctggcctgtgctgagttccttccattcccctgaagcttccacactcactgtgcttttactgcaggacaaagcagccctgccaatggccagggcaaagcaaggccaccaagctggcagtctgggagagtcagtgaccaaagtatgtgggcccccatagagcatgtagcggagactttcaggatgacccgtggactaagggagacattgtggcaaggggtgaggggtccaggacgggaagttggagccatagcggtggatgatgagtccagatgggatgattgtccccagtcgctgcacagccagcccactgacctgtcctccaagccagaccagtgccaaatgtgtctggtgagcagtggctgcaggctgggcatttcttcagtgagaacctggtagccagttacagctaagaacccacacacccgtcttctcagtgtggatccctggagcccctagctggaaccctgagccctggaaatgaggaaaggaatccctctatggcttattaccagacccacatgtcttgccccttgctctgttggcaatcagctccccccaccaccaacgaactaacctcctcctgactttccaccttgctcccaaccaacccatcaggtttggaaaaaatacagaaatacttcctgttagagtcaacttgggcttggctcagctctggtcagagcagcacagagtagcagccaaaggcctgtgcttctggtcttgaggcccactctcatggcatctgggttagatgagatcaaaacgcaactagagtcagcaaatactccacttctcataacaggtcaagtgcacagttgagtgatggcaatgtgggatccggagccacgggctcccggcctgaaggcttggctgcagtagacatcggctccgagagaggaaggtgagctgcccgggggaggcaggttctctcatgcccctggtgacagaccagggtcaagctgccaggctgcttgggctgctatgggtggggcactggtcacttcctatggctcctgtctactgcttctcccacactcccacattccaccacatcctgtgtccttgggctttccactttttggaatcttgttcatttttctgatccctgccactggccctcaagctcctccagagtaggcactaggcccactcacagctggaggcccagccctcacatggtgctggtcttgggctggtcaaatgaacgtgtagggaatacatgaagggacaaattaatgagtgaatgactgaatgatggaagagtcggcaccttcttacttcttggttaagctctgaggaccagctaggaggccctttgctcctgctttctcccttctctccttttcctgccccatccctaccccaggcagctctgctctgaggttcagggagaggaaaagcggtagccctggagagaccagcgtgtccagctgggctctggcttcttggacctggagggagtcaggggccactttctcaggtgatttgcagagtggcaaggtccctcttgtccctaagtggttccaaaccaagcctgaatcattcttggggcaaaggctaggtatgcagatgttggcataaatagtttagctccaaactatgctagagtccttctggttcagagcagatggctagggaggagtggcaaagccagtgtctgcaaagagctacaaccgcaagatatcatctgcctcctgcatcctactgcagtctggccaaggagggaatcctgtggggaaggccctgctgatgctttcctacttccctcagcacacccagggcccctttccctcactaacttcaatagtttgcaattcatgccatggaaccagagcccgaattctaaatccaggcccacaagtcaacacaggaaggggacagcaggtcctggcctctgaaaccactgtctccgagcaggtccaaggagaggccaccagagactctgttctttaagctgccactaatggggaggactccgctagagccctgtccatgcagcctgcatctttttgccatctgcagaggcattggagggatctttttaaaaataagctagatcacatttctcccctgctaaaaccttctagtggctctccattttccttagaatgaagtccaaaccctttcccatggcccactgggtcctgcatggcagaatctttggccttctatccagtcggggctcctgctactctccccacagtggtgcagcttgactggctctgctgatggctgtcgcggaagagacttctggtctactgtgattgggtggctctggtctcctccatgtcaccccgcctgcttatacaccctcataacatgaagcctgtgctgtccactgtttccttaaaatgaaaccaagcctcaaagttacttgtaaagtcatctgaagaatcttctagattttcatgaattttaacccagtcttttacagttgtcttacctatatagtagtccctaggtatctgtgggggattggttccagaacctcactcatataccaaaatccatgcatgttgaagtccctgatataaaatggtgtagcatttgcatgtaacctatgcacatcctcctgtaccctttaaagcatctctagattattataatacctcatacaatgtaagtggtatgtaaatagttgttatactgtattgtttagggaatgatgacagaaaaaagcctgtacatggtcagtacagatgcagccatcctattttaattatttttcccacatctcatctcatcctctcctctcctctcctctcctttttcagacaggaccttgctctgtcaccagggctggagtgcagtgctgtgatcacagctcacagcagcctcaacctctggggctcaagggatcctcccacatcagcctcccaagtagctgggactacaggcgtggaccaccacgcctggctaacttttgtatttttggtagagacgaggttttaccaggttgcccaggctggtttggaactcctgggctcaagcagtccaccgacctcagcctcccaaagtgctgggattacaggcatgagccactgtacctggtcccaaatattttcaatctgaagttggttgaatccacagatgtggaacccacaacatagagggctgaccacacttagtttgactataattttcaacaaactcctttattgtttttcctttttttttttttttgagacggactcttgctctgtcccccaggctggagtgcactggtgcgatctcggctcactgcaagctccgcctcctgagttcatgccattgtcctgcctcagcctcccaagtagctgggactacaggcgcccgccaccacgcccggctaattttttgtattttttagtagagacggggtttcaccgtgttagccaggatggtctcgatctcctgaactcgtgatccacccgcctcagcctcccaaagtgctgggattacaggcgtgagccatcgcgtcctgccttgtttttccaaaggaaaggttgtttctcatggcaacaaccactctccttttccattcattttcatggatttacttaatcatcgaacttagtgattcttctccattagtggcagctcaaagaactgagttgctgccccaggggcctttccttggatctgctcagagacattggtttcagaggccagggtctgctgtccccttcttgtgcaaatacaactggcataaagaggtctgggaccaaacaagagcacctcttagtgagtgtgctggttagtggagggcacaggcttgtataggcagtgattgttcagcatgccgtgagcatcagtctgcctggtttacagagacacagagaatgtgactccaccctgagaaggttgggtaagacattccccactaaatccatattgagtgggtgaatacaggtggactgggaaggtgcactgcttctataaacagccactgggccctgtggtaacaggaacacattagcacatgttatggcccaggcattattcaaagtacttggcatctatgaactcatttacttttctcagaatacttacgagacagacatgattagcatccctatttcattgatggtaaaactgaggcccagaaaaaaaggtcaggtaacatgcccaatgtcacacagctgggagatagcaaagccatgatttgcaacgccagagggcaaccactatgccacagagccccaggtgtcaggctgccttgagatataaatattgttcctcaagcatccatttgagcagcttcttggtcctcatcatctgtggggggcaggatccactttctcgggagagggtagacatacagacacaaagtcctgaacctggaccaggtctggccttctttcacaggctgtgtgcagctgctagctttgcctctttcctggaagaccaggatgggcacagtgccaactctcagtcctgcaagcctagaccagcagccatcaggtaaggttagggccactgccctagtgccctatcccattgccagacacagcctttggggcccagcctcagctgcagcaccccaggatccccctcgaacttctcagctccatgccactttcacatcaggtgatcacagcaagacagggaactccagggggagctctgaccaggggcagtggaagaagagggatgggtgatatgtctgctcacccagagagcccagcaccaacctacatggacccaagctgaggtggcagagaggagggcatctgaaggcagagcctgggaagagatcctgctaggaggtctcagagaacctctgctgtagggactacagccaggtttagcaagcaggagtcagggagaagattcccaggggcagccagcattagagggctcagttcccaggagcacaggaccggtggctgggatgggcaaaaatggctcctggggcacaaaggtacaatgggaagaagctgtgcattcccatgctgtaagcgtctgccctgtttcacccaccaatccaccagtgggcatggccactttgctgtgggtgtgtggagcatttggcaagtcctagtaaggaacgatctttcttaactcccataaaccctacagaggtgtaggtcaggtaaggatacgtcatgctcagggtcaggttccagccgcagctgagggctaaggggaatgggtggacgtggggcagggagctggaagaacactcgagagatagcaggtaaatgagacatggctttactcagcagcagctctcttacacagctttctcaaactagctttctcattagcagcttactctcacaccgtctgccctgtcttggctgcttagtccggtggcccctacgcacagctgcgtggccagctctcccttgccttcagggtcagcagcttaattctttctctccctgggcacgggcaagccaagctgtgtcctggctcccctctgtcctggctcccctctgtccacctgcaaagacagacagctcttgctctctctctttctctaggttcccgtgcacccgccatgtcaagctatgttgagctgagccaagccccaagagacatgtcccccatacacagcgtcaacagggcagttataccttttacagacaatagtggtttagagccaagtatgaacttacataaacaggttatataagaagtggaggtgtgcacctgtgcaccagactcattgagtcatgcaggcctggatatccccctctgcctattccttgaacaaagcacatccaggtaccttacaggatactagaacccaaaaccaggagacttccccagggaacccaagttggtcaggggcagtgtttgctcttgaactcaggtgctaaggccatgtccaaagctgacatgaggttgtcacacacagtggcatcggtgccacactaatgccaggactgagacaccagcctttactggaagacacagttcctccctttctggtgagaaggcagcctggagggggaagacctgggccccagccttctttggtctgagatctcagcaggcctgtgtttccttcctcagctccagtgccacttcagtctctgctgtccctgctgataggaagagcaacagcacagcagcccaggaggatgcaaaggcagacccaaaggggtaaggcatgagcagacagtgctgaacttctggggtggagagaggcagcttgggctgtgtgtccattggcctttggctgggaaggtgaggccagcaaggtttgtgagctggcctgaggcacatagcaagggcagaagccccaaccagaaccctctggcttctggggccagggagctttccactaaactgttgccttggccaggaaatacatcatagtcagaaagggtctttcagtcagcaaccactctgacagcaactgccttttgctggaggctggagcatgcagacaaatcagaaacacctctgccctccaggaactctcaggcagggggtgggcaaaggctggtccagattagagcaatacatgagcgctagagcaggggaagggggcttcatggggactgtatgtagctggatgtggtcagcgatgagtgtccttgttggggagtgctggaagaggaggctcagtgaactaggtagggcttgattggcctcttgtactgtgatattggagtccactgtgtgcacagccctctactcacagtgtctcatacggttctcctcacagtctctcaaaggtttatgcctaattacaacaaaacccaaaagcctggagcctaggtctctgtgcctcctgggaaggatagtgctccgaagaaaacagccgcagctgagatagagtgatggcagtgaggagggtactacttaggtgggtggaaaaggcaactcaggcgatctcctctaaagaggagaaggagccaactctagaaagaacacggtggagagagctatagataaggaaccacaaaccaactaaccctgaggtgggaacatgcttagcatgttccaaaggacagagtggctggagcttggccagtgaggagggccacagatggagcagggccttggtaagccatggttaagagattggatcttatttcaagttttaagccaaaggggagtctcatgtgatttaggtgtttaaaaggtgaatgcatgtttgcattttcataccacattgctgttgcttttttacttaaaccaagatgctgggggctggggtgggcaatggatatctaaggtatgaggccttattgtgtttcttttctcattcgaattgcactgacaattaacaatcagagtgaaaacaacagctgacaccaatactgtgctgtgctaggtgccttacagccttcccagcaacttgtgagatgggtaaggtgggaaactgaagcatagaaagattaagtgacttagccaaggccttacaagtggcagaactgagttccaagggaagaggctctaagaaaatcctcaggagaaactacgaaaaactagtttatgaaatcttgtctttggagcctagtctcaagacccagaatcagtaacttacagctggttaacatggttaacatgctgtgtgatctcaccttaattttccccaaacgtggaaaaggataaggcttcttattatgcaacttgacagaggagaaaattgagggactcactcctgtaatgaacacacttaggaacagagcccagatccagccaactctagagccaggctcacgctactttcctctgatgtttaaacgtctgcaaaatcagaggtgttttttttttttttttttttttttgagacagagttttgctttgtcgccccagctggggtgcagtggcgcaatctcgactcactgcaacctctgcctcctgggttcaaacgattctcctgcctcagcctcctaagtagctgggattacaggcacatgccaccacgcccagctaatttttatatttttactagggatagggtttcactgtgttggccaggctggtctcaaactcctgacatcaagccatccacccatcttggcctcccaaattgctgggattacaggcgtgagccactgtgcctggccaatacaaactttcttgattacagtgtttcacaactctggctgtacttgagaatcacctaggaagtactgaaatacactgttgatgaaaaaggccatactctgtaaaatatttgaagaaattctgagccaaatgttaggactatgacccgtgacacagcctcaggaggtcctgagagcatgtgcccagggtggttcacttacagcttggttttttatgttctagggagacataagacatcaatcaatacatgtgaggtatacattagttaggtccagaaaggcctaggtatacattagttaggtccagaaaggccggacacctcaaagctgggagtgtggtgggggtgggggtgggggtggggttccaggtcataggtggattcagagattttctgattggcaattggttgaaagagttgttattctctaaagacctggaatcaatagaaaggagtgcctgggttaagataaggggttgtggagaccagagttcttatataggtgaagtctcataagtggccgcccttagaagcaatagatggccaatgtttcttattcagacctttaaaaggtgctagactctcagatcagaaaaagtcctggaaagggaaggagattctctacagaatgtaaatttcccccaggagagacagctttgccaggtcatttcaaaatatgtcaaaaaatatattttggtgtaaaatacttcaatttctttcattacctgctgtctgtcatgtgatgctatactagagtcaggttggaatttggcatattattgcttcaaggagtctgttttgtcagtctgaatatctctctcaatgttaatactggtcagttgggcatgaattccaaagggaggagaatatattgaggcatgtctgaccttcccctttctcatcatgacctgaactagtttttcacgttgtgtccccttggctgagagaagtgtccattcattcagctggggagcttagaattttatttttggtttacaacacaacaaaaacttcccgaagtcccaggtagagatttggattttatttttctggggtgggtctccatcatgtgtctttttcaaagctccccagtttgttctccttccaggctaggtcgagaaccatcgttctcaggtagtggttctgacccaggggcatctcccaaagcttccagcctgctacgatacaatgtctggagccatttttggttgtcaaaactgggagtgggagacactactggcttcttatatgcagagatctgggatgctgccccacatcccccaacacacaccatagaattatggggttcaaaatggtaatagtgctaaggttgacaaaccttgctgtagagccttgacgatctatttgggaagacagcagggacggaaaagaaaaagggatggcacagaaccacacccctcaccttccccgaaatctgggtagcgggcacaggacgtgtgcgcctgcgcgaatgcgcgctcgccaccagcgtacgcgacgcgtgcgcgcctgtgcacctcggcgagcacgcgcccgtagtgagtacgcctgcgtaggccgccatttcttgaagccccgaactcggtcgcagtgcccgccgggaaaatgcgaccgtccacaaagtgaaatggccgcccgggacgagctcggcctcggcggggattctcttgaggccatgcccgtgccggccgccagaggtcgcccgaggatcacgaatgggcccgaggagctggctgccccttcccccgcgtaaggtctgaagccgcggccagagtggctttggggtgaccgcgcgtggaccgtcgccggcgggaggaagcgcggtcccgcgaggggccgaacggggcccctgcggcttgagcttgtttcgcagggagccctggggccatggcctctgggacactggacacgggtcgtcagggctgcccagggggagggggtgtggacgtgcagacagggaaggcagctggaccctccaaccacgctgggccctcgggctgaccggggctggtctgtggggcagtgaggaggggcttcgttccctaggagtttgatgagggagcgccatgggggtggcgtcatcctgacatcccgcagggcagtggagccttactttccctaggttacaacacagttttaactgtcccaaactgtggggactccgccctattccatcttgggccgctccatcacactacagggagaggcggtatagtatagtggttgagagcctggactctggtgctttgggttccagtccaagctctgtcacttacaagcaccgtgaccttgggcatgttactcatcttctctgtgcctcaggttcctcacgtgcggaatagtggtaatcatacctcctaccatatagggttgttgaaatggccaaatcggtttgtatatgtaaagcctgtaggacatttaaacctgcgagctaagtgaagcagcaccagaggaatatctcctcctctcagaggtgttcagggacacctggaaagctaacttaaccagctttattggtttgatttcatttgacatgacacgatatctcatcttcttcctactaaacttttgtcatcaaattttccatctagaacatgctgttttcctcattatgttgcaagcatgggcttctcgtttatattttttctgcatgaggatcaggtgaagtttaggcaccacatttcctcaccactggcaaccgttgttggccagtggaggcagtacaagggtggaagtgtcagctgggtgcagtggctcatacccacctgtaatcctatactttgagaggccgaggcgggaagaccacttgagttccggggattgagatcagcgtgggcaacgtagtgagacctcatctctacaaatattatctatatctatatatgtatatgtatatgtatatcatatatatgatgtatatctcatatatatatgtttttgaaacaatgtttcacttctgtcgccccagactggagtgcaatggggtgatctcggcttactgcaacctctacctcctgggctcaagtgattctcctgccttaacctcccaagtagctgggactacaggcacacaccactgcacctggcttatttttgtagagaggagtttttgccatgttgcgcaggctggtctcaaactcctgacctcaactgatccacccacttctgcctgccaaagtactgaaattacaggcgtgaaccactacgccgggactacaatttccgttttttaaaagaatggaagtgtgtagattatggttgtgttaggagttgacagtggctgtattaggctactggatctttggtccaattacactcagaaggaaaggcttcagagaaattaatccaaaatccaaaatcccgttggtcaccatcccctatgttaccttgcctatctctaaccacttgacttccaggaagttcatgaggagctcggacaggatagctgggaagtaattcccctggatgttacattgtccagcagagcttcctgtgagtgtttgcctaagatttcctttttatgacccacataggtcatatgtcctaaaatcacagtggccctgccacaggcctaggaaagaagaagccttgttcatccatttgtccctgtgtcacaatagagcccaaatttctctttgtggataatcctggctctatccacagacttggtgagggcaacctctactagtgtatttctacagaggacgtgggacaggacgggactctgattaaatccatagtaaagctaactcagggctaccacagtagggagacaagctcttcaggccttgtatgtttgtctttggctcaagcaagcatgtcactgacagagattgaatgggtgtgtcagggcaccctgctggcaaccctgggactggtgttacctgtgcagaccacttttggatctgcatgggctgcagcagaccctaagggtggaagcagcacagagaagcacaggcccagtgggatggttccccacagttactgtgtggcgtcacactcacttgcctgcagttctgcctggtgcagctggaggtggcaattagcttgttgtgcctgctggagaattttagttcccttgacctccacctgaggctgaagaatcatgttgctttcagggcatactttccaaaaagtgtggcctctgttggccttgttattccagcttgaaggcaggaagcctgcctagacaaagttaactcctatatacaaagagtcccagggtagtttgtagcgtgttcttgtctcggggtagcccccaccagctattgaaggtaggctggtgatgttgggaaggttatattcagagtgagctaggatcgaggtgatggcgaagtagattttcattctgaaatgctgggctcactctcttagtagcccaacttggtgtttgcccctggcctagtagactctggaagcagtaccttgcacctcggtgtggggctggtgatgggaggggtgtggaagtggaggatcagctagcagcctctttcccacggtacccagattggagggtgcagtgcaatcatggggtgaggccagggaggacccctgaagagctcgatgcctgagacatctgggggaagccctgtccttcttgctggattcaggggtggcaaaagccaaaaattggagggccaggtgcaatggcacatgcctgtaatccctgcactttgggaggccaaggcaggaggatcgcttgagaccagcctgggcaacatggtgaaaccttgtctctacagaaaaaaaaaaaaatacaaaaattagctgggcgtggtagtgtagacctgtagtctctgctactcagaaggctgagacaggaggatggcttgagcccaggaggcagaggttgcagtgagccgagatgatgccactgcactccagcctgggcgacagagtgagaccctgcctccaaacaacaacaataaaaacatcggaggcttcggcttcatctattacacatggaggcctgttcagtgagaagggagcagcgatgctgggctcctgccaaggaggagactgtctgctccctggaattggggctgtgcctggctcctttctgccccgctttcagggatatgagtccctccaagtccacaggaggtgacagccagcttgcgtcctggggctgaggcagggttagtttcagagcacttttttcataagggtgcttattcttcttcagggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcaggtaagggctgagctgcagtgggctctgcctctggagcccatgtttttgttgaggtctgcgacccacatgggaaccacttccccacaccctgtgccaatacccgacacattgcacacccaggctcctgttctgtgagtgggtcatggtgattccctggtcctagagcagtgtcatcaggcttcttgtggctcaaggagctgggaggggactgtgataggaggatgtgtctgtccccaggtgtgagaagccctggctaattcccaatgcatggggcaggaaggaaggctgtctctcagagtacaggtgctctacaggtgggggtcctgggcagagtgagggctatttgtgtgggtaaaatgccattgtcagagaaggacagagtgtgaaagagcaaaaaaacaggagggtaaaagtgcaaaagtgacagagtgaagcagagagagagaggccagagggagagaaagggagcatgtgtgagcaggcatgagagagtgacacaggatgtgactggccatgtgttggtgtgtgccactgtgcatgagcaagaggacaaacgtgcctgttactggagctgaccatgtggcattggtgtgagagtttcaagtcaggctctcttgaaggcatcttgcctgccagcgcaaacactgcatgtccttgcagctctggacacgtcaacaggccagtgattccaggggtgcaaagcgaacagtttcttacacaagacagaaatgtagaaggagagagctaagactcatattgccccgagagaggagctagtggaatccagcagggcatctgctgtggggagcaggtggagcctggggttccttttgcagggatgaaagaaacacagtcatctgccttctttgttctggggcttcttgtaccacagaggttccataattattaatagttaggttatttttagggcctagctcaactgttagataacaagttttaccttctaagaatatctagcccatctttgattccttggctccaggccctggagggtcccagtccaaaaacagagtgaacaactttggacttgctgtcacattgtgtggcttctagaactagtcagtgttccatgcagaaggggtataaaaagtgaggcttgtggatgaaggaggaggcgagtggttctgggttttgttttcgttttgcgggggagtgtcaggaaaggctttctttacagggagagtgatgttggagctgggtttggaaggctgagggagattttgccagatgtgccagacgtgcttgggaaggcattccgagtggaggctcacaaagtgtatagggaacatccagtcaggtagccatcacaaaggagggttaatccagcctggcttggcaggaagcaccaagtaggggctgggcaggcacctgctcctaggctgaggagtgtgacccacatcctgagggccttgggagccaccgatggttttcctgcaggagagtgccacagccagactcgagtccaaagaagatccctccattgccctgtggaggaccaggccaggggagtatacgacgagacaaggcaggaggccatattggagactgtttgcttacaccaggggcaaggtgatgaggctgcaagtatttttgaattattaaaggtaaaagcgggcttggcgtggtggctcacacctgtcatcccagcactttgggaggccgaggtggcagtatcgcttgagcccaggagtttgagactagcctggggaacacagcaagaccccatttctacaaaaaatttaaaaacattagccaggtgtggtggcacatgcctgtagtaccagctacttgggaggctgaggtgggaggattgtttgagccttgcacgtcgaggatacagggagccatgttcctgccactgtactccagcctgggtaacaaaacaagatcctgtctccaaaataaaaataaaaaaaataaagataacggtgagggaaaagtggtagccaaggttgctccccagatttcagggctaggcaattggatgggtggtgacaggaactagctgagggtaaggagtttgggggcaggcccgctgagagatgcacagagatgagaaggtcactgggccatgccgaatgagaagtgcctgtaggggctccagccagtgatgtccagtaggctactgagtaaacaaatgtggagttgagcaaagatctgacctggggctagagagctgggagttgtcagctcataggaagtcactaaagagaatgcatgaggttgcctggagaatgcctttggaaggcagtgtgtacaaagcatgtattctcggcttttctctgcagacttccagggacagttgtccagccaggcccttggctgggtgggtgagtccacgtggttcagggatgctgagggaagctgcttcatcagctgacatttctctccattttctgctcttcttttgtctcaaaaagaaaaaaagaggggatattaattattgatcccctaaaaccctagctgaatatataaaatgaaaagaagtaaaaatatgagagaagcaaaggcagatggaccataattttggaaaataattccaaaaggtcttaaggaggaagaggagctacagagaggtattgagaaggaaaattttggataaatggaagaatcaggaaagactaccgtcatggaaaccaagccacgctgagctaactttccagtgctctgtagatgctgaaataggcccatcagatttggctatgtagaactcatgactgccttgaggggagtaggttggggcagtgggaaaggctgtagttggattataatggattgaggagggagcggaggataagcaggtgcagttgatggggtacacactctgaaactggctgtgacgtgatggatgtgggaggggtgagcagataattacagctacaagataatggggaaggtttcctataggtgaaagcaacgtgtgcatgttaggtaaaggctgggcagagggtgcctacgtgaccagtccccgataaaatccttggactctgagtctctcatgaattgccctggtcgacagcatttcacacttgttgtcacaactcactgctgaggggaactgagtgaatcctgtgtgacccactgggagaggactctggaagcttgtgcccgggttccctcagaaatttgccttgtgtgcttttccctttgctgattttgcttcgtatcttttcactataataaaccatagccttgagtgtgatgatgtgatgtgtcctgtgagttcttcttgtgaatcaccaagcctagggatggtcttggggacccctgacacagatgggcaggatcagaactttatgccataacaaggactttagattttctttcgagggcaaagaggagccaggaaggtttgaagcaggggagtgatatggcgagagtattgctttgcaatgggatctccagtggcagtgagaagagtgactgaagtgggcagagtggagcagggagaagaggaagtgcttacagcatcctccatgtaagaaatgatggggcctggactaggggactagctgtggagatggagacagaactgtaaaataagtagaagagatcccaaattggatgacaggtaagacttgggagagcagtgacggagagggaagtgacaatttagaaagccacatttctggtcgagtgagtggagtatgtgacccctcctggcttaggtggtggccaaagtatctctaacctgcctctatactgcctgcaactgactgagcaaatgcctggtccgtggagatcccaagctgacaagggcacctgaggcaagcctctggctttcaggtggaggccctacctaggctggcctggctggattgccctggcacactgctgttttgctgaggcagacagcagcactctgcaagtgctcttctcctgttcctcttagtggtctaaatcctgtagcatgctggggtgcgactgtagacaaatcccctttccgggccccctggggttctctatttgcagtctttgggtctggtcactggcatggcatctcagtaggctaggttcatcaggaagggtcaactatgtcatggcacctgatgggcagcatttagagtctgtgggccaggggcttaagggctgcttactgctaatagttctaagtagcaagcattccctcagccctagtctgggcacacgccaggaagaaagccactagatgtgctctcctagtggataactagcctggagttccaagaagggcagagacaggcagagtgagagccttcagagatgtaggcaacgatagtagcagaacttcgagggagagtagatggaaaaattaaaaaaaatccttgtcattatttttaaatgtctgaattgaccagattagaatctttgagagtctagacactagggagatctcatgggtgggccagttattatatcatatggagggagagtacgtatgacccagcacgagaggaccagaggacagtcagtgctaagggtaaaaccttaggccatgggagattgagtttttcatcagttggcaagttttcactttaatactccactgtttccatcatttcagacgactggggatgataaggacaatgtaatttgggggataaaggaagaactcattatatttcttggatgactttactggggaaatggattccttagtcatttgaaagaagcggtagaattccacatgtggggaatacttgttctaacaaaagcttaataacattagtggcaatgatccttttatataagggaaagcttcaagccagtgagaaaaacataaataaactagtaagaacatatttataaccatgagatttgggtgcagaataaaatcaaattggcagttcaggaaaggtcctaaacatctgtatattaacaatattccatcagtgagcaatgtgaatttcccataattgaaatgatgattgataaccttgtattgttcttatctaatataaggcaaagcagcactggggctttgataaagagcaatatctcatgtacactgaggacactgaaaccccgctaggaattctatggaatttctaaaatatttatattaaggacattttacccattatagactaatttagggaaggttctgcattttttttttgatttgacaatgtttccaatgcaatttatacaatattaaataagactaattagtttttgcacctttcttgttacaaggtgaaagaactaatcctttgagattttccagaaggtccctggcaaatcccaaagccagttttaggtataaaatatatttaagttttgattgtgggaaggcaaatgttaagagttgtcaggagttctcgaacatttgattgaatagcattatgggttagcgagaaatactacttggttagctagtgaatcagagttgtaaaaattttcaagtaaacatatgaggtaacatggttgtaaagaatcttcagttcctttaaaattgaaaagactttaaaaaaataactaaggacataataaactgaacatacagatagggcattacagtattttgataagacataaaatctttgcctcttaggcagatgactcagaagaaaaacagaccatttataactttttattagggacagaccaatgatcaagaattttttttttttttttttgagatggagtcttgctctgttgcccaggctggagtgcagtcgcgcgatcaccatgttggccaggctggtctcgaactcctgacctcaggtgaactgcccacctcagcctcccaaagtgctgggattacaggcgtgagccactgcacctagcctaagaaaattttgttattttaacagagaaaccaacattttaattttatacaagtataatatttgatattagttcttttttgaaaatcttataaatacactgaataaaagttttaaccatgacaaataaaattccttttctgtgaacattttctaattttaaagatatttgtttacattttgtctcacacatttttaaattatttgtcattttaatttgggacaaagctattctctttttccttaggaaaagcatatttgcatacaaagttgtttccctttgccatttttgccattattacttttagcagtttatatatatatatacacacacacttatttacttattataattttaaccattaataacttctctttcacagagaaaacaggaggtaggtaattttgaaatatcatataccagcattttgtagcagactagtaaagcttatgaatatacatctcataactttttatagttgttatatactttttatagtaccattttgcaatgtggacaaatgaacacatttaacagatccatatgtagtcacactgtaccataaaaaaagcaaaaagtatataaacttaaatttaggtctagtgactaagtattttatcttctttataaatgatatttaatgaatttagttaacttaattcagcataagtctaaggttttaagttaccaaaaagattttagaaactgcctttaagcttacatattataaaacataattactgttgaaataaagtttgccagaataatgactcagtttggttaaaagcaaatttaaatttttataatcttaaacatgtagtagatataatactagcttattcaacatgtaaacctgtttaagtttaggaggaacatacccaagtagagtaaaaatatatgcttgtattctgttgtattatatgtaatgctgataactcaaagacacataggtgtctattaaactaacaatattaaactagttttgtttgccaaaagtttacataaattctgtgaacttgagttttaaaagcatttgggttagtttttataagaatacttttttgttgtttacactgaaagtattagaagttgtttccttaatttatgagagctttataataatttatataagtacttatttatctctaagtcaattagaatagaggataagggattttgtaaattaatttggtaatgccatctggaggtactgaactattacacatatacaacatacatgtatactaaacatacagacagacacaaatagagatctaatggcgagccctcaatgggtgcagggggcctgaagctctactggctataggcagttgagagggctgagtgggaaggggaaagcctggtgaagagtagataggggtatgtaggaggtagaggcattgaaggggacagatgaaaagattcagggagctgaagggaaggtccaaggtggtgaaaagaagggaagagggatgcggtaggaagatgagaagggggaatcttagatgagcaggtttggggagaccccaggttccctaataaggtcactgaagttccaaattacccttcgtgattactttttttttttttttttgccagttttggaaatactggacagaatgagtgccataggggcagggcatgtagtcagcaagggaggaggaggaggatgaggaggaggaagggcacccagtagattgagagttacctgtgggaagaggcagatcaaatagagaaaggagccaggctggacagtctcattaggaagttctgcacacagtcgtcatctgggagccaaagtttctcttcagtcctcattgaggagctgaagggctttccttgtgcaatctctagacaaggtgtcaagggaaacaatgaggcctcacaaaagagccaggaatttggagtaaatctccactcaaaaggaaccaagaaaacttctatccaggacgattctggctaaaattgaaaaggaccaggaagagtcctgctcaacagagtcaggggttaaatccccactcaaaaagagctaggaagagttctgtctgcgaagattcttgctcaaacagaaaagaactgggaagagctcatttaacagaatcaaagtaactgaatcacagaaccataaaaagtgtccaataaaagcaaataccgtctctgggcagggtgcaatggctcacacctgtaatcccagcacttgagaagctgagggaggaagatcacttgagcccaagggttcgagaccagcctgggtaacatagcgagactcctatatctataaaaattttaaaaattagccaggcatggtggtgtgtgcctatagtcccagctacctgggaggctgaagtagtggaggattgcttgagcccaggagttgaggctgcagtgaactattattgcaccactgcactccagcttgggtgacagagcgagaccctgtctcaaaaacaaaaaacaaatatggatttagatagagacttttattttattttattttattatttttgagacagagcctttctctgtcacccaggctggagtgtaggtgccatctcagctcactgcaaccaccacctcccgggtttaagcaattctcccgcctcagccttctgagtagctggaattacaggcgtgcgccaccatgcccagctaatttttcaatttttaatagagatggggtttcgccatgctggccaggctggtcttgaactcctgaccccaagtgattcacccgccttggcctctcaaagtgctgggattacaggtgtgagccaccgtgcccgaccaatactttatttaaaaagactattgcaatagggacaatgctgcaacctcaggacttgcaaacatcacaaaataatacaaaaaacatcacaaaataataaaaaaaaaaaagcctttttttttcagtagggagtagtaagcacagctagcagctcagctactttcaagggccagtgggcaagcaaaggggaacctgtttggcatgatttgaccagaaatgtgtttccctgtggtcagccggttctcaggagaagctgctaagtggggcatgttctgcattgcagcacttacttaaccaggagcaagcaaaattcaggccctgtggggaggacagaagcctgcctaacattctgtcaaggcaaaggagagggtaaaaagcagacagctgtgaacacttgatcatccttcaggcaataatccattctgggtttctggcttaagactcttgagaaacaaggggaaacaactggtaggagcagcaggctcacctatatgtagttccgtgaggtagccttatggacttctgccaccttccaaaactcagcatgtcccaaaccatctttatcaacacagcttctcaccaaaaacaaccaaataaaacaaattaactaatgtactaattctgtatctccccctgtgttgttcatctcaaaaaactgttatcacctcattgactcagactctcaaccagcgaggtagaagaaatgtttgggggcatgttaaatgtaacacctatgagacatgtaagaggtgaggtgcaggacgcaggtacatggtgataaaagaaaaacctcagccggattaaatttaaaggagtttcattgagcaatgaactatttgtgaatcgggcagcccccagaatcacagcagattcacagagactccagtgcagctacatggtggaagatttatagattaaaaaaaaggtggagggggggaaatgacgtacagaaattggaagtgaggtacagaacggctggattggttacaggttgggggtatgccttatttgaacacagtttgaacactcaccagtgtatgaatggttgaagtatggccgctgggattggccaagagttagctattgttacaggtacacactcctaagttaggttttcaattttgtctgcctctaggttacagtttattgacaaagactcaaatatagaactatggagtccttctcaggccgtatttaatttgctttaacaattccccctttttggtcattttctcaactttgagagattgacaaaaaccttagttattgatatcactattacccttgtaaatgtacttatatggtcttgaaacccactgggaaacaggaggacagtgggttttgtaaggagagaataaggactgagtagaaggtacctctttatgctagaatgttctgtttacaggacaaaaacaaaacctggtctgttttaataactatttgtttccttaaagtcttagtttgattatgttacatttagcatgagcaactccattttgtttggtttggtctgttgggtcctagtgcatgagctcagtacacaacaatggcttgccagaattttgtttaaaaaattccccttggctgggcgtggtggctcatgcctgtaatcccagcacttagggaggctgaggcgggcagatcacgagctcaggagatcgagaccatcatggccaacatggtgaaaccctgtctctactaaaaatacaaaaattagccgggcgcggtggcatgcgcctgtaatcccagctactcgggaggctgaggcaagagaatcacttgaacctggcagtcagaggttgcagtgagccaagatcacgccactgcactccagcctggtgacagagcgagactccacctaaaaaaaaaaaaaaaaaatatttccccttattggccaggttctcacttaggtgagagtgtgaccaaaacttagggccttagcaccacttttagttacctagttaccatcattttaggtttccagtctcagcatgtcattcataggttatgatgtcctcataatcatacatttcaatcagttttgttattccagttgaagagagaccatttgacatttcagagatggctgcatgcaaacatttgaaacctttgagagaatacagtgcactggggagactactatgactaccagtaggataatacccagagtttgaagtatgctgtttacctgaggtccccataaaacaaactgcctaaattaaataaaataaagaatgagctagacgaagagtctactcacttcactaagtgatcttttcattaatcctgtatgactgaatttttataatctgcacttgatatacatattagaattttagaaaccccatataattttggaatatatattaatataattcactaaaaatataccctgaagattaaacattatttttattggccaagcgcggtggcttacacctgtaatcccagcactctcggaggccgaggcaggcggataacctgaggtcaggagttcaagagcagcctggccaacatggtgaaaccctgtctccactaaaaatagaaaaattagccaggcatggtggcatgcacctgtaatcccagctactcgggaggctaagactggagaatcgcctgaacccaggaggtggaggttgcagtgagcagagatcatgccattgcactccagcctgggcaacgagggcaaaactcagtctcaaaacaaaacaaaacagtatttttattttgacaatgcctcccatgatttttataccaaataagccaaatgtcactgttgcattagtgcattatcgatgtcaaacccaattcttaaataaaaccttatagacaaatgtattcaatcttaatcagtttgaacataaggtaagaattttataaaccttttataaccctttacaatttttgttgaagagcagattagtgctctaagaaaacctgttgtgcttttatgtccatgttcaatttatggaaaaacctaataatacccttttaaatttagtattatcatacataaaattttttacaaggttaattttttttttttttttgagacggagtcttgttctgtcgcctaggctgacagtggcatgatctcggctcactgcaacctctgtctccccagttcaagcagttctcctgcctcagcctctggagcagctgggactacaggcgtgtgccaccatgtctggctatttttttttttttgtatgttagtagagagggggtttcatcatgttggccaggctggtctcgaactcccaggtgctcaaaggaaaatttaagacagtccatggaggagaaaggtatagacaaggtcatgcagatattaaaccagaaaggacttatttcctaagccaggaatcgaacccagactgccactgtgaaagggcaaaaccttaactactgagcccagaaggagtctagagtagttaattttgagcttgcaaaggcttttaactagtcaagataatttttagaactaactatgatatgaaccctaaaattcctgttccctggaaggtagagacaaggagaaagtactgccacatggttacaaggtcaagctcccaaggacataaaacaggatggcgaccttgtccagttttttgttggtttcagggacctgcagcaaagtttgtcactgaccagcttgctgggccatcttgagcagcaagcttatgggggcccaagcccatgttttatcctaaggtacccctcgacacagaaaaacgactttatagcacaaaatataccagattgactacagcttaagactagacagcctcagaattcctttttgcattaattaaaattttacagaggagataaacagtgattttacaatcagtttgcacagagagagagaagcctgaaatctgactgggaagagatatttacccttttgctggcatgccaggcttctgggctccctttccctgagtggccctggtgatctggctctctgcaccattgccccgggagccaagccacaacacaaaagaatttttttttaaaatgcacttcagtgtgttgttgttcatttggaatgttccactgtaagttatctttcgtaagatgtcaccatttctgtaagaatttgctgcctcccgggcgtaatgtgtaacccagaaggaactcagttttccagaagcaattaataggttccatggaatgttgatggtaagaaaggaaggaaaaggtgacaagagtgagcgtagacagctctttctaaggagtttggctgctggaaggggaagagaagcagctggggttaggtgggaggaactaagtttagagacgctaaaagtgtatgtagcaggagtcacctgatcaggttgaactgcagcaggaacaaggaagttccattttgactactattagttgcaaattggacccttatgtcaactttttcatctgtaaaaaaaaagggatggccaggcacggtggctcacgcctgtaatcccagcagtttgagaggccgaggcgggcggattgcctgagttcaggagttcacaaccagcctggccaacaaggtgaagccccgtctctactaaaatacaaagaattagccacgcgtggcagcgggcgcctgtagtcccagaatctctggaacccgggaggcggaggttgcagtgagtcgagatcacaccactgcactccagcctgggcgacagaccgaaactccgtctcaaaaaaaaaaaaaggggggcaggggatgaaaatgctattgctttccaggaatagctatgactacttccaataaagaagacaagaaggttccacatgtgaaaactacgcggtcacaacgataagtgggcgggtgcacgcacgcgcgctgagatcgtgcgtgcacaggccggggtgcggccggcgtgagtacgcctgcgcgtgccgccatttcctgcagccgcagactctgcctgcggtgctcgccgggaaatgagacgatcaacaaagaaaatggttgttttgggcgagatcgaccgtggagaggctttttctgcagcagtcccggttcctgccgccagatggcgctcgaggatcacaaatgggtctagggttctcataatggccccgcctaagaaattttggattctcctggcccttcccccctttgtggggtcaacagcggatttgggaatctggtgaccaacacgtgcgcactcccctacccttgcccctaccgagccctccagggtagcttgggggagaagctcctccctagactgccgggtatttgatgagcctggccagcgcacaggtcttgagcaccatggtcagggaagaaggctgaatggcttaggtcttcctagagaggccggaggcgggaaagaactggagaaaggagagatggcagtgggaggatggggacaagaataccagtgtgtttccagccagaagacgatgtcttttaacacctcattgaagtcgtcaggtgactttgcccttgtcagaaaggagcagcactgcgggggtcctactgaggaggagactgactgctccttggggtggggattgtgcctccttcctgtctgccccactcttggggagatgagtccctccaagtccacgagacatgacagccagcctacctgccatgggagaacaaagtctagtctcagggcactcacttcataagggtcttattcttcctcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctga

SEQ ID NO: 3989 - DNA, 59018 bp, human
tgaatcaagtgagaggagagctgcggagcaatcaccatgagtatctcagctcttggaggccgcaccaaaggtgaggcctgggctccctggtttcccaggctctgtttggggctgtttgcttccaagcctgcccctacaggccacaagcactgtcccagcagcaaagggagagcagcatactgggagaactggaaaggaggtcgagggtcctggggctgcattcctcttctgaggcggttggcttttcccaccacagggaagcctctgccaccaggcgaggaggagcgcaataacgttctcaagcagatgaaagtgcgaaccacgctgaagggggacaagagctggattaccaagcaggatgaatcggagggtcgcaccatgtaaggcaaggaggcggggagggaccgcagcaacgtgggggcgcgcaatccgtgggggaccgaccatacctggggatgcgaaggggcttccaccattcagagctccgccaggccatgtggagggcagagcgtgggaaaggctatccagcaatgtcacagggtgggagagcccctgggtgcctgggaaggagaatgtgtggcagaaatggcaggacttgctgggcagcctctaggatggaggccacaggatggcaggtgacagggagtctcggagccaatccttcaggatgcctctttcccccagagagctgccctcaggccggagtcgcgccacatccttttcatcagctggggaggttccgaagcctaggtaagaggtggtgctcaggtggctggtgggtcagccccagggactctcctgcagcttggggccagccctcaacagggaggggtgggcagtccacaggggacagggatgcagccccagccaagggtctgcaatgagtaatttgaaatctgcaggaaggaggggcttctccactgcaccttccttttgggaaggggagtgtaggagtcacttggtccaggcccttggcctggctgtgtggctgtggggcagctgacttccctgctgggcctccgtggctccagctgttaactgggattgaaattgtctttaagaagaagacgacctcccacccattccctgcagggagtgatactgcctctgagatgctttgggcagcttccagagtcacagtgactcactcctgcaggtcaccctgactgcttgagtgtacttgggactcagcatgcctgtagagaggcacgagtttgctctgactgtctcccaagtttaccgtgacatattttgtcagctgaccaaggagaactggcttctctctcttttgggggcttttccataacagtgtctaggggggctctgaagcgtgggcacaccctgctggcctctggaggaactgctcctgacagagaaagggaactgaaattcaggctcgctccttgctccaaacagccggcaggcggcttctcagggggtggtagaggcagtggcggcctctggaagggagggcctcaagtttacagccagcacacagggctacctttagtaactacggtctctctgtcacccctcgatgactcagcgcccactacctgccaggtcccatgctgggcacagaggatgcaggagtggtcaagacaaaggccctgtctttgggcaactgacgtcccagcaggggactcaggcaggaccctagtaaacagttcaatacaaaagcgagaacccccaagtgtgcctgcaacatggccacctctgggaggctgtcccctgttagagatggagattgtggggttggagactaccggaggctctgtgttgcccttgacccaaaccccgatgctccagcccacatcccctccactgcaggacagaagggtctaccctgaccccttgactcctcccctaactctgaggaggactctttgcaggggcccctaactcctgcccggaggccagaacttccaggctgaccacccctggctgtcagctccctgcccgctcgtcttggctgccccctgagttatctgagccccctcagttgctgccaagcaggaggtcccaagcacccagagcctaatgtttcccagccgctgaacaaggcctggccgcgccctctcgtctcaaacttccaccaagacttggggtgtgggcatgcaaggagctggagcaaagagggccccgagggacaggaagggggacagctggcttcggctggctgctgcctgggctctccccttcaagccctcatgcaccttcctggtggaggctgttgagggagatcaggtcagaccccgggctgaggggaagcctctggctctgactggggagcctccagcttgcactggttcagccccaagcacagaggatgggagggctgtcagctgagagcagtgctccgtcggcgcagcactgggaactggctggccaaggagaagctggactttggagaggccatcaagctgccttcctaggcacctgccatgaggagtcacctggggcacttttcctgggggagcatgagggaaataggcagagcatagcgggcacctgatcaggggcacagggggctggcacccctcgtttctgctgtactgggacacctggagcacttgccagccaatcttatttgctatcgttaagggcaggataaagtaggatgacctcagccctccagcaagcctcgcttcactccaccccttcttctcttcggcaggcctccgagcacaagggctcccactggctacatcatccggtaagtgaccgcaggactctgccggccttcctgtgcccactcacgccaagccctgacttcttacccctccagtccctccagggagctcaccggcatctcctgggctctctttcaggggagtgttcaccaagcccatagacagctcttcccagccccagcagcagttccccaaggccaacgggactccaaaaaggtatgtccatggggtgttggccagtcggccagtggggaggtgtgagggcctggtctgggctcctggcagagacagtgctctgcctatcaggactgtggggccttggaggtgccagctttcatcctgggtagggcaggaccctggagagcagggtggggtgaccagaggagatgggctggggtgggactggcagtcccaagtggatgtgtgggtctctgggaggtcctgggccactaacagtgtccttgtcctggggtcagtcctgactaggcctggctaatgggacagagaggtgcaggagtttgggaggggctgggtgtagagtccccctagcctggcagtgggcacccttgacttgacttgctgatggcattgagaaggctgaagttgcatgcaattcaagcaccttggcatcaggcattgcctgggactccgtcagactggaaaggccaaggggacccggaaacaggaagcaaagacacaggcaagagcccgctgggctgttccctgaagctcggtggggtttgcctacacagctgctctgagtggcgcagttccgggtgtctgtcagggccaaaagcaaagaggaaaggctcccaggcagctcctggtccacctctcatgtgtccactgggctgtgtggccaaatctggaggcaggagggagcctgcaggtagacacatggaaccttctcctctctagtgctgccagtctggtgagaacagctaacgctggtcctccccgcccctcctcctctggctacaagatgaccactgaggattacaagaagctgtgagtatgcaacgccaggctcagcgtggttccctcctccaaggaacaagtccaaactctgggtccactgaaggcagctgactacttgccaccgagcacagcccgggaagtcccgcctgcctgacactccctgccagttgcagctgtggcctggagcccaccagagggtaacaagccccagaaaactggatggctgtgcacattgcacgtctgatccgaggcagagcggagaccgcaggaagcttgtaggaggggccccacggatctggggaaagggtcatgggtcgtgaggctgctgctggctggctgtgcttcctgggcttggccctgcacccggccgagcctcaggtgctctgcctggctgcactgggctgggggcctggggatcctcagggtgctgctgtcagtctgagcattgtgtgcctaaatctgagctgcttcttggatagaaaccttcgggttttcccttagtgctccccttggggtccctttcaaagccccccaccccccactgcatgctcagggaggagggttctctggacagaggtgtgaattgtgtctctagttcccaggggaccacatctttccgttgtttgtcccttgcctccatcatccagggttggggagctgctgggtaacctttctggggaaggggagaggctcgaacagggagggaggggagagctggtctcagggaggaacaagtggcatgacctaaggcccaaaggcagagatattgacttgcctcgtcattgttgttgaaagccaggaagccaagctgctgagggtggcagcctatgacaggaaagcgcctctcccctctcttagggcaccctacaatatcaggcgcagctctacatcaggggacaccgaggaggaggaggaggaggaggtggtgccattctcctcagatgaacagaaacggaggtaatggaatggtgccttttgggcatcccggggggcagggcaggagcctgagtcttcgaagactgctggaatgaattgtactggttggggtgacaaaatgcacaacacgtaggccatcagcggtagcccacggagcatgagaataggtgtcattctctgagtgccagaaccacccactcagtgttggaccagctgaggggcccttgagaaccttctgtggggtagaacctaggtaatgtgggtccggggaaaagcctcctcatgtggaggctcttcagggctctaaatcggtttgttagaaagggccctgagacagttgaacaaaaatattcagggagaagccacctgcacagtgccctctatctgcatgatctgcatgccttgggggttctgaatgccccggaccccaaactgagctccaggcatgcacagcagtgggagtgtgccccatgctgctgaaattctaccctagtctctgcgccaagctgccctcgtccacacaggccagcaaagttccatggacccttgcccctcctcagtcctctgtccatggggactgaccacataccacccagtgctggtgaactatgacaggaagggtttgttaagcaccttttgtatgcctttggcttggggcctgtacagcagttgggccctgaggaaataaagccctcccctccctgggctcagccagccaccaggtccatatctgctgacccatctgtggcgcaggaatcacagcaaagccccattgccaaaggccctggcagattggctatcctcagggaacagttcacagtggcaggggcccccaggcctgggtggagcaaggaaaagagccagaagctaggagctgcctagcattgaatgccagctctgccacctgctaggtgagtgctcttgggcaaataatgaaagcttcttggactcagtttcctcatctgtaaatcacagaggatactagcgtctactttcctggattgagaagagcaataagccaatgcgaggatgttggcatctggcgcagagccgggcacatgccacatgctccataaacatgggctgcccttccttcaggttctacatttcctttgaatagtccttggagcaggtgcaaatctggtttctctcaccccttgcctccctggggtggccctaagtcaccccgagtccatcccaggctaggctggcagagcatgtccagcttggcacccatcagatgctcccccatcccgtgtcaccccaggtcagaggctgcaagcggtgttctgaggaggacagctccccgggagcactcctacgtcctgtcagcggccaagaagagcactgggtgagttgccaccaactggctccaggctctaggacagctctcctctcctcagagctccagccttctctggctgatgaaagggtgggtggagagatcacccccaagggccttcctagctgagccttctcagattctcagatgtactttctagaaaatggagaggtctggcggctaccaccagggacagtgaagtgccgggaatggagagggcccaggaccctctgaggtagagcggtcttgatgtcacctgcccacgggctctgcccaaagcattgcctttctgcttcctttccagcagtcctacccaggagacacaggcaccgtttatcgcgaagaggtaagtgtcatcaagggacaccttggaggcctgttactggccacaggaaggccttccgtcagcaggggtgtagtgtgggagctgtggagaggggatgtggatgtgggggactactgtccctgagcagggggagttgtgaggggctgggggcttctgtctggaggcctggcaagcacctgggtggctgtggtagcatatgtggtcaagctcttccatttgccaatggctaatggggctgggcccctgacccaacgtggagcatttccaaggccctctgggagttgttcccctgcccctgttgcttgcctgatgccttgccttctgctctcatccaggatcaaaacctgggccatcaggagaacttcccctgggaggtgactgtgacattggagatgggccctaaagggtgaacagggcttaacagggaatgatcagaacgtcgggatactccagctgaatgagggaggggtgtcaccattagttgagacagggcaccttctggaggaggaaaatattcgggggaaagcaagaaagaaacttctggaaacttgaatttgagggacttccagttgagtggacagggaaggcctctctctgtgctgaggtggctagctggggactgcaaacccaagagaagacagcatgccaactgccccaggcagagggccccagtgcacaggcccggggtgggactagcttgctgtgttggaagaccaggaagttggcaggaatacagagagcagggatggtggcagcacaaaggaagtgacagagaacggggggcggtgggggggtcttcctggctgcatttggttcctgtggtttctgtaacgcagtaccaaaaactgagtggcttaaaacatcagaaagggattctctcccggttctggagaccagaagtctagatcaaggtgttagcagggtgggttccttctggaggctttgagggagaaaccatcccaggccactctcctggcttctgctggtggttggtgatccttggtgttcctcggcttgtacctgcatcactccagtctgtgcgtctgtcttcacatggccttctcttctctgtgtgtctgtgtccagatttccctcttcttacaaggacagcggtcattggatttaggacccatcctactccagtatgacctcatcttacctgattacatctgcaaagaccctatttccaaataaggttacagtcacaggttccaggggacatgaattttggggggacactattcaacccagtatgctgtccttatcctgagctggagtcactgaacccccagcctgggccacctcttggccgtgatcctgaagggttgggtcagttagacgccactggaagcatgttctttgaggcctccaagctctagggcagccaagaagaccacgagcgctgtttctcttcttgctcaaagggtggaggtggtggaagaggacgggccttctgagaagagccaggacccacctgctctggcaagatccactcctggctcaaacaggtaatccattgcgctcatctctgcctggggctggtggctgccatacctgccactcagtcactgaggaacctcagtcagggcacctccatgctgggcttcgagatcagtgtccccatgtgcccagtgacaagacgggacaaagaaatcagtaagagcccatctggctggatgtcccagggctgaaaggagcaaaacagtccagccccccgggagagagcacctggctctggtctgatgagtacgtatctgtgtcaccttaacccttgcaccactgagcctggtggcaacttgaacaccccaagaaaaagtaccatccttggggtttgagagggccagccaccatggcagtagcatgccattgtcagacttgctccttgcactccaataagttagccacattcagcatgcccagggaggaggctctgacatctccagagcctctcacagccaccttctttgccagtgcggatggaggcaggaccaaagcgtctcgggcaatttggatcgagtgcctgccaagtatgcctagccccgctgggagccaggagctcaggtgggtgccgagagctgactctggcttgtgagtgggtgtgatggcttcccgccagcctggctggctggttctgccagctggggagggtctggcagtggggtgatggggcaaggacaggctgagcactggtgatctcactccaggaagggccgtgatttgtcttgatttctgatccctgagaatctgggcagataatggtgctctcttgtctgtggacaactaataccttcttgtactttgtgcagaatggtgctaagtcctgcagggagagccaccacctgctgttgctgctgtttaaagtgcctgcctggattgagacctttgctcaaatctaggtctcctaagagctgcatctctgtagcacccttggaagacccctgcatccagaaggggagagggcctgtccctaccggtcacttcccaggcccccaagggctgttcaggctctcctaataccatagcaatcccccaatttgagctccacagccatttatagacaggtgaccactgtcctcagggttacttcctcagtctgggagggagacagaaatgctggcagagggagccaggagcatgaggccagctccctccatggccccaggcagcagactgccagggtgcttctccttttcactctctccctctcttgatcttctctggttgtctgactctccccataagaactttggtccatagaagatgtggaaaggaagatttgagaattctttacaaggcaatatctagggcagagctccccagtctttttggcaccagggattggtttcgtgaaagacactttttccacgggacggagcaggggatggtttcaggatgaaactgttccaccttagatcatcaagcaccggattctcataaggagcgcacaatctagatctctcacatgtgcagttcacaatacggttcgcgctctcatgagaatctgctgatctgacaggaggcggagctaaggcagtaatgatctctagcttacctcctactgtgcagcctgattcccagcagaccacagactggtactgatcctcaggctggggttggggacccctgatctaggggacttggcaattgagggatatgggggcaaaggctgccacaacaaagtattgtaccacaccctggggcgcttaaaccacagaaacgtatcatctcccacttctggaggctagaagtgtgagatcaaggtgacggcaaggttggttcctcttgagtctctctccttggctggtagactccatcttctccctgggcccttatatgctcatccctgtctgtgtgtgcctgcgtcctaatcacttctgtttttttgagacagagtctcactccgtcgcccaggctggagtgcagtggcacagtcaccactcactgcagcctcgaccttccaggctcaagagagcctccagccttagcctcctgagtagctggggctacagtcacaggccaccatacccagctagttttttttttttaaatttttgtagagacagggtttcaccatgttgcccaggctggtctggaactctaggactcaaatgatcctcctgccttagcctcccaaagtgctgggattgcaggcatgagccaccgcgcccagaccctaatcacttcttataaggacattggtccaactggattagggcccaccctaacaactgtattttaacttagtcacttctttaaaggccccatctccaaatgcagtaacattctgaggtcatgggggagttaagacctcaacatatgaattttgggtggcacaagtcagcccataacagtatacagttctcatttctccttatttctcttttaaagaaaggcaataaatggtttcaggtgcctttctgtttgttcgtttgtttgttttgtttgtttttgagatggagtctcgctctgtcgcccaggctctgtcgagtacagtggtgtgatctcggctcaccgcagcctccgcctcccgggttcaagcgattcttctgcctcagcctcccgagtagctgggattacaggtgcacgcgaccacgcccggctaatttttgtatttttagtagagacgggtttcaccatattggccaggctggtctcaaactgctgaccttgtgatctgcccacctcaggctcccaaagtgctgggattacaggcgtgagccaccgcgcttggcctcaggtgccttttagaagataatataggaggctgggcatggtggctcatgcccgtaatcccagcactttgggaggccaaggcaggaggatggcttgaagccaggagtttgagaccaacctaggtaacatagcaagaccccatctctacaaaaaaataaaaaataaaaattaaaaattagttgggagcattgatgtacacctgtagtcccagctacttgggaggctgaggtgggaggactgcctgagcccaggagtttgaggctgcaatgagctgtgaccgcacccttacactctagcctgggtgacagagcaagaccctgtctctaaaacaagaaaaaaaagagagaaagaatggaggagaattagattgtgctgtattatagatttaaaaggcactttgacatttattccacaaaattcctttcgatgtttaatccccatcatatggttgtcattgcaaggtggctttttaagtttgctcaggttgccataacaaataaaggctagagattcagggtccggggcaagctcccaacaggaggctcagcttgatgcttctgatagttctttcctccaattctggtcactcaatatttggagctcacccaggcagcttccaggaaagctgctggctgatcctgaccctggagggccgtcttctctgaccctaccacgttaggtgctgcactggaccaagcagccaccatcagtactcccaggcccagctcctatctgcctggtgtctgagaagcccagcccgtgaggaacaatgactcaatcaaactcagggtcctgcagcacttcagaaaaggctggtttgtggcagagtggaagaggagaatgtcacagccttgtccccaggcacagacctatcgaggctaccctctccccaccccctgccctgccctgtttcccttagctacagtgcaaaggtcagctcctcataactcttgccccccttgcaacctgaacccagtttagggaccctctcttggagaaactggttctacacatgcaccccttctcggcccccaggcctggctgctttacccgaagcactggtcaagcttgcctcacctgaccagggcatggcctcctgggtcccggtcctaggctctgcccagcatgctgcctggcagagcgtctggggagcagggagtaggagcacagcttctggcacaggacaaaaccctggctttgcatcagactgactgtgtgaccttgagcaagtctcttcatctctccatgcatcagtttccccgtggataaaatagggagagcagtaatagctacttcccaaggctgtcccaaatgctaaatgagatcgtgcacctgaagtacttaccacagtgcctgggtgctggtatcctcgggggctcccagtcataggcgtgctgagctgcagggcccttattcaaatacaggaagagatcaatatctccacctgctggcatttgagggaaatgtggccaaaggcagtgaaaaggaggtatcccctcgccccacatccccgcctcctcgctctttggcagaatgagtcacacactgtttggcacaggccacagttggtcgcattcccacaggtggctgtgatcagttttgggcttcaggcttcagcagatgcctgcctctcttccttgggtgccttccaagggtgtgcagccttccagcgtggtcctggacttcagcttggactggagctgtctgtggttgagagtctggggagatggtagggtagcgggttgtgggggaggagagacccttgtattagtttactggagctgctgtaacaaggtaccagaaactgagtggcttaaaaccacacgcatttatcctctcacaattctggaggctggaagtctgagatcaaggtgtcggaagggccatgctccctccaaaggctctgggggaaaatctgttccatacctttctcttaccttttgttgcctgcaatccttggtgtttcctggcttgcgcccgcctcactcccatctcggcctctgtcttcgcgcagccgtcttccctctgtgtctgcccacattgccctagtctgacatcagtcactggagcaggctggggtgacactttgttcccatttcctctgtgacagagccagaaacgccagtgagaaaatatgttgtgcttgcctgtgacatccctgttccctggcaccacctgatttaaatgaggcagccaggggttttatactgtcatcataaatgacatcatcctcaacaacgatgtcatcgtcgttatcacgagaggagatggggagaagtcagagctgtctgtgtgtctagggcccctcctggctttcatgatgggagaggccttgtccttggtagcccttccatttccctctggtcactttgagcactccaggccctggccagggtggaagtggagggacagagatgagcagcccgctgacccagccctccatggctcattccttgctttcaccttggccactccatcccctacccctcctgggacccctgagtggcctctttaaagtgccagtctgaacctataaaccccccacctccacttcaagcccatcctgcatcttccctttgccataccagatctagtctgtacattcaggacccctgccagcctctacctcctcctcctcccccgatctcccttcagctggcctgggtcgggctatgcctccatgaagcttgtccactgctcccatggctaaacctgttctgggccctgcagcacagcaaggtcagtttccatgcctctctgcccctgcctgaccctgctgggcccagagcttcaccagggcaggcctggggctcaggcttgtctgcacttccagggcccagggacaaaggcaggagtgactgcaatgtggcttggaattaggctttgctccatggacctaaggaggtctggtttggggtgaagggtccacccccagaaagcctgggagctctatattctctctggccctggccacaccatggccaagcctgctgggcgtcatgccttgcagtacggccagagaatgcatcagacttggagggatgtgtgtccggggtggcctgtggtcatctgggggagggctctgagcgtggctggcaagaggaaagctcaaaggggccctttgtcctcatccccgagtctgcgacatcccctcccactggttttcattccatatttggtctgtgggttttctcagtctctcgtacccctcagtccccaccagtccatgaatgcagaactacccctggcctcacaaatggccactttggataccctggtggggtcacaggctgcggttgcccctgcaaatggttggtagaagcacgggttgggaggtttcatttctacccagaagggcccttgctgtgcctgagggagggctgggctcaggtcaggggtgggagaccggggaaggggcctacaggtcagtggcccgagctcagctgcagcaccaacaaggctcaaggccaaggaggagatgagagcacatcaaaagggggcagtgggtctgggcggcccaccgcactcaccagcccaagaagggggagacttttctcacctgcaacccactgggtctctcctttggcccgcagctcaagaggtgaggaaattgtccgcctgcagatcctgacacccagggcaggactccgcctggtggccccagacgtggaaggcatgaggtatgggggtcctgctgctgtcctggctccctggacaccattctagagatggaagcagcagcctcaggtggcaaatgatgaggcctagggccggctctgccactgtagggccaacaggttgatgggaggcatggtcgacctgggttttctgccccatctcattctttcactcagaaaaccattatggagcaagcgcttagtctgtgtaagggcacaggcccgaccctgggacacagtagtgaacaggaccccctggctggaattgccatctgcctggtgggggaggcagacgccgacatgagcatgaatgaggtcagccagagatgctgtgtgccaggagcccctgggaagtgacagctcaaccctgccaattgctgaagatgggaccagtcagccgtgctggggatgttggtgggggtgggaggaggattgggtctaaggagcccgtgaaggccactgaggccattgccctgcctgtgtgagagggccactgggaatagagtggggtcactgggtcagagtccacagctctccatgccactaggctctgtgctggggaggggtgggtcaaggaggccacaaccagcagggagcacgaggggctcagcctctgccctggggtgggggtcagacagccaggtgacatgcaggcaggattcgggggctggggtggaggctaggagagatccgagcagggagactgggcccctaccttgtgaaggccagggactggggagagaagcgggagtgtacactgaaggtcatcccttaatccctggggtggcaggaacttcgagcagaggcctctcaacagtgtggtgggtgggagtgcttggggagggcttcctggaggaattgacatccaagatgagtcctgagcgatctctaggtccctttaccctcctccttggctcctcccactttaattctgcccccaaggcaccaagtcctgtccactttattttagagatgtttccatccctattgctctgcccctggcccaggcctccactgctactcacccagttgtctgcgaccgtttcctactgtcccatccctggactcccttccacatctacctgggtgatgtttccaaagggcagaagtagttatgccagccccctgcagaaagccctgcaaagcccctcccactatgctctgcagcctgaactcagtacctggccccacctgcaggctcctccctccctgggcctttctctgtgcaggctggaggctctgcctgagatgccctttcccctcttcatctttctgttccacctcaaatgtcctgtcttctgggtcatgtccttctcctgagtttcttccccaggcagcatctgagggcttgtcgattctgcatggcagcatccattctgcatggatgtagatacaatcactatgcccattttacagattaagaaactgagaccctgaatggttaagtaacttgctcaaggtcacatggtccagagcaggcagatccgctcagcctgccctactcccaccttccaccttctgcaccatagctcattgtactagttggggcagggagcagggggacagagaggggtgatggaaagacttggcatttgctgagtgaactcatttgacgagtttattcgtaggcattgaagtcaaaatttccaggagggaggtattttaaggtttgtgattgaggtttgagagagtgattagggctcaagagatttccacgttatatgcagacagaatagagctgaaatcatgagcgtaaactagctttacatggggctcatggtgagccaatggaagctgggcaccgacctcagtatgcaggtggcagccacctggccagccctcctggggacagctgggcgagggcagtctcttctcgccatgttgagagtgggcctcctgagggccagttgggagttagtgggtgtgcaggccagtataaaggagaggcaggaacaagtggagatccctgcttcaagggtggcagttgacaccttgggaggggaggagacagcccagcaagtggtggagcacgccaaagggaggagaaaaaggcggagaccaggaaggtgtgtggccagggaggtaggcaggtggtgttgacaggatcaagggaggaggggtggtgagaaggctggagtggcccactgggtcagcagtactgaatggtggtttgaaataatgatgggactgtctctcctggatttgacaacatggggctccctgaggacctgaaggagaacagaagggggcttaaattaggagattaggatcagggatatagtccagaactcaaatcccagctactcctcttattacctgtgaaatttggggcaaatcacaggggctttgtgtgcctccgtttgctcatctgaaagatgggcatgggtgataacagtgcccatatcctggggttgatttgcagagttaatgcatataaagtcacgagaacaggctcaaatgctcaatcaacagtagctattgccaggcacagtggctcacacctgtaatcccagcacagtagctataaaacaacaacaacaaaaaacaaaaaacagtagctattagtaatgaagttttgataattggccaatctgtcaatcagcagggtttgtttgtttttggttctgttttttaagacagcatcttgctgtgtgtgcccaggctcaagtgcagtggtgccatcacagctcgctgcagcctcaaccttccaggttcaacctcccaagtagctgggaccacaggcacacaccaccactcctgactaactttcaaaaatatttttgtggagatggagtctagctgtgtttctcaggctggtcttgaactcctggctcaagtgatcctcttgcctcggcctctcaaaatgctgggttataggcgtgagccactgcacccggcccagtagcaggttttaagctccgtggagacagctggcgtttgaggatgaggtaacagcccacacctgagtgtgaatggctgctgcatggttaacttccatttctttcctccataggtcttccccaggcaacaaagacaaggaggccccctgctccagagagctccagagggacttggctggtgaggaggctttcagggcccccaacacagatgctgcaaggtaactcagtgcaggaagcagacacttcattcccagaacacggagcccacatacacccagctgaaggacttccatggcctccggtgcaatgtcaatggatgcagctggggccaggaaggtcctgttcccactgttcccccagtacctggggtactgcaggtctttaatgaacatctgttgaaagaaagaaagaatgaatgaatgaggcctggagggaggtaggcccctgccatgattcctcagggagccagttagagagcaggaccaaactccagggcaggctatccccagctcctggcctgtgctgagttccttccattcccctgaagcttccacactcactgtgcttttactgcaggacaaagcagccctgccaatggccagggcaaagcaaggccaccaagctggcagtctgggagagtcagtgaccaaagtatgtgggcccccatagagcatgtagcggagactttcaggatgacccgtggactaagggagacattgtggcaaggggtgaggggtccaggacgggaagttggagccatagcggtggatgatgagtccagatgggatgattgtccccagtcgctgcacagccagcccactgacctgtcctccaagccagaccagtgccaaatgtgtctggtgagcagtggctgcaggctgggcatttcttcagtgagaacctggtagccagttacagctaagaacccacacacccgtcttctcagtgtggatccctggagcccctagctggaaccctgagccctggaaatgaggaaaggaatccctctatggcttattaccagacccacatgtcttgccccttgctctgttggcaatcagctccccccaccaccaacgaactaacctcctcctgactttccaccttgctcccaaccaacccatcaggtttggaaaaaatacagaaatacttcctgttagagtcaacttgggcttggctcagctctggtcagagcagcacagagtagcagccaaaggcctgtgcttctggtcttgaggcccactctcatggcatctgggttagatgagatcaaaacgcaactagagtcagcaaatactccacttctcataacaggtcaagtgcacagttgagtgatggcaatgtgggatccggagccacgggctcccggcctgaaggcttggctgcagtagacatcggctccgagagaggaaggtgagctgcccgggggaggcaggttctctcatgcccctggtgacagaccagggtcaagctgccaggctgcttgggctgctatgggtggggcactggtcacttcctatggctcctgtctactgcttctcccacactcccacattccaccacatcctgtgtccttgggctttccactttttggaatcttgttcatttttctgatccctgccactggccctcaagctcctccagagtaggcactaggcccactcacagctggaggcccagccctcacatggtgctggtcttgggctggtcaaatgaacgtgtagggaatacatgaagggacaaattaatgagtgaatgactgaatgatggaagagtcggcaccttcttacttcttggttaagctctgaggaccagctaggaggccctttgctcctgctttctcccttctctccttttcctgccccatccctaccccaggcagctctgctctgaggttcagggagaggaaaagcggtagccctggagagaccagcgtgtccagctgggctctggcttcttggacctggagggagtcaggggccactttctcaggtgatttgcagagtggcaaggtccctcttgtccctaagtggttccaaaccaagcctgaatcattcttggggcaaaggctaggtatgcagatgttggcataaatagtttagctccaaactatgctagagtccttctggttcagagcagatggctagggaggagtggcaaagccagtgtctgcaaagagctacaaccgcaagatatcatctgcctcctgcatcctactgcagtctggccaaggagggaatcctgtggggaaggccctgctgatgctttcctacttccctcagcacacccagggcccctttccctcactaacttcaatagtttgcaattcatgccatggaaccagagcccgaattctaaatccaggcccacaagtcaacacaggaaggggacagcaggtcctggcctctgaaaccactgtctccgagcaggtccaaggagaggccaccagagactctgttctttaagctgccactaatggggaggactccgctagagccctgtccatgcagcctgcatctttttgccatctgcagaggcattggagggatctttttaaaaataagctagatcacatttctcccctgctaaaaccttctagtggctctccattttccttagaatgaagtccaaaccctttcccatggcccactgggtcctgcatggcagaatctttggccttctatccagtcggggctcctgctactctccccacagtggtgcagcttgactggctctgctgatggctgtcgcggaagagacttctggtctactgtgattgggtggctctggtctcctccatgtcaccccgcctgcttatacaccctcataacatgaagcctgtgctgtccactgtttccttaaaatgaaaccaagcctcaaagttacttgtaaagtcatctgaagaatcttctagattttcatgaattttaacccagtcttttacagttgtcttacctatatagtagtccctaggtatctgtgggggattggttccagaacctcactcatataccaaaatccatgcatgttgaagtccctgatataaaatggtgtagcatttgcatgtaacctatgcacatcctcctgtaccctttaaagcatctctagattattataatacctcatacaatgtaagtggtatgtaaatagttgttatactgtattgtttagggaatgatgacagaaaaaagcctgtacatggtcagtacagatgcagccatcctattttaattatttttcccacatctcatctcatcctctcctctcctctcctctcctttttcagacaggaccttgctctgtcaccagggctggagtgcagtgctgtgatcacagctcacagcagcctcaacctctggggctcaagggatcctcccacatcagcctcccaagtagctgggactacaggcgtggaccaccacgcctggctaacttttgtatttttggtagagacgaggttttaccaggttgcccaggctggtttggaactcctgggctcaagcagtccaccgacctcagcctcccaaagtgctgggattacaggcatgagccactgtacctggtcccaaatattttcaatctgaagttggttgaatccacagatgtggaacccacaacatagagggctgaccacacttagtttgactataattttcaacaaactcctttattgtttttcctttttttttttttttgagacggactcttgctctgtcccccaggctggagtgcactggtgcgatctcggctcactgcaagctccgcctcctgagttcatgccattgtcctgcctcagcctcccaagtagctgggactacaggcgcccgccaccacgcccggctaattttttgtattttttagtagagacggggtttcaccgtgttagccaggatggtctcgatctcctgaactcgtgatccacccgcctcagcctcccaaagtgctgggattacaggcgtgagccatcgcgtcctgccttgtttttccaaaggaaaggttgtttctcatggcaacaaccactctccttttccattcattttcatggatttacttaatcatcgaacttagtgattcttctccattagtggcagctcaaagaactgagttgctgccccaggggcctttccttggatctgctcagagacattggtttcagaggccagggtctgctgtccccttcttgtgcaaatacaactggcataaagaggtctgggaccaaacaagagcacctcttagtgagtgtgctggttagtggagggcacaggcttgtataggcagtgattgttcagcatgccgtgagcatcagtctgcctggtttacagagacacagagaatgtgactccaccctgagaaggttgggtaagacattccccactaaatccatattgagtgggtgaatacaggtggactgggaaggtgcactgcttctataaacagccactgggccctgtggtaacaggaacacattagcacatgttatggcccaggcattattcaaagtacttggcatctatgaactcatttacttttctcagaatacttacgagacagacatgattagcatccctatttcattgatggtaaaactgaggcccagaaaaaaaggtcaggtaacatgcccaatgtcacacagctgggagatagcaaagccatgatttgcaacgccagagggcaaccactatgccacagagccccaggtgtcaggctgccttgagatataaatattgttcctcaagcatccatttgagcagcttcttggtcctcatcatctgtggggggcaggatccactttctcgggagagggtagacatacagacacaaagtcctgaacctggaccaggtctggccttctttcacaggctgtgtgcagctgctagctttgcctctttcctggaagaccaggatgggcacagtgccaactctcagtcctgcaagcctagaccagcagccatcaggtaaggttagggccactgccctagtgccctatcccattgccagacacagcctttggggcccagcctcagctgcagcaccccaggatccccctcgaacttctcagctccatgccactttcacatcaggtgatcacagcaagacagggaactccagggggagctctgaccaggggcagtggaagaagagggatgggtgatatgtctgctcacccagagagcccagcaccaacctacatggacccaagctgaggtggcagagaggagggcatctgaaggcagagcctgggaagagatcctgctaggaggtctcagagaacctctgctgtagggactacagccaggtttagcaagcaggagtcagggagaagattcccaggggcagccagcattagagggctcagttcccaggagcacaggaccggtggctgggatgggcaaaaatggctcctggggcacaaaggtacaatgggaagaagctgtgcattcccatgctgtaagcgtctgccctgtttcacccaccaatccaccagtgggcatggccactttgctgtgggtgtgtggagcatttggcaagtcctagtaaggaacgatctttcttaactcccataaaccctacagaggtgtaggtcaggtaaggatacgtcatgctcagggtcaggttccagccgcagctgagggctaaggggaatgggtggacgtggggcagggagctggaagaacactcgagagatagcaggtaaatgagacatggctttactcagcagcagctctcttacacagctttctcaaactagctttctcattagcagcttactctcacaccgtctgccctgtcttggctgcttagtccggtggcccctacgcacagctgcgtggccagctctcccttgccttcagggtcagcagcttaattctttctctccctgggcacgggcaagccaagctgtgtcctggctcccctctgtcctggctcccctctgtccacctgcaaagacagacagctcttgctctctctctttctctaggttcccgtgcacccgccatgtcaagctatgttgagctgagccaagccccaagagacatgtcccccatacacagcgtcaacagggcagttataccttttacagacaatagtggtttagagccaagtatgaacttacataaacaggttatataagaagtggaggtgtgcacctgtgcaccagactcattgagtcatgcaggcctggatatccccctctgcctattccttgaacaaagcacatccaggtaccttacaggatactagaacccaaaaccaggagacttccccagggaacccaagttggtcaggggcagtgtttgctcttgaactcaggtgctaaggccatgtccaaagctgacatgaggttgtcacacacagtggcatcggtgccacactaatgccaggactgagacaccagcctttactggaagacacagttcctccctttctggtgagaaggcagcctggagggggaagacctgggccccagccttctttggtctgagatctcagcaggcctgtgtttccttcctcagctccagtgccacttcagtctctgctgtccctgctgataggaagagcaacagcacagcagcccaggaggatgcaaaggcagacccaaaggggtaaggcatgagcagacagtgctgaacttctggggtggagagaggcagcttgggctgtgtgtccattggcctttggctgggaaggtgaggccagcaaggtttgtgagctggcctgaggcacatagcaagggcagaagccccaaccagaaccctctggcttctggggccagggagctttccactaaactgttgccttggccaggaaatacatcatagtcagaaagggtctttcagtcagcaaccactctgacagcaactgccttttgctggaggctggagcatgcagacaaatcagaaacacctctgccctccaggaactctcaggcagggggtgggcaaaggctggtccagattagagcaatacatgagcgctagagcaggggaagggggcttcatggggactgtatgtagctggatgtggtcagcgatgagtgtccttgttggggagtgctggaagaggaggctcagtgaactaggtagggcttgattggcctcttgtactgtgatattggagtccactgtgtgcacagccctctactcacagtgtctcatacggttctcctcacagtctctcaaaggtttatgcctaattacaacaaaacccaaaagcctggagcctaggtctctgtgcctcctgggaaggatagtgctccgaagaaaacagccgcagctgagatagagtgatggcagtgaggagggtactacttaggtgggtggaaaaggcaactcaggcgatctcctctaaagaggagaaggagccaactctagaaagaacacggtggagagagctatagataaggaaccacaaaccaactaaccctgaggtgggaacatgcttagcatgttccaaaggacagagtggctggagcttggccagtgaggagggccacagatggagcagggccttggtaagccatggttaagagattggatcttatttcaagttttaagccaaaggggagtctcatgtgatttaggtgtttaaaaggtgaatgcatgtttgcattttcataccacattgctgttgcttttttacttaaaccaagatgctgggggctggggtgggcaatggatatctaaggtatgaggccttattgtgtttcttttctcattcgaattgcactgacaattaacaatcagagtgaaaacaacagctgacaccaatactgtgctgtgctaggtgccttacagccttcccagcaacttgtgagatgggtaaggtgggaaactgaagcatagaaagattaagtgacttagccaaggccttacaagtggcagaactgagttccaagggaagaggctctaagaaaatcctcaggagaaactacgaaaaactagtttatgaaatcttgtctttggagcctagtctcaagacccagaatcagtaacttacagctggttaacatggttaacatgctgtgtgatctcaccttaattttccccaaacgtggaaaaggataaggcttcttattatgcaacttgacagaggagaaaattgagggactcactcctgtaatgaacacacttaggaacagagcccagatccagccaactctagagccaggctcacgctactttcctctgatgtttaaacgtctgcaaaatcagaggtgttttttttttttttttttttttttgagacagagttttgctttgtcgccccagctggggtgcagtggcgcaatctcgactcactgcaacctctgcctcctgggttcaaacgattctcctgcctcagcctcctaagtagctgggattacaggcacatgccaccacgcccagctaatttttatatttttactagggatagggtttcactgtgttggccaggctggtctcaaactcctgacatcaagccatccacccatcttggcctcccaaattgctgggattacaggcgtgagccactgtgcctggccaatacaaactttcttgattacagtgtttcacaactctggctgtacttgagaatcacctaggaagtactgaaatacactgttgatgaaaaaggccatactctgtaaaatatttgaagaaattctgagccaaatgttaggactatgacccgtgacacagcctcaggaggtcctgagagcatgtgcccagggtggttcacttacagcttggttttttatgttctagggagacataagacatcaatcaatacatgtgaggtatacattagttaggtccagaaaggcctaggtatacattagttaggtccagaaaggccggacacctcaaagctgggagtgtggtgggggtgggggtgggggtggggttccaggtcataggtggattcagagattttctgattggcaattggttgaaagagttgttattctctaaagacctggaatcaatagaaaggagtgcctgggttaagataaggggttgtggagaccagagttcttatataggtgaagtctcataagtggccgcccttagaagcaatagatggccaatgtttcttattcagacctttaaaaggtgctagactctcagatcagaaaaagtcctggaaagggaaggagattctctacagaatgtaaatttcccccaggagagacagctttgccaggtcatttcaaaatatgtcaaaaaatatattttggtgtaaaatacttcaatttctttcattacctgctgtctgtcatgtgatgctatactagagtcaggttggaatttggcatattattgcttcaaggagtctgttttgtcagtctgaatatctctctcaatgttaatactggtcagttgggcatgaattccaaagggaggagaatatattgaggcatgtctgaccttcccctttctcatcatgacctgaactagtttttcacgttgtgtccccttggctgagagaagtgtccattcattcagctggggagcttagaattttatttttggtttacaacacaacaaaaacttcccgaagtcccaggtagagatttggattttatttttctggggtgggtctccatcatgtgtctttttcaaagctccccagtttgttctccttccaggctaggtcgagaaccatcgttctcaggtagtggttctgacccaggggcatctcccaaagcttccagcctgctacgatacaatgtctggagccatttttggttgtcaaaactgggagtgggagacactactggcttcttatatgcagagatctgggatgctgccccacatcccccaacacacaccatagaattatggggttcaaaatggtaatagtgctaaggttgacaaaccttgctgtagagccttgacgatctatttgggaagacagcagggacggaaaagaaaaagggatggcacagaaccacacccctcaccttccccgaaatctgggtagcgggcacaggacgtgtgcgcctgcgcgaatgcgcgctcgccaccagcgtacgcgacgcgtgcgcgcctgtgcacctcggcgagcacgcgcccgtagtgagtacgcctgcgtaggccgccatttcttgaagccccgaactcggtcgcagtgcccgccgggaaaatgcgaccgtccacaaagtgaaatggccgcccgggacgagctcggcctcggcggggattctcttgaggccatgcccgtgccggccgccagaggtcgcccgaggatcacgaatgggcccgaggagctggctgccccttcccccgcgtaaggtctgaagccgcggccagagtggctttggggtgaccgcgcgtggaccgtcgccggcgggaggaagcgcggtcccgcgaggggccgaacggggcccctgcggcttgagcttgtttcgcagggagccctggggccatggcctctgggacactggacacgggtcgtcagggctgcccagggggagggggtgtggacgtgcagacagggaaggcagctggaccctccaaccacgctgggccctcgggctgaccggggctggtctgtggggcagtgaggaggggcttcgttccctaggagtttgatgagggagcgccatgggggtggcgtcatcctgacatcccgcagggcagtggagccttactttccctaggttacaacacagttttaactgtcccaaactgtggggactccgccctattccatcttgggccgctccatcacactacagggagaggcggtatagtatagtggttgagagcctggactctggtgctttgggttccagtccaagctctgtcacttacaagcaccgtgaccttgggcatgttactcatcttctctgtgcctcaggttcctcacgtgcggaatagtggtaatcatacctcctaccatatagggttgttgaaatggccaaatcggtttgtatatgtaaagcctgtaggacatttaaacctgcgagctaagtgaagcagcaccagaggaatatctcctcctctcagaggtgttcagggacacctggaaagctaacttaaccagctttattggtttgatttcatttgacatgacacgatatctcatcttcttcctactaaacttttgtcatcaaattttccatctagaacatgctgttttcctcattatgttgcaagcatgggcttctcgtttatattttttctgcatgaggatcaggtgaagtttaggcaccacatttcctcaccactggcaaccgttgttggccagtggaggcagtacaagggtggaagtgtcagctgggtgcagtggctcatacccacctgtaatcctatactttgagaggccgaggcgggaagaccacttgagttccggggattgagatcagcgtgggcaacgtagtgagacctcatctctacaaatattatctatatctatatatgtatatgtatatgtatatcatatatatgatgtatatctcatatatatatgtttttgaaacaatgtttcacttctgtcgccccagactggagtgcaatggggtgatctcggcttactgcaacctctacctcctgggctcaagtgattctcctgccttaacctcccaagtagctgggactacaggcacacaccactgcacctggcttatttttgtagagaggagtttttgccatgttgcgcaggctggtctcaaactcctgacctcaactgatccacccacttctgcctgccaaagtactgaaattacaggcgtgaaccactacgccgggactacaatttccgttttttaaaagaatggaagtgtgtagattatggttgtgttaggagttgacagtggctgtattaggctactggatctttggtccaattacactcagaaggaaaggcttcagagaaattaatccaaaatccaaaatcccgttggtcaccatcccctatgttaccttgcctatctctaaccacttgacttccaggaagttcatgaggagctcggacaggatagctgggaagtaattcccctggatgttacattgtccagcagagcttcctgtgagtgtttgcctaagatttcctttttatgacccacataggtcatatgtcctaaaatcacagtggccctgccacaggcctaggaaagaagaagccttgttcatccatttgtccctgtgtcacaatagagcccaaatttctctttgtggataatcctggctctatccacagacttggtgagggcaacctctactagtgtatttctacagaggacgtgggacaggacgggactctgattaaatccatagtaaagctaactcagggctaccacagtagggagacaagctcttcaggccttgtatgtttgtctttggctcaagcaagcatgtcactgacagagattgaatgggtgtgtcagggcaccctgctggcaaccctgggactggtgttacctgtgcagaccacttttggatctgcatgggctgcagcagaccctaagggtggaagcagcacagagaagcacaggcccagtgggatggttccccacagttactgtgtggcgtcacactcacttgcctgcagttctgcctggtgcagctggaggtggcaattagcttgttgtgcctgctggagaattttagttcccttgacctccacctgaggctgaagaatcatgttgctttcagggcatactttccaaaaagtgtggcctctgttggccttgttattccagcttgaaggcaggaagcctgcctagacaaagttaactcctatatacaaagagtcccagggtagtttgtagcgtgttcttgtctcggggtagcccccaccagctattgaaggtaggctggtgatgttgggaaggttatattcagagtgagctaggatcgaggtgatggcgaagtagattttcattctgaaatgctgggctcactctcttagtagcccaacttggtgtttgcccctggcctagtagactctggaagcagtaccttgcacctcggtgtggggctggtgatgggaggggtgtggaagtggaggatcagctagcagcctctttcccacggtacccagattggagggtgcagtgcaatcatggggtgaggccagggaggacccctgaagagctcgatgcctgagacatctgggggaagccctgtccttcttgctggattcaggggtggcaaaagccaaaaattggagggccaggtgcaatggcacatgcctgtaatccctgcactttgggaggccaaggcaggaggatcgcttgagaccagcctgggcaacatggtgaaaccttgtctctacagaaaaaaaaaaaaatacaaaaattagctgggcgtggtagtgtagacctgtagtctctgctactcagaaggctgagacaggaggatggcttgagcccaggaggcagaggttgcagtgagccgagatgatgccactgcactccagcctgggcgacagagtgagaccctgcctccaaacaacaacaataaaaacatcggaggcttcggcttcatctattacacatggaggcctgttcagtgagaagggagcagcgatgctgggctcctgccaaggaggagactgtctgctccctggaattggggctgtgcctggctcctttctgccccgctttcagggatatgagtccctccaagtccacaggaggtgacagccagcttgcgtcctggggctgaggcagggttagtttcagagcacttttttcataagggtgcttattcttcttcagggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcaggtaagggctgagctgcagtgggctctgcctctggagcccatgtttttgttgaggtctgcgacccacatgggaaccacttccccacaccctgtgccaatacccgacacattgcacacccaggctcctgttctgtgagtgggtcatggtgattccctggtcctagagcagtgtcatcaggcttcttgtggctcaaggagctgggaggggactgtgataggaggatgtgtctgtccccaggtgtgagaagccctggctaattcccaatgcatggggcaggaaggaaggctgtctctcagagtacaggtgctctacaggtgggggtcctgggcagagtgagggctatttgtgtgggtaaaatgccattgtcagagaaggacagagtgtgaaagagcaaaaaaacaggagggtaaaagtgcaaaagtgacagagtgaagcagagagagagaggccagagggagagaaagggagcatgtgtgagcaggcatgagagagtgacacaggatgtgactggccatgtgttggtgtgtgccactgtgcatgagcaagaggacaaacgtgcctgttactggagctgaccatgtggcattggtgtgagagtttcaagtcaggctctcttgaaggcatcttgcctgccagcgcaaacactgcatgtccttgcagctctggacacgtcaacaggccagtgattccaggggtgcaaagcgaacagtttcttacacaagacagaaatgtagaaggagagagctaagactcatattgccccgagagaggagctagtggaatccagcagggcatctgctgtggggagcaggtggagcctggggttccttttgcagggatgaaagaaacacagtcatctgccttctttgttctggggcttcttgtaccacagaggttccataattattaatagttaggttatttttagggcctagctcaactgttagataacaagttttaccttctaagaatatctagcccatctttgattccttggctccaggccctggagggtcccagtccaaaaacagagtgaacaactttggacttgctgtcacattgtgtggcttctagaactagtcagtgttccatgcagaaggggtataaaaagtgaggcttgtggatgaaggaggaggcgagtggttctgggttttgttttcgttttgcgggggagtgtcaggaaaggctttctttacagggagagtgatgttggagctgggtttggaaggctgagggagattttgccagatgtgccagacgtgcttgggaaggcattccgagtggaggctcacaaagtgtatagggaacatccagtcaggtagccatcacaaaggagggttaatccagcctggcttggcaggaagcaccaagtaggggctgggcaggcacctgctcctaggctgaggagtgtgacccacatcctgagggccttgggagccaccgatggttttcctgcaggagagtgccacagccagactcgagtccaaagaagatccctccattgccctgtggaggaccaggccaggggagtatacgacgagacaaggcaggaggccatattggagactgtttgcttacaccaggggcaaggtgatgaggctgcaagtatttttgaattattaaaggtaaaagcgggcttggcgtggtggctcacacctgtcatcccagcactttgggaggccgaggtggcagtatcgcttgagcccaggagtttgagactagcctggggaacacagcaagaccccatttctacaaaaaatttaaaaacattagccaggtgtggtggcacatgcctgtagtaccagctacttgggaggctgaggtgggaggattgtttgagccttgcacgtcgaggatacagggagccatgttcctgccactgtactccagcctgggtaacaaaacaagatcctgtctccaaaataaaaataaaaaaaataaagataacggtgagggaaaagtggtagccaaggttgctccccagatttcagggctaggcaattggatgggtggtgacaggaactagctgagggtaaggagtttgggggcaggcccgctgagagatgcacagagatgagaaggtcactgggccatgccgaatgagaagtgcctgtaggggctccagccagtgatgtccagtaggctactgagtaaacaaatgtggagttgagcaaagatctgacctggggctagagagctgggagttgtcagctcataggaagtcactaaagagaatgcatgaggttgcctggagaatgcctttggaaggcagtgtgtacaaagcatgtattctcggcttttctctgcagacttccagggacagttgtccagccaggcccttggctgggtgggtgagtccacgtggttcagggatgctgagggaagctgcttcatcagctgacatttctctccattttctgctcttcttttgtctcaaaaagaaaaaaagaggggatattaattattgatcccctaaaaccctagctgaatatataaaatgaaaagaagtaaaaatatgagagaagcaaaggcagatggaccataattttggaaaataattccaaaaggtcttaaggaggaagaggagctacagagaggtattgagaaggaaaattttggataaatggaagaatcaggaaagactaccgtcatggaaaccaagccacgctgagctaactttccagtgctctgtagatgctgaaataggcccatcagatttggctatgtagaactcatgactgccttgaggggagtaggttggggcagtgggaaaggctgtagttggattataatggattgaggagggagcggaggataagcaggtgcagttgatggggtacacactctgaaactggctgtgacgtgatggatgtgggaggggtgagcagataattacagctacaagataatggggaaggtttcctataggtgaaagcaacgtgtgcatgttaggtaaaggctgggcagagggtgcctacgtgaccagtccccgataaaatccttggactctgagtctctcatgaattgccctggtcgacagcatttcacacttgttgtcacaactcactgctgaggggaactgagtgaatcctgtgtgacccactgggagaggactctggaagcttgtgcccgggttccctcagaaatttgccttgtgtgcttttccctttgctgattttgcttcgtatcttttcactataataaaccatagccttgagtgtgatgatgtgatgtgtcctgtgagttcttcttgtgaatcaccaagcctagggatggtcttggggacccctgacacagatgggcaggatcagaactttatgccataacaaggactttagattttctttcgagggcaaagaggagccaggaaggtttgaagcaggggagtgatatggcgagagtattgctttgcaatgggatctccagtggcagtgagaagagtgactgaagtgggcagagtggagcagggagaagaggaagtgcttacagcatcctccatgtaagaaatgatggggcctggactaggggactagctgtggagatggagacagaactgtaaaataagtagaagagatcccaaattggatgacaggtaagacttgggagagcagtgacggagagggaagtgacaatttagaaagccacatttctggtcgagtgagtggagtatgtgacccctcctggcttaggtggtggccaaagtatctctaacctgcctctatactgcctgcaactgactgagcaaatgcctggtccgtggagatcccaagctgacaagggcacctgaggcaagcctctggctttcaggtggaggccctacctaggctggcctggctggattgccctggcacactgctgttttgctgaggcagacagcagcactctgcaagtgctcttctcctgttcctcttagtggtctaaatcctgtagcatgctggggtgcgactgtagacaaatcccctttccgggccccctggggttctctatttgcagtctttgggtctggtcactggcatggcatctcagtaggctaggttcatcaggaagggtcaactatgtcatggcacctgatgggcagcatttagagtctgtgggccaggggcttaagggctgcttactgctaatagttctaagtagcaagcattccctcagccctagtctgggcacacgccaggaagaaagccactagatgtgctctcctagtggataactagcctggagttccaagaagggcagagacaggcagagtgagagccttcagagatgtaggcaacgatagtagcagaacttcgagggagagtagatggaaaaattaaaaaaaatccttgtcattatttttaaatgtctgaattgaccagattagaatctttgagagtctagacactagggagatctcatgggtgggccagttattatatcatatggagggagagtacgtatgacccagcacgagaggaccagaggacagtcagtgctaagggtaaaaccttaggccatgggagattgagtttttcatcagttggcaagttttcactttaatactccactgtttccatcatttcagacgactggggatgataaggacaatgtaatttgggggataaaggaagaactcattatatttcttggatgactttactggggaaatggattccttagtcatttgaaagaagcggtagaattccacatgtggggaatacttgttctaacaaaagcttaataacattagtggcaatgatccttttatataagggaaagcttcaagccagtgagaaaaacataaataaactagtaagaacatatttataaccatgagatttgggtgcagaataaaatcaaattggcagttcaggaaaggtcctaaacatctgtatattaacaatattccatcagtgagcaatgtgaatttcccataattgaaatgatgattgataaccttgtattgttcttatctaatataaggcaaagcagcactggggctttgataaagagcaatatctcatgtacactgaggacactgaaaccccgctaggaattctatggaatttctaaaatatttatattaaggacattttacccattatagactaatttagggaaggttctgcattttttttttgatttgacaatgtttccaatgcaatttatacaatattaaataagactaattagtttttgcacctttcttgttacaaggtgaaagaactaatcctttgagattttccagaaggtccctggcaaatcccaaagccagttttaggtataaaatatatttaagttttgattgtgggaaggcaaatgttaagagttgtcaggagttctcgaacatttgattgaatagcattatgggttagcgagaaatactacttggttagctagtgaatcagagttgtaaaaattttcaagtaaacatatgaggtaacatggttgtaaagaatcttcagttcctttaaaattgaaaagactttaaaaaaataactaaggacataataaactgaacatacagatagggcattacagtattttgataagacataaaatctttgcctcttaggcagatgactcagaagaaaaacagaccatttataactttttattagggacagaccaatgatcaagaattttttttttttttttttgagatggagtcttgctctgttgcccaggctggagtgcagtcgcgcgatcaccatgttggccaggctggtctcgaactcctgacctcaggtgaactgcccacctcagcctcccaaagtgctgggattacaggcgtgagccactgcacctagcctaagaaaattttgttattttaacagagaaaccaacattttaattttatacaagtataatatttgatattagttcttttttgaaaatcttataaatacactgaataaaagttttaaccatgacaaataaaattccttttctgtgaacattttctaattttaaagatatttgtttacattttgtctcacacatttttaaattatttgtcattttaatttgggacaaagctattctctttttccttaggaaaagcatatttgcatacaaagttgtttccctttgccatttttgccattattacttttagcagtttatatatatatatacacacacacttatttacttattataattttaaccattaataacttctctttcacagagaaaacaggaggtaggtaattttgaaatatcatataccagcattttgtagcagactagtaaagcttatgaatatacatctcataactttttatagttgttatatactttttatagtaccattttgcaatgtggacaaatgaacacatttaacagatccatatgtagtcacactgtaccataaaaaaagcaaaaagtatataaacttaaatttaggtctagtgactaagtattttatcttctttataaatgatatttaatgaatttagttaacttaattcagcataagtctaaggttttaagttaccaaaaagattttagaaactgcctttaagcttacatattataaaacataattactgttgaaataaagtttgccagaataatgactcagtttggttaaaagcaaatttaaatttttataatcttaaacatgtagtagatataatactagcttattcaacatgtaaacctgtttaagtttaggaggaacatacccaagtagagtaaaaatatatgcttgtattctgttgtattatatgtaatgctgataactcaaagacacataggtgtctattaaactaacaatattaaactagttttgtttgccaaaagtttacataaattctgtgaacttgagttttaaaagcatttgggttagtttttataagaatacttttttgttgtttacactgaaagtattagaagttgtttccttaatttatgagagctttataataatttatataagtacttatttatctctaagtcaattagaatagaggataagggattttgtaaattaatttggtaatgccatctggaggtactgaactattacacatatacaacatacatgtatactaaacatacagacagacacaaatagagatctaatggcgagccctcaatgggtgcagggggcctgaagctctactggctataggcagttgagagggctgagtgggaaggggaaagcctggtgaagagtagataggggtatgtaggaggtagaggcattgaaggggacagatgaaaagattcagggagctgaagggaaggtccaaggtggtgaaaagaagggaagagggatgcggtaggaagatgagaagggggaatcttagatgagcaggtttggggagaccccaggttccctaataaggtcactgaagttccaaattacccttcgtgattactttttttttttttttttgccagttttggaaatactggacagaatgagtgccataggggcagggcatgtagtcagcaagggaggaggaggaggatgaggaggaggaagggcacccagtagattgagagttacctgtgggaagaggcagatcaaatagagaaaggagccaggctggacagtctcattaggaagttctgcacacagtcgtcatctgggagccaaagtttctcttcagtcctcattgaggagctgaagggctttccttgtgcaatctctagacaaggtgtcaagggaaacaatgaggcctcacaaaagagccaggaatttggagtaaatctccactcaaaaggaaccaagaaaacttctatccaggacgattctggctaaaattgaaaaggaccaggaagagtcctgctcaacagagtcaggggttaaatccccactcaaaaagagctaggaagagttctgtctgcgaagattcttgctcaaacagaaaagaactgggaagagctcatttaacagaatcaaagtaactgaatcacagaaccataaaaagtgtccaataaaagcaaataccgtctctgggcagggtgcaatggctcacacctgtaatcccagcacttgagaagctgagggaggaagatcacttgagcccaagggttcgagaccagcctgggtaacatagcgagactcctatatctataaaaattttaaaaattagccaggcatggtggtgtgtgcctatagtcccagctacctgggaggctgaagtagtggaggattgcttgagcccaggagttgaggctgcagtgaactattattgcaccactgcactccagcttgggtgacagagcgagaccctgtctcaaaaacaaaaaacaaatatggatttagatagagacttttattttattttattttattatttttgagacagagcctttctctgtcacccaggctggagtgtaggtgccatctcagctcactgcaaccaccacctcccgggtttaagcaattctcccgcctcagccttctgagtagctggaattacaggcgtgcgccaccatgcccagctaatttttcaatttttaatagagatggggtttcgccatgctggccaggctggtcttgaactcctgaccccaagtgattcacccgccttggcctctcaaagtgctgggattacaggtgtgagccaccgtgcccgaccaatactttatttaaaaagactattgcaatagggacaatgctgcaacctcaggacttgcaaacatcacaaaataatacaaaaaacatcacaaaataataaaaaaaaaaaagcctttttttttcagtagggagtagtaagcacagctagcagctcagctactttcaagggccagtgggcaagcaaaggggaacctgtttggcatgatttgaccagaaatgtgtttccctgtggtcagccggttctcaggagaagctgctaagtggggcatgttctgcattgcagcacttacttaaccaggagcaagcaaaattcaggccctgtggggaggacagaagcctgcctaacattctgtcaaggcaaaggagagggtaaaaagcagacagctgtgaacacttgatcatccttcaggcaataatccattctgggtttctggcttaagactcttgagaaacaaggggaaacaactggtaggagcagcaggctcacctatatgtagttccgtgaggtagccttatggacttctgccaccttccaaaactcagcatgtcccaaaccatctttatcaacacagcttctcaccaaaaacaaccaaataaaacaaattaactaatgtactaattctgtatctccccctgtgttgttcatctcaaaaaactgttatcacctcattgactcagactctcaaccagcgaggtagaagaaatgtttgggggcatgttaaatgtaacacctatgagacatgtaagaggtgaggtgcaggacgcaggtacatggtgataaaagaaaaacctcagccggattaaatttaaaggagtttcattgagcaatgaactatttgtgaatcgggcagcccccagaatcacagcagattcacagagactccagtgcagctacatggtggaagatttatagattaaaaaaaaggtggagggggggaaatgacgtacagaaattggaagtgaggtacagaacggctggattggttacaggttgggggtatgccttatttgaacacagtttgaacactcaccagtgtatgaatggttgaagtatggccgctgggattggccaagagttagctattgttacaggtacacactcctaagttaggttttcaattttgtctgcctctaggttacagtttattgacaaagactcaaatatagaactatggagtccttctcaggccgtatttaatttgctttaacaattccccctttttggtcattttctcaactttgagagattgacaaaaaccttagttattgatatcactattacccttgtaaatgtacttatatggtcttgaaacccactgggaaacaggaggacagtgggttttgtaaggagagaataaggactgagtagaaggtacctctttatgctagaatgttctgtttacaggacaaaaacaaaacctggtctgttttaataactatttgtttccttaaagtcttagtttgattatgttacatttagcatgagcaactccattttgtttggtttggtctgttgggtcctagtgcatgagctcagtacacaacaatggcttgccagaattttgtttaaaaaattccccttggctgggcgtggtggctcatgcctgtaatcccagcacttagggaggctgaggcgggcagatcacgagctcaggagatcgagaccatcatggccaacatggtgaaaccctgtctctactaaaaatacaaaaattagccgggcgcggtggcatgcgcctgtaatcccagctactcgggaggctgaggcaagagaatcacttgaacctggcagtcagaggttgcagtgagccaagatcacgccactgcactccagcctggtgacagagcgagactccacctaaaaaaaaaaaaaaaaaatatttccccttattggccaggttctcacttaggtgagagtgtgaccaaaacttagggccttagcaccacttttagttacctagttaccatcattttaggtttccagtctcagcatgtcattcataggttatgatgtcctcataatcatacatttcaatcagttttgttattccagttgaagagagaccatttgacatttcagagatggctgcatgcaaacatttgaaacctttgagagaatacagtgcactggggagactactatgactaccagtaggataatacccagagtttgaagtatgctgtttacctgaggtccccataaaacaaactgcctaaattaaataaaataaagaatgagctagacgaagagtctactcacttcactaagtgatcttttcattaatcctgtatgactgaatttttataatctgcacttgatatacatattagaattttagaaaccccatataattttggaatatatattaatataattcactaaaaatataccctgaagattaaacattatttttattggccaagcgcggtggcttacacctgtaatcccagcactctcggaggccgaggcaggcggataacctgaggtcaggagttcaagagcagcctggccaacatggtgaaaccctgtctccactaaaaatagaaaaattagccaggcatggtggcatgcacctgtaatcccagctactcgggaggctaagactggagaatcgcctgaacccaggaggtggaggttgcagtgagcagagatcatgccattgcactccagcctgggcaacgagggcaaaactcagtctcaaaacaaaacaaaacagtatttttattttgacaatgcctcccatgatttttataccaaataagccaaatgtcactgttgcattagtgcattatcgatgtcaaacccaattcttaaataaaaccttatagacaaatgtattcaatcttaatcagtttgaacataaggtaagaattttataaaccttttataaccctttacaatttttgttgaagagcagattagtgctctaagaaaacctgttgtgcttttatgtccatgttcaatttatggaaaaacctaataatacccttttaaatttagtattatcatacataaaattttttacaaggttaattttttttttttttttgagacggagtcttgttctgtcgcctaggctgacagtggcatgatctcggctcactgcaacctctgtctccccagttcaagcagttctcctgcctcagcctctggagcagctgggactacaggcgtgtgccaccatgtctggctatttttttttttttgtatgttagtagagagggggtttcatcatgttggccaggctggtctcgaactcccaggtgctcaaaggaaaatttaagacagtccatggaggagaaaggtatagacaaggtcatgcagatattaaaccagaaaggacttatttcctaagccaggaatcgaacccagactgccactgtgaaagggcaaaaccttaactactgagcccagaaggagtctagagtagttaattttgagcttgcaaaggcttttaactagtcaagataatttttagaactaactatgatatgaaccctaaaattcctgttccctggaaggtagagacaaggagaaagtactgccacatggttacaaggtcaagctcccaaggacataaaacaggatggcgaccttgtccagttttttgttggtttcagggacctgcagcaaagtttgtcactgaccagcttgctgggccatcttgagcagcaagcttatgggggcccaagcccatgttttatcctaaggtacccctcgacacagaaaaacgactttatagcacaaaatataccagattgactacagcttaagactagacagcctcagaattcctttttgcattaattaaaattttacagaggagataaacagtgattttacaatcagtttgcacagagagagagaagcctgaaatctgactgggaagagatatttacccttttgctggcatgccaggcttctgggctccctttccctgagtggccctggtgatctggctctctgcaccattgccccgggagccaagccacaacacaaaagaatttttttttaaaatgcacttcagtgtgttgttgttcatttggaatgttccactgtaagttatctttcgtaagatgtcaccatttctgtaagaatttgctgcctcccgggcgtaatgtgtaacccagaaggaactcagttttccagaagcaattaataggttccatggaatgttgatggtaagaaaggaaggaaaaggtgacaagagtgagcgtagacagctctttctaaggagtttggctgctggaaggggaagagaagcagctggggttaggtgggaggaactaagtttagagacgctaaaagtgtatgtagcaggagtcacctgatcaggttgaactgcagcaggaacaaggaagttccattttgactactattagttgcaaattggacccttatgtcaactttttcatctgtaaaaaaaaagggatggccaggcacggtggctcacgcctgtaatcccagcagtttgagaggccgaggcgggcggattgcctgagttcaggagttcacaaccagcctggccaacaaggtgaagccccgtctctactaaaatacaaagaattagccacgcgtggcagcgggcgcctgtagtcccagaatctctggaacccgggaggcggaggttgcagtgagtcgagatcacaccactgcactccagcctgggcgacagaccgaaactccgtctcaaaaaaaaaaaaaggggggcaggggatgaaaatgctattgctttccaggaatagctatgactacttccaataaagaagacaagaaggttccacatgtgaaaactacgcggtcacaacgataagtgggcgggtgcacgcacgcgcgctgagatcgtgcgtgcacaggccggggtgcggccggcgtgagtacgcctgcgcgtgccgccatttcctgcagccgcagactctgcctgcggtgctcgccgggaaatgagacgatcaacaaagaaaatggttgttttgggcgagatcgaccgtggagaggctttttctgcagcagtcccggttcctgccgccagatggcgctcgaggatcacaaatgggtctagggttctcataatggccccgcctaagaaattttggattctcctggcccttcccccctttgtggggtcaacagcggatttgggaatctggtgaccaacacgtgcgcactcccctacccttgcccctaccgagccctccagggtagcttgggggagaagctcctccctagactgccgggtatttgatgagcctggccagcgcacaggtcttgagcaccatggtcagggaagaaggctgaatggcttaggtcttcctagagaggccggaggcgggaaagaactggagaaaggagagatggcagtgggaggatggggacaagaataccagtgtgtttccagccagaagacgatgtcttttaacacctcattgaagtcgtcaggtgactttgcccttgtcagaaaggagcagcactgcgggggtcctactgaggaggagactgactgctccttggggtggggattgtgcctccttcctgtctgccccactcttggggagatgagtccctccaagtccacgagacatgacagccagcctacctgccatgggagaacaaagtctagtctcagggcactcacttcataagggtcttattcttcctcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcaggtacgagccaaactgcactgggaccttacctgctagagccagtgtttttgtccagggcagcaacccaggacaaacccccacacactaggcatgcctgtttatcctctgcaggtgagtgtggttaggagccagagggaaggagagaaaccagcatctcaggggtagatattcatgggtttcagcttggagccatagcatcaaatctgttagactaagtctggcacagaaaggatgcacagagaaccaggttgtctggcagccagttcgaacctggaaacctgggtcaggggagggatataggttgctttttctgttaatggagatggaaactctctgagcaaggtgtgccatggtgtggatgtgattcactgccagaaataacaactgtaccagttggatgagctcttccactgccatcagcactgggatggccatggatttggacagtaatgtagctccacagtgctgactcagggttgctcattgattgcaagaagttggcagcagtagcctgaggaaacaggggctctgaattttctgagagagaccaagaaccaaggaacagccaggtactagggaacagacaacaccagatgcttgtgcttttctgtgagcagctcaggtctcccaaagtggtagtttcctggcttctggcctttgtagatcagtgtggatccacacccaattgtgatgtttgtggtagctgtaagaactttcccaattttgaaatcctaggtgacttgtagcatattttttcacatttgaaaataattgagttttgaaaatgtttttacaggcaatctagtatcagattttatatcatcctgaaacattctgtcaattgtcatttccaaaaatccatggaaaactggagttgttgaactggaaacagtgtggtctcaggaagtgcttcacagccattgcaacatgggcagggcctagagggcaggagagaatgccatgatttgatgacattttacccattcctgccaggtgaacttcatctccctctctgtgacagaattttctggctctcacatccagctttggtcactgggaacccacctattggctcttgcactggcaggacatgtggtagaggcttccagttcgaggcaggactggctgcattttcaagatgtccttatttctggtattttgtggcgatcgtcctgtccacttaactgattttgacccattgccttgctgtgatctctgtgctctctctgtctcccagttccaggtcattcccttgaccagcttccagtctttcctcatcttgtccctgccaatgaagtattctggctctgccttcactctcctgccatgatccattgctttgatagggtggcttcaggaacagggtgaggagagggctgtgctagctttatcttgccaaggaactcagcaaagaaaatttttgctgacctcttgcattcctcagcctggctctggtctctcaaacctaacacatgggatgcatgccagcagccagcctcagtttccctctggtccttttctgtgtgaggccagaggtccttgctttatcactgcctggagctgcagttgatgatggtgaaagaaggtgcacgtgtcttttgagagctccctttgttccccagagatttttttttcccaaagtggccatgagtttgggaataaccaggagccatgggccgccggctagagatgctgcatactaagagcctcctgtgagcagccatgtacacagtgaacacgatggctaaggccccatccagccgccctcaaagagcacatagtccactaaggaataagcatgatcgtaataaccattagcacctgctgtgtgctgagaatgtgcaggcactgttctgcatgccttatgtggactcactcatttaattctcacaccaactcaaggaggtgcttttattatggagaaactgaggcagatggaggttaagtaatttgctggcagttttgcagccaggaagtggcctaaccgagattagaatccagacagagatcagagcctgtactgttcatcgctgtggcatccatactgcccctccatttgtgataagcccaggaaggaaagaaaccaggtgctctgatggagaggggttagagcaaggatggttagggaaagcttttctatcgaggaggagacagttcggctgagacctgaaacatctggaggagcctgccttccaaagaacctggggagaggcattgtggacaaagaagatagggaggagggcctgaacaatgagccctgtgcttggagggtacggggtgaggtgagcagggggcaggagctgggccctgtagggtcttgtaggtgagggagaggaggctattgggagggctcctattgctcacattgcagtcctggggggatgcccagggcattttttcttttttttaagaggcggtgtttcactgtgttacccaggttgtttttgaattcctggcctcaagtgatcttcctgcctcagcttcccaagtagctccagggaatttctgttttaccttgcctcttcagttgcgccgtccccttcagtattctgctgacatggatcacaggataccagacacctggtagttgttcagtcagtaggaggtcttccttccttcctcttagaatcaatccttttctcacttgttggctctgcattttatcccccgtgtatcttttcagatttttgtggggcctcctctcccatccagtccaccttctccagtctctatggtatatttctttgtcatagggtgaagcaggaacaggtacaggatgattgggtacactgaggtgaggtaggagggcaggccctcaggaagggcttcccagaggaggtgatattgtctgcaaaggcatatgagagcctggaagtccaggggaactgcaggctggtctgtacggcttgagtggcacgtgatacagtttgagactatgaggcgagagagctaggcagatgctagaccatgattgttcttccctttccccactcttcaactagttgtaatcttaggcattggattctctggcaaggggacaatacccagtagcctgggccagatggaggcagccatatctggagtatgatctgagccacagcatgttggagaaaagccagaatcagcccagggcagtgtgcacccatagtgctggcctcaggcctttggagggtgagcagacttaagttggaaggtgcaaacaagtggtcagtggtgctgcccaacatcgtgccctgaactgcagttgacagctacggcagctttggtaatgaggctcatagcctgggggcaggcagagtgagagccgatattggcttggccagagaaaagcccttttgggctgccgaggaggttggattccaggccaagggccatatctggcagctgaagtgtggaggttcagaaaaacttcgacaccggtcagtttcccgcctctgctgggaatgaggtgcatctgactttcctcctcaatgatgcctaatttcatttggtcctctgccccttggccttgtgttctctagagagttccctgcagggtggcagaaggagctgatcctagtaagggaccgtcccatccagtgaggaggtgagctgggctgtgtcttccccttctgcaccctcctgactgtcacatccccgggagccccatgattccactctaactgagtgaatcacagaggccaaggcccttggctgcagtcaggagtactgagtggacactggaagattggggtcttgctactgactcacgatgtgacctgggacatgtctcaactcacctagcctgggtttgcttatctgtaaagtgagaagttccatttgttggtcttggaggaagcttcaagagcagtgctcaagggttaggctcagaaaagcctgtttgaccctggaaggtgtcagctcccaggttgacgtgcccacccctccctttatttctttcagggtgaggagcccctcgagctgcatggtcactgttactgtcactgccacatctgagcagcctcacatttatattccagcccccgcaagtgaattggactccagctctaccacgtaagaagggctatctagcaacctgggagatgttcctccgccacttcctccttggcggtaaaggacttggcttttgttccatgttgcttcccatttagtgccttccccagtttctagcaggccattagccaaggggccacacaggacagtgttagtcccctaatataaactcccatctaccgggcctagacattcccacacctcctttttcctatctctgtaagaggctgcagtggtacttcctagtgcactagtggatgtggctctgccattcatgggtccatgcctgggaagccagctccagtccgtgaaggccgggcctgtgagggcattcctgtgttactgtaaaggaatacctgaggctgggacatttataaaggaaagaggtttaattggctcacagtttggcaggctgcacaagcatggcaccagcagctgcttggcttctggcaaaggcctcgggaagcttataatcatggtggaagccgaagtgggagcaggaccatcacatggcacgagcaggaacaagagtgaggaaggggagggcccggactttgaaacaaccagatcttgtgtgaactaactgaatgagaactcacttttcactaaggggatggtgctagctgttcatgagggatccccccatgatcccgtcacctccctccaagccccacctccaacactgggaatcacatttcaacatgaggtttgtctgtctctgtcacatgcccactgcttcacctgcattcctggccacctgtcagggtgcaggaagggatgtcactgcaggaaggctgctcagtgaggtgtgtgtgttgggggcgggaggggggcatatccaagggggcctctgcagacatcaggtcagcaggctggagtgtgcagcatggaaatgggggaaaatttggggccatcctgagcccagcatgatgcagaccttgtttccagtcctgcagaggccagtccaggatgaggcaacctctaggcctctggactctaggagtgagaatggagaggttagatgtgaggtggagattgcacagtagctgagtaccttctgggaagtgctgagtggtaaagactgacagtgtaggattaaggcttggaggatatcttggttgtgggtagaggggaaagacgacgcagccctaaagtaggggtggaaagcccacaggactgaagtgtagaagtatagaagcctggggagaagatggggtcaccgaggtctgcatggaggaggacagcacattgtcattggttgcaggaagcccctttctggggccctcagtccaaacacaacaagagacgctcatggcctgggattgtagtctgagtccacagcagtgccagtgcctttatcctgggccttcccatgagctctttcacttccttcaaaccaggctgggtctccccagccctgaaccactcctgtgggccaggcctggttccctggaatcttctggtgtacctctgatttcttctgtgctccttctacagcaaagggattctcttcgtgaaggagtacgtgaatgctagtgaagtgtcttctgggaagccagtatctgcacgctatagcaagtaagagcgggtcccaaacccttccatgtcggccttctcctgccggctcccatattctcatccctgcatttccagttccttgtccaggacttggctcagagtagcttcggggtaattgtcgagtggatgagtgatgtagttgccctctgatgggattgatgcattttctactgaactgggcacctttgggttctcccttccggtgaattcatcctgcacaccattttcactgccattctgttctgcttgtctttgttattttattttgtaaaatgctgagaacacccctcttgacagagctggcagagccctagggaccaactagctcatcctatttcttttcagatcacagagctcttctcttctgccctcatgttcttttctgtcatgccaggctgcctcatttgaacacacatgtgactgcagttcctgatacatgtgtggctttgctttttaattttaattaattagttaattaattttaattaatttttttttgagatggagtcttgctctgttgcccaggctggagtgcagtggcgccatctcagctcaccacaacctctgcctcctgggttcaggcaattctcctgccttagcctccctagtagctgggattacaggcgcccaccaccatgcccagctagtttttgtattttagtagagatgaagtttcaccatgttggccaggctggtctcgaattcctgacctcaagcaatccacctgcctcggcctccccttttcattgatcatctcttcattttcttgctttgtgatgccatgtggaggggtacttccatgtcacctcggtgtattgctacctaccacactgaggtgaggtcccttagaatgtttcttatgacatgtcatctcactggaggattttagcaacagagaggagcatcctggccttatttcaggattgggcctctggggcttctggactggcttttattggtgctgtggaatgatgagcatggctgtgggggtcaagttcaagccccagctcaggcccccctgttaggatcacttcggacaagatgttcaacctctctgagctttgctttcacatctgtaggcccttagggtggtttttctcaacagcttattgagttataattcaccctttaaagtgtacagtcccgaggttttggtacattcacagagttatgcaaacatcattatccaattctggaacacctttgtctccccaaaaagaaactccaaacccgtctgcaccccctaattctaccccataactcaagcacaggtattataccagaatgatcccttctttcttctcattcccagtatctgatttctgctgagtgggctcctggtgactgtcacattatatcataggtggggaggaaagctctgctgttttcccactggtcagtggggtccccttggcatatacaacctcaggaatcctagccacccagccccgatcatctccctcattgtgaaaggtctcctttgcccccccatagaagggccctgtggcaccaagtcatgaatgacgactggcatcgtagttatgtctcagcttgtggccaaaggttaattagaaaattaactatgatagtgatttggctctcatctctgccctcctctcccctatcaaactccctgcagcgtcagcagcattgaggactcattcgccatggagaagaagcctccatgtggcagcactccatactctgagaggtatgttgactttcttagcacggagcttgcacttctacagaggagaatcagggaagggagagttcctgctgagtctgtttgcttttgtcttctgctttgcagcctccaatccatttgcagaaaggtgaaggacactaccgtagggtggtgcttcccttgttgggatatcacacttgtgacaactaaagcctttgaattgagctaagactagagggtagataccagcggtgactgagaagggaagtggtggcatctgacaacccagaggactcgtgtcagcaggaggggcccttcagattagaacctaatcaatcacttcattaacttgcaaatctaaccagaagtaaaaataaaatgactacaaaagagaggagtgggcagagaaggaagaaaaatgggctgctggcatcaagaagccagaaagacacacaaagccaagaatgcccagtgctgtggagccaccaaattgaaagcaggggcagagaacacctcgttcagcagttttgaaagctgtcactagatgatggcacagtcactagagagtcttaatgacaaagaaatcttatgttcagattcttggaatggggagaagagagtctcagagattgagttcactcaggcttctgtgaagaaaatggaataaatagccttcagtccacagtaagcaaatacggcagacccaggactaaaccccagggccctgactactcccaggttagggatgtttctactctgccatcttgcttctcattgatgggcagatcttaattcatgtggatgacattcagagaccaaagctacattggggaggaaaaggaaggaagtaagagggttaagataaagagaatcctaccgggccccagaggcaaacatataggagcagacaagcatatggggccagggaatctcctccactatagctgaagaagcaggtggttctgagtaactacagattacttggtgaggcacatcagcagatgaagtcttagcagagaagggcaggttggtcagaaacctgagagttaaccacttacataggagcaaatggaatgaggcttccaattctagtggagtgacaaaccagatactctagggacccccctttccattgcacaactactaaatccagaatcagtcattactgatccattgctaggcttggaggaaggaaggggactctctagggacaatctcagtcacttgcacacatgcatatgcacagacacacatgcacgcacacaaagaacagctgtgagctggtgctgctggtggtgaaagaagcaggaggagcagggctgcgctgagggcaaggatttcaagcagcactgctgtccagagtgaaccctgggccagcagcaggatggtgggccacacccaagctgcccgtgacacttctgggtcctccgacagagctaacgtggatctagattgttaatgtccccccgccccttgggcttctgtcagaagcagacccaaatctctggaagaaagtaccctgaattttggcttgtaggatcagatcaagcagttactttgaggaagtgcagtctgaggaagaaaagcagaggtgactctcagaaacaggcatcctggaactggaaagatgctcaacccaggagtcagtatctagaacttcagtgtcggatctgagtaggctctacagacagagcatgaagggtgggtccaggagtataggcaggggcagagctcagttggcccaggcgtgaggagaagggccatcaagacggggccaggcagggcacacaatgacatgtctcctgtaggagaaggcattggtcttcctgctctagagggtagcaggccccagcggataatctaagcagaaggtcagggggaggcaaactgtctggaataagtatcatatcaggacatctacaggagacatgtcattgtgagctggaaaaagatgcatgactagtttttggaaataatgcagaggtctacagcaggctgagaactgatctggcccagggctgtgctgcacaccacagaaaacagtggcatcctggggatcctgacagcaaacctgggcctggctgcaccaaattggaaggtctggctgtgtcacatcagaggtctgtacaccagcctgaccaccgggttattgttcttcatctcacaggacaactggagggatctgtacttactgcaaccgtgagatccgagactgtccaaagattaccctagaacatcttggtatctgctgccatgaatattgctttaaggtaaaaaagaggtggaagacaccttgagctaggcggtaactcctgatcacgtgctgctaagaacgttttgtagagtgcgggagtcttacgggttcagagactgtggaggaggcttgatctccatatacaattgcacatagtcgcagaggctttgcacaactgggagctgaatgagcttccaagtctaagacagtagatgagtgttggtggttctgcatgcttagtactgtagggaagacaaaagaggtcttttcaggaaagactatttctggcagagggccagcaagtgcaaaagccctggggcagaagcactagagtgttctagcttgcgtgggagaatgccaggagtgacagagtgggctagatcatgtaggccttggcgggcacagagtttggattttattctaagtgacattggggtccccattctccacagtgtgtggcactttgtaaccccaggttgttggttccaatccatttagggtgtcacctctgggtgcactgagaaaaacaaccctcccctttgccttgacagaatgttaggcaggcttctgtcctccccacagggcctgaactttgcttgctcctggttaagtaagtgctgcaatgcagaacatgccccacttagcagcttctcctgagaaccggctgaccacagggaaacacatttctggtcaaatcatgccaaacaggttcccctttgcttgcccactggcccttgaaagtagctgagctgctagctgtgcttactactccctactgaaaaaaaaggcttttttttgtattattttgtgatgttttttgtattattttgtgatgtttgcaagtcctgaggtccaggatgtgccacgggctcacagcatctgctcgcccaccttgttcaggcatccccttcccactccactcattcctcttgctttgctttgtgtgttgacctccagcttgcttttcttttcagtgtgggatttgcagtaaaccgatgggcgatctcctggatcagatcttcattcaccgtgacaccattcactgtgggaaatgctatgagaagctcttctaggtgggtgctggcactgcaaaggacaagtggccaagagactcattaaggagtagagatgcaccctggtctctcctggagtctcagccccagacacagctatctttcttggctcttccttatgttcagggggccttgtgtcctcatgtccctatgccttgtgatactttgagatcttaggtggcatggacaaaggccctcaatgaggacacttccaaatcacaccttccgtccagcacctgagccgagccctctagctaccctgggatactcgctcggccgctgttgttagccccattttgcaacaaggaaataaagatatagaaagggaggggacctggagaaacccaggtagaatcaggacctcaccccaggtctttggattcttgtccagggctctctgttcactgtcactcgcatagcttcagatcaggactgcatagccatggtgctcagtgaaacaagcctctgggccacattatgagaactgcctgaagatgtgtgtttgcatgctcatagccagtggaatttatcacggtgtctgagcacagagcagaatatatcccttgaaggcagtagcaaccaggctttccactagctccatgctgatggtcttctctccagaagacacaccttgagctaggtggtaactcctgatgactggagcagtcacccaccctgagggcctctagctgatgtgtttccagtctcatggctacttctgttttcttttagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatc

SEQ ID NO: 3990 - DNA, 5800 bp, human
atggactcggagtacgtcctatgctcttggaaaggccgactatggccagcaaaggttttgtgcacacgtgggacttcaccaaaaacgaagcctgaaaaggcgatttctctagaagttcaaatcctcgcagtagatgaaaaaatcaaggtgaaaagcacagacgtgaagaccccaactaagtttgagatggaagacattgccgcctctgcagcagcacagacgaagctcggtgccccactcagagagaagatggggtacagaggaacccttcgggtggccctggagattctgaaagagagaacaaatctgggtggaggaaggaaaccacatgaactagagagcaccacaccctctcagctttctcaaaaggtgcccgaaaagccagccagttctgtccctcgtgaagatgactggagatgcaaaggcgacctaaggaggagtcttgggaagagggaaaacccaagctcaccgacggtcccttcagagagtaagcgtgccctgcgggatgacaggtcgcaggagcccacagccattgcccctactccaggcgccctgcccggggacaggtcaggggcgcccagggccattgcccctactccaggagccatgctcagtggcaggtcacgggcacgcagggccattgcccctacaccaagcgccctgcgaggttacaggtcttgggcgcacagggccattgcccctaccccaggctgcctgtacagtgacaggtcacgggcgcacagggccattgcccctgctcgaggcaccaagcatggtggcaggtcatgggcatgcaggtccattgcccccaaaccaggctccctgtgcggggacaggtcacaggcgagcagggccattgaccctaccttaggcgccaggcgcggtggcaggtcacgggcccacagagccattgcccctactccaggctccctgtgcggcaacaggtcacgggcttgcggagccattgcccttactccaggtgtcctgtgcggtgtcaggtcacgggtgccaaaggacattacccctactccaggcgccctgcgaggttacaagtcatgggtgtgcagggccattgcccctactccaggtgccctgcgcggagacaggtcagcagcacgcacggccattgtccgtactccaggtgcccttggcagggacaggtcacgggcacgcagcgccattgcttctactccagggaccctgcagggaaacaggtcatctgtgtccaaggccattgcccctgctccaggtgccctgcgtggagacaggtcagcagcgcgcacggcctttgtccctactccaggcgcccttcacagggacaggtcacgggcccgcagcgccattgcttctactccagggaccctgcggggaaacacgtcatctgcgtgcaaggccattgcccctactccaggtgccctgcgaggttacaagtcatgggcgcgcagggccattgcacctaacccaggtgcctggcgcggttacaggtcaacgacaggcaccgccattgcacctaatctgggcgccctgggcggcaacaggtcagcggcacgcacggacattgcccctactccaggcgccctgcgaggttacaggccacggtcccgcagggccattgcctctactccagccaccctgcgtggtgaaaagtcacgggcgcacaccagccttgcccccgccccaggtgctttgcgcggtgacggttcacgagcacgcagggccattgtccctactacatgcccattgtgcgagatatggtcacgggtgggcataggcattgcccctattgcagatgccctgcgccgtgacaggccaccagtgcgcagggccattgctcctactccaggcgccctgcgctgtgacaggtcacgagagctcacagccattgatcctactccaggagctctgtgcagtgacaggtcaggggcaagcagggccattgcccccactccaggcactttgtgcagtgaaaggtcccgggtgcgcagggccattgcccctactccatgcgcactgtgcgggaaggggtcacaggtgggcatgggcgttgcccctactccaggtgcactgcgcagggacaggtcacaggcaggcagggccattgcacctactccatccgcactgttcagggttgggtcacgggtgggcacaggcattgcccttcctgcaggtgccctgcaccgtgacaggtcaccggtgcgcagggccgttgctcccactccaggcaccctgcactgtgacgggtcacgaaaatgcacggccactggttctactccaggagccctgcccggcgacaggtcaggggtgagcaaggccactgcccctgctccaggcgccttgtgcagtgaaaggtcccgcgcacgcaggagcattgcccctactccatgtttactgtgcggggacaggtcatgggtgggtatgggcattgcacctactccaggcgccctgcttggtggcaaatcaaggaaatgcagggccattgctattactcccggcgccctgcgtggtggcaggtcacagaaacgcagggtcgttgctcctactccagaggccctgcacggtgacgggtcatggacttatatggccattgctcctactccaggtgccctgcacggtgacagctcaccagcccacacgtccattattccctctccaggcgccctgcatggtgacgggccaccagcgcacatggcctttccttctactccaggcaccctgcatggtgatgcctctcacgcacacatggccattgctcctactccaggcacgatgcgcggtgacagctcaacagcgcgcacggccactgccccatctccaggggccctgcgaggtgacaggtcatggaaacgcaaggccattgcttctactccaggtgccctgcatggtaacaggtctgacaggtcacggaaatgcaaggccattgcttctactccaggcaccctgcacgttgagaggtcaccagcactcagggccattgttccaactccaggcaccctgggccgtgacagctcaccagggcgcacgtccattattccttctccaggcgccctgcatggtgacaggtcaccagcacacctggacattgcttctactccaggcgccctgcacggtgacagctctcaggcacacacggccattgctcctactccaggcaccatgcgcggtgacagctcaacagctcgcatggccattgccccatctgcaggggccctgagaggtgacaggtcatggaaacgcaaggccattgcttctactccaggtgccctgcgtggtaacaggtctgacaggtcacggaaacgcaaagccattgcttctactccaggtgccctgctcggtaacaggtctgacaggtcacggaaacgcaaggccattgctcctactccaggtgccccgcgcattgacaggtcaccagcatgcagggccattgctcctactccaggcgccctgggtgatgacagctcaacggccattgcccctactccagggaccccgcgaggtgacagttcgccagcaaacacggccattgcttctactccaggcgccctgcacggtgacacctctcagacacacaaggccattgctcctactccaggtgacctgggcggtggcagctcatcagcgcacaaggccatcgctccttctccaggtgccctgcatggtgacaggtcaccagcacacacggccattgcttctactccaggagccctgcatggtgacagctcccaggtgcacacgaccattgctccaactccaggcgccctgcgcgatgacaagtcatggaaacgcaaggccattgctcccactccaggcaccctgcactgtgacagctcacgaacgtgcaccgcctttgctcctactccaggcgccctgcatgctgacaggtcaccagcgcaccaggacattactcttacttcaggcgccctgcactgtgacagctcaagagaaagcagggccgttgctcctattctaggcgccctgcaccgtgtcggctctcaggcacacaaggctattgcttctactccaggccctctgcgcggtgacagctcaccatttcacacagccattgcacctatgccaggggccctgcatggtaccaggtcatggaaacgcgaagccatttctcagactccaggcaccctgtgtggtgacagctcaggagaacgcatggccattgctcctactccaggcgccctgcacagtgacaggtcacagacacatacggccatcgatcctactccaagtgtcctgcgcagtgacagctcaccagcgtgcatggccattgatcctactccaggtgccctgggcagggacaggtcacaggcgctcatggccattgctcctactccagttggaatgcaagcacatgtgttgcaaagcccccgagcctgccaggattccctgacgctttcgcggcatgtttgtgagaaaaaggggaagaaaagggcaaacgcctcaactcttatgtccctgcctcccacagtaacggaggagggtgcatctctgcctccaggtctcaccagccctgcaccccccgctctgaaggaagagacacaggacagccgcccgaagaaggccctggctgcatccccggaaagttctcccttctcggggaacattcaggaccccggagagggtgcctggaagccaggctgggcaggtatggctgcatcctctgggtcccgtcagcacaggctgccttcttcactccggcttgccaatagaaaaaggaagcgtccaggtccagattttcagaggagacctcaaggacctcagacgcctggtgacgctaagcttgctaatcctgtcaccaccattcaaagggctggcggtaaacaggatgggcagccccccagccttgcttttccacaggagccacatcccatcgaaaggggaacgatggtctggttcaaatttcaagatcatccgttttggccagcagtggtcaagagtgtcagcaacacagacaagaccgcgagggtgctcctgcttgaggccaacctgcaccatggaaagcggggcattcaagttcctcttcgaaggctgaagcacctggattgtaaggagaaagagaaactgctgaagagagcccagaaggcctacaagcaaagcgtcaactggtgcttctcactgatctcccactacagagaaggactggtccggggttctttccggggctctttcctggactattatgccgcagacatcagctacccaatcaggagagccatccaagagggagacctgcagattgactttccaaaggtgaattatggcgacctggaagactgggaggaggagacctccctgggcgggaagaggccttgcaagaaaatcctcccggaccggatgagggcctcttgggaccgagacaaccagaagctcgtggacttcatcgtgaggagaaagggggccgacccccaccttctggacatcttgcaaggcaggaagcagtccaggtggctgaccgcgtttctgaagccacacagggatttgcactgcattgaaacatacctggaggatgacgatcagttggaagtcgtggccaagcatttacaagaaatctacaagcaaattgacaaggccaggctgactctgataagggatgacaaagtcaattttgttctggaagttcttctgccggaagccatgatttgtaccatcgccgcacttgatgggctggattacaaggcagcagaggagaagtacctgcgaggaccacctgtgcattaccgggagaaagagctgtttgacagaaatatcttaaagaaggcaagaagagaaccagcaaccacccatacagcta

SEQ ID NO: 3991 - DNA, 6178 bp, human
tggactcggagtacgtcctatgctcttggaaaggccgactatggccagcaaaggttttgtgcacacgtgggacttcaccaaaaacgaagcctgaaaaggcgatttctctagaagttcaaatcctcgcagtagatgaaaaaatcaaggtgaaaagcacagacgtgaagaccccaactaagtttgagatggaagacattgccgcctctgcagcagcacagacgaagctcggtgccccactcagagagaagatggggtacagaggaacccttcgggtggccctggagattctgaaagagagaacaaatctgggtggaggaaggaaaccacatgaactagagagcaccacaccctctcagctttctcaaaaggtgcccgaaaagccagccagttctgtccctcgtgaagatgactggagatgcaaaggcgacctaaggaggagtcttgggaagagggaaaacccaagctcaccgacggtcccttcagagagtaagcgtgccctgcgggatgacaggtcgcaggagcccacagccattgcccctactccaggcgccctgcccggggacaggtcaggggcgcccagggccattgcccctactccaggagccatgctcagtggcaggtcacgggcacgcagggccattgcccctacaccaagcgccctgcgaggttacaggtcttgggcgcacagggccattgcccctaccccaggctgcctgtacagtgacaggtcacgggcgcacagggccattgcccctgctcgaggcaccaagcatggtggcaggtcatgggcatgcaggtccattgcccccaaaccaggctccctgtgcggggacaggtcacaggcgagcagggccattgaccctaccttaggcgccaggcgcggtggcaggtcacgggcccacagagccattgcccctactccaggctccctgtgcggcaacaggtcacgggcttgcggagccattgcccttactccaggtgtcctgtgcggtgtcaggtcacgggtgccaaaggacattacccctactccaggcgccctgcgaggttacaagtcatgggtgtgcagggccattgcccctactccaggtgccctgcgcggagacaggtcagcagcacgcacggccattgtccgtactccaggtgcccttggcagggacaggtcacgggcacgcagcgccattgcttctactccagggaccctgcagggaaacaggtcatctgtgtccaaggccattgcccctgctccaggtgccctgcgtggagacaggtcagcagcgcgcacggcctttgtccctactccaggcgcccttcacagggacaggtcacgggcccgcagcgccattgcttctactccagggaccctgcggggaaacacgtcatctgcgtgcaaggccattgcccctactccaggtgccctgcgaggttacaagtcatgggcgcgcagggccattgcacctaacccaggtgcctggcgcggttacaggtcaacgacaggcaccgccattgcacctaatctgggcgccctgggcggcaacaggtcagcggcacgcacggacattgcccctactccaggcgccctgcgaggttacaggtcatggacgcgcagggccattgcccctactccaggcactctgagcagttacaggtcacggtcccgcaggaccattgcctctactccagccaccctgcgtggtgaaaagtcacgggcgcacaccagccttgcccccaccccaggtgctttgcgcggtgacggttcacgagcacgcagggccattgtccctactacatgcccattgtgcgagatatagtcacgggtgggcataggcattgcccctattgcagatgccctgcgccgtgacaggtcaccagtgcgcagggccattgcccctactccaggcactctgagcggttacaggtcacgggcacgcacggccattgcccctactccaggcaccctgcgaggttacaggccacggtcccgcagggccattgcctctactccagccaccctgcgtggtgaaaagtcacgggcgcacaccagccttgcccccgccccaggtgctttgcgcggtgacggttcacgagcacgcagggccattgtccctactacatgcccattgtgcgagatatggtcacgggtgggcataggcattgcccctattgcagatgccctgcgccgtgacaggccaccagtgcgcagggccattgctcctactccaggcgccctgcgctgtgacaggtcacgagagctcacagccattgatcctactccaggagctctgtgcagtgacaggtcaggggcaagcagggccattgcccccactccaggcactttgtgcagtgaaaggtcccgggtgcgcagggccattgcccctactccatgcgcactgtgcgggaaggggtcacaggtgggcatgggcgttgcccctactccaggtgcactgcgcagggacaggtcacaggcaggcagggccattgcacctactccatccgcactgttcagggttgggtcacgggtgggcacaggcattgcccttcctgcaggtgccctgcaccgtgacaggtcaccggtgcgcagggccgttgctcccactccaggcaccctgcactgtgacgggtcacgaaaatgcacggccactggttctactccaggagccctgcccggcgacaggtcaggggtgagcaaggccactgcccctgctccaggcgccttgtgcagtgaaaggtcccgcgcacgcaggagcattgcccctactccatgtttactgtgcggggacaggtcatgggtgggtatgggcattgcacctactccaggcgccctgcttggtggcaaatcaaggaaatgcagggccattgctattactcccggcgccctgcgtggtggcaggtcacagaaacgcagggtcgttgctcctactccagaggccctgcacggtgacgggtcatggacttatatggccattgctcctactccaggtgccctgcacggtgacagctcaccagcccacacgtccattattccctctccaggcgccctgcatggtgacgggccaccagcgcacatggcctttccttctactccaggcaccctgcatggtgatgcctctcacgcacacatggccattgctcctactccaggcacgatgcgcggtgacagctcaacagcgcgcacggccactgccccatctccaggggccctgcgaggtgacaggtcatggaaacgcaaggccattgcttctactccaggtgccctgcatggtaacaggtctgacaggtcacggaaatgcaaggccattgcttctactccaggcaccctgcacgttgagaggtcaccagcactcagggccattgttccaactccaggcaccctgggccgtgacagctcaccagggcgcacgtccattattccttctccaggcgccctgcatggtgacaggtcaccagcacacctggacattgcttctactccaggcgccctgcacggtgacagctctcaggcacacacggccattgctcctactccaggcaccatgcgcggtgacagctcaacagctcgcatggccattgccccatctgcaggggccctgagaggtgacaggtcatggaaacgcaaggccattgcttctactccaggtgccctgcgtggtaacaggtctgacaggtcacggaaacgcaaagccattgcttctactccaggtgccctgctcggtaacaggtctgacaggtcacggaaacgcaaggccattgctcctactccaggtgccccgcgcattgacaggtcaccagcatgcagggccattgctcctactccaggcgccctgggtgatgacagctcaacggccattgcccctactccagggaccccgcgaggtgacagttcgccagcaaacacggccattgcttctactccaggcgccctgcacggtgacacctctcagacacacaaggccattgctcctactccaggtgacctgggcggtggcagctcatcagcgcacaaggccatcgctccttctccaggtgccctgcatggtgacaggtcaccagcacacacggccattgcttctactccaggagccctgcatggtgacagctcccaggtgcacacgaccattgctccaactccaggcgccctgcgcgatgacaagtcatggaaacgcaaggccattgctcccactccaggcaccctgcactgtgacagctcacgaacgtgcaccgcctttgctcctactccaggcgccctgcatgctgacaggtcaccagcgcaccaggacattactcttacttcaggcgccctgcactgtgacagctcaagagaaagcagggccgttgctcctattctaggcgccctgcaccgtgtcggctctcaggcacacaaggctattgcttctactccaggccctctgcgcggtgacagctcaccatttcacacagccattgcacctatgccaggggccctgcatggtaccaggtcatggaaacgcgaagccatttctcagactccaggcaccctgtgtggtgacagctcaggagaacgcatggccattgctcctactccaggcgccctgcacagtgacaggtcacagacacatacggccatcgatcctactccaagtgtcctgcgcagtgacagctcaccagcgtgcatggccattgatcctactccaggtgccctgggcagggacaggtcacaggcgctcatggccattgctcctactccagttggaatgcaagcacatgtgttgcaaagcccccgagcctgccaggattccctgacgctttcgcggcatgtttgtgagaaaaaggggaagaaaagggcaaacgcctcaactcttatgtccctgcctcccacagtaacggaggagggtgcatctctgcctccaggtctcaccagccctgcaccccccactctgaaggaagagacacaggacagccgcccgaagaaggccctggctgcatccccggaaagttctcccttctcggggaacattcaggaccccggagagggtgcctggaagccaggctgggcaggtatggctgcatcctctgggtcccgtcagcacaggctgccttcttcactccggcttgccaatagaaaaaggaagcgtccaggtccagattttcagaggagacctcaaggacctcagacgcctggtgacgctaagcttgctaatcctgtcaccaccattcaaagggctggcggtaaacaggatgggcagccccccagccttgcttttccacaggagccacatcccatcgaaaggggaacgatggtctggttcaaatttcaagatcatccgttttggccagcagtggtcaagagtgtcagcaacacagacaagaccgcgagggtgctcctgcttgaggccaacctgcaccatggaaagcggggcattcaagttcctcttcgaaggctgaagcacctggattgtaaggagaaagagaaactgctgaagagagcccagaaggcctacaagcaaagcgtcaactggtgcttctcactgatctcccactacagagaaggactggtccggggttctttccggggctctttcctggactattatgccgcagacatcagctacccaatcaggagagccatccaagagggagacctgcagattgactttccaaaggtgaattatggcgacctggaagactgggaggaggagacctccctgggcgggaagaggccttgcaagaaaatcctcccggaccggatgagggcctcttgggaccgagacaaccagaagctcgtggacttcatcgtgaggagaaagggggccgacccccaccttctggacatcttgcaaggcaggaagcagtccaggtggctgaccgcgtttctgaagccacacagggatttgcactgcattgaaacatacctggaggatgacgatcagttggaagtcgtggccaagcatttacaagaaatctacaagcaaattgacaaggccaggctgactctgataagggatgacaaagtcaattttgttctggaagttcttctgccggaagccatgatttgtaccatcgccgcacttgatgggctggattacaaggcagcagaggagaagtacctgcgaggaccacctgtgcattaccgggagaaagagctgtttgacagaaatatcttaaagaaggcaagaagagaaccagcaaccacccatacagctaa

SEQ ID NO: 3992 - DNA, 47850 bp, human
gagcatgcgcctgggacttgcaatgatgaaacagggccattggcaaagctggggtaccagtcacccagccacgctctagggtggtagccaagaagacggaccccgagcgggaggcagagagacaagaggtggatgaagcagagcaaggtcagaagggagagggagaggaaggggtgagggaaaggtgcctggagggcggcgagacgaggcagaagcctgacagggaccaagggggccgcagggtggcgatgaaggggcgtggatcagcagcctacagagagcaccggggaaatctgtggacaccctcgcggcactggggacagcaggaccagggcttgggacagcggaggcagcagagccaggggcatctctgggttgctgaggaggcagcttgaagccagccctacctggagaggggaggcgccaggcgcaggctgactagttggcgggctggggtggtgggccgtccgcacgtctatctgtccggtgtgtccggcggaccgaaagcagctactcactcctgggcagtttgtggagagagggagacagaggcggcgggcgggaggctaaaggctgggcaggcgggccgacggggaggggacagcggggagagggcggggagggaggaaaggagggagggggctggtggggcggagagggcgggcgagcaggagggggcaggcttcccggcccccctggcagcttcaaagggagcaattttcttgtagacggctggactagctgagcccccgccccctcgcccccaccacctccccccccctcccccgcctggggcagacagcaaaggaacggacacactcgcactcactcaaacaaggacccagagagtcaaactttccactgcccagatggggacactgaggtgctggctggcatctcgccaggcagaggaaagagagatggaagaaagacgagggggaggcggccttgggctgctaggcccatgagtggcccctggaatttggtcctgagcctgccaggaacctgcttgggcctaagcaaggaggtggtttctccaggatcagagaggtagctgttgtggatttctggaaggacttcatgtaggctcctggcgccctgtgccctcccttccactccagactttcttcccttaaaaagagggcccgatccggctggtggtggcaggacggggcagggggctccccagcttgcctgccctgaactgattcagagacgaaggatccagcgagtcagtcttcttgctcaatccctgcaggtcccctcggacatgagaaccactctgtgggtggccacttcctctgggctcagccctgtgctggtcacttacgggggctaaccgggttaccccaccaagactcagccgcttcctgagggcccaaatgagtccagttcctccagtggctagagcccaggtccttagtacgacactgcccccctgtcccgtagtgtccccttcttccctcagcaagagcagctcctgagacacaggggtaagagtttagatggagtgagaaacagatctgcaatagaactgggggccaagagtgcggaagaccaaaagagaaaattgcatattgagagaaaaagctcgaaggggcagagagggagagaggggtggctagagagaggcggcatccaatggagagaggacaacgtcgagggctgagggtcttcaacccctggcagtgccatcactcaaccggggggtggggtctgggaggtcccaggccagggaggatgctcccaggggagctctacctgggggcatggcagggcacagacccccttcctgttcaccagcggcagcccagggcctggctaggacctgggacgcatggcaccttgaccaaactgtggtacctgcctgcaagaagcttctagactgggccagggagaagagagacgtgggaaaccaggggccaggctggtaaccctggttctctcttgatttcatggttggaatgaggagattggagaccacatatgccctttccagacaaaggagatggcttgtctttcggcaggtttgtgtgttttaccttttgcccagcctcagcgtccgactcttggcagcctggtctcatctctgtcccaccctctttccctcccccactgccaactcattcgtggagaaatatgtcggtagagagcgggacaggcagcgaagcctgactagcagtctgggtggagagagaagcatttggaaacattccgctcagtgacagcagccagtcgcaaaaggccgcagagcctctggttccattcatttgaaatgtccacactaggctcatctgtggggacagaaagcggatttgtgggcagtgggtgctagaggggtggtacctaaaggtatgggttttctttttgaggtgatgaaaatgttctacaatcgactgagtgatggttgcacagttctgtgaatagaccatataaaagcccttgccttgtacgtgctcaatgcgcaaatcgtgtggtaagcacagccactctcagtaaagccgtttcagaaaaaaggagaaacccactcaaggcatgcctgctgcccgaggtgctggtacccagtaccttcctgcactgcttggggactgagaacccaggagctgtcactcagggcctcagcctccaggagtcccagtgggggtgaaacagctctgaataccgtgggggcgcagggccatgcacagtgccagaggctcgggagggctacctggaggaggtgacctggagcagaccagtagggaagagggaagttgccggtggaaggaagagcacacgtgcgggggggtgtggggagacacaggggagccaggcggcgctgcagtccggccctgcaccgacctcaccctcaggtctcagccaggcatgttcctggatgggggcttggaagtggcgatgaggcgacaccctgcttgggggagacacattatgcatgcaccttgcagctcttacctgaagttgggggctgcttctgggggcaatactcatataaatacggtccttgtacctggaaggtttttgtatctgtggtttgcagtctgcaataagccataactgcacgcccggcccggggcccaccgagtcactcggcctggctagggcccactgagtcactcggcctggccctctaatttgggggccactcccagaccagacaggcagtacctcagtcctagggcctcccccttctgctccccctcccactcccccctcctcaggcctgggctctctctgcagcgcagaaggtactttgatcccagctgaagtgctctaggaacagtgcttccttgctagcgagcagagctggcgggcgggcagccttctgcccttctggcctctcagggctgggaggaggcagggggaagcagggggaaggcaggcacggggggcgcaaggcaggaaggaagagcaggcatttcctgaggccctcagggatcctggggaggaggcggacacacagctgtcttagctccccaggaacccgcggcagacagggagcaggaggtgggggaagcagaacccggccccttccagcacggcctgtatgtgaccctgggatgccactgcacaggccccctaggccctagctgggatgcttcccccaaaaggctgtagagggccagaaggtcctgctggcaccagccttgccttgcatcccagcccgggagaccccttctcctgccggatggagccgagagctcagctctctccacctgacaaggagcccaaccccctcagctgcgtggggagggcagccctgggcagcctgctcaggcttccctgcagggaaagctgtcctgccctggcagttgcccctgcacagggccccaggccacactgtggtctccctgctctgagcctaactctggtctaggcctcatcaggcagctgccaccccagcctgcctgggacagcgcccaggacggctgctggaaggtagcaggtggggcggcagccatgggacggaaggatgggacaaggacatgtctgagggagggagagggccacggaagaagggggctgggaggaggggaggcagggcgcagggatctaagccagctgccatctccttggccagtgtggggaagaggacctggagtcagctgcagcctgtcccccacagctggcttgcagctgtttgtgccctgtcttcaaagctacagcagggaggcccaggagagaagcagggtgggggcgcccagagggcaggctgtgagctctctggtcccatttgggcatgaaatactggcgggtggtgtgagtcctagagggcagagcctaggagcctgggaggtggcctcttatgcaggggtcccctacagaggtgggctgcttgttccatgattctccagggtctggaaacaagaactgggccccgggctccctctgccctgctccccaagtgtgtccagtgggccctcttctctgtgggtggctgcttctcgaacccttctgcctggacacgaacctccccacccttccattctgatggtgtgaacagaagggcccatgcctgtcttggggatgggacggagagacagagggagagccgacagagctgggacagagagctgcagtgggcgaggcagacaggcagcactcccaccccctggaccatcagcaagaccctcaagaagcaaggaggtgacaagtgctatgtgcccgtacaagactggggggcagggagagcttctagaggaggaggcagtgccctgaggccgcctgtcattggggagtagctcttgcagagcctcagcttccagggcaaattcccatccagggacctgtcactcacacatcgaggttacctcttgagcaagagcggccccaagtttatggccttgagtgggcctcactccgagcctgtgggcttcgtccattcccagtgtcggcaccctcgggggcagacaccagtgggcaaccccatcaccactcaagggtctctggatgacctgcggcctcgaagcggcatgaagctcatgctcagcggggacctctgggttcagggggtggggcggttatggaggaggcttgtgccaacatgccctggggcagctgagctggtgctgagtgagcggagcctccactctctggaagcttcccagtgctggatggccgaggtgtggctggtgaaagctggcactctccatgccaggagctttttttgaccttcctctgaggacataatcacacagcatctctcccctccgggccaccagggctgtaatttcagggcctgcgtgggggctccggggaggcctggcctgcgtctagctatctttagagaggcatggtctggggcgtggccagaggatggaagatgggttgccttggaagccgaagtccgggagccagaggccaggggcaccctaggacccctgtggtcttccctcagggaggccagaggccagagcccaggagcagcaccaggaggctctggtgggagtgggaaggggctgggccctgtcccgagccctgacttcagctcggagcaatctttggcccagatgctcagaagatggggtgggatagcacctggcctgagggccagacagcttagcatctcccagactgtccccgtgtggccatggtggcagctattatgggggtagggggtggagggtggcacagtaggcgagatgcttgtgaacgggggtgttaggctggagggagggctcagaacagaatgtggcgaaggcgaggggtgggcccgtggggggccagtgaggggcagttggagaagaatttggaagctgatgggcagttttctgggactgcagctggcagaggcggagcagaggtgcaaggtcccacccaggtctcaggccggagacacaggcccagccccagggagggcacggctccttgcccccattctccacccttctgaattgtgagctgtccccactgtccttactctcagtcccaccccatcacctcagcatccccatccccatctgaggactgatgagtgcctcccttctgaccctagtcacacctatcctgttgccatcactattgcaattgtcactgcaatgtcccctcagatgcccagcattttggggtcaccgattggctgcacccactgctgtaccctcagatggagccagcagccaccccgaagaggaggagcacagtaatcacagagaaggtgggagtgagtgggtgtcggagcgtggcccgtgctgaaggaggggcaggtgcagggccacggctgggctgcccttgctctcgggctggggctctgtctagagattccctcgtggtgccagctagactctgaccagccctcccacagccccaagaagtgaagtccccagccctgagctcctggccctctggggaatcccctgggctggaaacagcacccttgtcccagtcatgagggggaaataaaggcccagtccctttgccccatctcggagtgcaggttggctgaggcctggccgggcctgtggggtcggctgcagcccagcttctcccttggccaggtgacgaccccaagagcccgcaggtacatttcccaagtgcgagtcccctgcctccccagttgggaaggtcacaggaggattagcccccgccgaggctctgagaagtggaattaaccacctgtgggtggcctgcctggcccctgccctcctgcagctgaggggcccctccccttctcctccccacctgcctcatctgtcgggcagtggtaagaagtgggcaggagatgtcggggactcacccagcctgcacttcctgtgcctcccgggcctgacctctgggactgcgagaaggtgggggctgcagggtgacctgagcaagaggcgcagggaccggggcggccaggcagggaggaggggtcgtgagagctgggagagtggggccagcgcctcgtgggctgctgacctctgacccagcccaaacaggaagtgccatatctgaggggccagctggaggagaaggaatgccgggacgagtccaaagcaaacagcccacagcttcccaggcctctcccgcccccgccacagtctggcgctttctccactgagaactcaggggtgggggcaggggtagggggaatcggccatggaatgggagcaaggcgagactcagttcccaggccccggtcctaggcagagctgatggcggggcgaggtccttgcagcggacaccctgtgcccttcctcctctgctccacccacatccagcagcccggaggcagaggggaaggagaggggcggccccgccagggtagagaaaggccggggaatgggaaggccgtgcccagatcgagatgggggtgctgaggtgatggggtgggatagcgagggccagaggggcatgctggaggctcacaagttagagggacagaggacagggacggagccatgcgctccttggggctgggctgtgtctctgctgggccctctcctgcggcatccttcatgcctgtcacctggctgtctctgtgagccccatcccagggcagtggctgtcgtgttccctgcggttgtgaccctttgtccctatcccttcctggcacagggcctggtggcctagagagctgtggaggctgtcccaggaaacccatccggttcccaggggccccctcactcaggcaggccaacggggcaatggcctcagtggccttcgagggctccgcagacccagtgtctccaccagcatatctggccagtctgtcttcagggctcggcagggctgagttgtcacttcccagggactcctggcacatggggaggtcaacatggagggccggcctcgctcaggcagacagtcagaaactctggccaggggtggtccttgcccagtgctcagggcggggcttggctttgcacagaccacgtgctcactccccacccttccctggcaccaggtcagataggggcacagcctggtctcacagcaagccagccatacatctctgggcaagttactcatctgtgagctgagggtggggccctggggacctctcttgcaggtgggtgtgcatgttgggggctgggatgagggttctggggccaggaatgggggggaggtgtcaagggagaggcaaaggggcttcccgagaggtgccactgtgcggtggtcaccagcccctgccccaggcctcagtgcaggtgtgggtggctctaggaccaatggcaggtgccctgaacctccacaccctcctgctctgccagccaagcccacctctttgggtccaggcccaggatagggatgagacggatcaggtgcagatgctgccccaagcaagggtggggagcctggcctcttgatggcttgggaccgagcaaggacttcaggaccctggtgaggcagggtgggggtggggaggctctcagagaagctgtgggacccaagccctctgaatctctttgctgacagtctcaggtgcagcccaggaaccgcacggacatgggagagccaggacatgcagcgtagctcctggagggagggaggctggctggtgagcctgcccaagctgcatttattatgttcaagtacaaaccagtgccacctttcgcccctgggccatttgctaagtgaagcggcctcaccagtcaatgggaagtgggtgcactggaagcagtggggtcttctagacctttctcccagtggtgcaaaggccaagcacacctcagcctgcccctccaccccctcgagaagcagagtgtgtgctggaggaaggcggcaggcaggactaggagccctcctccccccgccgctggggctggaggaccacgctgtgataggctcgggtgcaggagaaggcagtgggcgggatgcggcgccggtcaatgaggttgttctccaggtgtgtggaggtaaggttggagtcctgagccacgcgcatgtcacagatggaattcaagggcacttgtctgcaagggaggggtggggcagagcaggggagagaagaccccggaaagacggggtaggcatcattcaagaagagacagagacccctgccctgagagaagcagtaagaccgagccacagaatcggaactgtggaggagtgatggcgggcttcagagaccactgcggcctcctggccccctcccaactcgaggctcagtgccaggcctccagccccagcccttgtcgctccaggctggagccctgccagcatccggccactgcctgcccttggctttccaggcctgccagccactgggcacagcctccatcatggcaaccaagatgggtggatggctggattgggggaggatggatgagccccgactcctgccctcggcctctgcggcctgtgggtaaggagcccaaaggccagcctgtcctagcccagccagaaggcagggcctcctggcctcagggtacctcttcctctgtgtgctggcagggtgcgggggtggagacggccacaggtgtggggtcgaggaggggggccctacctgatcctgttgtggctcaggcccagcacctgcagtcccttgaggcccaggaggccgcgtgggatggcctgcacctggttatgatccaggagcagctccgccagcgaggcgcgcaggcccaggaaggacacgctgtggatgccgtcagcctgcagcctgttgtgggacaggtgcaggaactctaggcctggcttcatgtgcgcgaacgcgtagccagggatgcgctcgatgtggtcgtggtgcagcgtcaggcgcctcaggccccgcggcaggaagcggggcacgtgcaccagccggttgtaggacaggtcaagggtctccagcttcctgtggggcggggcacacaggggcagagggagctgacggttggcaactcctagaggggagttccaggggctgcagccccacactcccaagacgagcgtggggattcactccgagatggcagccgcaacccgaactctcaacagctgggactctggcaactcctgtgtgagtcaggccaggccctgtgtgggtttatgtcctcctctgtcccccaaggcttagggattagaggatctgggtgggggccttccttgctccctgcagggctagcgatacctgctgtcattgtggagactgaggaactgtcctcccactcacttccttccctccaggtgttgcctcagggtctcctgtctcctaatcctgacacctgacagagctcagagggtgacgcctaaaatctaggggaaaagtggggcaggggagctctctgcccctgccggtcctcggcctcgaagccctctcctctgtcccttccactctcctgccctcatcctgcctctcccagtcttatcctcagatgtgtggaagctagatgtgtggggagaaaaagatcaggctccatgagggttagggctgggggaccctgggaggtcacccagccctcgctgtccgatagtggagttcaggctgccaccttcagctgggagcccccggtcgctccatggtggacacctgactccttgaggccctgaccccagcagcaggaagccctggtccctgtggccatgcaggtgtgcaagggcagagggtggtgaggcttctggaatgggtaagaacatggagagagggagcagggaaggcttctcttggcaacaccctcagcccccgtggctagggtcagccttttgggctgctcctgtgcctctcggtcccctccttttccaccagcccgaaaagagatgggtggcgccagagtccaggagaggccgcggctgaggcagctggggcttgactggccgccagccccctgcccaggcctcgtggcgggagtggaatagcggccgggcagcccctcccaggctgctgtctgctttcctttgcccccttggcaagtgggggagaggaaagaggaataattaaacccaaacgtcctggtaactttttcctggaacgcaaggatgcagggcgggaggctctggtccctggaatggcgggtcagactgtctgtcgacccccgcctccctccccactgcggccccaccctgccttggtggtcatcaggccctcctcagcctcccgcctggcacccagcctcccccagccctccccgctgttcccaggaccgtgtcctgactccctagcccgactcctacagccctacagcatctggttgccgtgagtggcctgtgtgccagcatctctacctagctgtcccaaccagatccagggaattgcccttgacttttcttggaatgaggtgaagagtggcccccagaacctatgtccaccagaacctgtgaacgtggccttatttgcagatgtaaggattgcaggggaggatgtcgagctgagctcatctgggttccccggctgggccccgctcccatgacaggtgtgcttttgagggacagaagagagaagacgagacagagggagacacgcaggggagacggccacgtgcagccacaagcccaggaacacctggagccccctgaagctgggagaggcaggaaggatcccatcctaggcctccggagggagcacggccccctaacatctagattgcagacttctggcgtctgcaactgagagaggttatttctgttgtttgaagccacccagcttgtggcactcagtgatggcagccccaggacatgcatgcacttctcttccccactttcctgtgcccccagcccttccgcgctgcttcctgcccctgtcacctcctaactgcacccatcgtcgggccagctctccccaccactgctgccctccatccaggcccgtggcacctcccaggtgagcttcctgggggccggcagggcaggcctaggcacgggagggcaaaggggattctgctgggtgggagggacagagggaaggccttgcaagcttgcaagcaatatcttggaagagtctgtggtgactgagggcccaggctaacctaagcagggagggaggtgaccccagtgacccaccgaagaccaggcccaaggaacaagtcctcccctggagccccctgcctcctggccctctctggggctccgtggctcagcattgccctctccgccttccccacctgcctctcggggctgctctgggccatccttgctctctgcctccgaatgcccattggggcgaagctctgggactgccactcacgggagatgaatccaggctcggggtgccagccagtgctcctgaagccagttgtggctgagcaccagcacgctgaggctgtggatgtggctcagtgcgccctccgccacctcctcgatgaggttggtgcccaggtgcagctcctagggtcggggtcaggggttggggtgaggggcccacctgccagttgttggccacctggtcaggctccaactctggctgtgcccattctctgccggcactgcctccttccacccagccatgtctgtgcaactcaggtgccagtctctgccctgagcagtcaggcccatggcaggggtggattttcaggggactgtatggtccagagagagggtatgggccttactcagagaacccagagggtgcagagccatccaggaggtcccactgtgggcttctggaaggttaggtcaagctgaggagaggcctgaagcctcgtgagtttcagcgcacagatccccctatgggctgctccacgccccctcagcagaagcagaggcagggttgtttgatggtaacaatgttgcctccccatcctgggggctccagctcaactgcagggaggacggcaggccgcgtgggatggcccgcagccggttccggtccagcctcagatagagcaggctgcagaggggctggaaggccagggggagatgtccctgtcacgcagctggttcccttccacctccagcgtcaacagctggctgagccctgcaggcgggcagaggggtgcggtgagccattgcagagctgctcgcagtagctctagaacccctgcctgcccctagaggccagggccccttacccaggctggcagtctcctctgcgttccagccaggctgccctgggcactctcccgagtgtgcctcctagagggcagacccaccccttgccagcccctgtcctgggggtggggcacctgcccaggcctgccccctcggtccctgcccccggaactcgcccgcaccacggaagctgctgccttgcaagccctgcaggaggttgtcgttgagtttgagctcctgcagggaggcaggtagggccgggactgtggtcagcgagttcccaaccaggttcagccgcttcagccgcatcagattctgggaggtcatggggaataggtgggctggggttgggggcctgctggtcggggcacaggccttcctgggcatggctttgggcccatcctgaccaagggcactctgttggtggcatcatggcttcctagttcccactgaatccaggcctgtctgggaaggtttctgtttgctcctatacagggcctgcaagcctgtgctgctccccctactcccagcgatggaacacgtcacaccaaattgtggaagcccaccatgctggctgctctctgcagtgcctcctccaggccttaccccctaagcagctccaccctgcagtgagtggatgcctcaggtcacctgggacctgccagccccagccccagccccggcccccgagaagaggtgaatgggccacagcataccttgaaggcatgggggtgcaggcctcggggatccagcttgttcttgctgagatccagccactccaggttgggcagccccaggaacgtgtgggctgggatcttggcaatttcattctctgtgcgcacatggggcagccatattctctgccccctgcccgctgccactctgtacctcccacaccagacagggctgctcaggggagccagggtgggagcccaggtctcagccttctcacccctgctgcaggggtgggtgtggggcgaggaggccacccacctgccaggtagagtgtggtcagaccagggtgggtcagggcagggacatgcttcatcttgacattgccacaggcgatgactgcctgggccaggaggcacgaggccggcagagagggcatggcctgctgggtggtgcccaggtctgcgtgcctgtgcctgtgcccatgtgtgcttcctggtcttttccacccatggcctggggtcttggaggtgctgccgccgccaccctggcctcggctgcggtccttctgtgggcgccggatcctcagcccaggttgatgggaggtccctggaggaagagagacagcccctgctgggtcacaagcaacaggggccctactgaggaacaggggcttgcccgaggctcccagggcctgccagtgactcagccagcctgggttggagcgacaggttactgggacccctccccttggcaccaagggcaaaggcccaaatgggggctctgaggctggggaggggacgtgactttggagggcttccctcccaccccacacacgagggcacttggcttggaaacaccgggaacggggcagtgcctgggtggccaaactcatgcgtggtcctgtcagccccagcaggccccaggccccacctgaaggccgcctgtcctggccagttctcacctttggggggcctcctgggtttcaggccccttcccttgtcttcccggcctcctgtcctctggccctggtcctcctcggtgactgctgccccctcttgagcttgagggtccctgccggcctgccagggcctcagcttcaaggcctcgggcttccctgccccagccctcatggcagctgtggcctggggctgagcccactcagcgaccaggcccttgttgtgaccctgctcctgctccaaggtcactgggggtgactccttcctcagggccagccctggcctgggaagcgctttccagccagtggagggggactgggtgggggttccttgagctccctgcttcggggtgggctgatcccgcaactggtccagcttcccagcctcaggcttgtctgggtggccgatgccagggatgggctgcagctgacctgcggaaggagccagtgtgggctgggggccttgcctcctttccccaaggggctgtcagctgctagaaagcccatcgcccttcctctttacccaggcctccccccgccccgcctttcccttacctcctgaggagcactggcgagagaacagagtgtccccaccgtcagcagcaggccaccagcccctggggccagtaacccagagtacctctcagaacttacacagctcctcactgctggggaggggggtgggtggcgctctaggcccattagggctaaggggctgggcctataggttaggcccaggggttggaccggtggttgggcccagggagcttcagcagccctgggtagaaagccttgggctgctcaagggaccttgggtcccacctcccctcacttccccagtgtgtcccaagggtggggggtagggcgtttccccagcatcccctttgccccatacccattagtgagcaaggacttcacacgtgcttcctagggacagcttctggggagatgaaggggtcgctgcgacctggcacaatttgcttttagaagtgaaagccccagtgtctgctacagggggtttgttggggattaggcaagcccaggggccacctcaaggggtctgtgagccactttggaggaatgttgataaccccaatgcctcctgtcctctatggagcagctcctccttaaccagggccaaccatggggggcaccgctctgtctgcaggggtgaggggcagacccacccacctggcccctcccgccctacccccaagcctggggcagggccaccaagtgtggctacaaccactggcctataagacaaaggccacactcatagcccatgtcctcgggcccctcaagcccctctctgccagcaaccccacttcacccccaagccctatactcccagccacctgagattcttcctgtctcaggaggcactggggcagccagagcaactcctccccagcacaccccagcccgctctcagcctcactgtagcgcccgctcctaggaaggcctcttccctccctcgcccctagagtctgcgcacacccctcgccctccagggagggctctctcagggccatgggccctttgcagccctgcctgagtacccaaagtgggcctgaggtggacagcctgcggcagtcttcttcctgctggtgccagctactcaccgtcgggggcccctggtgggctgggcagcagctgcagggtagccaagcccatgggggttggtggggcccctcctgagcagctccccgcccacagtgccaggatggggagcagcacactcctcttggctgccatggagggaaggagagctgggagaggcacggtggtggccacggcaggacgatggcggacggcacaagttggtcttgctccctgagctcctggccctggctgcggcacttggagtcttccctgcccaccccagcccttccctgggaaggccccccttctgtcgagcaaacgcctcccccgaccttgcccccaactccccacaacgtgcactgctcccacctgaagagaaagacagattgccctttcctcagaccggacggtcctgcccttttgctgtgaggcccgcattgattctccgctggctctggcccagtggcctccatgaatggggcttctgtctcacacgtggcaggcctgagaggcccaccacagagcgggtcggccaccgcaggctgctgggccctgcatccatggctgcgaaaggagagggggtgggtgccaaggccgtgggcttctgccgtgggcagcactgtggaggcctccgggttccagaggaaatagaatctgtgggcacagtgcaggcggcgagggtatgcctcccgtgcctgagaccccagtgctgcttgggcatgggtgtgcctcgggctgggctggctcctggttcctctgcttgccctccaggtctctaccttctcctctgtaaaatggggtagggggcagagttgacgttctgtggctgtcccgaccccctacataggagcatgggtgttccaggcactgcctgggtgaagccatgtcacaggtcccccccagacttcttggccaacagtctgggatctctgatgtgcctaggctgcacgcatccttttggtcagaggggcacctgtgggtcaggatgacatgaggtggaaaataggctgggctcgatgaggggactgctgggtggggccagaggggcgtgtggtggagtgaggggcaaataagggggtgtctggctccagttcctagagcccgccaccctcagagggctgccggaagtccctgctccaactggggtgtccctgcagccccaaccccgcgttctgctgtgggagccagggtttgtgggagcaggcaggcgggggctggcagagaggactgatctcaccgctggctcggctcttcagggccagtattgaggaagcttttcctacagccctgtccagcgttgacttaggtttggaagcgatcttaagaaatgagttaattgtgggcaaggcttgggtggaggggagaagggaagcagtggaggaggggcaggggccggcaagggccatcaggcaggagtctccatcctggggcaatgaggcaatgtgtgagatccagaggggtgcagggctggtcaaggtggggaggaggcctggcaactgggtcttcactgggctccttgaggagctgccgctccagctaacagtcccgtaggagccacatggggtcctctgctatatccagggtaccctcgccatccagggctctggtttctgacctgaatttggaccctgccacgtacagaccagaaacagggaccatctagggagtcagcaaatgcctctggagtcagggatgaggccaccatctccttgtgcgtcctgtgggtgacacaggatggctgtgggccagtgtcctgcctgggggcagctgccgaagctgggacagggtagcactggggcacggcagacttgaagtatgctgccaagactaagtgaagcttgccccaggatcctgcaagacagagcacagtcgaccccccattttacagagaaggaacagagaaggagtggggctcacccaagtctcgataccagaggccagtcctcctgcctcctggtccaggcatcgcctgagaaacggggtaggtccctgcctgagctgagcctagcacctggggtcgggagactggacggtgatgggaaccccggctccgcccctccccctgcctggggatggattctggaatcctggccccctacccatttcccctgtttgcgccgctccccaggcgctgactaaacatcctgccatctggttcccattagctgggctgggggtgggggaagcctgctcccaggtttctctggcacagccagcctggaggagggagggactccgctcctacccacctaggcaggaaggggtgaggcctggggtgctctcagttcccagctcccatggaggcctggcctcgctgcccttcccctggtcgggagcctggtggctgacctgggtgggcccctggggagtggtactcctgctgcccactctgtccagtcccagggcacccggccattgtggggaccttgaaggaacccccatggagcagagccagccttcaggggctcagcagagccagaggctcccggcaagtttctgccttgccctcccccccgcccaagagctcactgacggacttgtgctgagacaggcaggccccaagccaacagtaatcccgagcccggtgtctggagcagagggtgggagggctgttgggattttccaggaaccagggatgcagcccgagggttgctggaaagagctttgggctcccagttctgccatggacggactggccatgtgacatcaggaacaagcttccctccctcctcagtgccccagtcttctcatttcagtatggtggaaacaggctccttagaaagttctagaatctgagagccagaaggcgcctagagaagctggattacatgatcaaggtcgcttctagttgtacaatcccaggattctaaggtcaaggaagggactcctgtcccttgtcctcctcccccttcccttccatgtagcccacgcttcacacactcatgcacacacataccctctacaagctgggactcagattggtagcctggaggatgccaaagcaatgctgtttgtccctcaaggctgtcatcaacgaggactggacagtggattctttgctcactgacaggggatcaggtgaggaccgtgagaaagtgacatttgggcagaggcatgagtgaagaggccatggccatgcaaaaagccacagaaagagccctccgaaaaagagggatggccagtgcagaggccccaggtgagaaagggttgggcccaatttgagcattggcaatgacagcaatgtggtggagcaggctgagtgagccgtgggaaggtgtctgtggcggtgggctggcttgcctttgtccttgaaagaatcagggagccaccttggactgctaagcagaggagtcacaggatccggcccccctcaggctgtggggtggagcacgagcagatgtactgggggcataagggtaggaggtgggagccaccgtgtggcagctgagcccgccaggggccaggtgatagtggctggccaagggtggaggcggggttgcgaggaggagcgggtggggtcaggagcatttgggcctcagggtcaaggtctgggggctgttcctgctctcctgctctcctgctctctgcaggagcacctactacgtgcctgtccttttcccagggcccagggcagccagagacacagccttggggtgacccccagagaaaaggaacaggcccattcttgagctttccacatgttgtctgagtgaaaacgacagcagtgtgtggcacatgggtggcattctctggggacatgcgcctgcagctatcttatatgtcagtaacaatatggggcctttcccccttaaagcttggagaagaaaaaagccccattttccatgccctcttcctgttgcccgcaactcttccctagaggaaacccatcttattttaatgctactgaaacctcagaggatctggtcccaattaaatgacttttcttgcagacgctttggtgagcactaaatgcttgagacctggtgatcctgagcgagagagcctgctgcggggtgggggtggagaagaaaaaggagggaaggggaacacaggaccccaaatgggacaagggtggctgcggatggggtggagggtgccagtggagggggactgcagagggtggcacgcagcagggaccagcccatagggagcagggccgtggtcgggatgggggcagaataggggccagtttcccaccctctttgcccgtgtgaaattcgagttcattcccgcccatagcgtggcttcgctggactccgtgtgaaagcggccccgccccatcccctccggtgggcttcgaggacctcggcagggaacggaggttgggcagaagctggagctcaggcccggccggggagctcgggcaaagcaagaaggcgaggcgggcgccccctcccccggccggccctccgagcgggcacgttcgtgttcccgtcctggcgccctcgcttcccgctccagacgcatgtgactcagccccgccggccttgccaagccgtctagacccgagcgtctccccgcggagggggcgatcccgcccgccgccgtttcctttgccgccgcctgcgcggctgcgccccgcgcacgtgcagcagcgctcgcccccgcccgccacctcccgcgagccgcgtgcacgcgcagccactcgcccatcccgcgccagcgcccgcgcccccgcccccgcccccgcccccgcccccgcctctcccgttgcgtccactgcaaacaggcagttcgagggcagaagcgggaaacccaaaggtccccagggccccagaccatccctcccatttttggggcccggggcaggaggacaaagatggaccgctgagccactgcctccctgccagccagactctgtccacaccccctacaactgcctctggcctcagagcaagggtcgccctaggtcgcaggccctgccctcttgcaggagcctgtggcctgggggacagggcggggtaggtgatggtagcacctccaggcccactggaggcgatggtgatggcgatggtggtaccatgctgactgcgctgcggaatgtgctcttgcaggagctggtggcctgggggcaggatggggcaggtgagggcccctcaactgcaggaggtgagggtggggccctaaagcaggaggcccagcatagggactagaagtgacaggaagaggaagccaaggtcccaaggcagcctctccattctcatatgccagtagactccaaagatgaacacggaggcctaggaggagaacgttgtagagttgagtcttcaggcagctcccaggttgacagtgtggtccctccagagttagggccacaggccgcagggctcccccaagcttacagccacttccttgtctcatttgcaaggcccccacccctgctttcgtgttctccatcccttcccccatctgcaaggatagggctgggtttcgggtgggctcctggctggtgcagatggcgtgggctgcccgcaagacctgggtactgagcctgcatgccaggatgcagggtggatgggtgaccaacagctcagcctggcagcttagcagcagagaggtcccaggaagacagggaggagatgaggagaaggaagagggagaggaggacaggacggggagggaggggaggggaggcagaggcagccccctggctttgccttgcctgcggagagcctcacactcagaccgtcctgagcctgacctcattactctgtcacatttctccctcaaacccaatgccagggctcaccacttgcttctcgcatgggtgtgatcagcttctcatcttagacctgaactctccccaaaacacacacacgcacacacacgcacacacttgccttgtcttcaacagcttgcatttggtactctccacccttactgaggaactttagtggccaggggtggggggtgatggaggacacttcagtccctcaaaggctcctccccaggttccctggttcagggccgggagtcgaagtggccccgtggagcaaggccttctagggctttagctctgacagcattctagggcctaggcgcccccaggtggggtggctccccctcaggtctaactccagcccctgccagaagcagacccgcctctgcagagaggaaagcccttggacttcagcttcctttgattcgcggtgtctttgggggattggggggtccctggttgattcccgctgcaccgtggggtctgcccttaaggtcatatgaagagcagggcccggatgctctgaggactttttcaataccctccacaggtcagggaggctgcccacttggtgagctcaactgtttggccatatatctctgggcccaccacacaaactgagaggtctcgaatgccaccagcacccgccagcccatctctggcacagcggggccagtgccgtgaaccagtctcattttccaacgtgttttccaagcactgacacggctgaggccctgctgggacgcatggccaactttcctccatgaccaggaccccccagcttccccgccacatccacagcttccccccaacatccctcctccaggtcaatgggtccttcagccacatttttggctcctgacccacccaggcctccctcagagaacctggggtctctgggttggaatgtcccttagagatgtgccccctccctcccccatggtaggactcaaccctccacatccccgcccacccacctccctgggcttgtagaccttctaggaccgggagctcccttcctctcctggcagccagctggtgttcagacagtgatttctgggaggagtgctttcttggactgagcttgagtccacatttccagaagcttctacctctgggccccttctttcccccttcctgagaggcccagcagcctctctgttccctccccagcctccagcttttccggaggaagatgcctgggaggtgctatgattctgggggcgggtggtgggtggcaggtggtgggtggtgggtggtgggtggtggggtggcgtgggcagggaagctgcagcctgctgctgggtcttcagcgaccatctccaggggctgagggctggccaacaggttctccatgagggggatggcctccataacctctcaagatgatcttcgcctctcaaggccctgccagttcctcagggtcccatagactgaactgctgaggttggggaggcctgttgagcacactggctccgtggagctgggtggaggagggagattttcttccagagtacacaggagctggtttcttcccggtcctcaggagcagagaatatggggagggttgggggaggctgccacactgccgtggtttcttccgccaaattccccagtcctaggaaagatccacagaaaaacccacaagaatttgaatgtctgagctggggctgtgattgagatgaaattttctaaaaagaaagaaagaaaaacaaaaacaaaaaagagggaaaaaaacgcttaaaaaaaaatcccaaagcctttgacagccctcagctaccagaagggcctgaggcagcagccacgtggaagggtagagagcaaccttgaggcacttcgctgggcctgtgtcggggcctcccaggctgaggtcccttcctgtgacccccggactcctgcccgctccctcctcccaggacggagtgaagtcccctcctgtcacttggatgactgcagttgcctcccagcaggtccctgggtctccctgactatagacttgccccctgatcccaccctccaggagatggcagggtagggcacagaggagggcacagtggcagctgcctgctgctgtctcctggctactgggcacaagccaccctccaactccttcctgccttgcccaatcagcaggtccctgggtaaggggcattcagtgaactgggggctttgcaggtctgggggaggagcgactgacatatttcattgcagacgcattgagtttgagggtcctgagggatgtagaaaaatttgttaagtagacaggataggaaggagccacaggtagccccaggagccgtgaggggagcagggcccagcatgtattacaatagtgagcatttacgtggttcttcgcatgcgccgggcactgttctagggattccacaggaattattaccgcctgccatcctcattagcaacccagtgggtaaggtgctctcattagctccattaggtgagggcaaagaggcacagagaggttaggtaactggttcaaaggcacacagctggtgagtgacaagaaatttccttctaactacagcgtgagcatggtgaagagaagacggagccccgcgctgggagaggaacgcttcagtccgagttccattctgcacccaaggctccccttggtcctcctgggaaccagggtgccccttagtggtggtggcccaggagaacccgaccaaggcaggagcgccccctcctggaagagcctcgcttcaacgcatcatcattcccggccggcagcaggggcgacgccagcaaggcctgcgactcagagccagcttggcccgttcgccccgccccttcccggtgtccgccccgcccctttcccggtgtccgccccgcctccttcccggtgtccgccccgcccccttccctgtgtccgccccgcccccttccctgtgtccgccctgcccgcttcactgtggtcctgcctctgggtggtgccggggcggggggtgggagcccggggcccgcgcaggcggagatgtcgcccaatgggaagggtcggtcgggaagggggtgggcgcaggcgggtgggcgggaagaacgctggaggttgattggcggtcttgccggccagtgaagccagggcatgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggtgctgttggcccagaaagccactccagggcgggggaccggggagggccccgcccgaggcccgggagggcttgctgcggaagtccgcggcgccacgcggccaccgtcgccggttccggctgcgccctgttcccttgcagcagggggtgcttgtggatcattcatctttgccctttggtgtgccccaggccttcgttcttgctgtctccacggcccgtgcctggtagttggggccagcaccgcctgtggaactgcagtacccgcgctgggcgctcggagcaagtgcagacacagaggacccaggcctggccttagggatcttgcggggtctggggggacagatgggcagagcctcgtgccactctgtcaagtcagcgagactagggcttggtgtcagttggtgtcagatgccaggggtgatagcctccagaagccctctacagccccacaggacagagccctcactgcagcagtgaggaaagctggcccacgaggttagggagctgtcccaggtcccctcggcccgctcgctcctccccccagacactcccccatcctgtccgcgactggctcagtggtccctctccctttccctctcccctttccctcagtcccgaaacctaggactctctcttaagtcttagtctcaggcgttgctcctaggtcctgctgccacaagagcccagagtgggagtacttgaaagaggtggggtctgcatgccgcgggagatgtggggttaagaatggggggacttgaactcttggcaagatggcaggacgcgggtaaaggaaagggtcctgggagcttgcagatgtacactgaggactgggcgcggcggcccacgcctgtaatcccaccactttgggaggctgaggtgggcagatacctgaggtcaggagtttgacaccagcctggccaacatggtgaaactccgtctctattaaaaatacaaaaattgtccgggcgtggtggcgcatgcctgtaatcccccagctaccctgggagctgaggcaggagaattgctggaacccaggaggtggaggctgcagtgagccgagatcatgccactgcactccatccaggctgggcgacagagtgagactccgtctcaaaaataaataaataaataaaatgaaatgatgtacactgggactttcagtgaatgttgctttccttttccttgcttaggacctaaactgccccttcctcgagggtctgtatatcacagagccaaagacaattcaggaactgctgtgcagcccctcagagtaccgcttggagatcctagagtggatgtgtacccggtaatgcatcagtttcttcctcttcccacctggggtgtgcatgggcgccagccagccccacctggggaagatggggtttgtggttactgtgagtagctgtcttcccagagggctccaccccctagcctggaccctcgtgagaacagctgtgtaggtaaggagtactggtgacaggcatgatcaaacttggggcaaagtggcccctggcggtgctgggctagtccagccacccctttgctgcagtgctgaacttgccctcagcgtttgccttgccttatgagtttggaggttcaggactggcaggcacctgagaaatgctccattccagtcctttccttctcagacccggaagccaagggtcaggctggaggcatgaacagtctctggtctcccagtggaggagtgacaggcagggccagggcgtgggctcctggctgggtctcagctggccaagtggtcctcatgcagtgtcacctcttgtcagcttctgtgccgtgacccgtttcccagtcctctggtgcctttgggccagggtgtagcatggtgtgtgcctggcaccctatgaagcccatggtgacagggtgacttcctgagtgatggtggaggaaatgatccagagtgtcccattcccagggcagacatccttcccctggtgacgtagtccctgagctgagggtctgtctcactgcctcacagctgtgagtggagaaggctttccccgcctcccacagagcacaggctcctgtgggattgggtgtgtgcccaggccatgctcaggaacagctgtagtctgttggtacaggagcctctcgtgagtccaggcccgggcctccccctcctcagcctgcggcctgcctacccttgctgcttgaggaaggggcctgggcgggagcctggcagtagagcagtggggagccaacctgcatccagccggtctggcccgccaggaccagagacatcagcaggacgcccagctggatacaggcccccagaggaaggaggaggcgtttttgtgtttgagcccttgctgttccagaggcgtctcctgcctctgccttctaggcccttcctcaggcctctccccagggctcagcacagcagctcctcgcttcataaccttttgctcttgctcacattgttccccctcctggaaatggccttctagtctctgcatgtcgtacgtcctcctgtacagcccgcaaagacccaactcacacgtcctgtctccttttaaaatgtttcctgttcccagggcagaatgtattccgcttccctctggatgcccacagcctttgagcacaccctgcccctgctggagccctcaacctgtgggtgcactcttggcctgctgtcatttccggctctttagtatgggagccgcagcatggtgtggccgtgcagtcggggggttctccaggctgcacctgtgtgccattccacgcgctgcagacgtgactgggtgtcctcaggagctgggtatttagtgggtacaagtcctggggttcagcagaaatgatgcacagcactgcagtctgagttgggtgctgtggatgttggcagggaggaggtggcatttgatctgggatggggacggtaacagcggggtgctcgtttggacaggagcagggagttgaggtgtgggagagagagctgggcagcagcagctggaatggcagctcagggcagctccctcagggccttgcatgctgtgccaaggcctttgagctttatgttctgggcagggcaggcgtggaacctggggagcgacgtgctgagattggcattttggtaaggtgactcagggtgctctgtggcagatggatttggagggcaatggctgcaggcagggagaccaataccccagggaaagacagaaggagccctgcgctgagtggcagatggcttgtctggcagccactactggccctggagggaccagcccctggcctgggaacctgggaggctgggaggtgaggcaggactggagatggctgggtggagtgtgagggtcttgagcgagctcccaggaggaggctcttgtgggagggggcgcagatttgcctgactcaggtggaagctgggggcacttggggaactggggtcatctggccagagagggacgggtaggaggccaaagccacgcccctcagatgcttctacaggttgagtgtcccatatccaaaatgtctgggggccagaagtgtttcagatttcgatttcttcggattttggaatatatgcattatactggtcgagtgtccctaatctgaaaatccgaaatctcaaatgctccagtgagcatctcctttgagcgtcatatcggcgatcagaaagtttaggattttggagcatttcaggttttcagattagggatattcaacctgtagtacttctgtaaataccagaaaccgaatcctttgaaaaagctgccagggagcatacgatgacgttgtctgatttcaggttggcgagaattccttaggccttttgagggtcctacaggagaatcagatggatgggagttttcctgtgaatttcccattgcctttctttgtacgtgaccgcaccctgtcagccccatttagggccgccttttcatctcctcccagtagaacctggaagctgcacctagtgttggtccttggtgtgggttggggcagagctcatggagccccctggattgtggaggtcaaggccctgtggctttccttggggcctccaaggcctccagcattttctgttcctgctctgccctctgctgtgacggtgcggtgacttgagtgacagcccttactgagtctggctactggggcttctgcagcgtgggttttgagtgtgttcagggtttactgtgcccgcccttgcacagtgctgggtgagtgccctctgctcctccgagccttgtgctcagagatgttctcggcaaccccgctggcagagcccagcctgctggcctcccccttccttccccaaccccgcttgcgcagaacccacggttgtcttaataagtcacagaggtgggtggtgctgtggaggcagccaagcccagcccgatctctgttgcagttctggggcaagtgtggcctctccagggaacagccaccagccctttcccaccacacgagtcagcaggctcctagagtgatggcaatggtgaggtgtagccaggctctggcagcctggtggaaagcgactccttcttgtttatgaaaggctgctgtggtggcaggtgcctggggctcccgggtaagagcctgtggccccagcggccggagtgatgtttctgggcctcagtgtcataccgggcttgaggcatggggcttgggactggggatgcagtgcttgggctgtgctcccctgaaggaggagacccagtggagggctgagccgtgtgtcacctgtggtgcatgtctgggtgtcgtgggacttcctgccttccatgcgctgtgcatgtggatctggttttgcccaccagatggcttttaaggtgacatgcttctgagcggcccctgtgtgctgcagtcaagggcaagccttcaccgtgcccaaggtgatgagcctcgactgtgaccacagactctgttgcggcaggagcccccacatgactgaatgcaggcctcacaagccttttctgcagagggccgggtgggaagaaagttttccaccctggagcagttgatgccgacccaggcgaggccggggagggtgccaggagcccggggccagccctcaaaacccacccgctgcgccatttcgagaaagagccctgagtgctggcagcttccctctctgcctctgctgcagccatcttttttttttttttttttttttttggtcttgagaagaattttcatttcagtatccagattcatttctgtatccagatttccgaggtaaacttcctggaatattctttccctaataattaatggaaatgaaatccacgtgacacagaagtaaccactttaaagtgagccgctccgtgccgttgagcacgtgcacaggaattcacttcttccagcgcgtatagagggcccagggggattctctggctgtctccggcctgaccagctctgctgtttccctgcagggtctggccctcactgcaggacaggttcagctcactgaaaggggtcccaacagaggtgaagatccaaggtaggtggaatcttggtccattctgagcttgtccacagcctccttatggagtggtggtgcatgttccattggaccaacgttttcttttaggtggtgcatgttgtgtggatgttgctagagccttcttgaaccccacccttccctaggcatggcaggtgggagaactcctctcgcagggacctagagcacatcagtccctgcagcgctggtggccagagacagagatttttgccgatgccagcagtggttccgtctccctgtgtcagtggtgtgtgacacgctctctacaggtggcatttctaggggcacctgctgctctccagcggagcttgccttataacctcctttctatcatttcttggtagaaaccgtgcttaacctggtaatgaatgttggataaaggtgagcaaaactgcagtccccaagttggtggctaacttttcatcttcatggtgatctctctagaagttggtggaatgtcaaaggtcaaatttttcatgggcctgtgtctgttctggccactccagggtagataagctggaccctggagtcctgatccgtgccccagctggcattgccacatgagttatctggggccagttcttcctgtgctgaagtgggccagaagaaggaggtgttgttttagagcagccggtgggctggcctgggccacacagaggcactgcccttctccctggagctgccgtgtctggtacattccagattctctgacccacaccaacacatgtgtgacccgacccagcccagccttagccctgacaccgccattcccagcctgtttcctctcctgtcaagtggggatgaaacccagccttgcctacctcatgggaatatactgagtgtcaggcttgtcagagggcaggtgggagagaccaggaccagtagggtgtgaggatagttcaggaattcatccgacgaatggttaaggagcagccaccacatgcgaggcgctgttcctggtgctggggtgcagcagtgagttccactgccctcgtggcgcttgcgtgctagcggggagagacagggccagagggtgggagaattgttcatgcacctgccagcgagaagcactgggaacagccagctgagggctgagggtcctgcagggcttggggaaagggtggtgctgtcttgacataagatggcaggaggggcggaagccagcgcggcatgtgcggagaggaagagcatgcgcacagggccccaggtgggctgtgcctggcagcttggaggcacaagaaggaggctggtgtggctggagagcagggcagggcaaggagtgaggttgggaggggacgggccagatcaggccaggccatgtgggccccagaaggacgtgggctttgactccgaggaaggccgagttctgctcttggctgtaacgacacccctggcccactgtgctgggaacagggtgcccggggaagaggcagggagagcggtgtggggctcttgcagtgagtggtccaggtgaaagtttggagaggcagtgcaggaggcagcgctggccagatctggatttatagagttggctggactcgctgagaggaagagaggggtcagggaggacttgaggatgtggggttaagggcagtggtggaacaggcttgcctaggcatgcagttggcatttatatggtggttctggggttactgagtgcttccccacagactctctgcttacttcttgcaacaaaccctccagggttaggtggaggggcaggtctggcatcggccccaggctttctggctccaagttactcagaaaatgccctgggcaccctggcagatgtggctggatagtctgcagtgtgcacggcgccaggttccccatgcatgaaatggaacaaggtcttccacccccagggctgctggcagggtgatagcagatgatggcacgaaggtcctttaggacatggccagatgggagcggtgagtccatttgctttggccttgtgaggtcttggagagagtggcagacagtgcactgtagaggttcactgacccctgtccactcctcaggcagctgctggcttctgctcaaagccagagtgagtgaccccaaacctgggagagcattgggtacaattcctaattttcagacgaggaagctgatgcccagagaggggtggggccactcagcaagaggcagcgctggcacctgggtgcctgcctcctggcccaccctggtctcctatacccagtctagtctgtgggtgctgggcttcctgggtgtctgctgtcccctgctgtctgggcaggtgcctgccatgatgggctctttgtgtttcaacagaaatgacgaagctgggccacgagctgatgctgtgtgcgccagatgaccaggagctcctcaaggtaagagggcctctgtctgctctgcagacggcacgcacgctttctgccctgggcagggaacctcatggtgctggctgaggtgggaggattttcctcccctagtgcctttgaggttcctcaggccctggggccggctgggtgcccgggcaggctgcttctctaggcatccctggggccagaactgctgggattctcttgggtagaacctggttgtccctggggcgcaggggagagggcagccgtgcagggaggggcagatctctggcttctgatgaccagtgggatggaaagtgtcctgtccttggttgatgacttcattcttcattcatcccggcgcctggctcccaagcccttgtggcccgagagtttctcccgaggtccctcatctaccctgcggtaggtcaaagaaactccagcacccaccttctcgtttctaaattttgaaataattgttttcactcgatgattatgagtaatgctactataaacattcttgcatatgatttttgactgaacacgttttcttttttttatatctgaagagatttattcacgtgaccaatggcctatgacacagccccaggaggtcctgagaacatgtgcacaaggtggttgggctacagctggttttctacgatttagggagacataagacgtcagtgaatccatgtgagatgtacactggctggttgaacacgtgttttccatcctcttgggtgtatagctgggagtggaattgctgggtcacagggtcactctgtgcttaacttttcgaggagcccccaaactgttttccagtgcggcggcaccatcttccttttccagcagcagcgcgggagagctccagtttctcctcgtcctcgctggcacttgctggcatccgtcttgttgattctagccaccctgctcggtgtggggtggcatctcattatggttttgatttgcatttccccatgaccagtgatacggagcgtctttttgtgagcttgttggccatttctgtatatgctttggaaaaatttccatattcatgtcctttgcccactttttaattgggtcacttgtccagtgaggttttttttttgttttgttttgttttttttcttaattagtagacttaataatttagggtagttttaggttcacagcaaaattgagcagaaagtacagagagtctccacaggccccctgccccacacatacacagcctctcccgccatggacacgacaccctgcacacgggggctcctttgtcacagtccatgaaccagcatggacacattgtcacccaaagtccatatccagtgagtcttctctcctgtggttgagagtccgtggttctccgtgtgccaagtagttctctcgacattttgcctattactttggctctgggaaaatgtattctccacacaatttatatttgtatacatatttgtgctttagcaggcacttgacctgcttaggtttaaggagcaagttcagccgcctcccgcctcttgcctgccgttccttccagcatcagctctgtttctgcagcctttgcatggctcttcgggtcccccctgtgtgtgcgccacccagtggtcagcctgggagactttgctgggctcaccaagatcagatccacttgtgcacaggtgggcctgagcccaggcattgtaaacagatttgtggggtcactttcttgagccgtttcctctccactgtcttttggatactttctagttccctggggctcccttttcctgtcctccagacataaaccacccacttccgtgatggtggtggcacggccagctccctgccagtctgcaggagaactcggaatcctggtgttcctccctgacccacctgctgacattcgcttctcagagcctgcgagcacctgccccatacattctgcccagccgtgggagcactgcgcttgctttatatttccacattggcattgtggcaaagtgcactttacgtaaaatctgccatgtcagtcatgaaaaacaatttcctaacaggccctgtgggagctcgctgctgcttttttttttttttaatttaaaaaattatggtaaaatacacatcacctaaattgtatcatgttcaccatttttaagtgtgcggtccaggggcataagcacattcacggttctgtgcagccatcaccaccatccagccgcagaacttgttcatcttcccaaactgatacttcgtcctcaatttttaagccgcgttaaagcgtacgatttagtggtcttcagtacattcacagtgttgtatgaccaccacctctatccagttccacaacattttcatcacccccaaaagaccctgaaccactgagtagccactccccattcccctcaggccttggcagccactgagttaccatctgtctgtatgtcattggagtggaatgctggaatgtgtggcctttggtgcctggcttcctcactgagcacaaggttttcaaggtttgtccatgttgcggcagcacttagcaggactgcattccttgttatggataaacaatcaaaggaattggagaattccattggtattattgagacctgggagttggaggagggaggaaggagatacagatttaagatcattaggtagggtcaacccttgtagtcctgagttttaattgggaatatcagcatgagcccccgggcttcaagcgatcctcccacctcagccctctgagtagctggggtcacaggcatgcgccaccacactcagctaatttttaaaatttttgtagagaggaggtcttgccatgttgcccaagctggtctcgaactcctgggctcaggcaatcctcccactttagcctcccaaagtgctgggatgacgggcatgagccattgtgcccgtcctccgcatatatttttacattaagggatatatatgtatttccttatcttgtgccctgaaaatgcctagaacaatatgacaccccggctgtaatgcaggcggaaacacagagagcagcagtcacccaagacttgggtcacgtccgagggactcaggagccaactagcaatagtcagagaggggccagtgggagcctcgtaagcataggggctgcagtagacaggcacccttcacgtatgcccaaatccaggtgttcatagtgatgttttataaagtcatcaatttgacactaaaaacataagcgacaaaagaaaaaacagatcaattggacttcattaaaatgaaacactttggtccaccaaaggacaccatgaagaaagtgaagaaacagaaaaacctacagaaaggcggtaaatagttgtaaatcacatgactgatgagggacttgtatcccgaatctattaacaacccttacaactcaataagaaagacagaaaacccagttcaaaaatggacaaagtgtccgaatagacgtttctccgaagaagatgaacaaatggccaagaagcacaagcaaagatggccagcatcacgggccattagaggaacacaaagcaaaatcatcatgagatgccacttcacacacactaggatggctagaatcaaaaaagaaaaggaggccgggcctggtggctcatgcctgtaatcccagcactttgggaggccgaggcaggaggatcgcttgagctcaggagtttaagaccagcccagacaacatcgtaagaccccgtctctacaaaaagtaaaaaattagccagacatgatggcacactgctgtagtcccagccacttgggaagctgaggcgggaggatcacatagagcccaggagttcaaggcttcagtgagctatgatggtaccattgcactccagcctgagcgacagagcaagaccctgttgtttaagaaaaaaaaggaaaatcccagtgttggccaggatgaggagagattggaacccttctgcattgctgtaggaatataaaatggtgcagctgttatggaaaagtctggcagttcctgaaagatgtcaacacagttaccccgtgacccagcagttccactcccagctgtccacccaggagaagtgaaaatatacatgcacacaaaatcctgtacctgagcgtccatagaagtgttattcttaatggcctgaaagtggaaagagcccaaatgtccatcagctggtgaatgtataaactaactagcaataaaaaggaaatcaactactcatctgcgctgggacacgcgtgatcctcgccagcctcatgcttggtagtgtatgattccattgctgtgcagcatgtagataggccaggtcagtgctgtggggacgtggcagcccgctgcccccagatcaccttggagcacatgactgtggtcagcaccaccgtgcaggcagtgagccctcccagtgccatcgcccctgtcctgggtgccctgagcttctcgcacctgtgctcctgaatctgcctcagttggatgtcatggtgatgcccaggctctatgctattggcagtgttgccaattttaccttatcattgcccccgcctgccacacacttttctgaggaatgcaccagaacggactggctcagccagctgctctggcagcttccccaagcccgccaaggagcatttgtgtgacaagttggcgctgaaggcacaggccacagtgaaagggccaaggcactcccggtggcatttcatgccatggagttgacccttttgacgtggttaggatgttcagagctcaagaagtaggcctggctgggggctttctggagcaggcgtagcctctcaggtcctggggctcctcagcgatcctcttcccttttctggaaggaggaaagagctgtgcttccggaagccttgagcttctggctgggtggctcccatgggtatctcactcacctttccggcgagtgggggactaattcagccccgcaggagctgctgctcctggagcctgggccttccgggctggaacgccagtcccctggctggaaagcaggccacctctcagccccatcctgtcggcttcatctgttcccagctgggacggcgatccttggaggagaacaggccttgtcctggaggtgtccctgtgggctgtgttctgtcatagcaggccctgctgtgtgctgcctgcccacccagcaagccatgctgtcggctgcacgacagacacatatgctcctgtatgtttctgcagtgctcagcccgttctggcgtgtggtcccagcatcattacagcccaaggcagggaccaggcagggagcacttgctagtccaagacattgctgggcaggcacagggtcgttgatgggccaggcccctcctttcccctggctcctggcatgggtggcatgtgggggcaggggcactggggacagctggccttggcctggcttagatggagccagtgaatgtctgtggtcttccttgcccagggctgtgcctgcgcccagaagcagctacacttcatggaccagttgctcgataccatccggagcctgaccattgggtgctccagttgctcgaggtaaaggtgtggatggcccaggtgggcagtattgacgggcttctcttggtcctagttctggagctggtaggggctggggtgtcactccccctctgatgctggctggggtgtgacaccccacttggggatctggctggccaatcaggggccgggcagcatacgggcaaggggcagctgtgtcccaagggtgctggctgttgcccaaggccccgggggtgagtatgaaggtgggatgtgggcctcagagcagacgggccaggcacagaggagggtgagcacctagggtgctccatgggtgggtaggtaggcgggcaaaaatggaggagccagggcagacaggtggggcaggattctgcgcggtggggcttgtcctggcctctgtgcctggccccgatgtgcttctggggccttccctgtggggctgagggcctgctgggcgagtgctctggcctgtgacggtgtggccctgggggctgcctttgcagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtggtacgtgctcctggaggcctcagtggcagcaccctggcctcctgtcccagccccaggctgcttggttctgttactgcagacacccctggcagcggtgagttgcaagtgttccctttctctccctgcagggccagtgcctctgccaagtccgaggaggaggagaagctggcggagcttgccaggcagctgcaggagagtgctgccaagttgcacgcgcttagaacggaggtgagggtgctagctcctgggagggggttgcttggaggcaaggccctgctttgtcacctccctcagcacgtgaggcttaggcgaggttgcctgtgcaccgggcctgacatgttctagaatactgtggtgctcagtccgcggggaggtgagaggtgggtcccgtggctgggggaagggatcagcctcaggtattgggtggtgcccacgcctgagcacattgccatgtgccttgccgcacgtggtcctcctggcagcccttggcctggcctctgtttgattgcggaggagaccggggcccacaggagagtgagtgagggggctgaggctgggagccagaaggtcttgctctggcctgagtcgctcggtacagctcccctgtgtccctgtttctgaaagctttcttcctcgccctgggtgtgcagtgtctgaggtgagggccggtggcagcctggctggtgggcagggcagcctcaagggactctgcctctggctttgcagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaagtaagggtgcccttcccctcccctctaaccgccccctcccctgttcactcagactgagagcttatatcctgcttgggctcaggggcctcagcagcccctgacaagggaccacagggcaggaccaggggctgggaggggctgggctgggctccctgctggccagtggcgtggcagggctctgggcccctcagtgggctggggaggtgctgcttctggtccttggacctgcccaccttagcaggcactagctaggcccagatccggtgtggggtcctgcgtgtcccagcctccaggtgctgttcctgtgttggccgcactgttgtcacgttacgctccaaaatagcaaggtccattcattcttgtggatgaccaagaactgtgccagacaggcagacaaatgcctgcctgtctgcccatgagcctgctcagacaggatgagaggaagtgggctcgtcaatgtttgcttgtttcgttgttccacatgtgagatccccagaggccaacctaaaaagccggctttagttacgatgactacagttcccacgtgcgcaactctgcccttggctcaaggattccgtgatgttcattttggttttctaagcgagaggctccgagccttccaacctctgactggctggtcctgtgagacccctcgatcagggatggtgaggccacagccctctcctgtccatttttcttgggacatttattttccccccttgccaattgctggggctgggaggacacgcagtgctggctggcatgtccctaggcatcgagggttgccagagcgacatgagagtgtggcatccccactgggccaggaagaggggacttaggtccgagaactctgattggtgacttccccgctgggagttctgtccctcacccttggctgtctttcaggtgaatgccacctgatcagtgtgagtgggggtgggaagcaggagatgccgtcgctacgtgagaccagcggcatttagtgcctgctcgctccctccctccctccctccctccctccctccctccccagctgctgcaagtggtcatggcagttgctgacacctctgcgaaggccgtggagaccgtgaagaagcagcaaggcgagcagatctgctggggtggcagcagctccgtcatgagtctaggtacgtggctgcccacctggccctctgcctggggctgccccacgcacaggcttccttttctgtgctccactagccctggaggagcatttggggaccggccccttcttttgtttttcattttctaatgcatgttttccttcacttgaaaaaatgctttcagcggattatcaaatgaaaacgctcatcgtagaaaattgagataactcagtaatagaaaatgtgaagcaaatgataacaaatgcctgaatggaatagtatttgacaattaaaaatgtaacttgggccaggcgcggtggctcatgcctgtaatcccagcactttgggaagcagaggaggatgaaccactttgagcatagagatcagcctgggcaacatggcaaaaccacgtttctactaaaatacagaaactagctgggcatggtggcgtgcacctgcagtctcagctacttgggaggctgaggtgggaggatcacttgagcccatgagagggaagttgcagtgagctgaggtcacgccacagtactccagcctgggtgacagccagaccctgtcttaaaaaaaaaaaaaaaaaagttacttaaggaaaatgggaaaaggcttataatgagggccatcttctcagagttgatttttgcatatggagtgaggtggggatccagtttcctcgtatcctatatggatacacatttgtcgcagcaccattgactggaaatcactctttctctcattgatctgcaataccatcactcttggtaattattaagtatccatatgttatgtgtgggtttctgggttctcctctgttccattctattcctttttttttttgctatccctgcactaataccacgtttcagggggctagaaaataaacagcaaaataaacccaaagaaagaaggtaaagccagttttctacctcttctaatttattttttaaataacagctctactgaattcaagttcatataacataaaatttacccttttaaaagtgtacaatttcatggtctttaggatattcacagagttgtgtaaccatcctcttatcactatctgagtccagaacatttttatcacccccagaagaaaccccatatgattagcagccattccccatccctccctagcctcaactcctggcaaccactgtcatagagacgctgtctgtctctatggatttgcctgtgctggacatttcctataaatggaataacaatgtgtggccttttgtgactggtgtctttcactgagcataaagttttgtaagggttatccatgtagttcattccttttcatggttgaataatatttgattgtgtggatatcccacattttgttgtagttggtagatgtgggtttctactttttggctatgtacatcgtaagtcttttgtgtgaacgtatttttctttttctttttgagatggagtctcgctctgtcacccaggctggagtgcagtctcagctcactgcaacctccacctcctgggttgaagcaattctgcctcagcctcccgggtagctggggttacaggcactcaccaccacgcctgactaatttttgtatttttaagtacagatggggttttgccatgttggccgggctggtctcgaactgctgacctcaggtgatccacctgtctcggcctcccaaagtactgggattataggtatgagccaccgcgcccagcctctttaactctgttttttaaagttattttttaagtggttggctttagaattacagttagcatcctaactgaaaacagtctagtaccaaatgaatttcaatagtatacagaaactgcctcctattaaagcaaaatgtatttgtgggtacaccattttaattcccttgttggttctttaacacttcttttaaaagttatttttaagtggttgtccttagaattgcatttagcatcctaactgaaaacagtgtattaccaaactaatttcagttgtatacaaaaactttgcccattagaatgaagctgtattaaatgtgtacattggtacacatttttatatttatcgatgttgttacctttgttggagttctttatttcttcatgtggatttgtgttactgtctagtgtccttccatgccatcccggaggcctacccttagtatttcctgtagggaaggctcactagtgatgaactccctcattttttatgtgggaatgtcttcatttctccttcatctttgaaggatagttttgctgaatatagaattcttttgtactttgaatgtgtcatttcagtgtcctctggctgccaaagcttctgatgcgaagccagctggtatatgatgagtctcttcactttcttttcaaaattctgttggtccctggctttggacagtttgattataatctgtcttcgtgtgaatcactgtgaatttattccattgggagctttttgagctttgtaaatgtgtcgtcattcatgtttttcatcaacactcagccaggtagttgacagctctttctccttcacatcttgcttgctcagagcctcaaggtcagccagaggtgagagatcagggccttctcaggtctctctctctgggattttcacagcccggcacacacccatggtcttccagattcccaggactgtgccagagctttccagagcctttgtggacatctgattttccagcctctcctgagcttcttgtttagtctcttgtttgccccggctattatgcactgcctcaggcagcagcagctaaagcatttgctgtaaatgttttccactgttgcacccccaagtagtggtttcaggtccatagcctctgagccctagttttggagactgtctttggatgaaccctccagccagccgtctcctcggagagccaggcttctcactgctcttggcctcggcacataactaccccatgtataccaggcactgaggagcctcttcttgccaattgaactgcagcagaaccctccactttaaaatgtattatagcgtttatcctaatcaccagtcactatgactctcttcccagtttttataattgctgttagtaaactgcttataatctatgccatcattcttataatgatcattggtattcgcaacagtgtgccatctcacctgtgactgtggcaccataggactggtggcaggtcttgcctttcagaaaggccccttatcgcttcttggctaagatcaagtgtagtatctgttcttaccagaaaggcaccctttacatccaggccgtgtgaactgggcagtgcgttgtgtacagggaagtgtctcttcacccttgagccccggccactttgggggtctggagagacgccaggggagcaggcctacggcgggcatcggcctctctaggggctctcaactcagctcccatcagttcagcatcctgatgtggcttgagatgaattcttagtgtctggacacaccagagaaagggtcagcatcaaatccacgccaaaggccactcgggacagttctttatttgtcccgtttcccatctgaccccttgagggccgtggtctcgatggccctcctcccgctgtggaaggccgtgtttctgtgctgtttcacctcccagcgatctgcatgcccgcagccaggctctgttggaggtgcggcaccacctatgaagtgaggagcagccagtgtgccttctgggctcttgctgggggcatggcctcatgtgagttgggagggccttggcactgtggatcagcaccacacaccaggagtcgccccccaggcttcctgaaacctcactgccatgaaaacatcaatgtatttagaaaccgaagcaatgctgtcagtgcaagaatgggacaggagagttgagggtaccaacagtggagagatgccaccaaccccggcagtggtgacgggctcagcgggcggggaaggtggcagcctagaggacagcccaaggggcagcggggtgccagggacagggcagtggtgagcagatggaagcagagggcacaggtgaagcaggtctggagaggcccacctccccggcgagaccctagcctgttcttctgtgaagaaagtgatggaaatgaataagcaaaccagctcccaagctggtggcccggctcacacagagcctgagcggctcccagctcgtctcttgatgtggctgatgtggctggcggcagcccgggtgaaacctacctttttgcagcctctgagggtccatggggcaagagctgatccctgcctcgcctccatggaactcctccaaactgtcctccagagagagaccccacaggcaacggctccaccacagcagaccaggggcagtggcagctacccagatcctcttcccagcccctgtggctcgaaaagcagccccatgcaggagagaaggaagccctggatgagcaggaaatctgacctgaaggactttccgacaccactgaatacactcagtgcgacatccagacatgcttggacagctgtgaaaacccagccacaaagagactagaaacgaagtgaggctgggatctctaagaagagagaaaacagagagaaaaaccagcacaaagatcagcatcacacaggccccagccaggcacagggtctccagggcaggggacaggggagatgaagggcagggctccggaggaggtgggcacacagtacaagccaggtgagtgcaggcgccgagcacagggtagatggaacccacctcctgccatctggagtacaggggccaagggctggggccaaagcttcaagagagacagcctgtggcctcagaggagcagccaggatgccttacaagcactgagggccctgcacacccggccttgggctctggaccctgccaagccctgcaccaagagtgagggcagagcaggaaggccgggatggaggtctagacgatttgataagggcagatgccacacgagggacacagtccggagcctaggaagacagtctagagcagtgcgcattgcggcaggaagcccctctgctgggatgccactggaagctgatggcgagtggagagggtcctggggcgcaattccaggcgggctgagcacattccccagctcggtgtcaccccgaggcacaccccaggattcctgagcttcagagtcaccctcgggatgggcagaggatgacagattcagggttcacagcacttaatgtcaatgctaatgacttcaacatgtaaaaggcaaagtctagctgacagtggggccacggatggggagcggacaggcagggcaggtgaggggctgtgtcctcctctgtctgctgggggagggggatgatggccatggtctagggttggcaactgagaggcagatgtggtcatggcagataaggtcagcgcagccaccacggtcgccactgggccgggcagccaaggcttagggctgtctgtgtgattgggtttattgtgtgtgcagtgttctccatctggttaatactgaacgtgccactgaagtcaggacagcccctgcctcctcactgtgtgccatgtgctgcccctggggcttggggggcagggggcaggtgggcgggggcacagccgggtcaacagaccctggcctgggtctcggaactgtgctgcggtcggtgtgacccagcccagggctcccaagctgctggcctggtccccacagagcctgagcagctcccagctcggcagtgcctgtcccttccctgccatcctggtggtgcctggggctcaaggaggatcagctgaggacatgtgccttgagtggtgggcaggaggcacctcgcctcttgcgccaggctcgctttcctgttggtttcttttctatttatttatttgtttattttatttatttattttatatatatatatttttattatactttaagttctagggtacatgtgcacaacgtgcaggttagttacatatgtatacatgtgccacgttggtgtgctgcacccattaactcgtcatttacattaggtatatctcctaatgctatccctcctccctccccccaccccacaacaggccccagtgtgtgatgttccccttcctgtgtccaagtgttctcattgttcagttcccacctatgagtgagaacatgcggtgtttggttttttgtccttgcgatagtttgctgagaatgatggtttccagcttcatccatgtccctacaaaggacatgaactcatctttttttatgggccgcgtagtattccatggtgtatatgtgccatattttcttaatccagtctatcagtgttggacatttgggttggttccaagtctttgctattgtgaatagtgctgcaataaacatacgtgtgcatgtgtctgtatagcagcatgatttatagtcctttgggtatatacccagtaatgggatggctgggtcaaatggtatttctagttctagatccctgaggaatcgccacactgacttccacaatggtggaactagtttacactcccaccatccttttggtttcttttctttcctctgcagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctaggcagggacctttggcccctttggggagggagagacagacgggcggtttgacttggacacaaagaaagccttggtttc

SEQ ID NO: 3993 - DNA, 39193 bp, human
attggcaaagctggggtaccagtcacccagccacgctctagggtggtagccaagaagacggaccccgagcgggaggcagagagacaagaggtggatgaagcagagcaaggtcagaagggagagggagaggaaggggtgagggaaaggtgcctggagggcggcgagacgaggcagaagcctgacagggaccaagggggccgcagggtggcgatgaaggggcgtggatcagcagcctacagagagcaccggggaaatctgtggacaccctcgcggcactggggacagcaggaccagggcttgggacagcggaggcagcagagccaggggcatctctgggttgctgaggaggcagcttgaagccagccctacctggagaggggaggcgccaggcgcaggctgactagttggcgggctggggtggtgggccgtccgcacgtctatctgtccggtgtgtccggcggaccgaaagcagctactcactcctgggcagtttgtggagagagggagacagaggcggcgggcgggaggctaaaggctgggcaggcgggccgacggggaggggacagcggggagagggcggggagggaggaaaggagggagggggctggtggggcggagagggcgggcgagcaggagggggcaggcttcccggcccccctggcagcttcaaagggagcaattttcttgtagacggctggactagctgagcccccgccccctcgcccccaccacctccccccccctcccccgcctggggcagacagcaaaggaacggacacactcgcactcactcaaacaaggacccagagagtcaaactttccactgcccagatggggacactgaggtgctggctggcatctcgccaggcagaggaaagagagatggaagaaagacgagggggaggcggccttgggctgctaggcccatgagtggcccctggaatttggtcctgagcctgccaggaacctgcttgggcctaagcaaggaggtggtttctccaggatcagagaggtagctgttgtggatttctggaaggacttcatgtaggctcctggcgccctgtgccctcccttccactccagactttcttcccttaaaaagagggcccgatccggctggtggtggcaggacggggcagggggctccccagcttgcctgccctgaactgattcagagacgaaggatccagcgagtcagtcttcttgctcaatccctgcaggtcccctcggacatgagaaccactctgtgggtggccacttcctctgggctcagccctgtgctggtcacttacgggggctaaccgggttaccccaccaagactcagccgcttcctgagggcccaaatgagtccagttcctccagtggctagagcccaggtccttagtacgacactgcccccctgtcccgtagtgtccccttcttccctcagcaagagcagctcctgagacacaggggtaagagtttagatggagtgagaaacagatctgcaatagaactgggggccaagagtgcggaagaccaaaagagaaaattgcatattgagagaaaaagctcgaaggggcagagagggagagaggggtggctagagagaggcggcatccaatggagagaggacaacgtcgagggctgagggtcttcaacccctggcagtgccatcactcaaccggggggtggggtctgggaggtcccaggccagggaggatgctcccaggggagctctacctgggggcatggcagggcacagacccccttcctgttcaccagcggcagcccagggcctggctaggacctgggacgcatggcaccttgaccaaactgtggtacctgcctgcaagaagcttctagactgggccagggagaagagagacgtgggaaaccaggggccaggctggtaaccctggttctctcttgatttcatggttggaatgaggagattggagaccacatatgccctttccagacaaaggagatggcttgtctttcggcaggtttgtgtgttttaccttttgcccagcctcagcgtccgactcttggcagcctggtctcatctctgtcccaccctctttccctcccccactgccaactcattcgtggagaaatatgtcggtagagagcgggacaggcagcgaagcctgactagcagtctgggtggagagagaagcatttggaaacattccgctcagtgacagcagccagtcgcaaaaggccgcagagcctctggttccattcatttgaaatgtccacactaggctcatctgtggggacagaaagcggatttgtgggcagtgggtgctagaggggtggtacctaaaggtatgggttttctttttgaggtgatgaaaatgttctacaatcgactgagtgatggttgcacagttctgtgaatagaccatataaaagcccttgccttgtacgtgctcaatgcgcaaatcgtgtggtaagcacagccactctcagtaaagccgtttcagaaaaaaggagaaacccactcaaggcatgcctgctgcccgaggtgctggtacccagtaccttcctgcactgcttggggactgagaacccaggagctgtcactcagggcctcagcctccaggagtcccagtgggggtgaaacagctctgaataccgtgggggcgcagggccatgcacagtgccagaggctcgggagggctacctggaggaggtgacctggagcagaccagtagggaagagggaagttgccggtggaaggaagagcacacgtgcgggggggtgtggggagacacaggggagccaggcggcgctgcagtccggccctgcaccgacctcaccctcaggtctcagccaggcatgttcctggatgggggcttggaagtggcgatgaggcgacaccctgcttgggggagacacattatgcatgcaccttgcagctcttacctgaagttgggggctgcttctgggggcaatactcatataaatacggtccttgtacctggaaggtttttgtatctgtggtttgcagtctgcaataagccataactgcacgcccggcccggggcccaccgagtcactcggcctggctagggcccactgagtcactcggcctggccctctaatttgggggccactcccagaccagacaggcagtacctcagtcctagggcctcccccttctgctccccctcccactcccccctcctcaggcctgggctctctctgcagcgcagaaggtactttgatcccagctgaagtgctctaggaacagtgcttccttgctagcgagcagagctggcgggcgggcagccttctgcccttctggcctctcagggctgggaggaggcagggggaagcagggggaaggcaggcacggggggcgcaaggcaggaaggaagagcaggcatttcctgaggccctcagggatcctggggaggaggcggacacacagctgtcttagctccccaggaacccgcggcagacagggagcaggaggtgggggaagcagaacccggccccttccagcacggcctgtatgtgaccctgggatgccactgcacaggccccctaggccctagctgggatgcttcccccaaaaggctgtagagggccagaaggtcctgctggcaccagccttgccttgcatcccagcccgggagaccccttctcctgccggatggagccgagagctcagctctctccacctgacaaggagcccaaccccctcagctgcgtggggagggcagccctgggcagcctgctcaggcttccctgcagggaaagctgtcctgccctggcagttgcccctgcacagggccccaggccacactgtggtctccctgctctgagcctaactctggtctaggcctcatcaggcagctgccaccccagcctgcctgggacagcgcccaggacggctgctggaaggtagcaggtggggcggcagccatgggacggaaggatgggacaaggacatgtctgagggagggagagggccacggaagaagggggctgggaggaggggaggcagggcgcagggatctaagccagctgccatctccttggccagtgtggggaagaggacctggagtcagctgcagcctgtcccccacagctggcttgcagctgtttgtgccctgtcttcaaagctacagcagggaggcccaggagagaagcagggtgggggcgcccagagggcaggctgtgagctctctggtcccatttgggcatgaaatactggcgggtggtgtgagtcctagagggcagagcctaggagcctgggaggtggcctcttatgcaggggtcccctacagaggtgggctgcttgttccatgattctccagggtctggaaacaagaactgggccccgggctccctctgccctgctccccaagtgtgtccagtgggccctcttctctgtgggtggctgcttctcgaacccttctgcctggacacgaacctccccacccttccattctgatggtgtgaacagaagggcccatgcctgtcttggggatgggacggagagacagagggagagccgacagagctgggacagagagctgcagtgggcgaggcagacaggcagcactcccaccccctggaccatcagcaagaccctcaagaagcaaggaggtgacaagtgctatgtgcccgtacaagactggggggcagggagagcttctagaggaggaggcagtgccctgaggccgcctgtcattggggagtagctcttgcagagcctcagcttccagggcaaattcccatccagggacctgtcactcacacatcgaggttacctcttgagcaagagcggccccaagtttatggccttgagtgggcctcactccgagcctgtgggcttcgtccattcccagtgtcggcaccctcgggggcagacaccagtgggcaaccccatcaccactcaagggtctctggatgacctgcggcctcgaagcggcatgaagctcatgctcagcggggacctctgggttcagggggtggggcggttatggaggaggcttgtgccaacatgccctggggcagctgagctggtgctgagtgagcggagcctccactctctggaagcttcccagtgctggatggccgaggtgtggctggtgaaagctggcactctccatgccaggagctttttttgaccttcctctgaggacataatcacacagcatctctcccctccgggccaccagggctgtaatttcagggcctgcgtgggggctccggggaggcctggcctgcgtctagctatctttagagaggcatggtctggggcgtggccagaggatggaagatgggttgccttggaagccgaagtccgggagccagaggccaggggcaccctaggacccctgtggtcttccctcagggaggccagaggccagagcccaggagcagcaccaggaggctctggtgggagtgggaaggggctgggccctgtcccgagccctgacttcagctcggagcaatctttggcccagatgctcagaagatggggtgggatagcacctggcctgagggccagacagcttagcatctcccagactgtccccgtgtggccatggtggcagctattatgggggtagggggtggagggtggcacagtaggcgagatgcttgtgaacgggggtgttaggctggagggagggctcagaacagaatgtggcgaaggcgaggggtgggcccgtggggggccagtgaggggcagttggagaagaatttggaagctgatgggcagttttctgggactgcagctggcagaggcggagcagaggtgcaaggtcccacccaggtctcaggccggagacacaggcccagccccagggagggcacggctccttgcccccattctccacccttctgaattgtgagctgtccccactgtccttactctcagtcccaccccatcacctcagcatccccatccccatctgaggactgatgagtgcctcccttctgaccctagtcacacctatcctgttgccatcactattgcaattgtcactgcaatgtcccctcagatgcccagcattttggggtcaccgattggctgcacccactgctgtaccctcagatggagccagcagccaccccgaagaggaggagcacagtaatcacagagaaggtgggagtgagtgggtgtcggagcgtggcccgtgctgaaggaggggcaggtgcagggccacggctgggctgcccttgctctcgggctggggctctgtctagagattccctcgtggtgccagctagactctgaccagccctcccacagccccaagaagtgaagtccccagccctgagctcctggccctctggggaatcccctgggctggaaacagcacccttgtcccagtcatgagggggaaataaaggcccagtccctttgccccatctcggagtgcaggttggctgaggcctggccgggcctgtggggtcggctgcagcccagcttctcccttggccaggtgacgaccccaagagcccgcaggtacatttcccaagtgcgagtcccctgcctccccagttgggaaggtcacaggaggattagcccccgccgaggctctgagaagtggaattaaccacctgtgggtggcctgcctggcccctgccctcctgcagctgaggggcccctccccttctcctccccacctgcctcatctgtcgggcagtggtaagaagtgggcaggagatgtcggggactcacccagcctgcacttcctgtgcctcccgggcctgacctctgggactgcgagaaggtgggggctgcagggtgacctgagcaagaggcgcagggaccggggcggccaggcagggaggaggggtcgtgagagctgggagagtggggccagcgcctcgtgggctgctgacctctgacccagcccaaacaggaagtgccatatctgaggggccagctggaggagaaggaatgccgggacgagtccaaagcaaacagcccacagcttcccaggcctctcccgcccccgccacagtctggcgctttctccactgagaactcaggggtgggggcaggggtagggggaatcggccatggaatgggagcaaggcgagactcagttcccaggccccggtcctaggcagagctgatggcggggcgaggtccttgcagcggacaccctgtgcccttcctcctctgctccacccacatccagcagcccggaggcagaggggaaggagaggggcggccccgccagggtagagaaaggccggggaatgggaaggccgtgcccagatcgagatgggggtgctgaggtgatggggtgggatagcgagggccagaggggcatgctggaggctcacaagttagagggacagaggacagggacggagccatgcgctccttggggctgggctgtgtctctgctgggccctctcctgcggcatccttcatgcctgtcacctggctgtctctgtgagccccatcccagggcagtggctgtcgtgttccctgcggttgtgaccctttgtccctatcccttcctggcacagggcctggtggcctagagagctgtggaggctgtcccaggaaacccatccggttcccaggggccccctcactcaggcaggccaacggggcaatggcctcagtggccttcgagggctccgcagacccagtgtctccaccagcatatctggccagtctgtcttcagggctcggcagggctgagttgtcacttcccagggactcctggcacatggggaggtcaacatggagggccggcctcgctcaggcagacagtcagaaactctggccaggggtggtccttgcccagtgctcagggcggggcttggctttgcacagaccacgtgctcactccccacccttccctggcaccaggtcagataggggcacagcctggtctcacagcaagccagccatacatctctgggcaagttactcatctgtgagctgagggtggggccctggggacctctcttgcaggtgggtgtgcatgttgggggctgggatgagggttctggggccaggaatgggggggaggtgtcaagggagaggcaaaggggcttcccgagaggtgccactgtgcggtggtcaccagcccctgccccaggcctcagtgcaggtgtgggtggctctaggaccaatggcaggtgccctgaacctccacaccctcctgctctgccagccaagcccacctctttgggtccaggcccaggatagggatgagacggatcaggtgcagatgctgccccaagcaagggtggggagcctggcctcttgatggcttgggaccgagcaaggacttcaggaccctggtgaggcagggtgggggtggggaggctctcagagaagctgtgggacccaagccctctgaatctctttgctgacagtctcaggtgcagcccaggaaccgcacggacatgggagagccaggacatgcagcgtagctcctggagggagggaggctggctggtgagcctgcccaagctgcatttattatgttcaagtacaaaccagtgccacctttcgcccctgggccatttgctaagtgaagcggcctcaccagtcaatgggaagtgggtgcactggaagcagtggggtcttctagacctttctcccagtggtgcaaaggccaagcacacctcagcctgcccctccaccccctcgagaagcagagtgtgtgctggaggaaggcggcaggcaggactaggagccctcctccccccgccgctggggctggaggaccacgctgtgataggctcgggtgcaggagaaggcagtgggcgggatgcggcgccggtcaatgaggttgttctccaggtgtgtggaggtaaggttggagtcctgagccacgcgcatgtcacagatggaattcaagggcacttgtctgcaagggaggggtggggcagagcaggggagagaagaccccggaaagacggggtaggcatcattcaagaagagacagagacccctgccctgagagaagcagtaagaccgagccacagaatcggaactgtggaggagtgatggcgggcttcagagaccactgcggcctcctggccccctcccaactcgaggctcagtgccaggcctccagccccagcccttgtcgctccaggctggagccctgccagcatccggccactgcctgcccttggctttccaggcctgccagccactgggcacagcctccatcatggcaaccaagatgggtggatggctggattgggggaggatggatgagccccgactcctgccctcggcctctgcggcctgtgggtaaggagcccaaaggccagcctgtcctagcccagccagaaggcagggcctcctggcctcagggtacctcttcctctgtgtgctggcagggtgcgggggtggagacggccacaggtgtggggtcgaggaggggggccctacctgatcctgttgtggctcaggcccagcacctgcagtcccttgaggcccaggaggccgcgtgggatggcctgcacctggttatgatccaggagcagctccgccagcgaggcgcgcaggcccaggaaggacacgctgtggatgccgtcagcctgcagcctgttgtgggacaggtgcaggaactctaggcctggcttcatgtgcgcgaacgcgtagccagggatgcgctcgatgtggtcgtggtgcagcgtcaggcgcctcaggccccgcggcaggaagcggggcacgtgcaccagccggttgtaggacaggtcaagggtctccagcttcctgtggggcggggcacacaggggcagagggagctgacggttggcaactcctagaggggagttccaggggctgcagccccacactcccaagacgagcgtggggattcactccgagatggcagccgcaacccgaactctcaacagctgggactctggcaactcctgtgtgagtcaggccaggccctgtgtgggtttatgtcctcctctgtcccccaaggcttagggattagaggatctgggtgggggccttccttgctccctgcagggctagcgatacctgctgtcattgtggagactgaggaactgtcctcccactcacttccttccctccaggtgttgcctcagggtctcctgtctcctaatcctgacacctgacagagctcagagggtgacgcctaaaatctaggggaaaagtggggcaggggagctctctgcccctgccggtcctcggcctcgaagccctctcctctgtcccttccactctcctgccctcatcctgcctctcccagtcttatcctcagatgtgtggaagctagatgtgtggggagaaaaagatcaggctccatgagggttagggctgggggaccctgggaggtcacccagccctcgctgtccgatagtggagttcaggctgccaccttcagctgggagcccccggtcgctccatggtggacacctgactccttgaggccctgaccccagcagcaggaagccctggtccctgtggccatgcaggtgtgcaagggcagagggtggtgaggcttctggaatgggtaagaacatggagagagggagcagggaaggcttctcttggcaacaccctcagcccccgtggctagggtcagccttttgggctgctcctgtgcctctcggtcccctccttttccaccagcccgaaaagagatgggtggcgccagagtccaggagaggccgcggctgaggcagctggggcttgactggccgccagccccctgcccaggcctcgtggcgggagtggaatagcggccgggcagcccctcccaggctgctgtctgctttcctttgcccccttggcaagtgggggagaggaaagaggaataattaaacccaaacgtcctggtaactttttcctggaacgcaaggatgcagggcgggaggctctggtccctggaatggcgggtcagactgtctgtcgacccccgcctccctccccactgcggccccaccctgccttggtggtcatcaggccctcctcagcctcccgcctggcacccagcctcccccagccctccccgctgttcccaggaccgtgtcctgactccctagcccgactcctacagccctacagcatctggttgccgtgagtggcctgtgtgccagcatctctacctagctgtcccaaccagatccagggaattgcccttgacttttcttggaatgaggtgaagagtggcccccagaacctatgtccaccagaacctgtgaacgtggccttatttgcagatgtaaggattgcaggggaggatgtcgagctgagctcatctgggttccccggctgggccccgctcccatgacaggtgtgcttttgagggacagaagagagaagacgagacagagggagacacgcaggggagacggccacgtgcagccacaagcccaggaacacctggagccccctgaagctgggagaggcaggaaggatcccatcctaggcctccggagggagcacggccccctaacatctagattgcagacttctggcgtctgcaactgagagaggttatttctgttgtttgaagccacccagcttgtggcactcagtgatggcagccccaggacatgcatgcacttctcttccccactttcctgtgcccccagcccttccgcgctgcttcctgcccctgtcacctcctaactgcacccatcgtcgggccagctctccccaccactgctgccctccatccaggcccgtggcacctcccaggtgagcttcctgggggccggcagggcaggcctaggcacgggagggcaaaggggattctgctgggtgggagggacagagggaaggccttgcaagcttgcaagcaatatcttggaagagtctgtggtgactgagggcccaggctaacctaagcagggagggaggtgaccccagtgacccaccgaagaccaggcccaaggaacaagtcctcccctggagccccctgcctcctggccctctctggggctccgtggctcagcattgccctctccgccttccccacctgcctctcggggctgctctgggccatccttgctctctgcctccgaatgcccattggggcgaagctctgggactgccactcacgggagatgaatccaggctcggggtgccagccagtgctcctgaagccagttgtggctgagcaccagcacgctgaggctgtggatgtggctcagtgcgccctccgccacctcctcgatgaggttggtgcccaggtgcagctcctagggtcggggtcaggggttggggtgaggggcccacctgccagttgttggccacctggtcaggctccaactctggctgtgcccattctctgccggcactgcctccttccacccagccatgtctgtgcaactcaggtgccagtctctgccctgagcagtcaggcccatggcaggggtggattttcaggggactgtatggtccagagagagggtatgggccttactcagagaacccagagggtgcagagccatccaggaggtcccactgtgggcttctggaaggttaggtcaagctgaggagaggcctgaagcctcgtgagtttcagcgcacagatccccctatgggctgctccacgccccctcagcagaagcagaggcagggttgtttgatggtaacaatgttgcctccccatcctgggggctccagctcaactgcagggaggacggcaggccgcgtgggatggcccgcagccggttccggtccagcctcagatagagcaggctgcagaggggctggaaggccagggggagatgtccctgtcacgcagctggttcccttccacctccagcgtcaacagctggctgagccctgcaggcgggcagaggggtgcggtgagccattgcagagctgctcgcagtagctctagaacccctgcctgcccctagaggccagggccccttacccaggctggcagtctcctctgcgttccagccaggctgccctgggcactctcccgagtgtgcctcctagagggcagacccaccccttgccagcccctgtcctgggggtggggcacctgcccaggcctgccccctcggtccctgcccccggaactcgcccgcaccacggaagctgctgccttgcaagccctgcaggaggttgtcgttgagtttgagctcctgcagggaggcaggtagggccgggactgtggtcagcgagttcccaaccaggttcagccgcttcagccgcatcagattctgggaggtcatggggaataggtgggctggggttgggggcctgctggtcggggcacaggccttcctgggcatggctttgggcccatcctgaccaagggcactctgttggtggcatcatggcttcctagttcccactgaatccaggcctgtctgggaaggtttctgtttgctcctatacagggcctgcaagcctgtgctgctccccctactcccagcgatggaacacgtcacaccaaattgtggaagcccaccatgctggctgctctctgcagtgcctcctccaggccttaccccctaagcagctccaccctgcagtgagtggatgcctcaggtcacctgggacctgccagccccagccccagccccggcccccgagaagaggtgaatgggccacagcataccttgaaggcatgggggtgcaggcctcggggatccagcttgttcttgctgagatccagccactccaggttgggcagccccaggaacgtgtgggctgggatcttggcaatttcattctctgtgcgcacatggggcagccatattctctgccccctgcccgctgccactctgtacctcccacaccagacagggctgctcaggggagccagggtgggagcccaggtctcagccttctcacccctgctgcaggggtgggtgtggggcgaggaggccacccacctgccaggtagagtgtggtcagaccagggtgggtcagggcagggacatgcttcatcttgacattgccacaggcgatgactgcctgggccaggaggcacgaggccggcagagagggcatggcctgctgggtggtgcccaggtctgcgtgcctgtgcctgtgcccatgtgtgcttcctggtcttttccacccatggcctggggtcttggaggtgctgccgccgccaccctggcctcggctgcggtccttctgtgggcgccggatcctcagcccaggttgatgggaggtccctggaggaagagagacagcccctgctgggtcacaagcaacaggggccctactgaggaacaggggcttgcccgaggctcccagggcctgccagtgactcagccagcctgggttggagcgacaggttactgggacccctccccttggcaccaagggcaaaggcccaaatgggggctctgaggctggggaggggacgtgactttggagggcttccctcccaccccacacacgagggcacttggcttggaaacaccgggaacggggcagtgcctgggtggccaaactcatgcgtggtcctgtcagccccagcaggccccaggccccacctgaaggccgcctgtcctggccagttctcacctttggggggcctcctgggtttcaggccccttcccttgtcttcccggcctcctgtcctctggccctggtcctcctcggtgactgctgccccctcttgagcttgagggtccctgccggcctgccagggcctcagcttcaaggcctcgggcttccctgccccagccctcatggcagctgtggcctggggctgagcccactcagcgaccaggcccttgttgtgaccctgctcctgctccaaggtcactgggggtgactccttcctcagggccagccctggcctgggaagcgctttccagccagtggagggggactgggtgggggttccttgagctccctgcttcggggtgggctgatcccgcaactggtccagcttcccagcctcaggcttgtctgggtggccgatgccagggatgggctgcagctgacctgcggaaggagccagtgtgggctgggggccttgcctcctttccccaaggggctgtcagctgctagaaagcccatcgcccttcctctttacccaggcctccccccgccccgcctttcccttacctcctgaggagcactggcgagagaacagagtgtccccaccgtcagcagcaggccaccagcccctggggccagtaacccagagtacctctcagaacttacacagctcctcactgctggggaggggggtgggtggcgctctaggcccattagggctaaggggctgggcctataggttaggcccaggggttggaccggtggttgggcccagggagcttcagcagccctgggtagaaagccttgggctgctcaagggaccttgggtcccacctcccctcacttccccagtgtgtcccaagggtggggggtagggcgtttccccagcatcccctttgccccatacccattagtgagcaaggacttcacacgtgcttcctagggacagcttctggggagatgaaggggtcgctgcgacctggcacaatttgcttttagaagtgaaagccccagtgtctgctacagggggtttgttggggattaggcaagcccaggggccacctcaaggggtctgtgagccactttggaggaatgttgataaccccaatgcctcctgtcctctatggagcagctcctccttaaccagggccaaccatggggggcaccgctctgtctgcaggggtgaggggcagacccacccacctggcccctcccgccctacccccaagcctggggcagggccaccaagtgtggctacaaccactggcctataagacaaaggccacactcatagcccatgtcctcgggcccctcaagcccctctctgccagcaaccccacttcacccccaagccctatactcccagccacctgagattcttcctgtctcaggaggcactggggcagccagagcaactcctccccagcacaccccagcccgctctcagcctcactgtagcgcccgctcctaggaaggcctcttccctccctcgcccctagagtctgcgcacacccctcgccctccagggagggctctctcagggccatgggccctttgcagccctgcctgagtacccaaagtgggcctgaggtggacagcctgcggcagtcttcttcctgctggtgccagctactcaccgtcgggggcccctggtgggctgggcagcagctgcagggtagccaagcccatgggggttggtggggcccctcctgagcagctccccgcccacagtgccaggatggggagcagcacactcctcttggctgccatggagggaaggagagctgggagaggcacggtggtggccacggcaggacgatggcggacggcacaagttggtcttgctccctgagctcctggccctggctgcggcacttggagtcttccctgcccaccccagcccttccctgggaaggccccccttctgtcgagcaaacgcctcccccgaccttgcccccaactccccacaacgtgcactgctcccacctgaagagaaagacagattgccctttcctcagaccggacggtcctgcccttttgctgtgaggcccgcattgattctccgctggctctggcccagtggcctccatgaatggggcttctgtctcacacgtggcaggcctgagaggcccaccacagagcgggtcggccaccgcaggctgctgggccctgcatccatggctgcgaaaggagagggggtgggtgccaaggccgtgggcttctgccgtgggcagcactgtggaggcctccgggttccagaggaaatagaatctgtgggcacagtgcaggcggcgagggtatgcctcccgtgcctgagaccccagtgctgcttgggcatgggtgtgcctcgggctgggctggctcctggttcctctgcttgccctccaggtctctaccttctcctctgtaaaatggggtagggggcagagttgacgttctgtggctgtcccgaccccctacataggagcatgggtgttccaggcactgcctgggtgaagccatgtcacaggtcccccccagacttcttggccaacagtctgggatctctgatgtgcctaggctgcacgcatccttttggtcagaggggcacctgtgggtcaggatgacatgaggtggaaaataggctgggctcgatgaggggactgctgggtggggccagaggggcgtgtggtggagtgaggggcaaataagggggtgtctggctccagttcctagagcccgccaccctcagagggctgccggaagtccctgctccaactggggtgtccctgcagccccaaccccgcgttctgctgtgggagccagggtttgtgggagcaggcaggcgggggctggcagagaggactgatctcaccgctggctcggctcttcagggccagtattgaggaagcttttcctacagccctgtccagcgttgacttaggtttggaagcgatcttaagaaatgagttaattgtgggcaaggcttgggtggaggggagaagggaagcagtggaggaggggcaggggccggcaagggccatcaggcaggagtctccatcctggggcaatgaggcaatgtgtgagatccagaggggtgcagggctggtcaaggtggggaggaggcctggcaactgggtcttcactgggctccttgaggagctgccgctccagctaacagtcccgtaggagccacatggggtcctctgctatatccagggtaccctcgccatccagggctctggtttctgacctgaatttggaccctgccacgtacagaccagaaacagggaccatctagggagtcagcaaatgcctctggagtcagggatgaggccaccatctccttgtgcgtcctgtgggtgacacaggatggctgtgggccagtgtcctgcctgggggcagctgccgaagctgggacagggtagcactggggcacggcagacttgaagtatgctgccaagactaagtgaagcttgccccaggatcctgcaagacagagcacagtcgaccccccattttacagagaaggaacagagaaggagtggggctcacccaagtctcgataccagaggccagtcctcctgcctcctggtccaggcatcgcctgagaaacggggtaggtccctgcctgagctgagcctagcacctggggtcgggagactggacggtgatgggaaccccggctccgcccctccccctgcctggggatggattctggaatcctggccccctacccatttcccctgtttgcgccgctccccaggcgctgactaaacatcctgccatctggttcccattagctgggctgggggtgggggaagcctgctcccaggtttctctggcacagccagcctggaggagggagggactccgctcctacccacctaggcaggaaggggtgaggcctggggtgctctcagttcccagctcccatggaggcctggcctcgctgcccttcccctggtcgggagcctggtggctgacctgggtgggcccctggggagtggtactcctgctgcccactctgtccagtcccagggcacccggccattgtggggaccttgaaggaacccccatggagcagagccagccttcaggggctcagcagagccagaggctcccggcaagtttctgccttgccctcccccccgcccaagagctcactgacggacttgtgctgagacaggcaggccccaagccaacagtaatcccgagcccggtgtctggagcagagggtgggagggctgttgggattttccaggaaccagggatgcagcccgagggttgctggaaagagctttgggctcccagttctgccatggacggactggccatgtgacatcaggaacaagcttccctccctcctcagtgccccagtcttctcatttcagtatggtggaaacaggctccttagaaagttctagaatctgagagccagaaggcgcctagagaagctggattacatgatcaaggtcgcttctagttgtacaatcccaggattctaaggtcaaggaagggactcctgtcccttgtcctcctcccccttcccttccatgtagcccacgcttcacacactcatgcacacacataccctctacaagctgggactcagattggtagcctggaggatgccaaagcaatgctgtttgtccctcaaggctgtcatcaacgaggactggacagtggattctttgctcactgacaggggatcaggtgaggaccgtgagaaagtgacatttgggcagaggcatgagtgaagaggccatggccatgcaaaaagccacagaaagagccctccgaaaaagagggatggccagtgcagaggccccaggtgagaaagggttgggcccaatttgagcattggcaatgacagcaatgtggtggagcaggctgagtgagccgtgggaaggtgtctgtggcggtgggctggcttgcctttgtccttgaaagaatcagggagccaccttggactgctaagcagaggagtcacaggatccggcccccctcaggctgtggggtggagcacgagcagatgtactgggggcataagggtaggaggtgggagccaccgtgtggcagctgagcccgccaggggccaggtgatagtggctggccaagggtggaggcggggttgcgaggaggagcgggtggggtcaggagcatttgggcctcagggtcaaggtctgggggctgttcctgctctcctgctctcctgctctctgcaggagcacctactacgtgcctgtccttttcccagggcccagggcagccagagacacagccttggggtgacccccagagaaaaggaacaggcccattcttgagctttccacatgttgtctgagtgaaaacgacagcagtgtgtggcacatgggtggcattctctggggacatgcgcctgcagctatcttatatgtcagtaacaatatggggcctttcccccttaaagcttggagaagaaaaaagccccattttccatgccctcttcctgttgcccgcaactcttccctagaggaaacccatcttattttaatgctactgaaacctcagaggatctggtcccaattaaatgacttttcttgcagacgctttggtgagcactaaatgcttgagacctggtgatcctgagcgagagagcctgctgcggggtgggggtggagaagaaaaaggagggaaggggaacacaggaccccaaatgggacaagggtggctgcggatggggtggagggtgccagtggagggggactgcagagggtggcacgcagcagggaccagcccatagggagcagggccgtggtcgggatgggggcagaataggggccagtttcccaccctctttgcccgtgtgaaattcgagttcattcccgcccatagcgtggcttcgctggactccgtgtgaaagcggccccgccccatcccctccggtgggcttcgaggacctcggcagggaacggaggttgggcagaagctggagctcaggcccggccggggagctcgggcaaagcaagaaggcgaggcgggcgccccctcccccggccggccctccgagcgggcacgttcgtgttcccgtcctggcgccctcgcttcccgctccagacgcatgtgactcagccccgccggccttgccaagccgtctagacccgagcgtctccccgcggagggggcgatcccgcccgccgccgtttcctttgccgccgcctgcgcggctgcgccccgcgcacgtgcagcagcgctcgcccccgcccgccacctcccgcgagccgcgtgcacgcgcagccactcgcccatcccgcgccagcgcccgcgcccccgcccccgcccccgcccccgcccccgcctctcccgttgcgtccactgcaaacaggcagttcgagggcagaagcgggaaacccaaaggtccccagggccccagaccatccctcccatttttggggcccggggcaggaggacaaagatggaccgctgagccactgcctccctgccagccagactctgtccacaccccctacaactgcctctggcctcagagcaagggtcgccctaggtcgcaggccctgccctcttgcaggagcctgtggcctgggggacagggcggggtaggtgatggtagcacctccaggcccactggaggcgatggtgatggcgatggtggtaccatgctgactgcgctgcggaatgtgctcttgcaggagctggtggcctgggggcaggatggggcaggtgagggcccctcaactgcaggaggtgagggtggggccctaaagcaggaggcccagcatagggactagaagtgacaggaagaggaagccaaggtcccaaggcagcctctccattctcatatgccagtagactccaaagatgaacacggaggcctaggaggagaacgttgtagagttgagtcttcaggcagctcccaggttgacagtgtggtccctccagagttagggccacaggccgcagggctcccccaagcttacagccacttccttgtctcatttgcaaggcccccacccctgctttcgtgttctccatcccttcccccatctgcaaggatagggctgggtttcgggtgggctcctggctggtgcagatggcgtgggctgcccgcaagacctgggtactgagcctgcatgccaggatgcagggtggatgggtgaccaacagctcagcctggcagcttagcagcagagaggtcccaggaagacagggaggagatgaggagaaggaagagggagaggaggacaggacggggagggaggggaggggaggcagaggcagccccctggctttgccttgcctgcggagagcctcacactcagaccgtcctgagcctgacctcattactctgtcacatttctccctcaaacccaatgccagggctcaccacttgcttctcgcatgggtgtgatcagcttctcatcttagacctgaactctccccaaaacacacacacgcacacacacgcacacacttgccttgtcttcaacagcttgcatttggtactctccacccttactgaggaactttagtggccaggggtggggggtgatggaggacacttcagtccctcaaaggctcctccccaggttccctggttcagggccgggagtcgaagtggccccgtggagcaaggccttctagggctttagctctgacagcattctagggcctaggcgcccccaggtggggtggctccccctcaggtctaactccagcccctgccagaagcagacccgcctctgcagagaggaaagcccttggacttcagcttcctttgattcgcggtgtctttgggggattggggggtccctggttgattcccgctgcaccgtggggtctgcccttaaggtcatatgaagagcagggcccggatgctctgaggactttttcaataccctccacaggtcagggaggctgcccacttggtgagctcaactgtttggccatatatctctgggcccaccacacaaactgagaggtctcgaatgccaccagcacccgccagcccatctctggcacagcggggccagtgccgtgaaccagtctcattttccaacgtgttttccaagcactgacacggctgaggccctgctgggacgcatggccaactttcctccatgaccaggaccccccagcttccccgccacatccacagcttccccccaacatccctcctccaggtcaatgggtccttcagccacatttttggctcctgacccacccaggcctccctcagagaacctggggtctctgggttggaatgtcccttagagatgtgccccctccctcccccatggtaggactcaaccctccacatccccgcccacccacctccctgggcttgtagaccttctaggaccgggagctcccttcctctcctggcagccagctggtgttcagacagtgatttctgggaggagtgctttcttggactgagcttgagtccacatttccagaagcttctacctctgggccccttctttcccccttcctgagaggcccagcagcctctctgttccctccccagcctccagcttttccggaggaagatgcctgggaggtgctatgattctgggggcgggtggtgggtggcaggtggtgggtggtgggtggtgggtggtggggtggcgtgggcagggaagctgcagcctgctgctgggtcttcagcgaccatctccaggggctgagggctggccaacaggttctccatgagggggatggcctccataacctctcaagatgatcttcgcctctcaaggccctgccagttcctcagggtcccatagactgaactgctgaggttggggaggcctgttgagcacactggctccgtggagctgggtggaggagggagattttcttccagagtacacaggagctggtttcttcccggtcctcaggagcagagaatatggggagggttgggggaggctgccacactgccgtggtttcttccgccaaattccccagtcctaggaaagatccacagaaaaacccacaagaatttgaatgtctgagctggggctgtgattgagatgaaattttctaaaaagaaagaaagaaaaacaaaaacaaaaaagagggaaaaaaacgcttaaaaaaaaatcccaaagcctttgacagccctcagctaccagaagggcctgaggcagcagccacgtggaagggtagagagcaaccttgaggcacttcgctgggcctgtgtcggggcctcccaggctgaggtcccttcctgtgacccccggactcctgcccgctccctcctcccaggacggagtgaagtcccctcctgtcacttggatgactgcagttgcctcccagcaggtccctgggtctccctgactatagacttgccccctgatcccaccctccaggagatggcagggtagggcacagaggagggcacagtggcagctgcctgctgctgtctcctggctactgggcacaagccaccctccaactccttcctgccttgcccaatcagcaggtccctgggtaaggggcattcagtgaactgggggctttgcaggtctgggggaggagcgactgacatatttcattgcagacgcattgagtttgagggtcctgagggatgtagaaaaatttgttaagtagacaggataggaaggagccacaggtagccccaggagccgtgaggggagcagggcccagcatgtattacaatagtgagcatttacgtggttcttcgcatgcgccgggcactgttctagggattccacaggaattattaccgcctgccatcctcattagcaacccagtgggtaaggtgctctcattagctccattaggtgagggcaaagaggcacagagaggttaggtaactggttcaaaggcacacagctggtgagtgacaagaaatttccttctaactacagcgtgagcatggtgaagagaagacggagccccgcgctgggagaggaacgcttcagtccgagttccattctgcacccaaggctccccttggtcctcctgggaaccagggtgccccttagtggtggtggcccaggagaacccgaccaaggcaggagcgccccctcctggaagagcctcgcttcaacgcatcatcattcccggccggcagcaggggcgacgccagcaaggcctgcgactcagagccagcttggcccgttcgccccgccccttcccggtgtccgccccgcccctttcccggtgtccgccccgcctccttcccggtgtccgccccgcccccttccctgtgtccgccccgcccccttccctgtgtccgccctgcccgcttcactgtggtcctgcctctgggtggtgccggggcggggggtgggagcccggggcccgcgcaggcggagatgtcgcccaatgggaagggtcggtcgggaagggggtgggcgcaggcgggtgggcgggaagaacgctggaggttgattggcggtcttgccggccagtgaagccagggcatgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggtgctgttggcccagaaagccactccagggcgggggaccggggagggccccgcccgaggcccgggagggcttgctgcggaagtccgcggcgccacgcggccaccgtcgccggttccggctgcgccctgttcccttgcagcagggggtgcttgtggatcattcatctttgccctttggtgtgccccaggccttcgttcttgctgtctccacggcccgtgcctggtagttggggccagcaccgcctgtggaactgcagtacccgcgctgggcgctcggagcaagtgcagacacagaggacccaggcctggccttagggatcttgcggggtctggggggacagatgggcagagcctcgtgccactctgtcaagtcagcgagactagggcttggtgtcagttggtgtcagatgccaggggtgatagcctccagaagccctctacagccccacaggacagagccctcactgcagcagtgaggaaagctggcccacgaggttagggagctgtcccaggtcccctcggcccgctcgctcctccccccagacactcccccatcctgtccgcgactggctcagtggtccctctccctttccctctcccctttccctcagtcccgaaacctaggactctctcttaagtcttagtctcaggcgttgctcctaggtcctgctgccacaagagcccagagtgggagtacttgaaagaggtggggtctgcatgccgcgggagatgtggggttaagaatggggggacttgaactcttggcaagatggcaggacgcgggtaaaggaaagggtcctgggagcttgcagatgtacactgaggactgggcgcggcggcccacgcctgtaatcccaccactttgggaggctgaggtgggcagatacctgaggtcaggagtttgacaccagcctggccaacatggtgaaactccgtctctattaaaaatacaaaaattgtccgggcgtggtggcgcatgcctgtaatcccccagctaccctgggagctgaggcaggagaattgctggaacccaggaggtggaggctgcagtgagccgagatcatgccactgcactccatccaggctgggcgacagagtgagactccgtctcaaaaataaataaataaataaaatgaaatgatgtacactgggactttcagtgaatgttgctttccttttccttgcttaggacctaaactgccccttcctcgagggtctgtatatcacagagccaaagacaattcaggaactgctgtgcagcccctcagagtaccgcttggagatcctagagtggatgtgtacccggtaatgcatcagtttcttcctcttcccacctggggtgtgcatgggcgccagccagccccacctggggaagatggggtttgtggttactgtgagtagctgtcttcccagagggctccaccccctagcctggaccctcgtgagaacagctgtgtaggtaaggagtactggtgacaggcatgatcaaacttggggcaaagtggcccctggcggtgctgggctagtccagccacccctttgctgcagtgctgaacttgccctcagcgtttgccttgccttatgagtttggaggttcaggactggcaggcacctgagaaatgctccattccagtcctttccttctcagacccggaagccaagggtcaggctggaggcatgaacagtctctggtctcccagtggaggagtgacaggcagggccagggcgtgggctcctggctgggtctcagctggccaagtggtcctcatgcagtgtcacctcttgtcagcttctgtgccgtgacccgtttcccagtcctctggtgcctttgggccagggtgtagcatggtgtgtgcctggcaccctatgaagcccatggtgacagggtgacttcctgagtgatggtggaggaaatgatccagagtgtcccattcccagggcagacatccttcccctggtgacgtagtccctgagctgagggtctgtctcactgcctcacagctgtgagtggagaaggctttccccgcctcccacagagcacaggctcctgtgggattgggtgtgtgcccaggccatgctcaggaacagctgtagtctgttggtacaggagcctctcgtgagtccaggcccgggcctccccctcctcagcctgcggcctgcctacccttgctgcttgaggaaggggcctgggcgggagcctggcagtagagcagtggggagccaacctgcatccagccggtctggcccgccaggaccagagacatcagcaggacgcccagctggatacaggcccccagaggaaggaggaggcgtttttgtgtttgagcccttgctgttccagaggcgtctcctgcctctgccttctaggcccttcctcaggcctctccccagggctcagcacagcagctcctcgcttcataaccttttgctcttgctcacattgttccccctcctggaaatggccttctagtctctgcatgtcgtacgtcctcctgtacagcccgcaaagacccaactcacacgtcctgtctccttttaaaatgtttcctgttcccagggcagaatgtattccgcttccctctggatgcccacagcctttgagcacaccctgcccctgctggagccctcaacctgtgggtgcactcttggcctgctgtcatttccggctctttagtatgggagccgcagcatggtgtggccgtgcagtcggggggttctccaggctgcacctgtgtgccattccacgcgctgcagacgtgactgggtgtcctcaggagctgggtatttagtgggtacaagtcctggggttcagcagaaatgatgcacagcactgcagtctgagttgggtgctgtggatgttggcagggaggaggtggcatttgatctgggatggggacggtaacagcggggtgctcgtttggacaggagcagggagttgaggtgtgggagagagagctgggcagcagcagctggaatggcagctcagggcagctccctcagggccttgcatgctgtgccaaggcctttgagctttatgttctgggcagggcaggcgtggaacctggggagcgacgtgctgagattggcattttggtaaggtgactcagggtgctctgtggcagatggatttggagggcaatggctgcaggcagggagaccaataccccagggaaagacagaaggagccctgcgctgagtggcagatggcttgtctggcagccactactggccctggagggaccagcccctggcctgggaacctgggaggctgggaggtgaggcaggactggagatggctgggtggagtgtgagggtcttgagcgagctcccaggaggaggctcttgtgggagggggcgcagatttgcctgactcaggtggaagctgggggcacttggggaactggggtcatctggccagagagggacgggtaggaggccaaagccacgcccctcagatgcttctacaggttgagtgtcccatatccaaaatgtctgggggccagaagtgtttcagatttcgatttcttcggattttggaatatatgcattatactggtcgagtgtccctaatctgaaaatccgaaatctcaaatgctccagtgagcatctcctttgagcgtcatatcggcgatcagaaagtttaggattttggagcatttcaggttttcagattagggatattcaacctgtagtacttctgtaaataccagaaaccgaatcctttgaaaaagctgccagggagcatacgatgacgttgtctgatttcaggttggcgagaattccttaggccttttgagggtcctacaggagaatcagatggatgggagttttcctgtgaatttcccattgcctttctttgtacgtgaccgcaccctgtcagccccatttagggccgccttttcatctcctcccagtagaacctggaagctgcacctagtgttggtccttggtgtgggttggggcagagctcatggagccccctggattgtggaggtcaaggccctgtggctttccttggggcctccaaggcctccagcattttctgttcctgctctgccctctgctgtgacggtgcggtgacttgagtgacagcccttactgagtctggctactggggcttctgcagcgtgggttttgagtgtgttcagggtttactgtgcccgcccttgcacagtgctgggtgagtgccctctgctcctccgagccttgtgctcagagatgttctcggcaaccccgctggcagagcccagcctgctggcctcccccttccttccccaaccccgcttgcgcagaacccacggttgtcttaataagtcacagaggtgggtggtgctgtggaggcagccaagcccagcccgatctctgttgcagttctggggcaagtgtggcctctccagggaacagccaccagccctttcccaccacacgagtcagcaggctcctagagtgatggcaatggtgaggtgtagccaggctctggcagcctggtggaaagcgactccttcttgtttatgaaaggctgctgtggtggcaggtgcctggggctcccgggtaagagcctgtggccccagcggccggagtgatgtttctgggcctcagtgtcataccgggcttgaggcatggggcttgggactggggatgcagtgcttgggctgtgctcccctgaaggaggagacccagtggagggctgagccgtgtgtcacctgtggtgcatgtctgggtgtcgtgggacttcctgccttccatgcgctgtgcatgtggatctggttttgcccaccagatggcttttaaggtgacatgcttctgagcggcccctgtgtgctgcagtcaagggcaagccttcaccgtgcccaaggtgatgagcctcgactgtgaccacagactctgttgcggcaggagcccccacatgactgaatgcaggcctcacaagccttttctgcagagggccgggtgggaagaaagttttccaccctggagcagttgatgccgacccaggcgaggccggggagggtgccaggagcccggggccagccctcaaaacccacccgctgcgccatttcgagaaagagccctgagtgctggcagcttccctctctgcctctgctgcagccatcttttttttttttttttttttttttggtcttgagaagaattttcatttcagtatccagattcatttctgtatccagatttccgaggtaaacttcctggaatattctttccctaataattaatggaaatgaaatccacgtgacacagaagtaaccactttaaagtgagccgctccgtgccgttgagcacgtgcacaggaattcacttcttccagcgcgtatagagggcccagggggattctctggctgtctccggcctgaccagctctgctgtttccctgcagggtctggccctcactgcaggacaggttcagctcactgaaaggggtcccaacagaggtgaagatccaaggtaggtggaatcttggtccattctgagcttgtccacagcctccttatggagtggtggtgcatgttccattggaccaacgttttcttttaggtggtgcatgttgtgtggatgttgctagagccttcttgaaccccacccttccctaggcatggcaggtgggagaactcctctcgcagggacctagagcacatcagtccctgcagcgctggtggccagagacagagatttttgccgatgccagcagtggttccgtctccctgtgtcagtggtgtgtgacacgctctctacaggtggcatttctaggggcacctgctgctctccagcggagcttgccttataacctcctttctatcatttcttggtagaaaccgtgcttaacctggtaatgaatgttggataaaggtgagcaaaactgcagtccccaagttggtggctaacttttcatcttcatggtgatctctctagaagttggtggaatgtcaaaggtcaaatttttcatgggcctgtgtctgttctggccactccagggtagataagctggaccctggagtcctgatccgtgccccagctggcattgccacatgagttatctggggccagttcttcctgtgctgaagtgggccagaagaaggaggtgttgttttagagcagccggtgggctggcctgggccacacagaggcactgcccttctccctggagctgccgtgtctggtacattccagattctctgacccacaccaacacatgtgtgacccgacccagcccagccttagccctgacaccgccattcccagcctgtttcctctcctgtcaagtggggatgaaacccagccttgcctacctcatgggaatatactgagtgtcaggcttgtcagagggcaggtgggagagaccaggaccagtagggtgtgaggatagttcaggaattcatccgacgaatggttaaggagcagccaccacatgcgaggcgctgttcctggtgctggggtgcagcagtgagttccactgccctcgtggcgcttgcgtgctagcggggagagacagggccagagggtgggagaattgttcatgcacctgccagcgagaagcactgggaacagccagctgagggctgagggtcctgcagggcttggggaaagggtggtgctgtcttgacataagatggcaggaggggcggaagccagcgcggcatgtgcggagaggaagagcatgcgcacagggccccaggtgggctgtgcctggcagcttggaggcacaagaaggaggctggtgtggctggagagcagggcagggcaaggagtgaggttgggaggggacgggccagatcaggccaggccatgtgggccccagaaggacgtgggctttgactccgaggaaggccgagttctgctcttggctgtaacgacacccctggcccactgtgctgggaacagggtgcccggggaagaggcagggagagcggtgtggggctcttgcagtgagtggtccaggtgaaagtttggagaggcagtgcaggaggcagcgctggccagatctggatttatagagttggctggactcgctgagaggaagagaggggtcagggaggacttgaggatgtggggttaagggcagtggtggaacaggcttgcctaggcatgcagttggcatttatatggtggttctggggttactgagtgcttccccacagactctctgcttacttcttgcaacaaaccctccagggttaggtggaggggcaggtctggcatcggccccaggctttctggctccaagttactcagaaaatgccctgggcaccctggcagatgtggctggatagtctgcagtgtgcacggcgccaggttccccatgcatgaaatggaacaaggtcttccacccccagggctgctggcagggtgatagcagatgatggcacgaaggtcctttaggacatggccagatgggagcggtgagtccatttgctttggccttgtgaggtcttggagagagtggcagacagtgcactgtagaggttcactgacccctgtccactcctcaggcagctgctggcttctgctcaaagccagagtgagtgaccccaaacctgggagagcattgggtacaattcctaattttcagacgaggaagctgatgcccagagaggggtggggccactcagcaagaggcagcgctggcacctgggtgcctgcctcctggcccaccctggtctcctatacccagtctagtctgtgggtgctgggcttcctgggtgtctgctgtcccctgctgtctgggcaggtgcctgccatgatgggctctttgtgtttcaacagaaatgacgaagctgggccacgagctgatgctgtgtgcgccagatgaccaggagctcctcaaggtaagagggcctctgtctgctctgcagacggcacgcacgctttctgccctgggcagggaacctcatggtgctggctgaggtgggaggattttcctcccctagtgcctttgaggttcctcaggccctggggccggctgggtgcccgggcaggctgcttctctaggcatccctggggccagaactgctgggattctcttgggtagaacctggttgtccctggggcgcaggggagagggcagccgtgcagggaggggcagatctctggcttctgatgaccagtgggatggaaagtgtcctgtccttggttgatgacttcattcttcattcatcccggcgcctggctcccaagcccttgtggcccgagagtttctcccgaggtccctcatctaccctgcggtaggtcaaagaaactccagcacccaccttctcgtttctaaattttgaaataattgttttcactcgatgattatgagtaatgctactataaacattcttgcatatgatttttgactgaacacgttttcttttttttatatctgaagagatttattcacgtgaccaatggcctatgacacagccccaggaggtcctgagaacatgtgcacaaggtggttgggctacagctggttttctacgatttagggagacataagacgtcagtgaatccatgtgagatgtacactggctggttgaacacgtgttttccatcctcttgggtgtatagctgggagtggaattgctgggtcacagggtcactctgtgcttaacttttcgaggagcccccaaactgttttccagtgcggcggcaccatcttccttttccagcagcagcgcgggagagctccagtttctcctcgtcctcgctggcacttgctggcatccgtcttgttgattctagccaccctgctcggtgtggggtggcatctcattatggttttgatttgcatttccccatgaccagtgatacggagcgtctttttgtgagcttgttggccatttctgtatatgctttggaaaaatttccatattcatgtcctttgcccactttttaattgggtcacttgtccagtgaggttttttttttgttttgttttgttttttttcttaattagtagacttaataatttagggtagttttaggttcacagcaaaattgagcagaaagtacagagagtctccacaggccccctgccccacacatacacagcctctcccgccatggacacgacaccctgcacacgggggctcctttgtcacagtccatgaaccagcatggacacattgtcacccaaagtccatatccagtgagtcttctctcctgtggttgagagtccgtggttctccgtgtgccaagtagttctctcgacattttgcctattactttggctctgggaaaatgtattctccacacaatttatatttgtatacatatttgtgctttagcaggcacttgacctgcttaggtttaaggagcaagttcagccgcctcccgcctcttgcctgccgttccttccagcatcagctctgtttctgcagcctttgcatggctcttcgggtcccccctgtgtgtgcgccacccagtggtcagcctgggagactttgctgggctcaccaagatcagatccacttgtgcacaggtgggcctgagcccaggcattgtaaacagatttgtggggtcactttcttgagccgtttcctctccactgtcttttggatactttctagttccctggggctcccttttcctgtcctccagacataaaccacccacttccgtgatggtggtggcacggccagctccctgccagtctgcaggagaactcggaatcctggtgttcctccctgacccacctgctgacattcgcttctcagagcctgcgagcacctgccccatacattctgcccagccgtgggagcactgcgcttgctttatatttccacattggcattgtggcaaagtgcactttacgtaaaatctgccatgtcagtcatgaaaaacaatttcctaacaggccctgtgggagctcgctgctgcttttttttttttttaatttaaaaaattatggtaaaatacacatcacctaaattgtatcatgttcaccatttttaagtgtgcggtccaggggcataagcacattcacggttctgtgcagccatcaccaccatccagccgcagaacttgttcatcttcccaaactgatacttcgtcctcaatttttaagccgcgttaaagcgtacgatttagtggtcttcagtacattcacagtgttgtatgaccaccacctctatccagttccacaacattttcatcacccccaaaagaccctgaaccactgagtagccactccccattcccctcaggccttggcagccactgagttaccatctgtctgtatgtcattggagtggaatgctggaatgtgtggcctttggtgcctggcttcctcactgagcacaaggttttcaaggtttgtccatgttgcggcagcacttagcaggactgcattccttgttatggataaacaatcaaaggaattggagaattccattggtattattgagacctgggagttggaggagggaggaaggagatacagatttaagatcattaggtagggtcaacccttgtagtcctgagttttaattgggaatatcagcatgagcccccgggcttcaagcgatcctcccacctcagccctctgagtagctggggtcacaggcatgcgccaccacactcagctaatttttaaaatttttgtagagaggaggtcttgccatgttgcccaagctggtctcgaactcctgggctcaggcaatcctcccactttagcctcccaaagtgctgggatgacgggcatgagccattgtgcccgtcctccgcatatatttttacattaagggatatatatgtatttccttatcttgtgccctgaaaatgcctagaacaatatgacaccccggctgtaatgcaggcggaaacacagagagcagcagtcacccaagacttgggtcacgtccgagggactcaggagccaactagcaatagtcagagaggggccagtgggagcctcgtaagcataggggctgcagtagacaggcacccttcacgtatgcccaaatccaggtgttcatagtgatgttttataaagtcatcaatttgacactaaaaacataagcgacaaaagaaaaaacagatcaattggacttcattaaaatgaaacactttggtccaccaaaggacaccatgaagaaagtgaagaaacagaaaaacctacagaaaggcggtaaatagttgtaaatcacatgactgatgagggacttgtatcccgaatctattaacaacccttacaactcaataagaaagacagaaaacccagttcaaaaatggacaaagtgtccgaatagacgtttctccgaagaagatgaacaaatggccaagaagcacaagcaaagatggccagcatcacgggccattagaggaacacaaagcaaaatcatcatgagatgccacttcacacacactaggatggctagaatcaaaaaagaaaaggaggccgggcctggtggctcatgcctgtaatcccagcactttgggaggccgaggcaggaggatcgcttgagctcaggagtttaagaccagcccagacaacatcgtaagaccccgtctctacaaaaagtaaaaaattagccagacatgatggcacactgctgtagtcccagccacttgggaagctgaggcgggaggatcacatagagcccaggagttcaaggcttcagtgagctatgatggtaccattgcactccagcctgagcgacagagcaagaccctgttgtttaagaaaaaaaaggaaaatcccagtgttggccaggatgaggagagattggaacccttctgcattgctgtaggaatataaaatggtgcagctgttatggaaaagtctggcagttcctgaaagatgtcaacacagttaccccgtgacccagcagttccactcccagctgtccacccaggagaagtgaaaatatacatgcacacaaaatcctgtacctgagcgtccatagaagtgttattcttaatggcctgaaagtggaaagagcccaaatgtccatcagctggtgaatgtataaactaactagcaataaaaaggaaatcaactactcatctgcgctgggacacgcgtgatcctcgccagcctcatgcttggtagtgtatgattccattgctgtgcagcatgtagataggccaggtcagtgctgtggggacgtggcagcccgctgcccccagatcaccttggagcacatgactgtggtcagcaccaccgtgcaggcagtgagccctcccagtgccatcgcccctgtcctgggtgccctgagcttctcgcacctgtgctcctgaatctgcctcagttggatgtcatggtgatgcccaggctctatgctattggcagtgttgccaattttaccttatcattgcccccgcctgccacacacttttctgaggaatgcaccagaacggactggctcagccagctgctctggcagcttccccaagcccgccaaggagcatttgtgtgacaagttggcgctgaaggcacaggccacagtgaaagggccaaggcactcccggtggcatttcatgccatggagttgacccttttgacgtggttaggatgttcagagctcaagaagtaggcctggctgggggctttctggagcaggcgtagcctctcaggtcctggggctcctcagcgatcctcttcccttttctggaaggaggaaagagctgtgcttccggaagccttgagcttctggctgggtggctcccatgggtatctcactcacctttccggcgagtgggggactaattcagccccgcaggagctgctgctcctggagcctgggccttccgggctggaacgccagtcccctggctggaaagcaggccacctctcagccccatcctgtcggcttcatctgttcccagctgggacggcgatccttggaggagaacaggccttgtcctggaggtgtccctgtgggctgtgttctgtcatagcaggccctgctgtgtgctgcctgcccacccagcaagccatgctgtcggctgcacgacagacacatatgctcctgtatgtttctgcagtgctcagcccgttctggcgtgtggtcccagcatcattacagcccaaggcagggaccaggcagggagcacttgctagtccaagacattgctgggcaggcacagggtcgttgatgggccaggcccctcctttcccctggctcctggcatgggtggcatgtgggggcaggggcactggggacagctggccttggcctggcttagatggagccagtgaatgtctgtggtcttccttgcccagggctgtgcctgcgcccagaagcagctacacttcatggaccagttgctcgataccatccggagcctgaccattgggtgctccagttgctcgaggtaaaggtgtggatggcccaggtgggcagtattgacgggcttctcttggtcctagttctggagctggtaggggctggggtgtcactccccctctgatgctggctggggtgtgacaccccacttggggatctggctggccaatcaggggccgggcagcatacgggcaaggggcagctgtgtcccaagggtgctggctgttgcccaaggccccgggggtgagtatgaaggtgggatgtgggcctcagagcagacgggccaggcacagaggagggtgagcacctagggtgctccatgggtgggtaggtaggcgggcaaaaatggaggagccagggcagacaggtggggcaggattctgcgcggtggggcttgtcctggcctctgtgcctggccccgatgtgcttctggggccttccctgtggggctgagggcctgctgggcgagtgctctggcctgtgacggtgtggccctgggggctgcctttgcagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtggtacgtgctcctggaggcctcagtggcagcaccctggcctcctgtcccagccccaggctgcttggttctgttactgcagacacccctggcagcggtgagttgcaagtgttccctttctctccctgcagggccagtgcctctgccaagtccgaggaggaggagaagctggcggagcttgccaggcagctgcaggagagtgctgc

SEQ ID NO: 3994 - DNA, 33956 bp, human
atgcgcctgggacttgcaatgatgaaacagggccattggcaaagctggggtaccagtcacccagccacgctctagggtggtagccaagaagacggaccccgagcgggaggcagagagacaagaggtggatgaagcagagcaaggtcagaagggagagggagaggaaggggtgagggaaaggtgcctggagggcggcgagacgaggcagaagcctgacagggaccaagggggccgcagggtggcgatgaaggggcgtggatcagcagcctacagagagcaccggggaaatctgtggacaccctcgcggcactggggacagcaggaccagggcttgggacagcggaggcagcagagccaggggcatctctgggttgctgaggaggcagcttgaagccagccctacctggagaggggaggcgccaggcgcaggctgactagttggcgggctggggtggtgggccgtccgcacgtctatctgtccggtgtgtccggcggaccgaaagcagctactcactcctgggcagtttgtggagagagggagacagaggcggcgggcgggaggctaaaggctgggcaggcgggccgacggggaggggacagcggggagagggcggggagggaggaaaggagggagggggctggtggggcggagagggcgggcgagcaggagggggcaggcttcccggcccccctggcagcttcaaagggagcaattttcttgtagacggctggactagctgagcccccgccccctcgcccccaccacctccccccccctcccccgcctggggcagacagcaaaggaacggacacactcgcactcactcaaacaaggacccagagagtcaaactttccactgcccagatggggacactgaggtgctggctggcatctcgccaggcagaggaaagagagatggaagaaagacgagggggaggcggccttgggctgctaggcccatgagtggcccctggaatttggtcctgagcctgccaggaacctgcttgggcctaagcaaggaggtggtttctccaggatcagagaggtagctgttgtggatttctggaaggacttcatgtaggctcctggcgccctgtgccctcccttccactccagactttcttcccttaaaaagagggcccgatccggctggtggtggcaggacggggcagggggctccccagcttgcctgccctgaactgattcagagacgaaggatccagcgagtcagtcttcttgctcaatccctgcaggtcccctcggacatgagaaccactctgtgggtggccacttcctctgggctcagccctgtgctggtcacttacgggggctaaccgggttaccccaccaagactcagccgcttcctgagggcccaaatgagtccagttcctccagtggctagagcccaggtccttagtacgacactgcccccctgtcccgtagtgtccccttcttccctcagcaagagcagctcctgagacacaggggtaagagtttagatggagtgagaaacagatctgcaatagaactgggggccaagagtgcggaagaccaaaagagaaaattgcatattgagagaaaaagctcgaaggggcagagagggagagaggggtggctagagagaggcggcatccaatggagagaggacaacgtcgagggctgagggtcttcaacccctggcagtgccatcactcaaccggggggtggggtctgggaggtcccaggccagggaggatgctcccaggggagctctacctgggggcatggcagggcacagacccccttcctgttcaccagcggcagcccagggcctggctaggacctgggacgcatggcaccttgaccaaactgtggtacctgcctgcaagaagcttctagactgggccagggagaagagagacgtgggaaaccaggggccaggctggtaaccctggttctctcttgatttcatggttggaatgaggagattggagaccacatatgccctttccagacaaaggagatggcttgtctttcggcaggtttgtgtgttttaccttttgcccagcctcagcgtccgactcttggcagcctggtctcatctctgtcccaccctctttccctcccccactgccaactcattcgtggagaaatatgtcggtagagagcgggacaggcagcgaagcctgactagcagtctgggtggagagagaagcatttggaaacattccgctcagtgacagcagccagtcgcaaaaggccgcagagcctctggttccattcatttgaaatgtccacactaggctcatctgtggggacagaaagcggatttgtgggcagtgggtgctagaggggtggtacctaaaggtatgggttttctttttgaggtgatgaaaatgttctacaatcgactgagtgatggttgcacagttctgtgaatagaccatataaaagcccttgccttgtacgtgctcaatgcgcaaatcgtgtggtaagcacagccactctcagtaaagccgtttcagaaaaaaggagaaacccactcaaggcatgcctgctgcccgaggtgctggtacccagtaccttcctgcactgcttggggactgagaacccaggagctgtcactcagggcctcagcctccaggagtcccagtgggggtgaaacagctctgaataccgtgggggcgcagggccatgcacagtgccagaggctcgggagggctacctggaggaggtgacctggagcagaccagtagggaagagggaagttgccggtggaaggaagagcacacgtgcgggggggtgtggggagacacaggggagccaggcggcgctgcagtccggccctgcaccgacctcaccctcaggtctcagccaggcatgttcctggatgggggcttggaagtggcgatgaggcgacaccctgcttgggggagacacattatgcatgcaccttgcagctcttacctgaagttgggggctgcttctgggggcaatactcatataaatacggtccttgtacctggaaggtttttgtatctgtggtttgcagtctgcaataagccataactgcacgcccggcccggggcccaccgagtcactcggcctggctagggcccactgagtcactcggcctggccctctaatttgggggccactcccagaccagacaggcagtacctcagtcctagggcctcccccttctgctccccctcccactcccccctcctcaggcctgggctctctctgcagcgcagaaggtactttgatcccagctgaagtgctctaggaacagtgcttccttgctagcgagcagagctggcgggcgggcagccttctgcccttctggcctctcagggctgggaggaggcagggggaagcagggggaaggcaggcacggggggcgcaaggcaggaaggaagagcaggcatttcctgaggccctcagggatcctggggaggaggcggacacacagctgtcttagctccccaggaacccgcggcagacagggagcaggaggtgggggaagcagaacccggccccttccagcacggcctgtatgtgaccctgggatgccactgcacaggccccctaggccctagctgggatgcttcccccaaaaggctgtagagggccagaaggtcctgctggcaccagccttgccttgcatcccagcccgggagaccccttctcctgccggatggagccgagagctcagctctctccacctgacaaggagcccaaccccctcagctgcgtggggagggcagccctgggcagcctgctcaggcttccctgcagggaaagctgtcctgccctggcagttgcccctgcacagggccccaggccacactgtggtctccctgctctgagcctaactctggtctaggcctcatcaggcagctgccaccccagcctgcctgggacagcgcccaggacggctgctggaaggtagcaggtggggcggcagccatgggacggaaggatgggacaaggacatgtctgagggagggagagggccacggaagaagggggctgggaggaggggaggcagggcgcagggatctaagccagctgccatctccttggccagtgtggggaagaggacctggagtcagctgcagcctgtcccccacagctggcttgcagctgtttgtgccctgtcttcaaagctacagcagggaggcccaggagagaagcagggtgggggcgcccagagggcaggctgtgagctctctggtcccatttgggcatgaaatactggcgggtggtgtgagtcctagagggcagagcctaggagcctgggaggtggcctcttatgcaggggtcccctacagaggtgggctgcttgttccatgattctccagggtctggaaacaagaactgggccccgggctccctctgccctgctccccaagtgtgtccagtgggccctcttctctgtgggtggctgcttctcgaacccttctgcctggacacgaacctccccacccttccattctgatggtgtgaacagaagggcccatgcctgtcttggggatgggacggagagacagagggagagccgacagagctgggacagagagctgcagtgggcgaggcagacaggcagcactcccaccccctggaccatcagcaagaccctcaagaagcaaggaggtgacaagtgctatgtgcccgtacaagactggggggcagggagagcttctagaggaggaggcagtgccctgaggccgcctgtcattggggagtagctcttgcagagcctcagcttccagggcaaattcccatccagggacctgtcactcacacatcgaggttacctcttgagcaagagcggccccaagtttatggccttgagtgggcctcactccgagcctgtgggcttcgtccattcccagtgtcggcaccctcgggggcagacaccagtgggcaaccccatcaccactcaagggtctctggatgacctgcggcctcgaagcggcatgaagctcatgctcagcggggacctctgggttcagggggtggggcggttatggaggaggcttgtgccaacatgccctggggcagctgagctggtgctgagtgagcggagcctccactctctggaagcttcccagtgctggatggccgaggtgtggctggtgaaagctggcactctccatgccaggagctttttttgaccttcctctgaggacataatcacacagcatctctcccctccgggccaccagggctgtaatttcagggcctgcgtgggggctccggggaggcctggcctgcgtctagctatctttagagaggcatggtctggggcgtggccagaggatggaagatgggttgccttggaagccgaagtccgggagccagaggccaggggcaccctaggacccctgtggtcttccctcagggaggccagaggccagagcccaggagcagcaccaggaggctctggtgggagtgggaaggggctgggccctgtcccgagccctgacttcagctcggagcaatctttggcccagatgctcagaagatggggtgggatagcacctggcctgagggccagacagcttagcatctcccagactgtccccgtgtggccatggtggcagctattatgggggtagggggtggagggtggcacagtaggcgagatgcttgtgaacgggggtgttaggctggagggagggctcagaacagaatgtggcgaaggcgaggggtgggcccgtggggggccagtgaggggcagttggagaagaatttggaagctgatgggcagttttctgggactgcagctggcagaggcggagcagaggtgcaaggtcccacccaggtctcaggccggagacacaggcccagccccagggagggcacggctccttgcccccattctccacccttctgaattgtgagctgtccccactgtccttactctcagtcccaccccatcacctcagcatccccatccccatctgaggactgatgagtgcctcccttctgaccctagtcacacctatcctgttgccatcactattgcaattgtcactgcaatgtcccctcagatgcccagcattttggggtcaccgattggctgcacccactgctgtaccctcagatggagccagcagccaccccgaagaggaggagcacagtaatcacagagaaggtgggagtgagtgggtgtcggagcgtggcccgtgctgaaggaggggcaggtgcagggccacggctgggctgcccttgctctcgggctggggctctgtctagagattccctcgtggtgccagctagactctgaccagccctcccacagccccaagaagtgaagtccccagccctgagctcctggccctctggggaatcccctgggctggaaacagcacccttgtcccagtcatgagggggaaataaaggcccagtccctttgccccatctcggagtgcaggttggctgaggcctggccgggcctgtggggtcggctgcagcccagcttctcccttggccaggtgacgaccccaagagcccgcaggtacatttcccaagtgcgagtcccctgcctccccagttgggaaggtcacaggaggattagcccccgccgaggctctgagaagtggaattaaccacctgtgggtggcctgcctggcccctgccctcctgcagctgaggggcccctccccttctcctccccacctgcctcatctgtcgggcagtggtaagaagtgggcaggagatgtcggggactcacccagcctgcacttcctgtgcctcccgggcctgacctctgggactgcgagaaggtgggggctgcagggtgacctgagcaagaggcgcagggaccggggcggccaggcagggaggaggggtcgtgagagctgggagagtggggccagcgcctcgtgggctgctgacctctgacccagcccaaacaggaagtgccatatctgaggggccagctggaggagaaggaatgccgggacgagtccaaagcaaacagcccacagcttcccaggcctctcccgcccccgccacagtctggcgctttctccactgagaactcaggggtgggggcaggggtagggggaatcggccatggaatgggagcaaggcgagactcagttcccaggccccggtcctaggcagagctgatggcggggcgaggtccttgcagcggacaccctgtgcccttcctcctctgctccacccacatccagcagcccggaggcagaggggaaggagaggggcggccccgccagggtagagaaaggccggggaatgggaaggccgtgcccagatcgagatgggggtgctgaggtgatggggtgggatagcgagggccagaggggcatgctggaggctcacaagttagagggacagaggacagggacggagccatgcgctccttggggctgggctgtgtctctgctgggccctctcctgcggcatccttcatgcctgtcacctggctgtctctgtgagccccatcccagggcagtggctgtcgtgttccctgcggttgtgaccctttgtccctatcccttcctggcacagggcctggtggcctagagagctgtggaggctgtcccaggaaacccatccggttcccaggggccccctcactcaggcaggccaacggggcaatggcctcagtggccttcgagggctccgcagacccagtgtctccaccagcatatctggccagtctgtcttcagggctcggcagggctgagttgtcacttcccagggactcctggcacatggggaggtcaacatggagggccggcctcgctcaggcagacagtcagaaactctggccaggggtggtccttgcccagtgctcagggcggggcttggctttgcacagaccacgtgctcactccccacccttccctggcaccaggtcagataggggcacagcctggtctcacagcaagccagccatacatctctgggcaagttactcatctgtgagctgagggtggggccctggggacctctcttgcaggtgggtgtgcatgttgggggctgggatgagggttctggggccaggaatgggggggaggtgtcaagggagaggcaaaggggcttcccgagaggtgccactgtgcggtggtcaccagcccctgccccaggcctcagtgcaggtgtgggtggctctaggaccaatggcaggtgccctgaacctccacaccctcctgctctgccagccaagcccacctctttgggtccaggcccaggatagggatgagacggatcaggtgcagatgctgccccaagcaagggtggggagcctggcctcttgatggcttgggaccgagcaaggacttcaggaccctggtgaggcagggtgggggtggggaggctctcagagaagctgtgggacccaagccctctgaatctctttgctgacagtctcaggtgcagcccaggaaccgcacggacatgggagagccaggacatgcagcgtagctcctggagggagggaggctggctggtgagcctgcccaagctgcatttattatgttcaagtacaaaccagtgccacctttcgcccctgggccatttgctaagtgaagcggcctcaccagtcaatgggaagtgggtgcactggaagcagtggggtcttctagacctttctcccagtggtgcaaaggccaagcacacctcagcctgcccctccaccccctcgagaagcagagtgtgtgctggaggaaggcggcaggcaggactaggagccctcctccccccgccgctggggctggaggaccacgctgtgataggctcgggtgcaggagaaggcagtgggcgggatgcggcgccggtcaatgaggttgttctccaggtgtgtggaggtaaggttggagtcctgagccacgcgcatgtcacagatggaattcaagggcacttgtctgcaagggaggggtggggcagagcaggggagagaagaccccggaaagacggggtaggcatcattcaagaagagacagagacccctgccctgagagaagcagtaagaccgagccacagaatcggaactgtggaggagtgatggcgggcttcagagaccactgcggcctcctggccccctcccaactcgaggctcagtgccaggcctccagccccagcccttgtcgctccaggctggagccctgccagcatccggccactgcctgcccttggctttccaggcctgccagccactgggcacagcctccatcatggcaaccaagatgggtggatggctggattgggggaggatggatgagccccgactcctgccctcggcctctgcggcctgtgggtaaggagcccaaaggccagcctgtcctagcccagccagaaggcagggcctcctggcctcagggtacctcttcctctgtgtgctggcagggtgcgggggtggagacggccacaggtgtggggtcgaggaggggggccctacctgatcctgttgtggctcaggcccagcacctgcagtcccttgaggcccaggaggccgcgtgggatggcctgcacctggttatgatccaggagcagctccgccagcgaggcgcgcaggcccaggaaggacacgctgtggatgccgtcagcctgcagcctgttgtgggacaggtgcaggaactctaggcctggcttcatgtgcgcgaacgcgtagccagggatgcgctcgatgtggtcgtggtgcagcgtcaggcgcctcaggccccgcggcaggaagcggggcacgtgcaccagccggttgtaggacaggtcaagggtctccagcttcctgtggggcggggcacacaggggcagagggagctgacggttggcaactcctagaggggagttccaggggctgcagccccacactcccaagacgagcgtggggattcactccgagatggcagccgcaacccgaactctcaacagctgggactctggcaactcctgtgtgagtcaggccaggccctgtgtgggtttatgtcctcctctgtcccccaaggcttagggattagaggatctgggtgggggccttccttgctccctgcagggctagcgatacctgctgtcattgtggagactgaggaactgtcctcccactcacttccttccctccaggtgttgcctcagggtctcctgtctcctaatcctgacacctgacagagctcagagggtgacgcctaaaatctaggggaaaagtggggcaggggagctctctgcccctgccggtcctcggcctcgaagccctctcctctgtcccttccactctcctgccctcatcctgcctctcccagtcttatcctcagatgtgtggaagctagatgtgtggggagaaaaagatcaggctccatgagggttagggctgggggaccctgggaggtcacccagccctcgctgtccgatagtggagttcaggctgccaccttcagctgggagcccccggtcgctccatggtggacacctgactccttgaggccctgaccccagcagcaggaagccctggtccctgtggccatgcaggtgtgcaagggcagagggtggtgaggcttctggaatgggtaagaacatggagagagggagcagggaaggcttctcttggcaacaccctcagcccccgtggctagggtcagccttttgggctgctcctgtgcctctcggtcccctccttttccaccagcccgaaaagagatgggtggcgccagagtccaggagaggccgcggctgaggcagctggggcttgactggccgccagccccctgcccaggcctcgtggcgggagtggaatagcggccgggcagcccctcccaggctgctgtctgctttcctttgcccccttggcaagtgggggagaggaaagaggaataattaaacccaaacgtcctggtaactttttcctggaacgcaaggatgcagggcgggaggctctggtccctggaatggcgggtcagactgtctgtcgacccccgcctccctccccactgcggccccaccctgccttggtggtcatcaggccctcctcagcctcccgcctggcacccagcctcccccagccctccccgctgttcccaggaccgtgtcctgactccctagcccgactcctacagccctacagcatctggttgccgtgagtggcctgtgtgccagcatctctacctagctgtcccaaccagatccagggaattgcccttgacttttcttggaatgaggtgaagagtggcccccagaacctatgtccaccagaacctgtgaacgtggccttatttgcagatgtaaggattgcaggggaggatgtcgagctgagctcatctgggttccccggctgggccccgctcccatgacaggtgtgcttttgagggacagaagagagaagacgagacagagggagacacgcaggggagacggccacgtgcagccacaagcccaggaacacctggagccccctgaagctgggagaggcaggaaggatcccatcctaggcctccggagggagcacggccccctaacatctagattgcagacttctggcgtctgcaactgagagaggttatttctgttgtttgaagccacccagcttgtggcactcagtgatggcagccccaggacatgcatgcacttctcttccccactttcctgtgcccccagcccttccgcgctgcttcctgcccctgtcacctcctaactgcacccatcgtcgggccagctctccccaccactgctgccctccatccaggcccgtggcacctcccaggtgagcttcctgggggccggcagggcaggcctaggcacgggagggcaaaggggattctgctgggtgggagggacagagggaaggccttgcaagcttgcaagcaatatcttggaagagtctgtggtgactgagggcccaggctaacctaagcagggagggaggtgaccccagtgacccaccgaagaccaggcccaaggaacaagtcctcccctggagccccctgcctcctggccctctctggggctccgtggctcagcattgccctctccgccttccccacctgcctctcggggctgctctgggccatccttgctctctgcctccgaatgcccattggggcgaagctctgggactgccactcacgggagatgaatccaggctcggggtgccagccagtgctcctgaagccagttgtggctgagcaccagcacgctgaggctgtggatgtggctcagtgcgccctccgccacctcctcgatgaggttggtgcccaggtgcagctcctagggtcggggtcaggggttggggtgaggggcccacctgccagttgttggccacctggtcaggctccaactctggctgtgcccattctctgccggcactgcctccttccacccagccatgtctgtgcaactcaggtgccagtctctgccctgagcagtcaggcccatggcaggggtggattttcaggggactgtatggtccagagagagggtatgggccttactcagagaacccagagggtgcagagccatccaggaggtcccactgtgggcttctggaaggttaggtcaagctgaggagaggcctgaagcctcgtgagtttcagcgcacagatccccctatgggctgctccacgccccctcagcagaagcagaggcagggttgtttgatggtaacaatgttgcctccccatcctgggggctccagctcaactgcagggaggacggcaggccgcgtgggatggcccgcagccggttccggtccagcctcagatagagcaggctgcagaggggctggaaggccagggggagatgtccctgtcacgcagctggttcccttccacctccagcgtcaacagctggctgagccctgcaggcgggcagaggggtgcggtgagccattgcagagctgctcgcagtagctctagaacccctgcctgcccctagaggccagggccccttacccaggctggcagtctcctctgcgttccagccaggctgccctgggcactctcccgagtgtgcctcctagagggcagacccaccccttgccagcccctgtcctgggggtggggcacctgcccaggcctgccccctcggtccctgcccccggaactcgcccgcaccacggaagctgctgccttgcaagccctgcaggaggttgtcgttgagtttgagctcctgcagggaggcaggtagggccgggactgtggtcagcgagttcccaaccaggttcagccgcttcagccgcatcagattctgggaggtcatggggaataggtgggctggggttgggggcctgctggtcggggcacaggccttcctgggcatggctttgggcccatcctgaccaagggcactctgttggtggcatcatggcttcctagttcccactgaatccaggcctgtctgggaaggtttctgtttgctcctatacagggcctgcaagcctgtgctgctccccctactcccagcgatggaacacgtcacaccaaattgtggaagcccaccatgctggctgctctctgcagtgcctcctccaggccttaccccctaagcagctccaccctgcagtgagtggatgcctcaggtcacctgggacctgccagccccagccccagccccggcccccgagaagaggtgaatgggccacagcataccttgaaggcatgggggtgcaggcctcggggatccagcttgttcttgctgagatccagccactccaggttgggcagccccaggaacgtgtgggctgggatcttggcaatttcattctctgtgcgcacatggggcagccatattctctgccccctgcccgctgccactctgtacctcccacaccagacagggctgctcaggggagccagggtgggagcccaggtctcagccttctcacccctgctgcaggggtgggtgtggggcgaggaggccacccacctgccaggtagagtgtggtcagaccagggtgggtcagggcagggacatgcttcatcttgacattgccacaggcgatgactgcctgggccaggaggcacgaggccggcagagagggcatggcctgctgggtggtgcccaggtctgcgtgcctgtgcctgtgcccatgtgtgcttcctggtcttttccacccatggcctggggtcttggaggtgctgccgccgccaccctggcctcggctgcggtccttctgtgggcgccggatcctcagcccaggttgatgggaggtccctggaggaagagagacagcccctgctgggtcacaagcaacaggggccctactgaggaacaggggcttgcccgaggctcccagggcctgccagtgactcagccagcctgggttggagcgacaggttactgggacccctccccttggcaccaagggcaaaggcccaaatgggggctctgaggctggggaggggacgtgactttggagggcttccctcccaccccacacacgagggcacttggcttggaaacaccgggaacggggcagtgcctgggtggccaaactcatgcgtggtcctgtcagccccagcaggccccaggccccacctgaaggccgcctgtcctggccagttctcacctttggggggcctcctgggtttcaggccccttcccttgtcttcccggcctcctgtcctctggccctggtcctcctcggtgactgctgccccctcttgagcttgagggtccctgccggcctgccagggcctcagcttcaaggcctcgggcttccctgccccagccctcatggcagctgtggcctggggctgagcccactcagcgaccaggcccttgttgtgaccctgctcctgctccaaggtcactgggggtgactccttcctcagggccagccctggcctgggaagcgctttccagccagtggagggggactgggtgggggttccttgagctccctgcttcggggtgggctgatcccgcaactggtccagcttcccagcctcaggcttgtctgggtggccgatgccagggatgggctgcagctgacctgcggaaggagccagtgtgggctgggggccttgcctcctttccccaaggggctgtcagctgctagaaagcccatcgcccttcctctttacccaggcctccccccgccccgcctttcccttacctcctgaggagcactggcgagagaacagagtgtccccaccgtcagcagcaggccaccagcccctggggccagtaacccagagtacctctcagaacttacacagctcctcactgctggggaggggggtgggtggcgctctaggcccattagggctaaggggctgggcctataggttaggcccaggggttggaccggtggttgggcccagggagcttcagcagccctgggtagaaagccttgggctgctcaagggaccttgggtcccacctcccctcacttccccagtgtgtcccaagggtggggggtagggcgtttccccagcatcccctttgccccatacccattagtgagcaaggacttcacacgtgcttcctagggacagcttctggggagatgaaggggtcgctgcgacctggcacaatttgcttttagaagtgaaagccccagtgtctgctacagggggtttgttggggattaggcaagcccaggggccacctcaaggggtctgtgagccactttggaggaatgttgataaccccaatgcctcctgtcctctatggagcagctcctccttaaccagggccaaccatggggggcaccgctctgtctgcaggggtgaggggcagacccacccacctggcccctcccgccctacccccaagcctggggcagggccaccaagtgtggctacaaccactggcctataagacaaaggccacactcatagcccatgtcctcgggcccctcaagcccctctctgccagcaaccccacttcacccccaagccctatactcccagccacctgagattcttcctgtctcaggaggcactggggcagccagagcaactcctccccagcacaccccagcccgctctcagcctcactgtagcgcccgctcctaggaaggcctcttccctccctcgcccctagagtctgcgcacacccctcgccctccagggagggctctctcagggccatgggccctttgcagccctgcctgagtacccaaagtgggcctgaggtggacagcctgcggcagtcttcttcctgctggtgccagctactcaccgtcgggggcccctggtgggctgggcagcagctgcagggtagccaagcccatgggggttggtggggcccctcctgagcagctccccgcccacagtgccaggatggggagcagcacactcctcttggctgccatggagggaaggagagctgggagaggcacggtggtggccacggcaggacgatggcggacggcacaagttggtcttgctccctgagctcctggccctggctgcggcacttggagtcttccctgcccaccccagcccttccctgggaaggccccccttctgtcgagcaaacgcctcccccgaccttgcccccaactccccacaacgtgcactgctcccacctgaagagaaagacagattgccctttcctcagaccggacggtcctgcccttttgctgtgaggcccgcattgattctccgctggctctggcccagtggcctccatgaatggggcttctgtctcacacgtggcaggcctgagaggcccaccacagagcgggtcggccaccgcaggctgctgggccctgcatccatggctgcgaaaggagagggggtgggtgccaaggccgtgggcttctgccgtgggcagcactgtggaggcctccgggttccagaggaaatagaatctgtgggcacagtgcaggcggcgagggtatgcctcccgtgcctgagaccccagtgctgcttgggcatgggtgtgcctcgggctgggctggctcctggttcctctgcttgccctccaggtctctaccttctcctctgtaaaatggggtagggggcagagttgacgttctgtggctgtcccgaccccctacataggagcatgggtgttccaggcactgcctgggtgaagccatgtcacaggtcccccccagacttcttggccaacagtctgggatctctgatgtgcctaggctgcacgcatccttttggtcagaggggcacctgtgggtcaggatgacatgaggtggaaaataggctgggctcgatgaggggactgctgggtggggccagaggggcgtgtggtggagtgaggggcaaataagggggtgtctggctccagttcctagagcccgccaccctcagagggctgccggaagtccctgctccaactggggtgtccctgcagccccaaccccgcgttctgctgtgggagccagggtttgtgggagcaggcaggcgggggctggcagagaggactgatctcaccgctggctcggctcttcagggccagtattgaggaagcttttcctacagccctgtccagcgttgacttaggtttggaagcgatcttaagaaatgagttaattgtgggcaaggcttgggtggaggggagaagggaagcagtggaggaggggcaggggccggcaagggccatcaggcaggagtctccatcctggggcaatgaggcaatgtgtgagatccagaggggtgcagggctggtcaaggtggggaggaggcctggcaactgggtcttcactgggctccttgaggagctgccgctccagctaacagtcccgtaggagccacatggggtcctctgctatatccagggtaccctcgccatccagggctctggtttctgacctgaatttggaccctgccacgtacagaccagaaacagggaccatctagggagtcagcaaatgcctctggagtcagggatgaggccaccatctccttgtgcgtcctgtgggtgacacaggatggctgtgggccagtgtcctgcctgggggcagctgccgaagctgggacagggtagcactggggcacggcagacttgaagtatgctgccaagactaagtgaagcttgccccaggatcctgcaagacagagcacagtcgaccccccattttacagagaaggaacagagaaggagtggggctcacccaagtctcgataccagaggccagtcctcctgcctcctggtccaggcatcgcctgagaaacggggtaggtccctgcctgagctgagcctagcacctggggtcgggagactggacggtgatgggaaccccggctccgcccctccccctgcctggggatggattctggaatcctggccccctacccatttcccctgtttgcgccgctccccaggcgctgactaaacatcctgccatctggttcccattagctgggctgggggtgggggaagcctgctcccaggtttctctggcacagccagcctggaggagggagggactccgctcctacccacctaggcaggaaggggtgaggcctggggtgctctcagttcccagctcccatggaggcctggcctcgctgcccttcccctggtcgggagcctggtggctgacctgggtgggcccctggggagtggtactcctgctgcccactctgtccagtcccagggcacccggccattgtggggaccttgaaggaacccccatggagcagagccagccttcaggggctcagcagagccagaggctcccggcaagtttctgccttgccctcccccccgcccaagagctcactgacggacttgtgctgagacaggcaggccccaagccaacagtaatcccgagcccggtgtctggagcagagggtgggagggctgttgggattttccaggaaccagggatgcagcccgagggttgctggaaagagctttgggctcccagttctgccatggacggactggccatgtgacatcaggaacaagcttccctccctcctcagtgccccagtcttctcatttcagtatggtggaaacaggctccttagaaagttctagaatctgagagccagaaggcgcctagagaagctggattacatgatcaaggtcgcttctagttgtacaatcccaggattctaaggtcaaggaagggactcctgtcccttgtcctcctcccccttcccttccatgtagcccacgcttcacacactcatgcacacacataccctctacaagctgggactcagattggtagcctggaggatgccaaagcaatgctgtttgtccctcaaggctgtcatcaacgaggactggacagtggattctttgctcactgacaggggatcaggtgaggaccgtgagaaagtgacatttgggcagaggcatgagtgaagaggccatggccatgcaaaaagccacagaaagagccctccgaaaaagagggatggccagtgcagaggccccaggtgagaaagggttgggcccaatttgagcattggcaatgacagcaatgtggtggagcaggctgagtgagccgtgggaaggtgtctgtggcggtgggctggcttgcctttgtccttgaaagaatcagggagccaccttggactgctaagcagaggagtcacaggatccggcccccctcaggctgtggggtggagcacgagcagatgtactgggggcataagggtaggaggtgggagccaccgtgtggcagctgagcccgccaggggccaggtgatagtggctggccaagggtggaggcggggttgcgaggaggagcgggtggggtcaggagcatttgggcctcagggtcaaggtctgggggctgttcctgctctcctgctctcctgctctctgcaggagcacctactacgtgcctgtccttttcccagggcccagggcagccagagacacagccttggggtgacccccagagaaaaggaacaggcccattcttgagctttccacatgttgtctgagtgaaaacgacagcagtgtgtggcacatgggtggcattctctggggacatgcgcctgcagctatcttatatgtcagtaacaatatggggcctttcccccttaaagcttggagaagaaaaaagccccattttccatgccctcttcctgttgcccgcaactcttccctagaggaaacccatcttattttaatgctactgaaacctcagaggatctggtcccaattaaatgacttttcttgcagacgctttggtgagcactaaatgcttgagacctggtgatcctgagcgagagagcctgctgcggggtgggggtggagaagaaaaaggagggaaggggaacacaggaccccaaatgggacaagggtggctgcggatggggtggagggtgccagtggagggggactgcagagggtggcacgcagcagggaccagcccatagggagcagggccgtggtcgggatgggggcagaataggggccagtttcccaccctctttgcccgtgtgaaattcgagttcattcccgcccatagcgtggcttcgctggactccgtgtgaaagcggccccgccccatcccctccggtgggcttcgaggacctcggcagggaacggaggttgggcagaagctggagctcaggcccggccggggagctcgggcaaagcaagaaggcgaggcgggcgccccctcccccggccggccctccgagcgggcacgttcgtgttcccgtcctggcgccctcgcttcccgctccagacgcatgtgactcagccccgccggccttgccaagccgtctagacccgagcgtctccccgcggagggggcgatcccgcccgccgccgtttcctttgccgccgcctgcgcggctgcgccccgcgcacgtgcagcagcgctcgcccccgcccgccacctcccgcgagccgcgtgcacgcgcagccactcgcccatcccgcgccagcgcccgcgcccccgcccccgcccccgcccccgcccccgcctctcccgttgcgtccactgcaaacaggcagttcgagggcagaagcgggaaacccaaaggtccccagggccccagaccatccctcccatttttggggcccggggcaggaggacaaagatggaccgctgagccactgcctccctgccagccagactctgtccacaccccctacaactgcctctggcctcagagcaagggtcgccctaggtcgcaggccctgccctcttgcaggagcctgtggcctgggggacagggcggggtaggtgatggtagcacctccaggcccactggaggcgatggtgatggcgatggtggtaccatgctgactgcgctgcggaatgtgctcttgcaggagctggtggcctgggggcaggatggggcaggtgagggcccctcaactgcaggaggtgagggtggggccctaaagcaggaggcccagcatagggactagaagtgacaggaagaggaagccaaggtcccaaggcagcctctccattctcatatgccagtagactccaaagatgaacacggaggcctaggaggagaacgttgtagagttgagtcttcaggcagctcccaggttgacagtgtggtccctccagagttagggccacaggccgcagggctcccccaagcttacagccacttccttgtctcatttgcaaggcccccacccctgctttcgtgttctccatcccttcccccatctgcaaggatagggctgggtttcgggtgggctcctggctggtgcagatggcgtgggctgcccgcaagacctgggtactgagcctgcatgccaggatgcagggtggatgggtgaccaacagctcagcctggcagcttagcagcagagaggtcccaggaagacagggaggagatgaggagaaggaagagggagaggaggacaggacggggagggaggggaggggaggcagaggcagccccctggctttgccttgcctgcggagagcctcacactcagaccgtcctgagcctgacctcattactctgtcacatttctccctcaaacccaatgccagggctcaccacttgcttctcgcatgggtgtgatcagcttctcatcttagacctgaactctccccaaaacacacacacgcacacacacgcacacacttgccttgtcttcaacagcttgcatttggtactctccacccttactgaggaactttagtggccaggggtggggggtgatggaggacacttcagtccctcaaaggctcctccccaggttccctggttcagggccgggagtcgaagtggccccgtggagcaaggccttctagggctttagctctgacagcattctagggcctaggcgcccccaggtggggtggctccccctcaggtctaactccagcccctgccagaagcagacccgcctctgcagagaggaaagcccttggacttcagcttcctttgattcgcggtgtctttgggggattggggggtccctggttgattcccgctgcaccgtggggtctgcccttaaggtcatatgaagagcagggcccggatgctctgaggactttttcaataccctccacaggtcagggaggctgcccacttggtgagctcaactgtttggccatatatctctgggcccaccacacaaactgagaggtctcgaatgccaccagcacccgccagcccatctctggcacagcggggccagtgccgtgaaccagtctcattttccaacgtgttttccaagcactgacacggctgaggccctgctgggacgcatggccaactttcctccatgaccaggaccccccagcttccccgccacatccacagcttccccccaacatccctcctccaggtcaatgggtccttcagccacatttttggctcctgacccacccaggcctccctcagagaacctggggtctctgggttggaatgtcccttagagatgtgccccctccctcccccatggtaggactcaaccctccacatccccgcccacccacctccctgggcttgtagaccttctaggaccgggagctcccttcctctcctggcagccagctggtgttcagacagtgatttctgggaggagtgctttcttggactgagcttgagtccacatttccagaagcttctacctctgggccccttctttcccccttcctgagaggcccagcagcctctctgttccctccccagcctccagcttttccggaggaagatgcctgggaggtgctatgattctgggggcgggtggtgggtggcaggtggtgggtggtgggtggtgggtggtggggtggcgtgggcagggaagctgcagcctgctgctgggtcttcagcgaccatctccaggggctgagggctggccaacaggttctccatgagggggatggcctccataacctctcaagatgatcttcgcctctcaaggccctgccagttcctcagggtcccatagactgaactgctgaggttggggaggcctgttgagcacactggctccgtggagctgggtggaggagggagattttcttccagagtacacaggagctggtttcttcccggtcctcaggagcagagaatatggggagggttgggggaggctgccacactgccgtggtttcttccgccaaattccccagtcctaggaaagatccacagaaaaacccacaagaatttgaatgtctgagctggggctgtgattgagatgaaattttctaaaaagaaagaaagaaaaacaaaaacaaaaaagagggaaaaaaacgcttaaaaaaaaatcccaaagcctttgacagccctcagctaccagaagggcctgaggcagcagccacgtggaagggtagagagcaaccttgaggcacttcgctgggcctgtgtcggggcctcccaggctgaggtcccttcctgtgacccccggactcctgcccgctccctcctcccaggacggagtgaagtcccctcctgtcacttggatgactgcagttgcctcccagcaggtccctgggtctccctgactatagacttgccccctgatcccaccctccaggagatggcagggtagggcacagaggagggcacagtggcagctgcctgctgctgtctcctggctactgggcacaagccaccctccaactccttcctgccttgcccaatcagcaggtccctgggtaaggggcattcagtgaactgggggctttgcaggtctgggggaggagcgactgacatatttcattgcagacgcattgagtttgagggtcctgagggatgtagaaaaatttgttaagtagacaggataggaaggagccacaggtagccccaggagccgtgaggggagcagggcccagcatgtattacaatagtgagcatttacgtggttcttcgcatgcgccgggcactgttctagggattccacaggaattattaccgcctgccatcctcattagcaacccagtgggtaaggtgctctcattagctccattaggtgagggcaaagaggcacagagaggttaggtaactggttcaaaggcacacagctggtgagtgacaagaaatttccttctaactacagcgtgagcatggtgaagagaagacggagccccgcgctgggagaggaacgcttcagtccgagttccattctgcacccaaggctccccttggtcctcctgggaaccagggtgccccttagtggtggtggcccaggagaacccgaccaaggcaggagcgccccctcctggaagagcctcgcttcaacgcatcatcattcccggccggcagcaggggcgacgccagcaaggcctgcgactcagagccagcttggcccgttcgccccgccccttcccggtgtccgccccgcccctttcccggtgtccgccccgcctccttcccggtgtccgccccgcccccttccctgtgtccgccccgcccccttccctgtgtccgccctgcccgcttcactgtggtcctgcctctgggtggtgccggggcggggggtgggagcccggggcccgcgcaggcggagatgtcgcccaatgggaagggtcggtcgggaagggggtgggcgcaggcgggtgggcgggaagaacgctggaggttgattggcggtcttgccggccagtgaagccagggcatgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggtgctgttggcccagaaagccactccagggcgggggaccggggagggccccgcccgaggcccgggagggcttgctgcggaagtccgcggcgccacgcggccaccgtcgccggttccggctgcgccctgttcccttgcagcagggggtgcttgtggatcattcatctttgccctttggtgtgccccaggccttcgttcttgctgtctccacggcccgtgcctggtagttggggccagcaccgcctgtggaactgcagtacccgcgctgggcgctcggagcaagtgcagacacagaggacccaggcctggccttagggatcttgcggggtctggggggacagatgggcagagcctcgtgccactctgtcaagtcagcgagactagggcttggtgtcagttggtgtcagatgccaggggtgatagcctccagaagccctctacagccccacaggacagagccctcactgcagcagtgaggaaagctggcccacgaggttagggagctgtcccaggtcccctcggcccgctcgctcctccccccagacactcccccatcctgtccgcgactggctcagtggtccctctccctttccctctcccctttccctcagtcccgaaacctaggactctctcttaagtcttagtctcaggcgttgctcctaggtcctgctgccacaagagcccagagtgggagtacttgaaagaggtggggtctgcatgccgcgggagatgtggggttaagaatggggggacttgaactcttggcaagatggcaggacgcgggtaaaggaaagggtcctgggagcttgcagatgtacactgaggactgggcgcggcggcccacgcctgtaatcccaccactttgggaggctgaggtgggcagatacctgaggtcaggagtttgacaccagcctggccaacatggtgaaactccgtctctattaaaaatacaaaaattgtccgggcgtggtggcgcatgcctgtaatcccccagctaccctgggagctgaggcaggagaattgctggaacccaggaggtggaggctgcagtgagccgagatcatgccactgcactccatccaggctgggcgacagagtgagactccgtctcaaaaataaataaataaataaaatgaaatgatgtacactgggactttcagtgaatgttgctttccttttccttgcttaggacctaaactgccccttcctcgagggtctgtatatcacagagccaaagacaattcaggaactgctgtgcagcccctcagagtaccgcttggagatcctagagtggatgtgtacccggtaatgcatcagtttcttcctcttcccacctggggtgtgcatgggcgccagccagccccacctggggaagatggggtttgtggttactgtgagtagctgtcttcccagagggctccaccccctagcctggaccctcgtgagaacagctgtgtaggtaaggagtactggtgacaggcatgatcaaacttggggcaaagtggcccctggcggtgctgggctagtccagccacccctttgctgcagtgctgaacttgccctcagcgtttgccttgccttatgagtttggaggttcaggactggcaggcacctgagaaatgctccattccagtcctttccttctcagacccggaagccaagggtcaggctggaggcatgaacagtctctggtctcccagtggaggagtgacaggcagggccagggcgtgggctcctggctgggtctcagctggccaagtggtcctcatgcagtgtcacctcttgtcagcttctgtgccgtgacccgtttcccagtcctctggtgcctttgggccagggtgtagcatggtgtgtgcctggcaccctatgaagcccatggtgacagggtgacttcctgagtgatggtggaggaaatgatccagagtgtcccattcccagggcagacatccttcccctggtgacgtagtccctgagctgagggtctgtctcactgcctcacagctgtgagtggagaaggctttccccgcctcccacagagcacaggctcctgtgggattgggtgtgtgcccaggccatgctcaggaacagctgtagtctgttggtacaggagcctctcgtgagtccaggcccgggcctccccctcctcagcctgcggcctgcctacccttgctgcttgaggaaggggcctgggcgggagcctggcagtagagcagtggggagccaacctgcatccagccggtctggcccgccaggaccagagacatcagcaggacgcccagctggatacaggcccccagaggaaggaggaggcgtttttgtgtttgagcccttgctgttccagaggcgtctcctgcctctgccttctaggcccttcctcaggcctctccccagggctcagcacagcagctcctcgcttcataaccttttgctcttgctcacattgttccccctcctggaaatggccttctagtctctgcatgtcgtacgtcctcctgtacagcccgcaaagacccaactcacacgtcctgtctccttttaaaatgtttcctgttcccagggcagaatgtattccgcttccctctggatgcccacagcctttgagcacaccctgcccctgctggagccctcaacctgtgggtgcactcttggcctgctgtcatttccggctctttagtatgggagccgcagcatggtgtggccgtgcagtcggggggttctccaggctgcacctgtgtgccattccacgcgctgcagacgtgactgggtgtcctcaggagctgggtatttagtgggtacaagtcctggggttcagcagaaatgatgcacagcactgcagtctgagttgggtgctgtggatgttggcagggaggaggtggcatttgatctgggatggggacggtaacagcggggtgctcgtttggacaggagcagggagttgaggtgtgggagagagagctgggcagcagcagctggaatggcagctcagggcagctccctcagggccttgcatgctgtgccaaggcctttgagctttatgttctgggcagggcaggcgtggaacctggggagcgacgtgctgagattggcattttggtaaggtgactcagggtgctctgtggcagatggatttggagggcaatggctgcaggcagggagaccaataccccagggaaagacagaaggagccctgcgctgagtggcagatggcttgtctggcagccactactggccctggagggaccagcccctggcctgggaacctgggaggctgggaggtgaggcaggactggagatggctgggtggagtgtgagggtcttgagcgagctcccaggaggaggctcttgtgggagggggcgcagatttgcctgactcaggtggaagctgggggcacttggggaactggggtcatctggccagagagggacgggtaggaggccaaagccacgcccctcagatgcttctacaggttgagtgtcccatatccaaaatgtctgggggccagaagtgtttcagatttcgatttcttcggattttggaatatatgcattatactggtcgagtgtccctaatctgaaaatccgaaatctcaaatgctccagtgagcatctcctttgagcgtcatatcggcgatcagaaagtttaggattttggagcatttcaggttttcagattagggatattcaacctgtagtacttctgtaaataccagaaaccgaatcctttgaaaaagctgccagggagcatacgatgacgttgtctgatttcaggttggcgagaattccttaggccttttgagggtcctacaggagaatcagatggatgggagttttcctgtgaatttcccattgcctttctttgtacgtgaccgcaccctgtcagccccatttagggccgccttttcatctcctcccagtagaacctggaagctgcacctagtgttggtccttggtgtgggttggggcagagctcatggagccccctggattgtggaggtcaaggccctgtggctttccttggggcctccaaggcctccagcattttctgttcctgctctgccctctgctgtgacggtgcggtgacttgagtgacagcccttactgagtctggctactggggcttctgcagcgtgggttttgagtgtgttcagggtttactgtgcccgcccttgcacagtgctgggtgagtgccctctgctcctccgagccttgtgctcagagatgttctcggcaaccccgctggcagagcccagcctgctggcctcccccttccttccccaaccccgcttgcgcagaacccacggttgtcttaataagtcacagaggtgggtggtgctgtggaggcagccaagcccagcccgatctctgttgcagttctggggcaagtgtggcctctccagggaacagccaccagccctttcccaccacacgagtcagcaggctcctagagtgatggcaatggtgaggtgtagccaggctctggcagcctggtggaaagcgactccttcttgtttatgaaaggctgctgtggtggcaggtgcctggggctcccgggtaagagcctgtggccccagcggccggagtgatgtttctgggcctcagtgtcataccgggcttgaggcatggggcttgggactggggatgcagtgcttgggctgtgctcccctgaaggaggagacccagtggagggctgagccgtgtgtcacctgtggtgcatgtctgggtgtcgtgggacttcctgccttccatgcgctgtgcatgtggatctggttttgcccaccagatggcttttaaggtgacatgcttctgagcggcccctgtgtgctgcagtcaagggcaagccttcaccgtgcccaaggtgatgagcctcgactgtgaccacagactctgttgcggcaggagcccccacatgactgaatgcaggcctcacaagccttttctgcagagggccgggtgggaagaaagttttccaccctggagcagttgatgccgacccaggcgaggccggggagggtgccaggagcccggggccagccctcaaaacccacccgctgcgccatttcgagaaagagccctgagtgctggcagcttccctctctgcctctgctgcagccatcttttttttttttttttttttttttggtcttgagaagaattttcatttcagtatccagattcatttctgtatccagatttccgaggtaaacttcctggaatattctttccctaataattaatggaaatgaaatccacgtgacacagaagtaaccactttaaagtgagccgctccgtgccgttgagcacgtgcacaggaattcacttcttccagcgcgtatagagggcccagggggattctctggctgtctccggcctgaccagctctgctgtttccctgcagggtctggccctcactgcaggacaggttcagctcactgaaaggggtcccaacagaggtgaagatccaaggtaggtggaatcttggtccattctgagcttgtccacagcctccttatggagtggtggtgcatgttccattggaccaacgttttcttttaggtggtgcatgttgtgtggatgttgctagagccttcttgaaccccacccttccctaggcatggcaggtgggagaactcctctcgcagggacctagagcacatcagtccctgcagcgctggtggccagagacagagatttttgccgatgccagcagtggttccgtctccctgtgtcagtggtgtgtgacacgctctctacaggtggcatttctaggggcacctgctgctctccagcggagcttgccttataacctcctttctatcatttcttggtagaaaccgtgcttaacctggtaatgaatgttggataaaggtgagcaaaactgcagtccccaagttggtggctaacttttcatcttcatggtgatctctctagaagttggtggaatgtcaaaggtcaaatttttcatgggcctgtgtctgttctggccactccagggtagataagctggaccctggagtcctgatccgtgccccagctggcattgccacatgagttatctggggccagttcttcctgtgctgaagtgggccagaagaaggaggtgttgttttagagcagccggtgggctggcctgggccacacagaggcactgcccttctccctggagctgccgtgtctggtacattccagattctctgacccacaccaacacatgtgtgacccgacccagcccagccttagccctgacaccgccattcccagcctgtttcctctcctgtcaagtggggatgaaacccagccttgcctacctcatgggaatatactgagtgtcaggcttgtcagagggcaggtgggagagaccaggaccagtagggtgtgaggatagttcaggaattcatccgacgaatggttaaggagcagccaccacatgcgaggcgctgttcctggtgctggggtgcagcagtgagttccactgccctcgtggcgcttgcgtgctagcggggagagacagggccagagggtgggagaattgttcatgcacctgccagcgagaagcactgggaacagccagctgagggctgagggtcctgcagggcttggggaaagggtggtgctgtcttgacataagatggcaggaggggcggaagccagcgcggcatgtgcggagaggaagagcatgcgcacagggccccaggtgggctgtgcctggcagcttggaggcacaagaaggaggctggtgtggctggagagcagggcagggcaaggagtgaggttgggaggggacgggccagatcaggccaggccatgtgggccccagaaggacgtgggctttgactccgaggaaggccgagttctgctcttggctgtaacgacacccctggcccactgtgctgggaacagggtgcccggggaagaggcagggagagcggtgtggggctcttgcagtgagtggtccaggtgaaagtttggagaggcagtgcaggaggcagcgctggccagatctggatttatagagttggctggactcgctgagaggaagagaggggtcagggaggacttgaggatgtggggttaagggcagtggtggaacaggcttgcctaggcatgcagttggcatttatatggtggttctggggttactgagtgcttccccacagactctctgcttacttcttgcaacaaaccctccagggttaggtggaggggcaggtctggcatcggccccaggctttctggctccaagttactcagaaaatgccctgggcaccctggcagatgtggctggatagtctgcagtgtgcacggcgccaggttccccatgcatgaaatggaacaaggtcttccacccccagggctgctggcagggtgatagcagatgatggcacgaaggtcctttaggacatggccagatgggagcggtgagtccatttgctttggccttgtgaggtcttggagagagtggcagacagtgcactgtagaggttcactgacccctgtccactcctcaggcagctgctggcttctgctcaaagccagagtgagtgaccccaaacctgggagagcattgggtacaattcctaattttcagacgaggaagctgatgcccagagaggggtggggccactcagcaagaggcagcgctggcacctgggtgcctgcctcctggcccaccctggtctcctatacccagtctagtctgtgggtgctgggcttcctgggtgtctgctgtcccctgctgtctgggcaggtgcctgccatgatgggctctttgtgtttcaacagaaatgacgaagctgggccacgagctgatgctgtgtgcgccagatgaccaggagctcctcaaggtaagagggcctctgtctgctctgcagacggcacgcacgctttctgccctgggcagggaacctcatggtgctggctgaggtgggaggattttcctcccctagtgcctttgaggttcctcaggccctggggccggctgggtgcccgggcaggctgcttctctaggcatccctggggccagaactgctgggattctcttgggtagaacctggttgtccctggggcgcaggggagagggcagccgtgcagggaggggcagatctctggcttctgatgaccagtgggatggaaagtgtcctgtccttggttgatgacttcattcttcattcatcccggcgcctggctcccaagcccttgtggcccgagagtttctcccgaggtccctcatctaccctgcggtaggtcaaagaaactccagcacccaccttctcgtttctaaattttgaaataattgttttcactcgatgattatgagtaatgctactataaacattcttgcatatgatttttgactgaacacgttttcttttttttatatctgaagagatttattcacgtgaccaatggcctatgacacagccccaggaggtcctgagaacatgtgcacaaggtggttgggctacagctggttttctacgatttagggagacataagacgtcagtgaatccatgtgagatgtacactggctggttgaacacgtgttttccatcctcttgggtgtatagctgggagtggaattgctgggtcacagggtcactctgtgcttaacttttcgaggagcccccaaactgttttccagtgcggcggcaccatcttccttttccagcagcagcgcgggagagctccagtttctcctcgtcctcgctggcacttgctggcatccgtcttgttgattctagccaccctgctcggtgtggggtggcatctcattatggttttgatttgcatttccccatgaccagtgatacggagcgtctttttgtgagcttgttggccatttctgtatatgctttggaaaaatttccatattcatgtcctttgcccactttt

SEQ ID NO: 3995 - DNA, 47850 bp, human; identical to SEQ ID NO: 3992

SEQ ID NO: 3996 - DNA, 39193 bp, human; identical to SEQ ID NO: 3993

SEQ ID NO: 3997 - DNA, 33956 bp, human; identical to SEQ ID NO: 3994

SEQ ID NO: 3998 - DNA, 62913 bp, human
cgccgccggtgcagagcgtggggagcactcggccgcagccctcgcccgccgcagagggtcgcgtcccgcgccgccggccaggccgccccgtgcccaggcctttccatccttggagcggatcgttgcccgcctgacgcccgcccgcagcgacagcgcccgccggagccgaggccgcggcggcggccgtgcccatgcccgggtaagtggtgctctgggcgcgcgggcgccgccggggtgggcgcgggcgcggcgcgggcacaaggcgcgggtggggatgggaggatgacccggcaggtggtgcggcggcaggtagggggacacgggtccccgcccgaggcacctgagccccgcgccgggcctgcgtgtccttgcggcactgcggccgcgcgtcaccccggggccccaggccggcgggcagcgccccgcaccctgcaccctgcgccccgcatcgcgcgcgcacgcgcatccgtgtctgaggaacaaggcccttgggggctgcgggccggggctcagggtgggcgcagccgggggcgcgggatctgggccgggagcccgccagtgcgcacgcaccttcccggagcctcgggcaccccctcccccccgcgccctcacactgtatcatccttcccctctcgccttcccgcaccgttccccgcacgcccacgcggctgcccagcagaccccaccgcggtcatgggcagtgcccacgagaagccgcccggggccgcacttaggtaacttctccatccctccaggaacggctgtctccccctcctcgcctgtgtgaccttggccagccagcttttcctgtggccgcctgcgttttctcacgggtgaaagctctggctttaagattctggaatttggaatggcaggtgcggcatctcccagagcctgagacgatgggcttctctctctgtgacctggtgtccttccttctgctggcccttctgggggttggtggctcagccagccggctgaggaggggtgggaggcagggcaggggcatggcgccggggcaggtcaggactggagggagtcttggagagcccgcggtgagggctccatgagggtttaggagagactgtggaaatgctccttcgctcactcaaggggcagggaagggaccagaattcctcaacgagatgcttgccatttcctggcgaggtcatataactttcaaagatgaagcccagggcctccgacctcaaaggagtccctgcctgctaaaggatcaagtccagcctgtccccaactggcccccatcctgaattccactggcaccctaaacgtcagccgacttcccctggctgacttgggcaccagtctggcaggcaccccctgcacctcctcccctcctttgcccactaggatctgtgccctcaccccctgccattgcccctcactagtcagtgaccatcttaaggcaaggactggctcttcatttgcacaggcctggcacagagtgggcacctggtttctgcatggcatattcatgaccttgacctcactgaatctgcagactcactgaacaggagaggcaaggcctggatttttgtccccatttttcagatgggatcattgaggcccccaagaggagaagggattcagccctgaattgaggccccttccttcatgagcagatggctagggacattcctatgaacctggtggggcagggaggcggggagaggttatcgtaataatcaaagaccagccccacttcctgagctccatctgagtctcacctcaaccacacgagtgaatggctgttttcatccccaacccccaccccccgccgccacttttcacagatgaggaaaccgaagccatgtggctcattaaaggggcactgggatgccgaggagagggctggggatgcctgggcccctgtgggacacagctgagacccagcagagggtcccagggtgaggtcagcccctcaagtctgcgccatcggaacgggctgggaacttgtggtccccggccattgattgtcactgctgcaggccccgaggcgggggacagccaaggacacagccagtctccatcagctccacctgggccgtgccctgcacggccaggtggtttgagtgcaggagtaggcatgctctcacacagcagggggtaacgggcagatggaagtggggcgggcgtgggagggggccttgcacagggccagaaggagagccggtccctgaggaaggaagcccctaaggcaaagagcatgccaggggacagccacaatgccaggtgatggagatgccccaatcggcccccgaggggcaaggaaggggccagaggaggctcgtgagggtgcctggggcttcagtgacagcagccccttacctgatggtctttgtgaccttggccaagtcccttctccattccagatccagggagggtgggggtgggcctgggggagctggagcttcagaggttgaatcattcactagcaggagaagccaagcctgtgagtcagtgagtgctctccatcccagaacgtctgctcccagcccagggatgcagccacggagtgccggggtcagccgtggaggaccctctgagaatgtcttgtggaaaggggcgccttgcctgcccggtagacaggatgagggcgccccagagccccaggggcttctgagagctgagtaccctctgggcctcttgcagccagcagagccaggcagagcttcttctggccttttcacctcctcccccacctcacagagcaagtcatcagcacatatgaactcccctctgattttaaactgatggcttgtgtatttcaccaatggccactgtctccatcagtggtcagtagcacatcaagtaatgtcaacaatgataatagttataatggcagtcactttatgtcagacactgagtgctgcacagacatttccttgcccacttaattgaaacaacaacaaatgattgcaagtgctgttatccccattttgcattgcggctgaggcccagagaggctaggtaacttgcccaaggtcacacagccagtaggtagcaaatccagggctggaatgtagtccatcaggctccggagtctggtctgtgcttgtagccattagttcctgtatctccagaagtgtgtgcggaagtcagcagagtagagtgtggttcgtgtgaactcactgtctcgggtactcccagccttgtgggctgaagccggggattcttgggaagaccttgcagctcagaagctgagccacctgcacctctgccccgtctacccactgagagaaatggacaacaggtggatttatatcagtctccagcaactcagggaccggtttagctctgcattcatggccccttcagggcacccggaagcactggcagtgcacgtaaatggcagctgatagatggggacctgtgccatggtactgaaggcaaacacttccctctaagcctcttgctgtgactttgcagcaagctccccagcaacgccccgggctgggtatgccaggcagagacctggagcatgcacagggctcctcccttccccaccctggctaagctggcagaagccaggccaagcagcgcctggctggaaagccctcccctgcctgggctccttctgttgggtgggcggtgctggcagtgggcctgggagcctgcggagaaggatcagagccacgcgtcactggggcagagggaagcaggctctcaaatgcaggggaattcgggcatcctggactgcccaaggttgggaaggagacaagtccaaggtcacatggctgagtaggtggcaggacttgaatcagagcaacaaggcaagggtggaaatgccaatggttggggaatcttgggactggcaggactcttttagagcacgaggaggtttccggagtcttggttccaaatcaaagttgtacaaagcgagtatgtccgtgtccttgaagagcaccttatttaaaggggtcctgagccagcctctcttgttctgtaggtgggtctctcagtaagcgagcaaccattttattccagtgagaagttctcccctgaggccacaggctcaaggcactttctccagctgcactgtccaagcagcgattttattagaatgcacttcctcaggtgcaccagccacatttcaagggctcaggagccacccaaggctggtggctaccgtcacagacagtgcagagagagaacatttccatcactcccgaatgctctgtcacacagagctgctctacaggaaatggaaacccaagtcctcacacggaccctgaagccacctcccacacccactccctggtggcacaaggccactaatgcagcagcttgggctcccccagagaaccatcctgaagagaagccccaaagagggctgactgctcacagaaatttgaagaggtgttctgtggtgggacaggctccagtctgagagcttaacaggtagggacagaaagtgccaggctgggcttgaacgggtcgttcctcagaatggatgagtgcattctattgtcagaatggcgccagctatgccagggggccacatcttattgatgtgatgggcatgagggacactgccctggttcactgtgtgccaggctctgtgtttgcttcaggggagacgacggaaagcaaaaagcaaacgcaatgcccttcctgccctcctggagcctttgtgctttgctcagtgttcaccaaagtaagagtgcaaacctggctggggccgggaggatggactgaggccacgaggccagccggtatctcccagggctcgggtccacaacctgagtccccgcccatcctgccctgaccccgcctcctcaggtagccacacatggctggtggctaccatatgggacagtgcagagactccgggatgtactgtcacacagagctgctttggagcaaatggagacccgagtcctcacacggacctagacaccccccaccaagcccactgccccatgcctccttggaaggcagtggccaagcatgtactctccaggggctgcgcagatacctagacaaacacagaccagggaggagggaaagggcctctgtcccagcagctcaccgtgctgtgggggatgcccagacctcgcctcgtgctgactccagtggtcctagcacacccagcatggggcaaaaaccagatccggccaccgcctggtccttattaggccccaccatatgcccagcgcactgcctgtgctcaggaaacagcagggaggagacgtgggtttttttttttttaattgatttcttcctatttaaaaacaatactcttaatatgctctctataggaaacgtataaaacacagagaagtcgaaaatgtagtaaagccatcctatcatgcaaatgtaaatccaacatctccatttgattcatttcacattgctgtcattataccatgggctcaattgtgtaatctgttttttacttcacataagcattttctttattaatataatcccttcctaaatgaatggtttttttcaaaatggttatagtttaattttttaagattataaaagcagtaagtgcttattgcaaaaagaaagaatgatcttgaaccatgcaaagaagaaatttgatcattcaacagttatttaccaagcacccgggatgtatcaggcggccttcagtaattacaatttttaatggctgaataatattctcccaagagattgtaattcgcttaattatttggctatttttggaaacccaggcagtcagatttattttgctcttatgcgtgagctctgctgaggagcctctgtcctgaggagagggcccaggcagaggtatcttctgccaaattgttctccaaaagggctttttcatcgcactgcatggtgtcgctcactgcaaccttgccagcattagatattttaatcaaacaaattgtcataagtatctaggtcaaaaatatgtactttactttatatgtctttaattgctgatgagggggcacgtttttcctcatgtttataagttgtcttttccttgtgaattatctgttcctcccttcatttttttttttttttttttttttccctgagacagtctcgctctgtcacccaggctggagtgcagtggcgcgatctcagctcactgcaacctccacctccagggttcgagccattctcctgcctcagcctcccgagtagctgggattacaggggcccgccaccacacccggctaatttttgtatttttaatagacccggggttttaccatgttggccaggctggtctcaaacacctcacctcaggtgatccacccacctcggcctcccaaagtgctggaatgaaaggcgtttattgaagtcttagtgtttcttctgtgggcttgaataaactgtatgcatgaaaaaacagtgacaatttaacagatttgttgcaaataatttttaagacctttgttctttgccatttttttttttcatgcaaaaggtaaacactttgttgctcacaattatttgtgatttcttccattgtttctaggcttagaaaatccctttcggaaatttgagagctgttcatttctgagttttccatgtgtcttcgtgtgtgtgtgtctgtgtgtgtgtgtgtgtgtgtattggggtggtgtagttgcatttttaagatacttaactctttaatttagggattagcaagctttttctgcaaaaggccagatggtaaatagatttccagtttgcaggccacatagtctctgtcccgactactcaactctgcatggtagcctgcaagtagccacagacaatgcgaaatgagggggtgaggctgtgtcccaataaaactttattcacaagaacactgggctgccagatttggcacttaagctgtaatttgccaaacctgttgaatccaaatgagatgtgtcttaggggatagtttgaggtgaggatctaaggtgcatcctttgcagattgctaaccagttgtccccatctctagtagcaaatcggttgttccctggctcatttgcacgcactgacactggtctgcagtcagacctggtgctggctgcctgtcctgacccacgggcccatctgtgtgctgctgtaccggtgatgtgcttttgcctcttgtacctggtatcatttaatacctgacctgccggccccacctcagcaatcctaaagcttgcttctctgtccagtggacttcagaaccactttgtcaagacccccttcctccctccccgccaagataaagcactgggtgatacattctctggacatcctcagagttccgaagccgcagatgagtccggtccccatggggtggggtggcggctggctctgtgcagatgctgtggatttgactctccgcagatgggaggcgggtgtgggcagtacagcgccatcctgagtgaaggcccccagctgaggatagccagacggccctgggaacgccacagcctcctgactgagaaacacgaaaacaaagccggcagtacaagagagcgcgggagattgggaagccactgtgggccggcagaagatgacctcaaatgacaggacttaggcctttctgctgctcttttggaaatcactgtcctgacactcagaattccctgcactccggcgtttcaaatcaaaccctgaaccgggttaaggcgcatggagtggccggttcgaaactgaacctacattcccacagattgcgggccaggggtgtgatggtggcacagggcgtgaccaaatgggaaggggccctttctccaggttggaccagcccggcagtaaccgcttggctccctcaaagagcagcaggagcaggagagtgtgtccagccccaattctcgggcagagcaagggctcaccaggcacaagggtccattccgccccccaccatgggcctcagctccatttctcctggaagcatccaggaccagacactgccacatcttggcttggagccacaggcccaggagagatgggctcaggagcagctggtcctggctcctctggctcctggggtctctgggtaccttcctgtagtcagagggcggctgccagcagatggtcccacgtctggtgcaggagaagagggagggctgtggacgggtagggcacgtctcccacctagtctcatctctccctcctggcctgtggttcatctgcccacaacactgtgaccagcagctaggcttggaaacctctgtcctggggagtggagcaagagtccccccttgtaacccatccatggggccagagggtaagaatgcgctgacctgggggccactgccccagacgcctgccctggtagcccctagggaggcactcgtggctgtgtctgtaggtgggatggggtgggtcagggctcccaggccaccgcctggccctctgcgccccatccacccttccccgaaggaggaagctgggctatagcacaatcgtgggagggggtatctgagatggagacgggcagggttggggtctcccctaagggaggaggggagggggtgagcacacagagcagaaatccaccccttcaggtcctgtccccagcccagctgtgctctcccggtgccttcccagtggggagagcaggcatctgtccatgagcacagagggggcgggaggaatggtgctgatgacagatgatgataagagggtcaggaactggaggagcagctggtggtgggagggtagggggagctgatgggctgtggggcgcactgagggagagactcggagccctgtgttggtgttgggtcccggcctgagagggggcctctgcctctgcactcccttcaggcactcctggagcacggcaggaacttggtggtgcttcctctgggctttgctggaaaagctttgggctcgtatgccgggttcctcgctcagaaatagtgtcttaggcaaaattcaaaaatgaaccagcaatgctcagttcacgcgattcagacagcagccaagcccttgatgaccttcgcgtcctgcagcctcggctgcagcttctgaggtaccctctctctgggcatcctcgccactggctcttcctccatcaccacatttggcagcaggcatcctgccccctcagctggggagagtggcacggatacttcggtgtgctcgttccttgggtctagatcacagaagggcaggcttgactcccatcttcagttggagcccccatttggaggtctgcctcccagatccttttattggcctctgaccttgacaccaatgcatccccccagcctgtactcccaaggactttggcctgcttccagaaaccaggatgccctctctactgcccctgccaggattcctaatggggccccatgggactcgttccctaggaggacacgtgtatgtgtcctggtagctccttatttagtcactgcctgtccaagctggaaggacttagcccagggcccacagccccatggcctccagctgcctgtaatttccttaattacctatttaggccccgacggcttccggtcctcagagctggctctgagattggaagcgggctgggacgggcaccgaggtaccacagcagagccgggccgacttggggcacctctcctcccatccacgtgctctctggctatgaagggctgggaggacagggacccggcttcccattggaccccaaacacgaggtctccgtccctttgtaggctagagtctttcacgctggccacagccacagcgtttctaggtccccatgccgtccctgccttcggggctgctgggcaggcccgggctggcaggaggggcgtggggagcacgtaggggcagggtagtggctggccaggctcacgctgctatgcagctcgcacacccgctgtaattggataattagtgtcattatgcttcctgctccctcgctctctccttctgcagctcttgccttctctggcaggaaacaaatgactgtcccccaaccctcagtgtagacttctggccccaatcacaaaggggcttccaacctccccgtgggatccagggacacccagcattgtgagggccgcctgtgtgggagacaggagcactgcgggagtccgggcaagcttggggaagcatccagagaggcacatgggttcagcccccggccgaacggaatgttctgacttcaccggtcgagcttggtcctgacctgtgaactctggggtccagctggagtccagctgaagacttcaggacaagcctcgggaggggagcgtgtggcgggaggggctgactcagcgaagagcattgccctgctcggcttcctggagatctcctgggcttgaaggaacctccgggaaaatgggcccagtcccctggggaccagcctcagggtgtgtgggcaggtggagccctgccttctcaccaacccagcaaaaaggaacgaggaccatttcgcagattaaaaagtgaaggcccagagagcttgagtgaccaaagccagcacctgcactctggaaccctgaggttgatggggacagatttcctgtccagtcactttgctgaactcttttcattggttctaatcacttgctcgttgcttttctgggcttttcagggcagtataacttggcagagcagcaatgtcgaatcctctggagctagaccacttgaggtcctgttggcctctgcttctggcttgccgtgtgaccttgagtaggctctctaaccactctgtgcctgagccgcatgtgctctttggtggggagggccaccccatgctatagaggctgctggcagagtgatagtcattctgcctctcatccgtggctctatcatctcccttctgcctcagctagaacttctaggacaatatcaccccccagggagctcaggggaaagtgggggtttggtaggtcctggagacctcagggaggcctcctggctctcccagaaccaggctggatttgggttaggagtgaacatttactcaggctatgggcttggcctatctaacagagacccagcataacagtggcttcagtgagagagaattgacttctttctcatgtaagagtctaggtgggcaacctagggccagcgcaacagctacttagccctcaggaatctgagctcctttgattgtgtcatacatggactccatgtgcaagatggcaacagatagatagctgcggccgcacctgtccccacatcagcattccagctggcaggaaggaggggaagggcagaggagaacacattccttctctttaaggacatggcccttgaattcgtccctgtcacttttgctcatacccagttggccaggacagagtcagatggtcatggttagctgcaagggagttgggggaatgtaatcattagctggatgacaagacacttagctgaaaattaaaacatgacgtaggaggtgggagagtagctagcaagtttctgccacacacctctgcggattcattaacacctcctcaagacacatttgagaagtggaaggtacccatcttgaggccaggctttccccaggtgacctggccagcccttctggggatggaatggggtcagtacctctgaagaagtgcagcaaaaagaggggccatttgtgagcaagagggcaggagcagtggtgatggcctctctccactgatctgctcctgtgccaccaaatagggtacccacctggctgggcaggatatgggtggtgttaaaagtcacagaggctgcagggtgggggtagggtgtgtggggaagggtctgcttgggtttccatatccagtaggggggtttcctggaagttaaaatccatacaagcgaactgctggctgattgggctggtcaaggcagtgaaactcctgcaatcacggcgtgtggcttgggcaccacgggaggccattcaggcccagtgtccaccaccctggacacagggcgaagtggctggtgggggctgcttgcgtgttctattgtggtggcatagacatcacctaaaatgtaccacgttcaccatttttaagtgtgcggcccaggggcagaagcacattcatggtgctgtgcagccatcaccaccatccagccgcagaacttgttcgtcttcccaaactgaagctctggccccgttcaaccccaactccccagcccccagcccatggcacccacccttccactgtccgtcccctcagatttcacagctctcctatgaggccctcacaggagtggaatcctacagtgttggcctctctgtgactggctccttctactgagtccaacgtcctcaagggtcagccatgttgaagcccgtctcagaatggccttactttgtaaggctgagtcctattctatggcctggatgggccacatggtgtttatccagctgcctatccatggacattgggttgcatccaccttttggctattgtgagtaatgttgctatgaacttgagtggacaaatacgtttgtgtccctgctttcaattctttggggcctaccccagcagtggggtgggtgggtcctatgggaattctactgctttccacagtggctgcaccgtcttccattctatggcggtgcttgtttgaatgagaattctgggccagccctggagcctctgaaggcaggcaaatgtgtggtctcgagcttgactagacacccagatcccccaggggttggggtgctttatagcgttctggtcctcccgcttctgaatgggaagctctggacccaagactctgtattcgtgaagttccctgagtggggaggggtgcccacccaggtctggcatgggctgccgtagattagagtagagcgctgggccacctaggggccaggagtgctgcagaagtgcatccacccaaaggcgcaggctgaatcgggcaacctcctgggctcctgccacctccagggtgtttctgtgggttccagaatcctccttgtctggacccttgttaacgaggacttccaatgcctgtgtctttctgcggcacccggcgccggacaggcggttgctttggctttgcacgcagctgccagtgggtccccaaggtggcccctccggggctgccctgcagggcagagcttcaggcaggtgggtgcatgcaggagtggggagggggcgccatggtgatggctattgtttttgcccaaagctgttccaggcatgagagccacttgtcatgtgtacagattgtaccaggaacagggggaggaaggaacagagcactgggggccggtggggggcagagggggagcctgtccctttaaatctgttttctcgggttttatttccttctcttttcccatcctcctccctccaccagcacaagtggagccgtgagggcccaggagctgcagcgacggtgcctctgaaatattaatgaggctgttctctgcctcagctccttccctcccccttccctggctgcatgcaggccttgtccttggaaccctcctttcccctcccaggtggtcgccaaggtgcgtcaagcagaggggagggggcaggggcgggcaggaaggagagggcctggcgcaagggcaggaagatgtggggaatcagggataaaaggggtctcccaggtgcacaccagccaccagcatctcgacctgcctaggatcatgccaggcccaggagagggcagggtggctgccagactgggcgccctccttccgtgccctctccccacctgctccccagctggtctaggggcccaccccgggcctgacctacgaggcctgggccacacctctcgctgttgccttggcttgcttttcctctctgggttctgccgggcctggcctgtgttctaggagcctggaggtggagagagatgggggactattgttttaaggaatccccgtagtgagtcacgtcgctgagtgatgggcccttctgaaaggcgggcccttgcttggtgggtctgtagggagcaggtgacggacagtctgccttcaggagggcccacggtggagggcatgtgcccaggtaggcccccaggcgtccacctcctgccctctgcccctgagttctgcttccttcttgcttcggggccacggcatcctgggcctggctctggcttccagatggtctgaatgcccaggagccgcatgttctcatcactgagggtccagtgactagggagtgactcgggagctgggacttcctggcagtacatgccccatcatccctgtggggatatatgtccacgcagaccccagaaactgaaggggtgctcgactggggtgcagtggggctgttttcaggaaagagaatggcgtgaatcccgatgcgtgcatcacctgagatctggaggacggtggtgggatctcgccctccatctgttctctcctccataaaggcggagcaggtggccgagtggaatgcagcctgggcctgctggggaggctttcaggggtgtcatcagagcgtcccagcaagggcggccatgacccacctcaagtcacatggaaggcagggctgggagaaccagggcaaaagcaggaggcttcctgagcctcagtttccccctctgtaaggcagggagagttctcctggccctcgtagggtgtttccaagggtgcagtgaaagaaacatgtctgtcaagagctggcatgcagatgtgggctcaaaactcagtgtgtgccatggggtcctgagaggggccccatgggagcgggggtgccccctacttagaaagtgccgagccttctggagcatgctgggctgcccagggcctggaggaagtccatgggggactaagctggaggtgccagcagagcccccaaagccagggagggacaacataggggaaagaggacccctgggtctctggtcaggtgggtttgagtcactgggtggggagtaggcactctgagcctagttgggaggtgagggtctctgggccctgctgaagagaagagtccagaaggcggttgagtaatgggcctggacttgggccatcccctccagcagcccctggaggcagcagccagggacccccctggctgtctcccaccacgaggccggccagtctgtgcggggatggtgcaaatgccggaaggtgcgaggccccctctgtggaggttctcatttcaatgaagccaattaaggtcagaaagatgaaagagcacagaaatggtatgttccctgcccttttggtgcctacagaccattctcggcagccagcccaggccggaaactctgtcaggcctgcagaactgataggcctagtcacttcggttcttggccatctcggcgatggctgctgtctttattgggcctcagggaggccaccgcccaggcttatatagaacccagaaaagcaaagtatatgccatttggtctgcacagcagccaacagtcgctctaaatgggccttactctaactgatggatcctgtctgccctatagcctgttgcattcatgaagacagtgagggttagcagagcaccccgaccccaccctgtcctccaggatggagactccacctcccaggactccaagttcctcccctgtgggccaggcccccattcactcattcctccaggcccccggccacatgcgggactgaccacgcggtagacttcctgccgactccataccacgtgtctcaaagagcttagggcccagctggtgggagacaagctcacagatcatcgcagcgccaagcagagtgaaataggaatgggtcgcgggattatagactcaggcgcaatcagttttggctggggaactggcagagactcctggagaatgttccacttgaattgtgactaagaggattcatcggaggtcagcaggtggagctggaacagagggcgtgcggtcggggctcagagctggcagggctgtgtggctggggtgggagtggggctgggaagtgctcagaaggaatctggccttttgcttgatggggatgggagactgaaacaggggctcgctggagtgatggtgcctgaaccaggaaagtggtgactcacagcagggtcatgaccagttgctggactagagagagacctaagaggtggtccacaggacgtggagcttgcttgctgaggggtggggatcctgcagtggggagggccagcagggccagccgaggagaaggaagttggccccgggaccatggcagaggggaggactgcctccttgcccactgccctccccatgagtcactgtgggtccagtcagacacagccatggctgcaccagtcaggagcagctgtacgacctggtatggttctgtctgggccaccgctgtggggtcaggggcagggaccgggtgggggaggacagagctggccttgggtatgccatggtcagaggagggaggatgagcacatgccaggggagggccaccaggcctcggtgaccgtgccacgaggaacccctgctctgaggaacaagcatttctgtcatggccgtgtgccacccaagagcctaccacacaagccattcactctgtcacccgctgggggcacagagcctgaacctgacagtggcacaaagttgctacatggtgggattgttgaggcatgaggtgactggagctcaggaaggcagggagaaggcgccctggcaggtgcaccgtcacaagcaaaggtcctggggtggggaggggaggctgtctcgagaagacgaggagtccaggtgagagccgaaagctgccattgctgccttgaggggtcagaagtgggacacccagctgtcctctggctctgccacttccccaagccagcctcagtttcccgcatcagaaaagcaagggcaattcgtccacacagcacccccagaaggagcccgcctcacctgggacagcttcgcttgctgtcctggccccctctcctcagctttcactccttctagtcttttccccccaatgcctgtccccagacgccttgcctcacctttgccccagctgcaaccccacagctcttggccctcgggcctgctgttctccctgtcccagctagagagggacggggttagttgaaacttgttgagcacctgtcccagcacatcaagccagtgccaggcatgtagtagctgctcggtgaatatgtgtcaggtgaccaactgcaagacagggcggggagaggtggggagagaggacggcacaggcacatggccatcattttgtccccacatctcccagaagtgaaggctgcttcatgtgcaatgtgtcgcgagagtaaacgcgcaggtgcccacgcttttcaaacatgggtcactgtggatggatgtttcgtgaagtatccaccagggcctctcctgagaataaggccatggacttggccgtgtctgctttggctgcctgagggctttctcccctttcttcagggctctgggccactcgtttccaacggatgcttctgagccaggagcttccccagagacgggggttcagggccctgctgagctgccaggagggctcttggctgatgtcaaggccaggccatgtgcactgaggccatttcagttccatgaggatgtgacaggcttagctcgggccgggaaggagcggagagagaggagctgcagtgggccccgccaaacactgtgatggctgcagaaggggcagcctgggccctagcggatccttgggtaaggtgacggggacagggagagggatgacaactttgcgatgctcggcagagtggggccagggccgtggcctggatgctttcagtgtggggagactttggctccttactttgtcatctggagggaagaagagcgtggaggggagtgggtggcaccatgctgtgggctgggacgttggcagactcaccagcgacctgtggctgctttggctttctcctgtgtaccctctcctcctctcctcctcagccactccctttatcccctccctcttctccctccctccatccccctttccctccctctctttgcctttccgtcttgtccctctctcccctcccctgtttcccacccttcctccgggcctcctcctttcctcgcccctggccccccaggtactctcagggccacagaaaccgtgagccactaaggccacaccagaagaccaccagggactcatggcatgcccgctgcacagggcgcatcttaaccaggcaagagcagggagtgaaccggagtgaacaagcgcaggactggtggtggggcgcgggcaagaccagccactgatcagtcccagcacgctgccctcacttcagcgtgggttcccgaatggatctggggggcagtgacagcctctgcctccagctagctagtgttaaccactgcagggtcctggcaggaggcatcgacacttcccctcccccacctgggcaagccctccaggttctgggcacccatggtgggcaggacccgggagtggcctggctggtggggcctggcagagcatgagggccactggcccagcctgggaggtgatttctgcacttcgagggtcatggcacagactgagtgaagatttgccgagaatattctggaagatgggacctcagttttgtctcaaccactcccctggcttcttctcgcctccatctccccaggtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggtaagtccctctcaggctgcatgccacccagccctgctcccagccttcagaggagcgacctgaaggcatccttagccccaaggctggccagggtcaagggccacctgtgcccctcctctcagccatttcccttgagggggagatgccctgggtaacctgacctgaccccctcatctccacacctccacaatcaggagttctccgctctatagagcgagactggggagggggagatgggaacttcatgggacacacacacaggcggaatgggccccaaacagaaacccttccgaggaacagggcagggcagggcagggaggaggaagacagccccatctgtatatttggggatttccggtgtgctcaaccctgtgttcacttaagggggatcagaacaggaggaagggatgcagggtgcaagccttcggagtttcgggtgaccggggcctctcctgggaagagagaggatggcctggggatggcacaagccatttgggtctggcaggaaggggtgaccgaagctgggtcacgggaggcccagagtgctgatcagaggtggcactgactggccacaggctgtcccaaagaggcacaagcccagggtagtgtcggtctcactgctgagggaggctctagaaagcccggtgagcactgtctagaaagatctggggcggaggcctgactatccctgtgggaggcaatgttccacccggccttgtgaggcctgcccagccctggttgctgcggtctgccatgaagcggggacccccaggagccaggcccagccccagattccaggagccacagcattctctggcgctgcgtgcctggcagggctgctggggctatcccagcctagtgccaggcctgttccccagccagtgcgggctgatttgatctgctgcccatctgggcaacgcctgggcccacccatctcctctgctcccagccgtgaggctccttggcacctccagcctcccgctctgccctcaccctcaacccagagactgttctcttgtggctccggcctcggccccgtctgtctgcaggtggcactcaggctgcagggaggagtgaagatggaggaggggggctgcgggccaggtcaggaactccagggtctgcctgggtctccctagctttgtgccctggagctgatgcgcccgtgacacccggcctcgccgccgcacacgccctcacggtgcagctgctgctggggctgatgccttggctctgctcccgagcatctcttgccttccctcctccttgcccagcccccgaggaggctgtggagggccatttatccacaagagctctggcctctcccagatcaaaggaagcagatgggcctcagctgtctgctcttcccctgtctgccaggccttgttaaatatttaaaatgtcaaggcccctgggaacctgcccgattctgccatggagctcaggagctcttgcgtgcctgtggaggcaggggcacggagaagggcaggtgcacaggtgggtggcttggcctctgacgggcttccaagcacctgggtccccaaggccacagtgcagggagccggccaggcctggatctgctgcccacagaatgagcagcagaggaccggcccctcccctcttcaaccctcaaggtcctcgggctggagctgtcgggcttgagctgtctgggtgccaggagcgggtgactcgctccccgcatcccctagcccggccgtgcacccggaccctggtgctcagacctgcctgcccctcagtcctcctcagacacaagggcctgagccacgggggcagctggctttgttgtgccccaagccccatgccaatcccctgacaaggtgggcagacgtggggctgcccaggaggcaggcactcccccgtggggcaggtgctttatggcgcatagtgcattgcgggaaggggactttatcttctggcggtacactcatcaatccactgccctccctgtcttgggagcactccaagaggattccagaacccatcctggaaaccgcgctgctgttgtcaggaaacctgggtctcaggctgaactcagaggtgggttcgcccgggaacctggccccgcccagtgcccctctgggctccacaggcagttctggaaaggagggggcggattcgctgggagccgacacgagatgctcctaatccaattctgatggcatctggcctctgctccgggcaggccgcccatctgtgtccatgccaaccggccagcccctgcccccatgccctggacctggactgccctcgggcctgctggggaagcatgtgctcagagccagaggggccgcagctgtgttcctcctccccgtcaatgggtgctgcagtggggcagccgtcgggaccccgagcccacaggaaggctaaggagaaacgagcaaggctacagctgcaagggcaggtcaaggccaagggagaggctggcgagggcgagggagctcctggggaatgggccaggggtcccggctgctctcagggacaaactgggcatgtgaggaggggcaggcaggagagagactcgcatggaggctccaggctaagggcagtggagaccccaggtgtctggggagccctcccctgctcctctccctccgcagaagccccacggttagcacgtgcttcttcttaagtcacttggggggtcttgtactccctagtactgtccccacctggcttagctcctgtaattccaggagacagtcccagtccagagcgaggtgcacacccctcagttgggtccctggtccccagccccctccccaccacccaggagctgaggtcgtgcgttaaccccaggctcccgattggggcaggctcgggcctcagcaagaggcctttggctcctgaagaaacctgagccaggggcagagaggcacggacagctgcggctcttctgggtggggaggacgccatgtggccgtcgcctagctggggtgaatgagccacggttgtgcgggcggcagcttctgttccactgcggccagggctacccctgcccctcctcagaagccccaaggttagcatgcgcctgttctccagtcatctggagggtcttgtgtgccttcccagacccactgtgagtgccccatgggctggggctgggctctctggtcatcccgtccctgcagcagatggcaggcgtgagcccagctgcccagggctgggagctgcaagctgctgtctgtccaccaggtgtcagtgtgggtctggtcacggccgcgacagcactgggcgccgggtgagcgcccgggagggctcctcgggatcagccggggctgagaatcctggggccaagggtggggccagaggagggtgtcatcccacatgcctgccccggtagaaggtggctgagtgggtgtccaggcccggatgccagtcacgcacgtaagcttccagtaccttcaggccaaggaagactgagaagtaagcgtcctcaaggatgacaagtgacagaattggatagggacaggtggctctgattgtgaaggcaaagccaatttgggggcttctgagtggctttgggtgtcattcaagtcgccatgtagacaagctgtgagccctggctgagggatcaaagttggtgctggagttgcattagaaccaaggctgctgggtcctgagggccctgtgctcaccgggtcctgtcgggcagcgtaggttctgtcctgacctgggccacaggccagagctctgactcatggttacagggccctctccacctccggcctcagtggccttgtctgcaccctgcagagagcagctgatgagcagcccagggtgggcagtgtctccccgacccctgcgaggccatgcagcccagaaaaggcttgaagacttcccagtcccctccctcagcaccgtgactccggtttggcttctccccgcctgttccccaccaggaacccactcccattcccgtgcctctctctctcctcgcgtgacaccgttcttcttctttgggtctctggacccaagaacttgcatctcccattagctctcatgctccctccccactgcttcttccccgagaaacttctggaaagtaagcctccgctccctgttgccagcagccacaggcaccctggagactgctgattcctcggcactggccgtgctcatgccccaatccctcgggccctgcccaccctctttgcaggctgtccctgcccccacaggttgggctgtgtgacactgccagtctttgggaccggctggccccatcttacagagctggggaggggggtgttggtgacaagcctgctcagggaattcataggctgggagctagagaggtgtttcctgacaggcacagagccctggcctagtctttggcatctggtgccatcccagcctcccctgattggtggccctccccatgtctccactaaagtcccctggacactcgctctcctccccaggggaccattggctatactcttctgtcctgtctcctagcaacccttgttgacctggacataccctgctgggtcccctctgtgcccccttgttgggtcctgtcccctgccttccagtgccccctcagcggtagtgtggaggtggccaggaaagcacagggacctgggacccgctggagtccaggagcctcctggcctgttttgtcatctgtgtgtcaggaggaggatggctagggactccccatgacagcagccagagagccgcatgctcactcccacgtgcacacccccagcagtctgcagaaaggctcctgtctagagggagagccaggcgctggccagacggccccagagggctgctgccaccccaggagcagtcagtcagggccacataggaggcctgggacacacaaggccgacccgtcccatcccatcctccccttctgtgcttccggggcaccatgcaggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaaggtaaggcccgggggcctgggctggaaggaggaagaggaatggggcttgagatgagggacggtcacaggatggtgatgtctcctccactgcttcccttctgtcctccgcacagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggtgagtgccctggtcttcacccaccctgtcaaggaagctcggctcctgcttctggggagggtgagccagaggagacccccagcacaggttctccccggtggcctgcgtgtcgtcacctgccttaggaggcgggaggtggcgggggtgggggaggtgggggaacacggggcagggcagagtggtttcagacacagcaggcccccgaagaatcaactgtccccacagcctccacggcgggctttcccccctacaaaggatgcaaatgtcctcgttccccagaaggaggagggctcctgagtccctttcccaggcggcccatggcacctgacgggacctcccctggggcagccgggaggaggcggtggggagaaaggcctctgcttcccggtgctctaggcgacctgctgccagccgacggcgtgctcatccaggccaatgacctcaagatcgacgagagctccctgacgggcgagtctgaccacgtgcgcaagtcagctgacaaagatcccatgctgctctcaggtgagggccaccctccgggccagcctggcaccaaggggcgtcagcagccgtgtggcccagcatcctgtccaggctgcctgctgggctcagcctccacctccaccagggccttccagcataaccttcaggttgggaatctgaagactccgcccgtcttgaggcctgatggtggcagctccagccacagggcgaggaagctggccctccaggcccgggagagtgctttgtgtcctgaatgggaagccccaagcggagaggcttgcaggggccagcacagcgctgtgcttctctcaatccagaccctcgacaatatccagtgggggtagtgttccctttccagaaggtttcagcatagtccggtgtttatcccagttggaaacgtagtgtgaaacgggacaggaaggctggaggccctaggtgggccctgtgggcctcggggtctcctccaagccagggaggaggcttcagcctagttttaaggtggacaccgcgtccctgcttccgggagaccctgggagacaggttgtgggcgctgaatgtgtctcccactgggtgatacaaattcctgtctcagtctctgtgttgctgttccaggcactcatgtcatggaaggttctggaagaatggtggtgaccgccgttggcgtgaattcccagacaggcatcatcttcacgctgcttggagctggcggagaggaggaagagaagaaagataagaaaggtagcgcagcagtgccgccagtccctggtgctggtggcggctccttccacgctgcccattctttctttgcgggccggtgccactgggggctcagggagagccagcccaagtgggtgggaggccgggccctctcttttgattctccgtggagactcctcttctgaggatatcccccctgagagccggcaggccaagggcccctccagtgccgtggacggggagtttccctgagaccaccatccccaaaggctccgggatcccatacctacctggacaggaatggcgttagagggacaggagctacggggagcctcatgcttaccctcagggcccgtgcccagtaaggtgccgaggatcccaggccagcgtgggaggcagccagggaggtgggggtcagaggtcagaggaggctgggacaggtgagggccgggcagcccaactgtgggtggtggccctgccctggggcttacaaagctaggcaagcccgagccaggagggcccattcctcgtcctgtggctggagctgccaccatcaggccctgcagcgggcggagtcctcagaccttctaacctgagtactattcagggaggccctgatggacaagattgaatggctgccacagccccttctggctgggcagccttgctctggcctggacttgccttctggcctctcctgcagccaaaacatggtagggagccacacccgcatgggaaagctctgcttcctgccagtgacctccagccagggccctggggccagtgcgcggggtgtgggggcgtgggggcgtggggcgggcagtcagggcccggggaaaaggtcagccctgagcccaaagctccctggaggcagcaaaggagtagctggatgaccctctgtggcctagaagcttcgacgagccctgcctcctggcagcctgggcctgtgtctccctgcaccggctcttctttgtggcaccaagtcctgtagggctcagtgcagtgtctcaccccagtgagtgccctgggggtgcgcaggcagatgggcagccctgggcctcgtctgggctgggctggagtccctaggcctctgtcctgggaagcccagctgcccctgcctgggctgcctcctcatgtcttgcacacaatggccctctcccatcgtccacgggaacccacgctcctctggagtctccagccgcccttctcaggctgctcaccttctctgtaccttaaatgagtgtgtccttcctaactgttccaggcctctcctttcttttttaaattgacaagaccattcagcccctcccaggccccacctggccctcctctccagcaccctcaggctgtcctacttaggagtcagagctagagggcttcctggaggaagagaaccctgagggggccctggagggagagcagcagctggccagctgggtagagggtaccagcaagaccagggggctccctgctcgccctccccgtctctcccgccccatccccattgtttggcgcagcctgccaggtacacgcttaggatacttgccttctacctgcacccaaccccctatttcttgtctcttgaccttgactcctatgcacctttctccaagtgtgcttctcctcctcaccttccccccactcctgtctcttctggcggggcccagccctcctcttccagcaatgctcatcccagacttccccctgcctccctcctccagaggcctcccagggcctgtgtgcaggctgggtccagagtccatgcttccttcgggcccccacggccccaaggctctgccatctcccctgctgtgctgtgcggtcatcgcactgccatcttgtgtccgtgggggtctcccctccctgcaagaagggccctctgtgcccacaggaaccctgggcggagagggcctgatcaatgccccacccctggctgagtagggtcggggggggggccctccctgctccctggggaccccggatcccaaccccaactgcctgggagtgcagatgtggcccccaggaagctcctctaactgcagctctcagaaggggtgactgtgcccaccacctgagcccctggatagggccacttggggcccagcctggccttgcagggctgctgtgtgccggggctcaggctggcactcctgtgctgcagccctgggttgaccaatgacctgaaagcgccccgcagagtcctagcgtctcattcctttgtccctttaaaacacacactggggccaggcacagtggctcatgcctgtaatcccaacactttgagaggtcaaggcaggtgaatcacttgaggtcaggagttggagaccagcctggccaacatggcgaaaccccgtctctattaaaagtacaaaaattaactgggcgtggtggtgtacacctgtagtcccagctacttgggaggctgaggcaggaggatcgcttaaacctgggaggtggaggttgcagtgctcaaacacacacacactgagctaactgctggacgtgactgcagggaaaaccaatccctaggcaagggcagctgggtgctgtctgcctggcttccaggggttaggagccatctaagtgaaccccttgagctggtttgcagggagcagacgtcccgacttggggaggttccagcttccgggaacctcccactgccagccatgtgtgacccagggcccttccaaggctggctttaggggttcactgtagggctgagcttaaggccgaaggggagccctgggcagaggtctggctcaggaatgccagtgttcatggtgaccgtgtgctgggaggtggtgacggggtgagcctggagaggacggggcatgaagaaggccaccagcaatcaggcccctcctccccaccccctctgccacgcggcccccaggctggtgtcctcaagccttcgtgtctgtcatccctcttccattgtaggcaagcagcaggatggggccatggagagtagccagaccaaaggtaacgggcgccgctgcttgggcacaacaagcttggagccctgggggtggggctggtggagggcacagtgttgggggaggttcacctgcctcggtggcaggagcaacacttggagaccaggtgagtgggctggctgcacagtcccgtcccagtgcagagggaggagagagcacacccctggggctgctcagggcatcctggccacagacactgctggcagctcagcccagccacctagaggagaccttagcccagcatgggcataaggatcacctgtgagtgggcgccccgagtccactctggccagatgagaaaactgaggcccagaagggctgactcacctgaagctctgggtcccagtcagtgtgtttcccaggccagcttcctttcagccaagcctgaggacctgggagacagagtggtcggctgagggccagaggcccggctctcctctcagccccggacagctggcaggtgccgacaccctggggccagcatgagcctggctgtgagacgcaggaagcaggagaaggggtgggaggagcggggaggaggccagccgtggcccacggaggacaggagatgtcggccaatgcagcagccagctctaggtgctggagtccatggggaacaaggcaggtcctgaccctcaggaaggtcacaggcagagatgacccaggcaacgccctgtgcggagctgggtttgggagggcagtggggggacagcccgatggctgcagccctgggttgaggaggtggcagcaggtggggcacaaagctggaggggcccagctgggtggggcaattgtgtcctgacgccactgggaagaggagccgtggcgaatggccttgggctggcaagtgaggaggagcaggaggaggcagaggtgatggcggtagtgccaagagccccagtggatcggggaccagagtagtgagggagaaagacgagtctgctctccccaggtcgctgcgtcggtcccggggcagaagagggaggtggggtggccaggattactctgggccgtggagtgggtgcggccagagcttggcagggagggagatgaggaagtgacagaagcagaggagtggggagaggagggagccggagtgggggacacaccaccaccatgtcgagggcagcaaggatgaggagcacaggacccaccagggaagaagggagaggagccgtctgctccaggggagaggcagggagggtgctggagggacagatggagcccgaacaggcgcagggctggctggtgggaggagagtgcatggggcttctgggcctccctaagggaggtaggaggtggctcggacaccagtaagcagatgagtcagctcagggttctggaagattcctcgggccacaggcctctgctctcaggtattatttggggcattccaggaccagtcaccctgtctgtgtgcccaaaagccttgtgctgtgtctgtcctcccttctcccgagagaaccatctctgtcccacctagaacagtgctggagccaccccacccaccccaagagggcctgggcttaggaggcgagagaagggaagctgatagacttggaaataggagagctccactgaatcccgtctcctctctatggtgtggcatgtctttcccccacaaaagccccttataacgccttctccccagccaggcactgaccttggccatggggttcctctgtgtgcagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcaggtagggacagcaggaggtggtgggcccaggccattgactgggcgtggaggatgctgggctcctggagatgagcccaggctgtgtagagcaggtgggaagggatgtggcaggtgatgtgtgggccaggcaggcaagggcacaggccaggccggcagtggccatcagggcctggcgcagcccttccctagtgagcagaagtcccaaaccctcgacgaaagcccgggtcacacactgagccactgcccatgaggtgcccctacccaaggctccaggctctgcccctggcaccctcaaaaggcagctgggggcatgcagggctggtaccccaacttctggggtgcagtgggggattgactcttgctagtcctccccagcggtgcttctcctgccatcagaccacaaagtccactccccaaccccagcagcactccagaagaggccacacagagcccccttgcaaacaggccccagctcacctgctgagccaaacctgggctgtttatcctgaaacgcaaggcaaatctacaaggccttcacaaatgcctccgagaccgtgtccatacctcttcttccctcttcctgtccccctccttccctcacccgtggcaacccctttcgtctcctccccgctctgtggcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaaggtaatcataaaacttacagttgatactgtttacagactcggaaactggggtaagaagtcattgggcgccttggtggcagtataaactggggacgtttgggatagctcaagggaggagaggaggtgccgagcagggacccagggggcagctttgctgatctgtcagctcaggtccctcggcatgagatgggccagaaagcaggcaggcggtgagatacccaggggttcagcatctgcacaatgtgggcagtaggacggaggggctgggaggcagcggggaagcggagaatcagcagagggcccgggacactgggaggcagtgggaggaggtggggggagccaggtgtggggtggtggggtggtggggtggtggggtgggagagctgcagggctggtgggtaactgagagggggctcgggcaggggaggtcccgggtgcgcatcccgcccccaccattggatgaggttgctgatgccttacagcctcgctattggctcagggctgaccaggtgcccagtgggcttagtgccacacgtggagctagctgagcagaacagagtcacgcgatgtttgtgttgacatctctcactcctccaccccaacaagcacctgggccaaatgcccacaccctcgccctttgcagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactagtgagctggggcaggagcgggcgggcagggccgggggcaggagcaggggagggtcctggccagggtgccaggtgagctgttgcaaggtgctcattaggcccccccttgagaacttttgcccatccctggcctcacaggtggctctggctgggaaactgcctgtagctaaggccgaccttcctctgctccctgccgcccacaccctaacaatgtggtgaccacgagggggcagagctggggctccaggggcagcatggagggtggtctcaggcccccagtgcctgctagccctcgtcatcttgcagcctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgagtgagcagcagggaggtgccggggtacgcacggagtttctgattctattgtcgtggtaaaagaggccgaacgtaaaattcaccatttcaaccactttacagtgtacagttgaatggcattaagcacgttcacaatatcatgcaaccgtcaccactacccagttccaaaacacctccatcaacccggaaagaaaccccaggcccatgagcagccctccccacgcccctccccagcctcatgtgcttcctgtctgtatggatttgcctgtctggacatttcctatcaagggactcatacactgtgtggccttttgtgtctggcttctttccttagtgtaaagtttttccgtttccctcagatattagaccttcctttctttttttgttttgttttgttttttccctcaagccatcctcctacgtcagtgtcccccgtagctgggattacatgtgcatgccaccacgcccagcgaattttcaaattttttgtagagctggggtctcctcatgttgcccagggtggtcttgaagtcttgggctcaagcgatccacccacccggcctccctaagtgctaggattacaggaatgagccactgccaccagcccgaacttccattctttctaaggctgagtaatatccattgtatgctaaagagcattgtgttggtccatccatcccttcatctgtctaccagcacgtctaccagcacgtgagtcgtttccaccttttggctgtcacgagtcacgctgctgtgaatattcacgtacaagtttttgtttgaacccatgttttcaattcttttgcgtggacatctaggagaggaatggctgggtcgtggtgtccacgaaactgttttccacaggggcagcaccgtttcacattcccaccagcgacataggagggttccaccttctccccatcttcaacagcacttattttctggtgtgacaatgctgatgggggccatccttgtgggtgtgaggcaatatctcctggtggttttgatctgtgtttccttgatgactaacaacgctgagcctcttttgctgtgctgactggccatttgcctgtcttccttggggaaatgtctgtcctagccctttgctcattgctgagttgggttgtttgtctttttattgttgggctgtaacattttttctgtattctggatcctagatccttatcagctatgcgatttctacacattctgtcccattctgtggcctgtcttcactctcttgatagtgtccttaggtgcacaaatgttttaaatcgtgatgacgtccagttgatctattttcttgttgttgcttagagatgatgaaaattttcttagagatgatgaaaattttctggaattggagactggtgatggtcgtgcagctctgtgactatactaaaaaccatcgaattatctactttaaatgggtggactgtgtggtgcgtgaattatatcccaataaagctattagaacaaagtaagggagagtgcacagcgtcacctccaaatgccctggcttccccactcccactcagccttcccggactccacacccttggccttggcgtctctgtccacaagtcacctcgctcctcatgactgccgtcccagggccctcagggcaaggtcctctgcaggacgcccagggctccccaaaggcccaggcccacgctccttcctgtgttctgcggactggaccaccaagtgcaccctgcctggccgccccacccacagcgctctcccagaactctgccaggtgcagcgctcactgccagggccaggaccacctcctccctggagccatccctgctggtgtgggggcctcagccctctttctgtgcttcttttttggtgggcactgagggacactgaggcactgcggacaaaaggcccagcccagcttcactcccccttactcccatgcctcagtttccctggtggcatggagatcacagaatacttatctctggggaggggtgtgagggttccgtgggtgaatccacatccataggaggctctccgtccacacagcttctgttatgatcatttccttcgtcaccagcctcccatgcagtggcagcacctggcactcacagccccactggcttcttccaccatgcccgcctctgtgaccctcggctcctttgctccctcctctccccacctgaatcctcccaagtcctgtcccttttgagaagctcctggagtcatgagcgctctactgaggctgtggctgcctggacgtggttatagcgattgtccacagacttcagtttttgcccaggttccacccgcttgccctatgaagtctgtggtggagctgccatgagccacatgctcctgcctccctcccggtctctcagcctgcagcagtgcatgagcgtcctggtgccctcaagcaacagaaatggattctcccccagttctggaggccggaagtccaaaagcagggcgtgggcagggccgaagcgcctccaaagcatctcagagaggatgcatcctgcatcctccagcttctggtggtggctgccagtcctcgcgttcctcagcttgcagctgaccctctctaatctctgcctgttgtcacacgcccttctccctgtgtgtctgtgttctcacacggggcactcctctctgataaggaccccagtccttgactaagcccccaatccagtgtgaccagcgctgttccttgttgttctctccccacctccacctcatctctgcccaccccctgcctaggtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtagccaccaccttctctgtgagctgccctggtaactgtgccctctgcccgagcttgtccggactggtaggggcggccttccttcacacacagctgctgcggtccctccgtagtacacttgagccccgtcctgggtgctctcaccctgacacccgcacaaaggctctgtcctgcctgctggaaagcccttcccgcttgacctatgggcccagctcaggctccaccttctaccaggtgagaaggtggcagtggcggagagaccgtcgacatttgggatctgatccacccaggaccgatggactggaggtggtgctgaagcctgaggggacacaggtttggggcacagggtgggcgtttattggttgagggtttggctggggctactctacggtcaggacgtcctgtggcgagctcacagcaaaggtcctggcgggaaagggagcccagaagcatatccccatatggacgatgccaccaggggagtccagatgaggggacctcgagggccgcgtggcagatgccatggccttgacactgggaagtcactttgttgttgaaagatcccagaccctggagagtgtggaggatggccggccccggagggagaatgcaaggcatggggtgcccctctgtctccccagggcctctgcatggcacccacctgtgtcacaagcagggccactgtgaccctgacaacttgtctttgtaggagccaccctgggggtgcaggtgcaacctgggaggagaagcttctgggctctccttcgggagacaggcattcatgtattggatcatgtagcaaaaacactcaattcaaagacagtgcgtctaaacgccagccatggctcatgtcaacagagcagccccgtgccccgaggagaacatggtcactgcgcccagagagggagcacctcgagcttgccctgggagaaaatgggtggtagcggaggacaggggacagaagtccagcgagggaaatgggccccgcaaaggcgggcagcggcatgagtcccgggccccactgagcctgggagagcagaaggagagggtgctggtgaggcgaagcaaggccacacttggggacaggagccatcgagtccctctgttggaccagggagcaactgaagcacagagcagaggaaggaatcttgccagaggggcctggggaatagggacagctcctttccagcttaagagtggctgagagagagtccaaggggtagaccacagtgacagggccaggctgcggaggctgggcagacccccacaaagactggccagcctggtggtggctgaggaggacgcacagaaggcccagcgaagtcctgggtgccggcaacaggcagtaggacacaagggcctcactgaaaccgccagggtgcttggagatgcggcacggctgcagccagaggagggcccgtgaggctgggccctggggagccataggaagcctgtggctggggtggtattgatgctggagctgggccggccgggggcactggcaacttctccagacacctggctggctgctgtgctgtggggccttggggagaaggcagggagcagggctgagcaggcgaggaaggacagcctggcctggccctttggggccatggggaaggaactgggctacacacactgggcctgaggagggaggaggcctgggttcgcagctgctggttttcaggctcgtcacggccacttggtggcagcagaggggtggcttccagacttttcagggacaggcattcgctggctcaaaggagaattgtcttcttgtggctcgtgatcttgttatccagcaccccaagatcctcagagagtacgaagtgtccccgaggctggcagtgaggccacttagtggtatatgctgcaggaaccattggatcaccctgtcacagcttagagtggggcccccagctgtctccctggcaaagatcacagcccccctgcccatggcctcagggggcgccaggattcagggactcccaggtcaatgtcctcccctggtgtctcccggctgccctacccctggctcccactcctgcgtgtctactccccaccgccgcaggctccccaggcctggcggctcggccacacctaggcttctacacttacccgacggtgctcacaagccccactgcctaggcttgacctcctcattcaggttcccaaactctgaacctggctcctcttctcctctccccctgcccgtctacctcagtggcatcagctgcctgaccctgtctctctgtccccgagcctgaagagccacatacctcttcatttgggaactgtcttccctgtccccccaccactgggacaatgccaccacctcccggccagtctcctggcttcccgctctcaaccccttgcaggctgttcgctttccactcagcactggggaacctctttctctttctccagaatctaatgtgatgcaggtggtccccaacttttaacaattttgtaacttggtgcaaaggtgatgcacattcagcagaaactttacttcgagtcccatgcttttccctttcagtgcaggattcaatgagttacatgagataatcagcactgtattccacaataggctttgtgttcaatgcttttgcccaactgtaggctaacacaagtgttctgagcacgtgaatcggatggctttactctcacctctgctggaccttgggccacctgcagatctgatggaggaaggggtactgcctcaacccaaaatacgtcttgcctcgatggccccgcccacctctcttgtctcttctaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgaggtagcacccggctgtctgccaccccagaccccccttctcctcaccccagccccctgcgtgcccgccttagctctgcagcgtccttgtgcttcccctccccagatagaacaggagcggctggacaaggtgtggcccaagctgagggtgctggcccggtcgtctcccaccgacaagcacacactggtcaaaggtagccgagcccccacacccctttcctggggtggccagcccgaggttgtctgcttcctgacaccaaaagccaggttcccaaacaggtccccagggcctgcctaggaagctgggtccatttgtcccattagcccagagcagcagggcaggggcccatgagggaaccagggttcggggagggctagtgactcactccaagtcacacagtgagtctctagaagcagtgggtctagagccagggacccaggattgtgtccccaggccctaaccagatccctatcctcccaccctggccctgtcactcagtgagatttgcttacttatttggggataggagatgatccaggtgacggggagcacagataattgggacagtcaggacggggtaatcccaaagggttttcacagccaacctacccccatagctccctgggcagggctacacagggttgtggtgacagatggccccagccctgccctgccctgatctgtcttccagggattatcgacagcaccactggtgagcagcggcaggtggtggctgtgacaggggatggcaccaacgatgggccggccctcaagaaggcggacgtgggcttcgccatggtaagccacctggtgcccgcccagctcaccacggcagatggggcctgcatctgtcccatggacattagctttgtaccaggaagtgggagccagtgtcggggcaggttacagagtgcctgaaggttctttctttcacatcctggccacttgggcctgcgtgggctctgccagtcgggggacatgtggttaaaggcatctgctgtgatgcccaaggtgacagtgggccccagacatactgtggagaggaaggggaatggggggtgggggctcatcactgatggcattgcccacccccgtcctctctaaatggactctcagccccagatgaggtgagcagagtccccagatgtgctcttcctctgcacttccttcctgttgctcacccactgagcagggtagccctgcagacgccacccacatggctggttgcggcccctcagtggccccacagccactgaacgcagcaacctggtgagcccctctccctgccctaccgaaaaggagtgtcacccagggaacccagcccagtccttcccagcacccgtagcccagaagggagctccagcccaagcttcgagaggtggcagctctcacggggccaggcttggggcagaggagaggactgcgcagcttggcacagctgcagctgcgcctccatgggacagggactcctctgcaaggagccgccccgcccagggtgtccccatgcaggacttcccagggctccttagccagcaagcctctctggagtgctaagaacagaccacgctgcttggtggccacgtggtggcagctgggctttatgtgtaaagctgtgttgatgccatgtcatcagcaccctctgtgtttatgagcaaagcccccccccccaccgtgacatgtgacaacttactgtttgtagtacaagaatgtgttgcattaaaaaaaagcaacaaaaaacagtgctgttcttggctttggggggcggggtgggatgttattcagaaggggagagcagggagccagcccaggcgggccaggtgatcaaggggggctggggaaggggcccccacaaacactctgtgtgagtgtgtgtgtcacccccccagggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggtgggtactgggggctgccatgccccagctaggacacctgggctcaggcctgagggccagattgtgagagtgagggttttgttttctttgctgcagattattttaattgagatcaaattcatatgccaaaaattcaccattttcaagtacataattcagcactcgaatttgtaggacattcaccacgttgtgcaaccattggctctatctagttccagaagattgtcatcatcttaaaaagaaaccctgtgctcttgagcagtcatttccccatttctcccccaaacatcccagcccccggcaaccactcacaggcttcctgggtctatggatttgcctgttccggacatttcattcctatgggatcaaataatatgtggcctcttgtgtctggcatctcgcttagcaccgtgttttcaggctcacacacaccgtagcatagggcaggactttctgccttttcatggcctcataacactccacggcacagactgccacattatgtatgtctgccctgatggacacatggctcgttcccactttttggctcttgtgaatggtgctgccaggagcatctgtgtatgagtttctgcgtgggctatgcgtcccatgggaaccctttctcaacagtcccattttccccattggtgagtgtccagattttcttcaccccgccttagaaagggggtgtttaaattgcctgctgatcaacttggtcttttcaaaacaattttttaaattgagataaaaaatcacataacaaacttcaacagaaccattttaaccttttgaaagtacataactccgaggtttatatccctccactgtctattcccagaacattctcatcaccccaaaaggacacccagaccccgtgagcagtcactctctactccccaaaccccagcccctggcacccactcatctgctttctctctctatggatttgtcagttctggaagtttcctatgaatggaatcagacagtacgtggccttgtgtgtctggcttctgtgaggctgatttttaacgaacaactcagaggagctgagaaggaaggtccagttcagagtttctgcctcctcctgcccctgaggtgcaggagacaaggagagcagccctcactctgttgccccaaatggcagaccccatcgtcgggctgttttgtggtctggggtttttcacctcctgcgagggatttggagcacacctgctgccaggtgagagaagggaggcgggcacgtgacagcccaaagaaaacgccccactagcgtaaaggcgatgtagggatggagatgtctgttttcatgggcatgaaatcctggtgatgtggaccccatgaggagcccccaggagctactgggtttccacccccaaccttcccgggcaggcggcccatggaaaggtgactgcctcctctccataggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggtaggctggccaggggcacccgggaggacttcaggacactgttgccaccacctcgggctcagattctgtctggtgtgtctccacctgtgtctccgcacccagtacggggtgggacgctgcacttcctgactggacagcacacaggggaaggagcagatgggccaggctagcaaccctgcagccaggcctgctggtggcctacagctctttcgcaagcctctcctcccaggccgctgagcagctgagaaacagttcatgtcttgacatcctgcccacggctgtgtagctgtgtagagtaggcagcttctacccagccccagagtggccacggtaaccctaggaacagaacagcccacatttaccctgtgaagattgctcctgtggagtgactggggtgccgtgctggaagctgtgaggtgggtggggggtgaccgcaagagagaggaagaggaggagggcgtccgaggaaagccagccttaagaacttcccttcttaatctcttccttcctgccctcaggctcagggtctggcccctggcccagaggggtctcaggactctggttggttgagcctggggtgggtgtggctgccttgggccttggccgtgagctggaagtggccatcccctgggacaagggacccatctcgggagctacacaccgaagtctcgctcctgagtaatgcgtcatgcgctgagatgactgtgcctgagtggggaatgttgctttccaggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcaggtaggaggggcggctccactcttggcctctgccacttgcaaaaagtggaggtggtgggcttcaagacccctcgtccacccctagtactggcctccccacctccactcccagaaggagccccaccccacctggctttcctgtagcccccgtcctctctgcatgtcggagagggccttcttcatcttccaaacattgccggccttgccctgggtgagcgcgctggcttccagaagggtttcgtgagccctcatcggaacgaagttttctcacagatgctggaaggagtcctccctggctccctctaggtctgccattcccatttctagcacttaattccttggcatgaggctgccataactccagaagtttcttttggagatgacctctgtgcccagtgctgacacactaacctctgcttcccacagtgctgtggacaggctggtcagccccactgtctaggaggggctaagtgttctaaaatatagtgtatttgtagaaaaattgaggtatagtaaggccaaaaggtcaagagacagttgccactgaaagacagtttatgactcagagaccccaagaggaggacacatgccacaccataggggcccacatgggagagcgccaggcaggaggtggggtgtgagagctgtggacaagagcctttgctgtggttccctcggggaggagcaggtgaggcagggctggtaggctcaggactggctaggttgcgtcattgcagcggttccagggcatacgggtgctccctggctgtctggtacctggtcctgggtaatgagtgcaaggggatagtggcccggaatgtgacagtccaacagaggacggggtcagtttgcatttggacagcttgcccctgcaaattggatgcctcccgaggaggcaggaggccaagacaaggtgacctcggcaggttctagggtcctccagaatgaggcatgtccagcgtgcccgcagggtgggtgtcacagcctccgtcttgctgaaaataggagcatggtcagtggagctgggccccactccgaggctggagtcagtaggtgcctggcacccaggggcgctgggggccatgcactgctctgtcatcacgcccccggccttgtggtcctctcgcaaggagcagcccgtgcaactgggggaaccaaccagggtggctgggtcttcaaggggttggaggacaagggtggctcaggagccgcggctggacctgcctctctcccacttgcccttcgcagattgtcatcgtccagtttggcgggaagcccttcagctgctccccactatccacagaacagtggctctggtgcctgtttgttggtgttggggagctggtctggggacaggtgagtgacagccctgcccctcatttcagactgccctgcagacagcttctgtgatgggcccacttgccctaaccctgcttcagagccttggggtcctcaccctaggaagcacactgagggctcaggcctgtgacacaccaggacccagggacaggacgcaagggaaggtgtcagcaaaagaatgcaaaggaacatggctgggatgtgacagggcccaggaaaactgcccgcagctcccctttctatgataagagccaaaaattgccccttccaattgggtgggtagcttgggaaatccccacatattttaaatcaatcaaacagcaccctgatcaataatccatggggcgaaaagaaagtctccagagaaattaggaaatattttgacctgatggaaaggacagagagtcccacatcgagctctgtgggctgcagctgaagccgcacactggcaggtttctaggaccccacaattagatcaggaagaaacagcctgggtatttaggatccgcttatctctgtcttcatcagctccgactgccatagcaaaataccatagactgggaggcttagacaacagacacttactttctcgaagtcccggaggctggatatccaaggccagggagccagcggggccagttcctggtgagggctccttcctggcttgcagacagccgcctcctcactctgtgctcacatggtggacagagggagcaaggtctctggtgtttcctctcctaggagcattaatccagtaggatcagggccccaccttggtgacctcatttaaccttgatcacttccttactccaaatccagccacactgggcactaggacttcaacacatgaactggagagcacagttcagtccatagcattctggcttttcctttttttttttttttttttttttgagacagggtcttgttctgttgcccaatgtggagtgcagtggtacaatcacagctcactgtagcctcgaactcccaggctcaagtgatcctcctatctcagcctcccaagcagctgggaccacaggcacatgccaccacaccaggctaagttttgtattttttgtagagatgtgttgtgccatgttgcccaggctggtcttgaactcctgaactcaagtgatctgcctgcctcagcctcccaaagtgctgggattacaggcgggagccaccatgctcggcctggcttttgtttcttgatctctgtgccggccacaggggctgctgcagctgctgcagatgccagccttcttgctggccccagcattagtgtcctcggggacagcccacccagttcctgtttcattttcagaattctcctttccctctgctactgcacctcacctccgaatcacacttgaacctggttgctccatggagtcccttcacttcccgaaacctggactctaaccacagcccagaggggtgccaggccctcttcttgctcttcaagctcccaggccactggccttctggtccccccaggaatgtggcaccagcctgtagctcggcctctcagggctactgggttgtccttttcatttttaaccttgttcagttacaaagataaaacatgttcaagagaaaaacgaaaagaagggaatctctgtgaaccagtcctcaagtcccctcctggccatgttcgacaaatacactggcatagacacacaagacagacgagacgtcttgctctagaactccagatgcccatcatccctttctgtggcttcccctgcgtccttctagactgttccccccacttcccagtggcctacaatatgcgaagccatgccctctctttactcctgccaggctccttatccagtcaccctttccagctgtcaccctccttgtcacctcccaccctctctagcccccaatgcacaggtcttctctaggctggtgttcctccaggagatgccctctccaggagagactaggccagagctccagctgtcctctcccaggggagttgcgcaaacagcgcctgtgtctcccagcaacggtgtggagcgacatgcagggagtattgtcaaccagggcagctcacccaggccccggtgtccagggcttttcttgcggtggttcacagagccatgctgtggtcacgtggctggcctccatctccagccctctggaggtccagctgttagtgtagcctacggggcacggtccccagccccctgccccactgagccatgctgctctcaagcaggatgttccaggggcttagcgatccctcccaggagcccttgctgcaccgcgttccactcgggccactccctgggccctttggctgaatggagctccatggaggatccgcttatctctgtcttcatcagctctgactgccatagcaaaataccatagactgggaggcttagacaacagacacttactttctcgaagtcccggaggctggcccagagctccacgtactcctgaaaatgcatctcagccccccgggggaacactacgccagttctccaagggctgccagttcccggggggactgctctagctttactccctttgcttagtcacaaaaacaaatgacatcctttggaagaaggaggccggcgtctccctctggagagggaccttacaccaggcagatgctgctcagcctggctctcacggccacttccgtgtggctcccccaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcaggtaagccccgactcgctctcgccctggcacttccaccccaagagggtagaggcaagctggccagcagcagccgagagccggccgtctgcacccgacacccacagggaaaccctttggtcttgctgccaaggtcacaaaagcagctgccagtgtcccctttgccattccgggctgtgcccgctgatggctgtggcactgagatcgcctctccctgacagctccttcagagcccaggcatcccctgtagctaaaggtgtgtgtgggtgactaatggctctctcagaggcacaggccagcaccgtcctcatcactgctggggctcccttcacttggtgggaacggccccaggtcataggcaagtgacagtatcgggaagagaggcccatttcaaacagccaccagcgagctcaaggttcactggttgacactgtaaatgcgatggggagacttcatttgggaagtggactctggccaccgagttggtcctttctggtcatccaaatcaccaagggttagggccggccaagaccaagggcgtcagctgtgttcctctctgaagtcagatggccaccactgccaccagtatcaggcgcttgccagagctaccatgctcccttgttcccatctcctcccggccaacagttttgccagaatgctccagactcgctgtgtctccacacccctccctggaactctcttgtgatcccactacagcctggcctctgcccaccactccccagaaacggcgctcgcctaggcctgcgaggctcccttccggctcgtggggtcgggctgtccctgcatcgttcctgcctgctgtgggcactgcctggagacttgctgtcctcacccgcctggcacccccacctcctgctcagccctcgccccaccctgctgtggcccttgagtgctgaaaatcctggccggggaggaagaaagggcccatggggaccccacctgcggcctggcccctctcccaccgcagcccctgcagcctctccttcatggcctgcccctcccccagcagcctccagagggccacccagcatgcttcacactccacctccttctgcaaggcctgggccaccatctctcaggtcacagccatcactccctgcccctccaggccctgtccaggatccccagttgcaatgcccctgacatggagcgactgaccctcctccctgaggtcctgccagagtaaggacaccactgcacacttggctgcggagccagggcccgcctgagccaccagccccagctcaagcgggaataggcggggcctgaggccacaccccttcccagggtcagtcacacatcaccaagggcctgtcccaaagaatcatccatgcaacttgcacaaagctgttcttggtgccctgggtcctgtgttccctcccagtggtctcaagggccgagtctcaagggacccagcctcagggcaaccccactccctgggcctcagcctcctttgcttgccttggctcagctcagcccctccaacaccaccctctgcagtgggactggtggagcctctctccattgtcctaaggatgaagtctacgctcctgaccatggccttcaagcccctgcctcttggtgtcaccccaaccttcctgcacacctgcacccctgcacccccggctgcctttccaatcatgccctctgcccgcctgtgccactgcacctccccaactcccgctgcgtcccctgggccctcatgcttacaaagccctctttgactcctctcactctcaccacgggctccttgcaaaactttccagagctacagagtcccccagagaccacgatcacgcagggctaggtcaaggggcaacaaagaactccacatttcaagagccccccaggggtccaaggggcctctccagctgagaaccgggaggcgaggctggcatcctaggcaccgaacacagcgtagcctgggaaggatgtgttaggtctggactctgaacactgtcacctatgccctggcctggccagaacacagagagccccggtgaggaaggggagcaggctttgtcgccagatggcctgcgtctcccctcccacgtgcaggggctactgcctcaagcacaatgctcggacaggccaggggtgcagcacagatagtctgttctcgttccctgcaataaatatttctgcgctaaatcttaaacacatcgaatgttagaagcagcattcacatctcccccagtgccctcctagcggcccaactgtgccttctacgagaccatgcctatgggccccccagctgcccccagatgggctcttatctatcgtacccctgttgtgctacagagcccagagctgcccaagcctggggtggggggtgaggacagcaggaccttgcccctcggcggcccacttcactcctgccgccgcagccgaaggcgacgttaggttttccagcagctgagacaacagccctgccctgacctgaagcatcagtggtgtcagtggtaccccggccacctgtgtgtctcgtgtcctctgtatgtgggggccgctgcagcctggctagtagaagcgagtcccatcggtcagagtcttagagttccaggctgttccaattgtcggtgctcacagagacacgggcagctgagtcccctgttttgcgtatgaggaaacagggtgcactctttccccttggcaccagccgatccgactcttccacgggctcctgacccccatggcttttcgctttgactttgtcacatccaactcaccatgtttctcaggaatgctgaaccagtcggttcttttagccagctatgtaagagcatctgctctctttgattcgaaacacctgcttgaaaaatggagctaaagcttgggagaagcccgtcaggttgtacgtatgccccaagccaagaaaaacatttcctaggcagctggccccaggtttctgctttttgggaaccacaaaatcgctccccagattttggaggccggcacaagcttttctgttgctaagtgaaggcattttgtaacctgctcgcaccatggttccatactaacatatcaacgcaccagatggacagggtgtcattccagaataaaagagtccttcaaacccagaacatgtagctttctgaagcgctcatgactcggtctgtcttttttgcatcccattataatgcaaagagaagcttcgtcagcaactgggccttgctcccggctcagctcttgggcttccaggtgtggggtggtggcgactgtggtattgtcactgatgtggctctcccactgggacaccatctgtagccaggccagaccaatgcaaatctgaggcaggaaaggcatctttcctatccctcatcacttttgccgcagcgagagtcctctcctgaatctagacaggagaccccccaccccgcaagccaccgcgacgccatcacatcaaccatcctccttccgtgcgctgacacactcagtatgcattcctcacggtcgcagcaagtgccatgaggttccccttgtgacaagcaagcgagtgggatgtgctgggcggaaggggactgggcaggctgagaagaaggaggagtcctttccacagcgcgtcaaaggctgaagtggcgtacatcctcattttggccggtgcagggggagtctgaacactcaagctgccttcttccacgaagccctggcccgtttcaagacacccaggtgaacctggtggccaccacatagcactgcagggctcgggctggagcaggtagctttgggctccagatgcgcacactggctttgctgttcacatcatctccagtgagacggacatgagtccccatcccagccaagggcaggtcaggaaatccaaagacactgggtcaaggccctcctgcaggcctcagtttccccagccttgcttccccttcaatttgcaggaagctgtaagagtggggacaaagcgaagccacggctgccagtcggtgggaaaaccccctcctccgctaggtccattcttctgctgaagtttcgagggggcgccccctgcccagtcactcagatgagccacagaagctggcggagacgggcaggcggatggagcatggggcataagtcctccgggtttagaggaagcagggcgggttctaataggagcgtgtcatgtccctcaggtgtgttggagaggaaaaacaaggttgagaactatgaagtacttcctgataagtggcttgcaaggggcatttctgacatgtttgcagtgtgccctgacttgtgacccccttcccttcccaatctcatgaccactaaccatctgctcagcaaaccctctctcggtgggtggcacagaggctggcctcagtcagggccctgtccaaacatcgccagctcccagtgagcggggtgacccgatgaggctttgctgtcaccctatgtgcccagtggtggcccctatcctcgcccagccctcccctccgtgatagcctggacaacagtgcaagccaaactttatctcattttctctcccacagatggaggtagtgagtaccttcaagagaagcggttcagttcagggtgctgtgcgccggcggtcttcggtcctcagccagcttcatgacgtaaccaatctttctacccctactcacgcaattctctctgctgccaatcctaccagtgctgctgggagtgagtcttgacttcccttttctctcataaatggcatctctggggaagaataagcctccccagctcggccttctctcttttgcagtcttgcattccgctcaccgtggcttttctgttctttctttaccgccctgtccagtccttcccgcccagacggtgtctctcgaaagccatattcttttatgaaacgtattcaacccatggcacttccggacctcccgttctttgctttgtttggtttttcggtttgtgtttagtgctccttgtgccattggttctcttttcttgaacttgtctgcctttgccgatggttcttcatgaacttgggccgcttctgggggtgtctggtgtcaggctagggccttgctcagtgttcagtggtgcagcatcagggcagcacgcgggctcagggccgccttcccggggctggaggggtggcgggtgcctttcccacactgtttgccacagaagaatctagcccacgtacccaggaactggagcggcgcttccagcatcctccttgaagtggtttcctaaggatgccgctgtcacctgtccccaggtgggctcagtgctgaccaatcactactgcacaggtggtgcctgccctgtaggccttgccccaagccaccgggtgttagaggtttccccagaactggcactcagaggcctcttcaagacgttgccaggaaaatttcccaccatgttggtcacagtttaaagagaacccaggggctgtcctaaggaggtagaaacttccagaattgctcacatctttttacaaagacaaagggaaggccactccaccgctgaccccactaccctgatgggagagaatgcagggaacccagtgggcccagccaggcagcctgctttttccagcaaactcaagagagtttatacaccaaagagtaaactttcgcgcgtgggcccagggcctttgccaggatggttctatgctacctctttcctttccttctagcaagcccccgaagcgctcccctctgccaacacgaacacgccactcccctgcaggtgggagtccttaaccacgcctttttccatcacagactcttccagcttgattgcttttcttttcctttctttttttttttaggaactggtgagaggtccctggtgggggtcacccctcctcttgcataagctgtcattttgggccactctgtcctttaaggaagggaggaggcccatcctgtcccccttgggaacagagcacgtgcgcgcgtacacacacacacacacacacacacacacacacacactccttctccaaaccacaggccacgtacacctccagcttgctccacactcatcatggggccacctacccttgtcacaaatattggctgacaccgtggcagttgggctgaaaagcagtcggcgcctccagtgccctagacgtgggcccaaaggggcctcgccgccactccacccagagaggcggacaggaggctctgccaagtcagttaaagccagaaatggttcgtggcctcccagcaccttccttcctgggagctgagggcagcagggggcatggctgtgcctccgcctccctcccccttgacttcctccgtatgtctctttgccatctctctctgtgcttcctgtctgtctgtccatttgcccatttgttgagttaaggggaaggcagccaccacggccccactccacgcgttcctcgagccttctccacagctctggcctcatcccaccccaggaccagctccttgtccctctccaggtccagcccagcctctgtggggcctgctgtcttttctccctctggattcctcctgcttcctccctggggcagcctcttgctcctctcttccttggctcctagcacttccttcctgccttcattccgtggccatctgtccccctcctccccacctccggagcctggcagtgcggggtaagtagagtgggagagacgccacccctcctgctgttcacaagctattccatgggggccctaagtggcggatagccagaaggagggcagctgtcccttgcacactgtgtgctccagcagaaggtgggtggcagggccctctgaagaggcccatcccagctgaacatcagcatcccagaaaggactctgccgtggaggaagatgctggctggggacctggcaacaccaaggacatgcccacttctggaagccacctgccagaaccacctcctgccatcatcacagtgcagcggattggtttagaactcagaacccaacccccactccacgcttcaaggaccccaagcaatcaccaagcccagcactctcatcctagagatcaggggaaggaggttgtccccaagggccaggacctgcactgggtcccataagcagccaggcctggcagagtggggactagcaccagcgcccaccctctacttggaactttctggtggatgagagatgctctgaaggctgtgacggagctcccctagacaagagggctgccccaactaggcctgcaggggcgtcgagtcacgtggtttcctaaggcaagcccacagtttcccatcctctttgcctgctccaggccaggctgcctttcagcccaccaggagtctggggcctttctgggcactggagctgcctccgtcccaagcctttcctactaaggacctcaggtcctccagagagaagggccggtggttggtagcatgacatcccctcaccctgtgcccctggggccaatgcaggaagtagcaagggggtggctaggaggggtcgagagatttgggatcgctggggctcagtgctcacacactcgagccctccccaccctgtctaacctcccacacctttgctgcttctggactcaggagtcccaacacaggccccatatccctcctctgcatgcattgtcagactgtgccggccacaacttctgacccccagctccaggcagcctccactgcccctcccctgcccagcctggtgactaccccacaccatgccccaaccacacactcacacaccgaggccacagtatcaccctccctgttgggtgtccatattccggagagctggtcagggacagctggttcagtcactcgggtctaccaagggcagcaggcacagggggctgcgcgtctgccactaggaggcacgggagggtgcgcgatcatttggaaagccccatcaaagccacttgagaggccttttatgtctgttttccactgggacacacagacaaaccccagccacgcatccaaagtctatccttccagcagcgccacaccaggcctgtgtgagatgcttactgttggagtcgttcctgagatgcctcctgacctggcccagcaaaggagcaggggttaggcagcaggccatgagtctggtcccatgtggccaccgggggtccctccgggccgtttagttccagttaatcatgctggaaacagatcacagcagttgcttggttttattggctttggcaacatgaaaaccgtgtggccaaaggggccaaaccgggccacgtgagtcccaggctttccctggacactcctttccagggcccagggcgacatgctcaccacactcccagccccgtggtggaaggagtcttgttttctggagtttgctccattctcaggaaggtcatgtgctttgagccaagcctccctacctggtttctgggaacggtgtattggcattttttctcagatctttgacagtctgcaccctgcctccatgctggaagcagtagcaaccctcccccaagagccctgccctaggctttcctggaaccctgggccctaccacaggggaatgcccttccaggcaaaccctaaagtaggcaccagaacgcagcctagggcagaccccaggacccctggtccaaggccctccccatcaggcactccgagtgtggactcccaagctgggaacctgggcagagacctctcaagactaattggaggtcccgcagctggattcagccagtacggaggcaagggctcagctgggccttcctcctgggtcctctttagtccgaccacccgacactgactcgccgcgcccaggtcagttcagcttgctggtgttgggagcacaggtctaggctcacacggtcctgggcatgagtgtgcacacaaggtgggaggcaattttcatgaaacttgccagctgcaagcagttctggcttgccaacacacacacagccatgtcttgtcttttccgttctttggttcaattccttggggaaagagccagctgtggagtttgcattttcattgttcctaattcaagcatgtgacatccccatggggtagaaaggggccttccccttgctcttcccccacatagagaagtgaggccgaagccatcttctcctcagtgttcaggctatctgagcttggcttctcattgcccgagttgactgatggttcctattgccacaggctcttgaggacacctttgtctcgctttcaagttgtgattcaccttcacgcctacaggggttgttttgagcctggaaaccctaaagttcttgacaagaagttccccatgggtctccctggctgctgtgttcagaatctgctctaaattcaaagctcagatgcctggggagctgacaggtccctgcctccaaaggaaggttctggaccagtggttggtgctgagcagtggataggtagggaggaaatcgaccagaagcatccgagttctgtgaaccttagcggctgagactgagcagagagcatggagcccctcgggtcggctggtgcccagcacagaggcagcaggatagggcttgtttctgcttgaggaattagaaggaagagtgagaaggtgtcaggcacagcttctgtcgtttcgttgtcactgcggtcaggagtctttgctttgattgttctcttttcctttcctttttctactcttctcggtccttcgcttgtctccctgcttctgcggcccttctccaccctcatcctcctccccagccctgcactgcaaactccagcacttgaaggctaaccaggggcacgtctccccatgcacatggcgggcacctccactccagctggccggcagtggcatcgcacatggcactccacacctgcaccccttccgctttggctcagtgtggccagggatgggccttgtcagtctgcagcgtcacccgccctgtgtaaggctcagaactgctcatccacgcaagtcgggagcccgggccaagcccacagcactcagcatgtctcctctgggcagctggtaacaaactgcccgggacagcctctctaaggatgcgtacttgagctaagttcagaggaaggagaaaggccagccaggcagcagaaagggcaggggtcatggctccggggagcccctgcgtggggtgttcagaaacagctccagccggctgggcattgcaaagtgggcaaagagctatggggagggccgaagccagcacaggaggctggtgcaaagccgtgtgggccccagacattcagccccgtccactgagcccctgctgggtgcagcgagccagacagacagacccctgccccagggggattaccttccagtgaaaggtggatggatgtagggggcacttgaaggaaggagcagaagtgggcaccatgctgctggggaagacaagagtgaggggagccttcctggtgtggggtgcagccacagcaaaggtccccaggtgggatgtgccggaggctgaggggtaaaagagggcagagtgagaaagactggggccggctccgagggccacagccagtggagggcttgtagcgggggagaccaagacacgctctggttttcgggccgccgtgctaagggcatggaggggtgggggcgaagtgcaggttctggatggcgtttgaagggagccacggggctggggccgggggggttgggcctgctaagtttgagacccagcttagatgcccaagtctggagccggagccgagaggctgttagccgacaggtggaatggaaggccgagagccagaagagagtacctagacccagaggaggggccctcgggtgtcagggatgggagaggaggaggggctggagcagtgtcggacagcgctgggggactgtgaggagtaaaggactgtggcctctcagggccatcagccatgatggggaacggagaagtgtggcagagggagacagcaggaggacacaaggaggtggggacacacagtggggagccacctcgcctcacccggatgagatggggagtcctccagcccaacctgaccctcctaggggcatctctcccggaagagtgctttcatttcctttctttttaaattgtcacagtaaaacgggcttttgggggtacagttcaatgaatttccacacagtcaggacacgggccagttccatcgcctactggaaggtttagagccagatgggggaccaagagtctgacttggcagccagagagagctcggaaactccacctagagaagggacaggaaggatggagggctttgctggtgggggttggggtcccaatgtgaccccagggccccaggcaggacatagcagcagcaatggaggtgaggagaggctcagatgtggaagatgcttttgagttagggtagggcccacaggacacgtggatgtctggtacatagggtcagggggtcaaagtgcctctgaggtttggccagagccctgcactgggatgggaaggctgctggtgggcagagttcagctggagcactgataagagtcctcctcgggcctcctgcaatttgagaggtcccttaggcatccgagggggaacacccgggaggcagccagggcagaagtctggcagtccaggaaaaggtggacatggtgcagctggtatctgcagtatttacggtggcctgatggtctatagacagcattgacagccctgggggccatgagattcctttgggagcagtagggggcgtggcgcgtcctgggctgagagcagagcaggaggcggtgcaggagcctgagatgaggacagagtgaacccaggctggtggaaggagggcatccttgagcacccaggtaggagtgcagccctctgggatgggcctctcttagaaacgtttgttgctttccattgaaccaatctcccaggaatcgactgcatccttcagtgttgggtgggctgaaaacaccccaccttaacaccaacaccaaaacattgtttaatggcccaggattaggatgcagggaaaatagagcctggagaaagctgactcactgtcagctgtaacagactcaccaggactccagccaagcttagcacccccaaacagcagaatgttggggggcagcccttccatcctgcagcggttcactcagtcacttgtgcattccccaagtgtctgctgagcagctgctctgggccaggctctgttgttaagccacaaacaaggcagatgccatccgggaggggcacgctggagtagccggtgagaccggaggagcagtagcagcagaagcccagcctggaaggaagggctggctccgtggcctggctgtcctttatggaggtctttggagttgagccaggtgcagtgagacctgtgcataggtttgagcaggggcctggcctgatcacatgcccccaggtctgaatgaggccaccagctcagcgagatctcaccccacacagccctggggtcaaggcctgcagcactttgtcctttttgtgacttgatgggcaacagctttagcaggcgatgtcccaggcggcttccacaccacaatcctgtaccagaaaaggcctaaataatgaggcaacatctgcattggctacgaaaactgaattctgtttcttttcattaaaaacgtcaaattattctcaatttctgtgttacccctaattcagaaaccagtctggggataaaggcctgagtgagaatagctgaccatctgccgtctggcagatgtggctttcccgaatgcagagaaaatccgaaccagatttcagatggggtgctagaaaattccaatgtggagctttttggcttacttttttttattattattttaaataggaacggggagtatcactctgttgcccaggttggtctcgaacacctgagctcaagcgatcagcccgcctcggcctcccaaagtgctggaattacagccgtggaccaccaaacctggccctggctcactttttgcactggagaggtgatgaggttggcatcatttcagctgattccgaagcactgtgctttgcctagctgagcccctggagggctgaaagaaagtcaccgaaaaaaggtgattaattgtctaaacgacagagccagagaggaaatatttttagctttccaggcctggtctctgctgccgtgacacaactgtgcccttacagcatgaaacttaaaccagtaaaattttattaaccaaaactagcagagagctggggttagcccctcagcaagccctgacaccttgtctaaacccagaaaaccaaatcctaggtcgaaccttggccccagaaatgcttcagaactcctaatgtgtccacctgctcacataggcaggggtggacaggtgttggatgaaccccagggtctgcctggcagctcagcgctccgtctgctgccccctatagggatggcagtacaaggtgggccagctaccattggcggctgtgctgacactggcctgtgcgaggccaggcagaggcctccccatcaactcctggcttctagaagcaggagggggcccaggctgaggggccagggagcaaagagaggcagcaaggacttgagtgcgtgaggcaaggtggagaagccagaggagggaagggctcgctcctggagcagtgccctgccggagggtcagggggcttaagggctgccgtgcgctcagctgggggcagagggccactgtgccgggggagtctggggcacagcgggagctctttcatgcgggaagttccgctgatctgaggtctgcaaactcctgtggggagggatggccagggaacaacacagagcggagcccgggaggcagcagagacgcaagttttggaatgtctgactggaagatggaggaggagacgggagagaggacaggcggagtgaggtcagaagagcaggggcaccagattgaaccagacccagtcagacacgggggctgtgaggaggccacaggggcatctgagcagagacaggctttagtgggtgcaaatcaaaagtgtggccattttcggtctcagatacctccagctggggactgctgggctctctggcctggagctctgagtacaggcctgggccacagtttctggttatagccagatgggccccagcactgtggccagggtggagaggtatggacagagaggaggagggacagagccaggccagagctctggggcacccagggacagaagagagggcagtggaggagatggggccagggcagctggtgaggtggaagagggccaggcaggggcaatgtcaggaagccatgagaagcttccagaaagagggatgatcttctgtgttgagtgccctgagggatcaaatcagacgaagatgcagaagtggccagtggagttagccgcagggagaccctcgacatggcaggtcccggctccagccatgggagctgggggatggagggagacccatgcgagaaaggccggcagtgcccataggctgggaacttgctcataccagcaggtacttcggactttctggtaagatcgagaagacatcccactcaccagcattctctccttttcaaatcatctttcttttctaccaaattggaattcagattgggcagagaccccagaggtcaccaaagccactcgtctccccaggacagggaactgcggggtcacagccaagagcctagtgcagcactctcaagttccagaatacctgcccagctcagcctagagaaagacactgccatcttttcctgcatgcggatcggttgacgagaccaaggcccacacctgaaaactctttccaaaggcaggcagagccatcccattccgtagcagccctccaacaaatgggtggacatttctcatgccatgacccccagccattgacgtgggtggaatttaccagcaccagccggccactgactgtctccttccttccttcctaccttccttccacgtttcctttcctttcccttcctttcctccctccctgctcccacctcgcgccctgtccctccacctcccactccagatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgtctcagcacatgcgcacacgcacactcggactcacacgaagtcacacgcacacatgcacgcacacacacatatggggacctgcacacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggagaaggttcttcgtccaaaggag

SEQ ID NO: 3999 - DNA, 65263 bp, human
cgccgccggtgcagagcgtggggagcactcggccgcagccctcgcccgccgcagagggtcgcgtcccgcgccgccggccaggccgccccgtgcccaggcctttccatccttggagcggatcgttgcccgcctgacgcccgcccgcagcgacagcgcccgccggagccgaggccgcggcggcggccgtgcccatgcccgggtaagtggtgctctgggcgcgcgggcgccgccggggtgggcgcgggcgcggcgcgggcacaaggcgcgggtggggatgggaggatgacccggcaggtggtgcggcggcaggtagggggacacgggtccccgcccgaggcacctgagccccgcgccgggcctgcgtgtccttgcggcactgcggccgcgcgtcaccccggggccccaggccggcgggcagcgccccgcaccctgcaccctgcgccccgcatcgcgcgcgcacgcgcatccgtgtctgaggaacaaggcccttgggggctgcgggccggggctcagggtgggcgcagccgggggcgcgggatctgggccgggagcccgccagtgcgcacgcaccttcccggagcctcgggcaccccctcccccccgcgccctcacactgtatcatccttcccctctcgccttcccgcaccgttccccgcacgcccacgcggctgcccagcagaccccaccgcggtcatgggcagtgcccacgagaagccgcccggggccgcacttaggtaacttctccatccctccaggaacggctgtctccccctcctcgcctgtgtgaccttggccagccagcttttcctgtggccgcctgcgttttctcacgggtgaaagctctggctttaagattctggaatttggaatggcaggtgcggcatctcccagagcctgagacgatgggcttctctctctgtgacctggtgtccttccttctgctggcccttctgggggttggtggctcagccagccggctgaggaggggtgggaggcagggcaggggcatggcgccggggcaggtcaggactggagggagtcttggagagcccgcggtgagggctccatgagggtttaggagagactgtggaaatgctccttcgctcactcaaggggcagggaagggaccagaattcctcaacgagatgcttgccatttcctggcgaggtcatataactttcaaagatgaagcccagggcctccgacctcaaaggagtccctgcctgctaaaggatcaagtccagcctgtccccaactggcccccatcctgaattccactggcaccctaaacgtcagccgacttcccctggctgacttgggcaccagtctggcaggcaccccctgcacctcctcccctcctttgcccactaggatctgtgccctcaccccctgccattgcccctcactagtcagtgaccatcttaaggcaaggactggctcttcatttgcacaggcctggcacagagtgggcacctggtttctgcatggcatattcatgaccttgacctcactgaatctgcagactcactgaacaggagaggcaaggcctggatttttgtccccatttttcagatgggatcattgaggcccccaagaggagaagggattcagccctgaattgaggccccttccttcatgagcagatggctagggacattcctatgaacctggtggggcagggaggcggggagaggttatcgtaataatcaaagaccagccccacttcctgagctccatctgagtctcacctcaaccacacgagtgaatggctgttttcatccccaacccccaccccccgccgccacttttcacagatgaggaaaccgaagccatgtggctcattaaaggggcactgggatgccgaggagagggctggggatgcctgggcccctgtgggacacagctgagacccagcagagggtcccagggtgaggtcagcccctcaagtctgcgccatcggaacgggctgggaacttgtggtccccggccattgattgtcactgctgcaggccccgaggcgggggacagccaaggacacagccagtctccatcagctccacctgggccgtgccctgcacggccaggtggtttgagtgcaggagtaggcatgctctcacacagcagggggtaacgggcagatggaagtggggcgggcgtgggagggggccttgcacagggccagaaggagagccggtccctgaggaaggaagcccctaaggcaaagagcatgccaggggacagccacaatgccaggtgatggagatgccccaatcggcccccgaggggcaaggaaggggccagaggaggctcgtgagggtgcctggggcttcagtgacagcagccccttacctgatggtctttgtgaccttggccaagtcccttctccattccagatccagggagggtgggggtgggcctgggggagctggagcttcagaggttgaatcattcactagcaggagaagccaagcctgtgagtcagtgagtgctctccatcccagaacgtctgctcccagcccagggatgcagccacggagtgccggggtcagccgtggaggaccctctgagaatgtcttgtggaaaggggcgccttgcctgcccggtagacaggatgagggcgccccagagccccaggggcttctgagagctgagtaccctctgggcctcttgcagccagcagagccaggcagagcttcttctggccttttcacctcctcccccacctcacagagcaagtcatcagcacatatgaactcccctctgattttaaactgatggcttgtgtatttcaccaatggccactgtctccatcagtggtcagtagcacatcaagtaatgtcaacaatgataatagttataatggcagtcactttatgtcagacactgagtgctgcacagacatttccttgcccacttaattgaaacaacaacaaatgattgcaagtgctgttatccccattttgcattgcggctgaggcccagagaggctaggtaacttgcccaaggtcacacagccagtaggtagcaaatccagggctggaatgtagtccatcaggctccggagtctggtctgtgcttgtagccattagttcctgtatctccagaagtgtgtgcggaagtcagcagagtagagtgtggttcgtgtgaactcactgtctcgggtactcccagccttgtgggctgaagccggggattcttgggaagaccttgcagctcagaagctgagccacctgcacctctgccccgtctacccactgagagaaatggacaacaggtggatttatatcagtctccagcaactcagggaccggtttagctctgcattcatggccccttcagggcacccggaagcactggcagtgcacgtaaatggcagctgatagatggggacctgtgccatggtactgaaggcaaacacttccctctaagcctcttgctgtgactttgcagcaagctccccagcaacgccccgggctgggtatgccaggcagagacctggagcatgcacagggctcctcccttccccaccctggctaagctggcagaagccaggccaagcagcgcctggctggaaagccctcccctgcctgggctccttctgttgggtgggcggtgctggcagtgggcctgggagcctgcggagaaggatcagagccacgcgtcactggggcagagggaagcaggctctcaaatgcaggggaattcgggcatcctggactgcccaaggttgggaaggagacaagtccaaggtcacatggctgagtaggtggcaggacttgaatcagagcaacaaggcaagggtggaaatgccaatggttggggaatcttgggactggcaggactcttttagagcacgaggaggtttccggagtcttggttccaaatcaaagttgtacaaagcgagtatgtccgtgtccttgaagagcaccttatttaaaggggtcctgagccagcctctcttgttctgtaggtgggtctctcagtaagcgagcaaccattttattccagtgagaagttctcccctgaggccacaggctcaaggcactttctccagctgcactgtccaagcagcgattttattagaatgcacttcctcaggtgcaccagccacatttcaagggctcaggagccacccaaggctggtggctaccgtcacagacagtgcagagagagaacatttccatcactcccgaatgctctgtcacacagagctgctctacaggaaatggaaacccaagtcctcacacggaccctgaagccacctcccacacccactccctggtggcacaaggccactaatgcagcagcttgggctcccccagagaaccatcctgaagagaagccccaaagagggctgactgctcacagaaatttgaagaggtgttctgtggtgggacaggctccagtctgagagcttaacaggtagggacagaaagtgccaggctgggcttgaacgggtcgttcctcagaatggatgagtgcattctattgtcagaatggcgccagctatgccagggggccacatcttattgatgtgatgggcatgagggacactgccctggttcactgtgtgccaggctctgtgtttgcttcaggggagacgacggaaagcaaaaagcaaacgcaatgcccttcctgccctcctggagcctttgtgctttgctcagtgttcaccaaagtaagagtgcaaacctggctggggccgggaggatggactgaggccacgaggccagccggtatctcccagggctcgggtccacaacctgagtccccgcccatcctgccctgaccccgcctcctcaggtagccacacatggctggtggctaccatatgggacagtgcagagactccgggatgtactgtcacacagagctgctttggagcaaatggagacccgagtcctcacacggacctagacaccccccaccaagcccactgccccatgcctccttggaaggcagtggccaagcatgtactctccaggggctgcgcagatacctagacaaacacagaccagggaggagggaaagggcctctgtcccagcagctcaccgtgctgtgggggatgcccagacctcgcctcgtgctgactccagtggtcctagcacacccagcatggggcaaaaaccagatccggccaccgcctggtccttattaggccccaccatatgcccagcgcactgcctgtgctcaggaaacagcagggaggagacgtgggtttttttttttttaattgatttcttcctatttaaaaacaatactcttaatatgctctctataggaaacgtataaaacacagagaagtcgaaaatgtagtaaagccatcctatcatgcaaatgtaaatccaacatctccatttgattcatttcacattgctgtcattataccatgggctcaattgtgtaatctgttttttacttcacataagcattttctttattaatataatcccttcctaaatgaatggtttttttcaaaatggttatagtttaattttttaagattataaaagcagtaagtgcttattgcaaaaagaaagaatgatcttgaaccatgcaaagaagaaatttgatcattcaacagttatttaccaagcacccgggatgtatcaggcggccttcagtaattacaatttttaatggctgaataatattctcccaagagattgtaattcgcttaattatttggctatttttggaaacccaggcagtcagatttattttgctcttatgcgtgagctctgctgaggagcctctgtcctgaggagagggcccaggcagaggtatcttctgccaaattgttctccaaaagggctttttcatcgcactgcatggtgtcgctcactgcaaccttgccagcattagatattttaatcaaacaaattgtcataagtatctaggtcaaaaatatgtactttactttatatgtctttaattgctgatgagggggcacgtttttcctcatgtttataagttgtcttttccttgtgaattatctgttcctcccttcatttttttttttttttttttttttccctgagacagtctcgctctgtcacccaggctggagtgcagtggcgcgatctcagctcactgcaacctccacctccagggttcgagccattctcctgcctcagcctcccgagtagctgggattacaggggcccgccaccacacccggctaatttttgtatttttaatagacccggggttttaccatgttggccaggctggtctcaaacacctcacctcaggtgatccacccacctcggcctcccaaagtgctggaatgaaaggcgtttattgaagtcttagtgtttcttctgtgggcttgaataaactgtatgcatgaaaaaacagtgacaatttaacagatttgttgcaaataatttttaagacctttgttctttgccatttttttttttcatgcaaaaggtaaacactttgttgctcacaattatttgtgatttcttccattgtttctaggcttagaaaatccctttcggaaatttgagagctgttcatttctgagttttccatgtgtcttcgtgtgtgtgtgtctgtgtgtgtgtgtgtgtgtgtattggggtggtgtagttgcatttttaagatacttaactctttaatttagggattagcaagctttttctgcaaaaggccagatggtaaatagatttccagtttgcaggccacatagtctctgtcccgactactcaactctgcatggtagcctgcaagtagccacagacaatgcgaaatgagggggtgaggctgtgtcccaataaaactttattcacaagaacactgggctgccagatttggcacttaagctgtaatttgccaaacctgttgaatccaaatgagatgtgtcttaggggatagtttgaggtgaggatctaaggtgcatcctttgcagattgctaaccagttgtccccatctctagtagcaaatcggttgttccctggctcatttgcacgcactgacactggtctgcagtcagacctggtgctggctgcctgtcctgacccacgggcccatctgtgtgctgctgtaccggtgatgtgcttttgcctcttgtacctggtatcatttaatacctgacctgccggccccacctcagcaatcctaaagcttgcttctctgtccagtggacttcagaaccactttgtcaagacccccttcctccctccccgccaagataaagcactgggtgatacattctctggacatcctcagagttccgaagccgcagatgagtccggtccccatggggtggggtggcggctggctctgtgcagatgctgtggatttgactctccgcagatgggaggcgggtgtgggcagtacagcgccatcctgagtgaaggcccccagctgaggatagccagacggccctgggaacgccacagcctcctgactgagaaacacgaaaacaaagccggcagtacaagagagcgcgggagattgggaagccactgtgggccggcagaagatgacctcaaatgacaggacttaggcctttctgctgctcttttggaaatcactgtcctgacactcagaattccctgcactccggcgtttcaaatcaaaccctgaaccgggttaaggcgcatggagtggccggttcgaaactgaacctacattcccacagattgcgggccaggggtgtgatggtggcacagggcgtgaccaaatgggaaggggccctttctccaggttggaccagcccggcagtaaccgcttggctccctcaaagagcagcaggagcaggagagtgtgtccagccccaattctcgggcagagcaagggctcaccaggcacaagggtccattccgccccccaccatgggcctcagctccatttctcctggaagcatccaggaccagacactgccacatcttggcttggagccacaggcccaggagagatgggctcaggagcagctggtcctggctcctctggctcctggggtctctgggtaccttcctgtagtcagagggcggctgccagcagatggtcccacgtctggtgcaggagaagagggagggctgtggacgggtagggcacgtctcccacctagtctcatctctccctcctggcctgtggttcatctgcccacaacactgtgaccagcagctaggcttggaaacctctgtcctggggagtggagcaagagtccccccttgtaacccatccatggggccagagggtaagaatgcgctgacctgggggccactgccccagacgcctgccctggtagcccctagggaggcactcgtggctgtgtctgtaggtgggatggggtgggtcagggctcccaggccaccgcctggccctctgcgccccatccacccttccccgaaggaggaagctgggctatagcacaatcgtgggagggggtatctgagatggagacgggcagggttggggtctcccctaagggaggaggggagggggtgagcacacagagcagaaatccaccccttcaggtcctgtccccagcccagctgtgctctcccggtgccttcccagtggggagagcaggcatctgtccatgagcacagagggggcgggaggaatggtgctgatgacagatgatgataagagggtcaggaactggaggagcagctggtggtgggagggtagggggagctgatgggctgtggggcgcactgagggagagactcggagccctgtgttggtgttgggtcccggcctgagagggggcctctgcctctgcactcccttcaggcactcctggagcacggcaggaacttggtggtgcttcctctgggctttgctggaaaagctttgggctcgtatgccgggttcctcgctcagaaatagtgtcttaggcaaaattcaaaaatgaaccagcaatgctcagttcacgcgattcagacagcagccaagcccttgatgaccttcgcgtcctgcagcctcggctgcagcttctgaggtaccctctctctgggcatcctcgccactggctcttcctccatcaccacatttggcagcaggcatcctgccccctcagctggggagagtggcacggatacttcggtgtgctcgttccttgggtctagatcacagaagggcaggcttgactcccatcttcagttggagcccccatttggaggtctgcctcccagatccttttattggcctctgaccttgacaccaatgcatccccccagcctgtactcccaaggactttggcctgcttccagaaaccaggatgccctctctactgcccctgccaggattcctaatggggccccatgggactcgttccctaggaggacacgtgtatgtgtcctggtagctccttatttagtcactgcctgtccaagctggaaggacttagcccagggcccacagccccatggcctccagctgcctgtaatttccttaattacctatttaggccccgacggcttccggtcctcagagctggctctgagattggaagcgggctgggacgggcaccgaggtaccacagcagagccgggccgacttggggcacctctcctcccatccacgtgctctctggctatgaagggctgggaggacagggacccggcttcccattggaccccaaacacgaggtctccgtccctttgtaggctagagtctttcacgctggccacagccacagcgtttctaggtccccatgccgtccctgccttcggggctgctgggcaggcccgggctggcaggaggggcgtggggagcacgtaggggcagggtagtggctggccaggctcacgctgctatgcagctcgcacacccgctgtaattggataattagtgtcattatgcttcctgctccctcgctctctccttctgcagctcttgccttctctggcaggaaacaaatgactgtcccccaaccctcagtgtagacttctggccccaatcacaaaggggcttccaacctccccgtgggatccagggacacccagcattgtgagggccgcctgtgtgggagacaggagcactgcgggagtccgggcaagcttggggaagcatccagagaggcacatgggttcagcccccggccgaacggaatgttctgacttcaccggtcgagcttggtcctgacctgtgaactctggggtccagctggagtccagctgaagacttcaggacaagcctcgggaggggagcgtgtggcgggaggggctgactcagcgaagagcattgccctgctcggcttcctggagatctcctgggcttgaaggaacctccgggaaaatgggcccagtcccctggggaccagcctcagggtgtgtgggcaggtggagccctgccttctcaccaacccagcaaaaaggaacgaggaccatttcgcagattaaaaagtgaaggcccagagagcttgagtgaccaaagccagcacctgcactctggaaccctgaggttgatggggacagatttcctgtccagtcactttgctgaactcttttcattggttctaatcacttgctcgttgcttttctgggcttttcagggcagtataacttggcagagcagcaatgtcgaatcctctggagctagaccacttgaggtcctgttggcctctgcttctggcttgccgtgtgaccttgagtaggctctctaaccactctgtgcctgagccgcatgtgctctttggtggggagggccaccccatgctatagaggctgctggcagagtgatagtcattctgcctctcatccgtggctctatcatctcccttctgcctcagctagaacttctaggacaatatcaccccccagggagctcaggggaaagtgggggtttggtaggtcctggagacctcagggaggcctcctggctctcccagaaccaggctggatttgggttaggagtgaacatttactcaggctatgggcttggcctatctaacagagacccagcataacagtggcttcagtgagagagaattgacttctttctcatgtaagagtctaggtgggcaacctagggccagcgcaacagctacttagccctcaggaatctgagctcctttgattgtgtcatacatggactccatgtgcaagatggcaacagatagatagctgcggccgcacctgtccccacatcagcattccagctggcaggaaggaggggaagggcagaggagaacacattccttctctttaaggacatggcccttgaattcgtccctgtcacttttgctcatacccagttggccaggacagagtcagatggtcatggttagctgcaagggagttgggggaatgtaatcattagctggatgacaagacacttagctgaaaattaaaacatgacgtaggaggtgggagagtagctagcaagtttctgccacacacctctgcggattcattaacacctcctcaagacacatttgagaagtggaaggtacccatcttgaggccaggctttccccaggtgacctggccagcccttctggggatggaatggggtcagtacctctgaagaagtgcagcaaaaagaggggccatttgtgagcaagagggcaggagcagtggtgatggcctctctccactgatctgctcctgtgccaccaaatagggtacccacctggctgggcaggatatgggtggtgttaaaagtcacagaggctgcagggtgggggtagggtgtgtggggaagggtctgcttgggtttccatatccagtaggggggtttcctggaagttaaaatccatacaagcgaactgctggctgattgggctggtcaaggcagtgaaactcctgcaatcacggcgtgtggcttgggcaccacgggaggccattcaggcccagtgtccaccaccctggacacagggcgaagtggctggtgggggctgcttgcgtgttctattgtggtggcatagacatcacctaaaatgtaccacgttcaccatttttaagtgtgcggcccaggggcagaagcacattcatggtgctgtgcagccatcaccaccatccagccgcagaacttgttcgtcttcccaaactgaagctctggccccgttcaaccccaactccccagcccccagcccatggcacccacccttccactgtccgtcccctcagatttcacagctctcctatgaggccctcacaggagtggaatcctacagtgttggcctctctgtgactggctccttctactgagtccaacgtcctcaagggtcagccatgttgaagcccgtctcagaatggccttactttgtaaggctgagtcctattctatggcctggatgggccacatggtgtttatccagctgcctatccatggacattgggttgcatccaccttttggctattgtgagtaatgttgctatgaacttgagtggacaaatacgtttgtgtccctgctttcaattctttggggcctaccccagcagtggggtgggtgggtcctatgggaattctactgctttccacagtggctgcaccgtcttccattctatggcggtgcttgtttgaatgagaattctgggccagccctggagcctctgaaggcaggcaaatgtgtggtctcgagcttgactagacacccagatcccccaggggttggggtgctttatagcgttctggtcctcccgcttctgaatgggaagctctggacccaagactctgtattcgtgaagttccctgagtggggaggggtgcccacccaggtctggcatgggctgccgtagattagagtagagcgctgggccacctaggggccaggagtgctgcagaagtgcatccacccaaaggcgcaggctgaatcgggcaacctcctgggctcctgccacctccagggtgtttctgtgggttccagaatcctccttgtctggacccttgttaacgaggacttccaatgcctgtgtctttctgcggcacccggcgccggacaggcggttgctttggctttgcacgcagctgccagtgggtccccaaggtggcccctccggggctgccctgcagggcagagcttcaggcaggtgggtgcatgcaggagtggggagggggcgccatggtgatggctattgtttttgcccaaagctgttccaggcatgagagccacttgtcatgtgtacagattgtaccaggaacagggggaggaaggaacagagcactgggggccggtggggggcagagggggagcctgtccctttaaatctgttttctcgggttttatttccttctcttttcccatcctcctccctccaccagcacaagtggagccgtgagggcccaggagctgcagcgacggtgcctctgaaatattaatgaggctgttctctgcctcagctccttccctcccccttccctggctgcatgcaggccttgtccttggaaccctcctttcccctcccaggtggtcgccaaggtgcgtcaagcagaggggagggggcaggggcgggcaggaaggagagggcctggcgcaagggcaggaagatgtggggaatcagggataaaaggggtctcccaggtgcacaccagccaccagcatctcgacctgcctaggatcatgccaggcccaggagagggcagggtggctgccagactgggcgccctccttccgtgccctctccccacctgctccccagctggtctaggggcccaccccgggcctgacctacgaggcctgggccacacctctcgctgttgccttggcttgcttttcctctctgggttctgccgggcctggcctgtgttctaggagcctggaggtggagagagatgggggactattgttttaaggaatccccgtagtgagtcacgtcgctgagtgatgggcccttctgaaaggcgggcccttgcttggtgggtctgtagggagcaggtgacggacagtctgccttcaggagggcccacggtggagggcatgtgcccaggtaggcccccaggcgtccacctcctgccctctgcccctgagttctgcttccttcttgcttcggggccacggcatcctgggcctggctctggcttccagatggtctgaatgcccaggagccgcatgttctcatcactgagggtccagtgactagggagtgactcgggagctgggacttcctggcagtacatgccccatcatccctgtggggatatatgtccacgcagaccccagaaactgaaggggtgctcgactggggtgcagtggggctgttttcaggaaagagaatggcgtgaatcccgatgcgtgcatcacctgagatctggaggacggtggtgggatctcgccctccatctgttctctcctccataaaggcggagcaggtggccgagtggaatgcagcctgggcctgctggggaggctttcaggggtgtcatcagagcgtcccagcaagggcggccatgacccacctcaagtcacatggaaggcagggctgggagaaccagggcaaaagcaggaggcttcctgagcctcagtttccccctctgtaaggcagggagagttctcctggccctcgtagggtgtttccaagggtgcagtgaaagaaacatgtctgtcaagagctggcatgcagatgtgggctcaaaactcagtgtgtgccatggggtcctgagaggggccccatgggagcgggggtgccccctacttagaaagtgccgagccttctggagcatgctgggctgcccagggcctggaggaagtccatgggggactaagctggaggtgccagcagagcccccaaagccagggagggacaacataggggaaagaggacccctgggtctctggtcaggtgggtttgagtcactgggtggggagtaggcactctgagcctagttgggaggtgagggtctctgggccctgctgaagagaagagtccagaaggcggttgagtaatgggcctggacttgggccatcccctccagcagcccctggaggcagcagccagggacccccctggctgtctcccaccacgaggccggccagtctgtgcggggatggtgcaaatgccggaaggtgcgaggccccctctgtggaggttctcatttcaatgaagccaattaaggtcagaaagatgaaagagcacagaaatggtatgttccctgcccttttggtgcctacagaccattctcggcagccagcccaggccggaaactctgtcaggcctgcagaactgataggcctagtcacttcggttcttggccatctcggcgatggctgctgtctttattgggcctcagggaggccaccgcccaggcttatatagaacccagaaaagcaaagtatatgccatttggtctgcacagcagccaacagtcgctctaaatgggccttactctaactgatggatcctgtctgccctatagcctgttgcattcatgaagacagtgagggttagcagagcaccccgaccccaccctgtcctccaggatggagactccacctcccaggactccaagttcctcccctgtgggccaggcccccattcactcattcctccaggcccccggccacatgcgggactgaccacgcggtagacttcctgccgactccataccacgtgtctcaaagagcttagggcccagctggtgggagacaagctcacagatcatcgcagcgccaagcagagtgaaataggaatgggtcgcgggattatagactcaggcgcaatcagttttggctggggaactggcagagactcctggagaatgttccacttgaattgtgactaagaggattcatcggaggtcagcaggtggagctggaacagagggcgtgcggtcggggctcagagctggcagggctgtgtggctggggtgggagtggggctgggaagtgctcagaaggaatctggccttttgcttgatggggatgggagactgaaacaggggctcgctggagtgatggtgcctgaaccaggaaagtggtgactcacagcagggtcatgaccagttgctggactagagagagacctaagaggtggtccacaggacgtggagcttgcttgctgaggggtggggatcctgcagtggggagggccagcagggccagccgaggagaaggaagttggccccgggaccatggcagaggggaggactgcctccttgcccactgccctccccatgagtcactgtgggtccagtcagacacagccatggctgcaccagtcaggagcagctgtacgacctggtatggttctgtctgggccaccgctgtggggtcaggggcagggaccgggtgggggaggacagagctggccttgggtatgccatggtcagaggagggaggatgagcacatgccaggggagggccaccaggcctcggtgaccgtgccacgaggaacccctgctctgaggaacaagcatttctgtcatggccgtgtgccacccaagagcctaccacacaagccattcactctgtcacccgctgggggcacagagcctgaacctgacagtggcacaaagttgctacatggtgggattgttgaggcatgaggtgactggagctcaggaaggcagggagaaggcgccctggcaggtgcaccgtcacaagcaaaggtcctggggtggggaggggaggctgtctcgagaagacgaggagtccaggtgagagccgaaagctgccattgctgccttgaggggtcagaagtgggacacccagctgtcctctggctctgccacttccccaagccagcctcagtttcccgcatcagaaaagcaagggcaattcgtccacacagcacccccagaaggagcccgcctcacctgggacagcttcgcttgctgtcctggccccctctcctcagctttcactccttctagtcttttccccccaatgcctgtccccagacgccttgcctcacctttgccccagctgcaaccccacagctcttggccctcgggcctgctgttctccctgtcccagctagagagggacggggttagttgaaacttgttgagcacctgtcccagcacatcaagccagtgccaggcatgtagtagctgctcggtgaatatgtgtcaggtgaccaactgcaagacagggcggggagaggtggggagagaggacggcacaggcacatggccatcattttgtccccacatctcccagaagtgaaggctgcttcatgtgcaatgtgtcgcgagagtaaacgcgcaggtgcccacgcttttcaaacatgggtcactgtggatggatgtttcgtgaagtatccaccagggcctctcctgagaataaggccatggacttggccgtgtctgctttggctgcctgagggctttctcccctttcttcagggctctgggccactcgtttccaacggatgcttctgagccaggagcttccccagagacgggggttcagggccctgctgagctgccaggagggctcttggctgatgtcaaggccaggccatgtgcactgaggccatttcagttccatgaggatgtgacaggcttagctcgggccgggaaggagcggagagagaggagctgcagtgggccccgccaaacactgtgatggctgcagaaggggcagcctgggccctagcggatccttgggtaaggtgacggggacagggagagggatgacaactttgcgatgctcggcagagtggggccagggccgtggcctggatgctttcagtgtggggagactttggctccttactttgtcatctggagggaagaagagcgtggaggggagtgggtggcaccatgctgtgggctgggacgttggcagactcaccagcgacctgtggctgctttggctttctcctgtgtaccctctcctcctctcctcctcagccactccctttatcccctccctcttctccctccctccatccccctttccctccctctctttgcctttccgtcttgtccctctctcccctcccctgtttcccacccttcctccgggcctcctcctttcctcgcccctggccccccaggtactctcagggccacagaaaccgtgagccactaaggccacaccagaagaccaccagggactcatggcatgcccgctgcacagggcgcatcttaaccaggcaagagcagggagtgaaccggagtgaacaagcgcaggactggtggtggggcgcgggcaagaccagccactgatcagtcccagcacgctgccctcacttcagcgtgggttcccgaatggatctggggggcagtgacagcctctgcctccagctagctagtgttaaccactgcagggtcctggcaggaggcatcgacacttcccctcccccacctgggcaagccctccaggttctgggcacccatggtgggcaggacccgggagtggcctggctggtggggcctggcagagcatgagggccactggcccagcctgggaggtgatttctgcacttcgagggtcatggcacagactgagtgaagatttgccgagaatattctggaagatgggacctcagttttgtctcaaccactcccctggcttcttctcgcctccatctccccaggtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggtaagtccctctcaggctgcatgccacccagccctgctcccagccttcagaggagcgacctgaaggcatccttagccccaaggctggccagggtcaagggccacctgtgcccctcctctcagccatttcccttgagggggagatgccctgggtaacctgacctgaccccctcatctccacacctccacaatcaggagttctccgctctatagagcgagactggggagggggagatgggaacttcatgggacacacacacaggcggaatgggccccaaacagaaacccttccgaggaacagggcagggcagggcagggaggaggaagacagccccatctgtatatttggggatttccggtgtgctcaaccctgtgttcacttaagggggatcagaacaggaggaagggatgcagggtgcaagccttcggagtttcgggtgaccggggcctctcctgggaagagagaggatggcctggggatggcacaagccatttgggtctggcaggaaggggtgaccgaagctgggtcacgggaggcccagagtgctgatcagaggtggcactgactggccacaggctgtcccaaagaggcacaagcccagggtagtgtcggtctcactgctgagggaggctctagaaagcccggtgagcactgtctagaaagatctggggcggaggcctgactatccctgtgggaggcaatgttccacccggccttgtgaggcctgcccagccctggttgctgcggtctgccatgaagcggggacccccaggagccaggcccagccccagattccaggagccacagcattctctggcgctgcgtgcctggcagggctgctggggctatcccagcctagtgccaggcctgttccccagccagtgcgggctgatttgatctgctgcccatctgggcaacgcctgggcccacccatctcctctgctcccagccgtgaggctccttggcacctccagcctcccgctctgccctcaccctcaacccagagactgttctcttgtggctccggcctcggccccgtctgtctgcaggtggcactcaggctgcagggaggagtgaagatggaggaggggggctgcgggccaggtcaggaactccagggtctgcctgggtctccctagctttgtgccctggagctgatgcgcccgtgacacccggcctcgccgccgcacacgccctcacggtgcagctgctgctggggctgatgccttggctctgctcccgagcatctcttgccttccctcctccttgcccagcccccgaggaggctgtggagggccatttatccacaagagctctggcctctcccagatcaaaggaagcagatgggcctcagctgtctgctcttcccctgtctgccaggccttgttaaatatttaaaatgtcaaggcccctgggaacctgcccgattctgccatggagctcaggagctcttgcgtgcctgtggaggcaggggcacggagaagggcaggtgcacaggtgggtggcttggcctctgacgggcttccaagcacctgggtccccaaggccacagtgcagggagccggccaggcctggatctgctgcccacagaatgagcagcagaggaccggcccctcccctcttcaaccctcaaggtcctcgggctggagctgtcgggcttgagctgtctgggtgccaggagcgggtgactcgctccccgcatcccctagcccggccgtgcacccggaccctggtgctcagacctgcctgcccctcagtcctcctcagacacaagggcctgagccacgggggcagctggctttgttgtgccccaagccccatgccaatcccctgacaaggtgggcagacgtggggctgcccaggaggcaggcactcccccgtggggcaggtgctttatggcgcatagtgcattgcgggaaggggactttatcttctggcggtacactcatcaatccactgccctccctgtcttgggagcactccaagaggattccagaacccatcctggaaaccgcgctgctgttgtcaggaaacctgggtctcaggctgaactcagaggtgggttcgcccgggaacctggccccgcccagtgcccctctgggctccacaggcagttctggaaaggagggggcggattcgctgggagccgacacgagatgctcctaatccaattctgatggcatctggcctctgctccgggcaggccgcccatctgtgtccatgccaaccggccagcccctgcccccatgccctggacctggactgccctcgggcctgctggggaagcatgtgctcagagccagaggggccgcagctgtgttcctcctccccgtcaatgggtgctgcagtggggcagccgtcgggaccccgagcccacaggaaggctaaggagaaacgagcaaggctacagctgcaagggcaggtcaaggccaagggagaggctggcgagggcgagggagctcctggggaatgggccaggggtcccggctgctctcagggacaaactgggcatgtgaggaggggcaggcaggagagagactcgcatggaggctccaggctaagggcagtggagaccccaggtgtctggggagccctcccctgctcctctccctccgcagaagccccacggttagcacgtgcttcttcttaagtcacttggggggtcttgtactccctagtactgtccccacctggcttagctcctgtaattccaggagacagtcccagtccagagcgaggtgcacacccctcagttgggtccctggtccccagccccctccccaccacccaggagctgaggtcgtgcgttaaccccaggctcccgattggggcaggctcgggcctcagcaagaggcctttggctcctgaagaaacctgagccaggggcagagaggcacggacagctgcggctcttctgggtggggaggacgccatgtggccgtcgcctagctggggtgaatgagccacggttgtgcgggcggcagcttctgttccactgcggccagggctacccctgcccctcctcagaagccccaaggttagcatgcgcctgttctccagtcatctggagggtcttgtgtgccttcccagacccactgtgagtgccccatgggctggggctgggctctctggtcatcccgtccctgcagcagatggcaggcgtgagcccagctgcccagggctgggagctgcaagctgctgtctgtccaccaggtgtcagtgtgggtctggtcacggccgcgacagcactgggcgccgggtgagcgcccgggagggctcctcgggatcagccggggctgagaatcctggggccaagggtggggccagaggagggtgtcatcccacatgcctgccccggtagaaggtggctgagtgggtgtccaggcccggatgccagtcacgcacgtaagcttccagtaccttcaggccaaggaagactgagaagtaagcgtcctcaaggatgacaagtgacagaattggatagggacaggtggctctgattgtgaaggcaaagccaatttgggggcttctgagtggctttgggtgtcattcaagtcgccatgtagacaagctgtgagccctggctgagggatcaaagttggtgctggagttgcattagaaccaaggctgctgggtcctgagggccctgtgctcaccgggtcctgtcgggcagcgtaggttctgtcctgacctgggccacaggccagagctctgactcatggttacagggccctctccacctccggcctcagtggccttgtctgcaccctgcagagagcagctgatgagcagcccagggtgggcagtgtctccccgacccctgcgaggccatgcagcccagaaaaggcttgaagacttcccagtcccctccctcagcaccgtgactccggtttggcttctccccgcctgttccccaccaggaacccactcccattcccgtgcctctctctctcctcgcgtgacaccgttcttcttctttgggtctctggacccaagaacttgcatctcccattagctctcatgctccctccccactgcttcttccccgagaaacttctggaaagtaagcctccgctccctgttgccagcagccacaggcaccctggagactgctgattcctcggcactggccgtgctcatgccccaatccctcgggccctgcccaccctctttgcaggctgtccctgcccccacaggttgggctgtgtgacactgccagtctttgggaccggctggccccatcttacagagctggggaggggggtgttggtgacaagcctgctcagggaattcataggctgggagctagagaggtgtttcctgacaggcacagagccctggcctagtctttggcatctggtgccatcccagcctcccctgattggtggccctccccatgtctccactaaagtcccctggacactcgctctcctccccaggggaccattggctatactcttctgtcctgtctcctagcaacccttgttgacctggacataccctgctgggtcccctctgtgcccccttgttgggtcctgtcccctgccttccagtgccccctcagcggtagtgtggaggtggccaggaaagcacagggacctgggacccgctggagtccaggagcctcctggcctgttttgtcatctgtgtgtcaggaggaggatggctagggactccccatgacagcagccagagagccgcatgctcactcccacgtgcacacccccagcagtctgcagaaaggctcctgtctagagggagagccaggcgctggccagacggccccagagggctgctgccaccccaggagcagtcagtcagggccacataggaggcctgggacacacaaggccgacccgtcccatcccatcctccccttctgtgcttccggggcaccatgcaggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaaggtaaggcccgggggcctgggctggaaggaggaagaggaatggggcttgagatgagggacggtcacaggatggtgatgtctcctccactgcttcccttctgtcctccgcacagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggtgagtgccctggtcttcacccaccctgtcaaggaagctcggctcctgcttctggggagggtgagccagaggagacccccagcacaggttctccccggtggcctgcgtgtcgtcacctgccttaggaggcgggaggtggcgggggtgggggaggtgggggaacacggggcagggcagagtggtttcagacacagcaggcccccgaagaatcaactgtccccacagcctccacggcgggctttcccccctacaaaggatgcaaatgtcctcgttccccagaaggaggagggctcctgagtccctttcccaggcggcccatggcacctgacgggacctcccctggggcagccgggaggaggcggtggggagaaaggcctctgcttcccggtgctctaggcgacctgctgccagccgacggcgtgctcatccaggccaatgacctcaagatcgacgagagctccctgacgggcgagtctgaccacgtgcgcaagtcagctgacaaagatcccatgctgctctcaggtgagggccaccctccgggccagcctggcaccaaggggcgtcagcagccgtgtggcccagcatcctgtccaggctgcctgctgggctcagcctccacctccaccagggccttccagcataaccttcaggttgggaatctgaagactccgcccgtcttgaggcctgatggtggcagctccagccacagggcgaggaagctggccctccaggcccgggagagtgctttgtgtcctgaatgggaagccccaagcggagaggcttgcaggggccagcacagcgctgtgcttctctcaatccagaccctcgacaatatccagtgggggtagtgttccctttccagaaggtttcagcatagtccggtgtttatcccagttggaaacgtagtgtgaaacgggacaggaaggctggaggccctaggtgggccctgtgggcctcggggtctcctccaagccagggaggaggcttcagcctagttttaaggtggacaccgcgtccctgcttccgggagaccctgggagacaggttgtgggcgctgaatgtgtctcccactgggtgatacaaattcctgtctcagtctctgtgttgctgttccaggcactcatgtcatggaaggttctggaagaatggtggtgaccgccgttggcgtgaattcccagacaggcatcatcttcacgctgcttggagctggcggagaggaggaagagaagaaagataagaaaggtagcgcagcagtgccgccagtccctggtgctggtggcggctccttccacgctgcccattctttctttgcgggccggtgccactgggggctcagggagagccagcccaagtgggtgggaggccgggccctctcttttgattctccgtggagactcctcttctgaggatatcccccctgagagccggcaggccaagggcccctccagtgccgtggacggggagtttccctgagaccaccatccccaaaggctccgggatcccatacctacctggacaggaatggcgttagagggacaggagctacggggagcctcatgcttaccctcagggcccgtgcccagtaaggtgccgaggatcccaggccagcgtgggaggcagccagggaggtgggggtcagaggtcagaggaggctgggacaggtgagggccgggcagcccaactgtgggtggtggccctgccctggggcttacaaagctaggcaagcccgagccaggagggcccattcctcgtcctgtggctggagctgccaccatcaggccctgcagcgggcggagtcctcagaccttctaacctgagtactattcagggaggccctgatggacaagattgaatggctgccacagccccttctggctgggcagccttgctctggcctggacttgccttctggcctctcctgcagccaaaacatggtagggagccacacccgcatgggaaagctctgcttcctgccagtgacctccagccagggccctggggccagtgcgcggggtgtgggggcgtgggggcgtggggcgggcagtcagggcccggggaaaaggtcagccctgagcccaaagctccctggaggcagcaaaggagtagctggatgaccctctgtggcctagaagcttcgacgagccctgcctcctggcagcctgggcctgtgtctccctgcaccggctcttctttgtggcaccaagtcctgtagggctcagtgcagtgtctcaccccagtgagtgccctgggggtgcgcaggcagatgggcagccctgggcctcgtctgggctgggctggagtccctaggcctctgtcctgggaagcccagctgcccctgcctgggctgcctcctcatgtcttgcacacaatggccctctcccatcgtccacgggaacccacgctcctctggagtctccagccgcccttctcaggctgctcaccttctctgtaccttaaatgagtgtgtccttcctaactgttccaggcctctcctttcttttttaaattgacaagaccattcagcccctcccaggccccacctggccctcctctccagcaccctcaggctgtcctacttaggagtcagagctagagggcttcctggaggaagagaaccctgagggggccctggagggagagcagcagctggccagctgggtagagggtaccagcaagaccagggggctccctgctcgccctccccgtctctcccgccccatccccattgtttggcgcagcctgccaggtacacgcttaggatacttgccttctacctgcacccaaccccctatttcttgtctcttgaccttgactcctatgcacctttctccaagtgtgcttctcctcctcaccttccccccactcctgtctcttctggcggggcccagccctcctcttccagcaatgctcatcccagacttccccctgcctccctcctccagaggcctcccagggcctgtgtgcaggctgggtccagagtccatgcttccttcgggcccccacggccccaaggctctgccatctcccctgctgtgctgtgcggtcatcgcactgccatcttgtgtccgtgggggtctcccctccctgcaagaagggccctctgtgcccacaggaaccctgggcggagagggcctgatcaatgccccacccctggctgagtagggtcggggggggggccctccctgctccctggggaccccggatcccaaccccaactgcctgggagtgcagatgtggcccccaggaagctcctctaactgcagctctcagaaggggtgactgtgcccaccacctgagcccctggatagggccacttggggcccagcctggccttgcagggctgctgtgtgccggggctcaggctggcactcctgtgctgcagccctgggttgaccaatgacctgaaagcgccccgcagagtcctagcgtctcattcctttgtccctttaaaacacacactggggccaggcacagtggctcatgcctgtaatcccaacactttgagaggtcaaggcaggtgaatcacttgaggtcaggagttggagaccagcctggccaacatggcgaaaccccgtctctattaaaagtacaaaaattaactgggcgtggtggtgtacacctgtagtcccagctacttgggaggctgaggcaggaggatcgcttaaacctgggaggtggaggttgcagtgctcaaacacacacacactgagctaactgctggacgtgactgcagggaaaaccaatccctaggcaagggcagctgggtgctgtctgcctggcttccaggggttaggagccatctaagtgaaccccttgagctggtttgcagggagcagacgtcccgacttggggaggttccagcttccgggaacctcccactgccagccatgtgtgacccagggcccttccaaggctggctttaggggttcactgtagggctgagcttaaggccgaaggggagccctgggcagaggtctggctcaggaatgccagtgttcatggtgaccgtgtgctgggaggtggtgacggggtgagcctggagaggacggggcatgaagaaggccaccagcaatcaggcccctcctccccaccccctctgccacgcggcccccaggctggtgtcctcaagccttcgtgtctgtcatccctcttccattgtaggcaagcagcaggatggggccatggagagtagccagaccaaaggtaacgggcgccgctgcttgggcacaacaagcttggagccctgggggtggggctggtggagggcacagtgttgggggaggttcacctgcctcggtggcaggagcaacacttggagaccaggtgagtgggctggctgcacagtcccgtcccagtgcagagggaggagagagcacacccctggggctgctcagggcatcctggccacagacactgctggcagctcagcccagccacctagaggagaccttagcccagcatgggcataaggatcacctgtgagtgggcgccccgagtccactctggccagatgagaaaactgaggcccagaagggctgactcacctgaagctctgggtcccagtcagtgtgtttcccaggccagcttcctttcagccaagcctgaggacctgggagacagagtggtcggctgagggccagaggcccggctctcctctcagccccggacagctggcaggtgccgacaccctggggccagcatgagcctggctgtgagacgcaggaagcaggagaaggggtgggaggagcggggaggaggccagccgtggcccacggaggacaggagatgtcggccaatgcagcagccagctctaggtgctggagtccatggggaacaaggcaggtcctgaccctcaggaaggtcacaggcagagatgacccaggcaacgccctgtgcggagctgggtttgggagggcagtggggggacagcccgatggctgcagccctgggttgaggaggtggcagcaggtggggcacaaagctggaggggcccagctgggtggggcaattgtgtcctgacgccactgggaagaggagccgtggcgaatggccttgggctggcaagtgaggaggagcaggaggaggcagaggtgatggcggtagtgccaagagccccagtggatcggggaccagagtagtgagggagaaagacgagtctgctctccccaggtcgctgcgtcggtcccggggcagaagagggaggtggggtggccaggattactctgggccgtggagtgggtgcggccagagcttggcagggagggagatgaggaagtgacagaagcagaggagtggggagaggagggagccggagtgggggacacaccaccaccatgtcgagggcagcaaggatgaggagcacaggacccaccagggaagaagggagaggagccgtctgctccaggggagaggcagggagggtgctggagggacagatggagcccgaacaggcgcagggctggctggtgggaggagagtgcatggggcttctgggcctccctaagggaggtaggaggtggctcggacaccagtaagcagatgagtcagctcagggttctggaagattcctcgggccacaggcctctgctctcaggtattatttggggcattccaggaccagtcaccctgtctgtgtgcccaaaagccttgtgctgtgtctgtcctcccttctcccgagagaaccatctctgtcccacctagaacagtgctggagccaccccacccaccccaagagggcctgggcttaggaggcgagagaagggaagctgatagacttggaaataggagagctccactgaatcccgtctcctctctatggtgtggcatgtctttcccccacaaaagccccttataacgccttctccccagccaggcactgaccttggccatggggttcctctgtgtgcagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcaggtagggacagcaggaggtggtgggcccaggccattgactgggcgtggaggatgctgggctcctggagatgagcccaggctgtgtagagcaggtgggaagggatgtggcaggtgatgtgtgggccaggcaggcaagggcacaggccaggccggcagtggccatcagggcctggcgcagcccttccctagtgagcagaagtcccaaaccctcgacgaaagcccgggtcacacactgagccactgcccatgaggtgcccctacccaaggctccaggctctgcccctggcaccctcaaaaggcagctgggggcatgcagggctggtaccccaacttctggggtgcagtgggggattgactcttgctagtcctccccagcggtgcttctcctgccatcagaccacaaagtccactccccaaccccagcagcactccagaagaggccacacagagcccccttgcaaacaggccccagctcacctgctgagccaaacctgggctgtttatcctgaaacgcaaggcaaatctacaaggccttcacaaatgcctccgagaccgtgtccatacctcttcttccctcttcctgtccccctccttccctcacccgtggcaacccctttcgtctcctccccgctctgtggcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaaggtaatcataaaacttacagttgatactgtttacagactcggaaactggggtaagaagtcattgggcgccttggtggcagtataaactggggacgtttgggatagctcaagggaggagaggaggtgccgagcagggacccagggggcagctttgctgatctgtcagctcaggtccctcggcatgagatgggccagaaagcaggcaggcggtgagatacccaggggttcagcatctgcacaatgtgggcagtaggacggaggggctgggaggcagcggggaagcggagaatcagcagagggcccgggacactgggaggcagtgggaggaggtggggggagccaggtgtggggtggtggggtggtggggtggtggggtgggagagctgcagggctggtgggtaactgagagggggctcgggcaggggaggtcccgggtgcgcatcccgcccccaccattggatgaggttgctgatgccttacagcctcgctattggctcagggctgaccaggtgcccagtgggcttagtgccacacgtggagctagctgagcagaacagagtcacgcgatgtttgtgttgacatctctcactcctccaccccaacaagcacctgggccaaatgcccacaccctcgccctttgcagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactagtgagctggggcaggagcgggcgggcagggccgggggcaggagcaggggagggtcctggccagggtgccaggtgagctgttgcaaggtgctcattaggcccccccttgagaacttttgcccatccctggcctcacaggtggctctggctgggaaactgcctgtagctaaggccgaccttcctctgctccctgccgcccacaccctaacaatgtggtgaccacgagggggcagagctggggctccaggggcagcatggagggtggtctcaggcccccagtgcctgctagccctcgtcatcttgcagcctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgagtgagcagcagggaggtgccggggtacgcacggagtttctgattctattgtcgtggtaaaagaggccgaacgtaaaattcaccatttcaaccactttacagtgtacagttgaatggcattaagcacgttcacaatatcatgcaaccgtcaccactacccagttccaaaacacctccatcaacccggaaagaaaccccaggcccatgagcagccctccccacgcccctccccagcctcatgtgcttcctgtctgtatggatttgcctgtctggacatttcctatcaagggactcatacactgtgtggccttttgtgtctggcttctttccttagtgtaaagtttttccgtttccctcagatattagaccttcctttctttttttgttttgttttgttttttccctcaagccatcctcctacgtcagtgtcccccgtagctgggattacatgtgcatgccaccacgcccagcgaattttcaaattttttgtagagctggggtctcctcatgttgcccagggtggtcttgaagtcttgggctcaagcgatccacccacccggcctccctaagtgctaggattacaggaatgagccactgccaccagcccgaacttccattctttctaaggctgagtaatatccattgtatgctaaagagcattgtgttggtccatccatcccttcatctgtctaccagcacgtctaccagcacgtgagtcgtttccaccttttggctgtcacgagtcacgctgctgtgaatattcacgtacaagtttttgtttgaacccatgttttcaattcttttgcgtggacatctaggagaggaatggctgggtcgtggtgtccacgaaactgttttccacaggggcagcaccgtttcacattcccaccagcgacataggagggttccaccttctccccatcttcaacagcacttattttctggtgtgacaatgctgatgggggccatccttgtgggtgtgaggcaatatctcctggtggttttgatctgtgtttccttgatgactaacaacgctgagcctcttttgctgtgctgactggccatttgcctgtcttccttggggaaatgtctgtcctagccctttgctcattgctgagttgggttgtttgtctttttattgttgggctgtaacattttttctgtattctggatcctagatccttatcagctatgcgatttctacacattctgtcccattctgtggcctgtcttcactctcttgatagtgtccttaggtgcacaaatgttttaaatcgtgatgacgtccagttgatctattttcttgttgttgcttagagatgatgaaaattttcttagagatgatgaaaattttctggaattggagactggtgatggtcgtgcagctctgtgactatactaaaaaccatcgaattatctactttaaatgggtggactgtgtggtgcgtgaattatatcccaataaagctattagaacaaagtaagggagagtgcacagcgtcacctccaaatgccctggcttccccactcccactcagccttcccggactccacacccttggccttggcgtctctgtccacaagtcacctcgctcctcatgactgccgtcccagggccctcagggcaaggtcctctgcaggacgcccagggctccccaaaggcccaggcccacgctccttcctgtgttctgcggactggaccaccaagtgcaccctgcctggccgccccacccacagcgctctcccagaactctgccaggtgcagcgctcactgccagggccaggaccacctcctccctggagccatccctgctggtgtgggggcctcagccctctttctgtgcttcttttttggtgggcactgagggacactgaggcactgcggacaaaaggcccagcccagcttcactcccccttactcccatgcctcagtttccctggtggcatggagatcacagaatacttatctctggggaggggtgtgagggttccgtgggtgaatccacatccataggaggctctccgtccacacagcttctgttatgatcatttccttcgtcaccagcctcccatgcagtggcagcacctggcactcacagccccactggcttcttccaccatgcccgcctctgtgaccctcggctcctttgctccctcctctccccacctgaatcctcccaagtcctgtcccttttgagaagctcctggagtcatgagcgctctactgaggctgtggctgcctggacgtggttatagcgattgtccacagacttcagtttttgcccaggttccacccgcttgccctatgaagtctgtggtggagctgccatgagccacatgctcctgcctccctcccggtctctcagcctgcagcagtgcatgagcgtcctggtgccctcaagcaacagaaatggattctcccccagttctggaggccggaagtccaaaagcagggcgtgggcagggccgaagcgcctccaaagcatctcagagaggatgcatcctgcatcctccagcttctggtggtggctgccagtcctcgcgttcctcagcttgcagctgaccctctctaatctctgcctgttgtcacacgcccttctccctgtgtgtctgtgttctcacacggggcactcctctctgataaggaccccagtccttgactaagcccccaatccagtgtgaccagcgctgttccttgttgttctctccccacctccacctcatctctgcccaccccctgcctaggtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtagccaccaccttctctgtgagctgccctggtaactgtgccctctgcccgagcttgtccggactggtaggggcggccttccttcacacacagctgctgcggtccctccgtagtacacttgagccccgtcctgggtgctctcaccctgacacccgcacaaaggctctgtcctgcctgctggaaagcccttcccgcttgacctatgggcccagctcaggctccaccttctaccaggtgagaaggtggcagtggcggagagaccgtcgacatttgggatctgatccacccaggaccgatggactggaggtggtgctgaagcctgaggggacacaggtttggggcacagggtgggcgtttattggttgagggtttggctggggctactctacggtcaggacgtcctgtggcgagctcacagcaaaggtcctggcgggaaagggagcccagaagcatatccccatatggacgatgccaccaggggagtccagatgaggggacctcgagggccgcgtggcagatgccatggccttgacactgggaagtcactttgttgttgaaagatcccagaccctggagagtgtggaggatggccggccccggagggagaatgcaaggcatggggtgcccctctgtctccccagggcctctgcatggcacccacctgtgtcacaagcagggccactgtgaccctgacaacttgtctttgtaggagccaccctgggggtgcaggtgcaacctgggaggagaagcttctgggctctccttcgggagacaggcattcatgtattggatcatgtagcaaaaacactcaattcaaagacagtgcgtctaaacgccagccatggctcatgtcaacagagcagccccgtgccccgaggagaacatggtcactgcgcccagagagggagcacctcgagcttgccctgggagaaaatgggtggtagcggaggacaggggacagaagtccagcgagggaaatgggccccgcaaaggcgggcagcggcatgagtcccgggccccactgagcctgggagagcagaaggagagggtgctggtgaggcgaagcaaggccacacttggggacaggagccatcgagtccctctgttggaccagggagcaactgaagcacagagcagaggaaggaatcttgccagaggggcctggggaatagggacagctcctttccagcttaagagtggctgagagagagtccaaggggtagaccacagtgacagggccaggctgcggaggctgggcagacccccacaaagactggccagcctggtggtggctgaggaggacgcacagaaggcccagcgaagtcctgggtgccggcaacaggcagtaggacacaagggcctcactgaaaccgccagggtgcttggagatgcggcacggctgcagccagaggagggcccgtgaggctgggccctggggagccataggaagcctgtggctggggtggtattgatgctggagctgggccggccgggggcactggcaacttctccagacacctggctggctgctgtgctgtggggccttggggagaaggcagggagcagggctgagcaggcgaggaaggacagcctggcctggccctttggggccatggggaaggaactgggctacacacactgggcctgaggagggaggaggcctgggttcgcagctgctggttttcaggctcgtcacggccacttggtggcagcagaggggtggcttccagacttttcagggacaggcattcgctggctcaaaggagaattgtcttcttgtggctcgtgatcttgttatccagcaccccaagatcctcagagagtacgaagtgtccccgaggctggcagtgaggccacttagtggtatatgctgcaggaaccattggatcaccctgtcacagcttagagtggggcccccagctgtctccctggcaaagatcacagcccccctgcccatggcctcagggggcgccaggattcagggactcccaggtcaatgtcctcccctggtgtctcccggctgccctacccctggctcccactcctgcgtgtctactccccaccgccgcaggctccccaggcctggcggctcggccacacctaggcttctacacttacccgacggtgctcacaagccccactgcctaggcttgacctcctcattcaggttcccaaactctgaacctggctcctcttctcctctccccctgcccgtctacctcagtggcatcagctgcctgaccctgtctctctgtccccgagcctgaagagccacatacctcttcatttgggaactgtcttccctgtccccccaccactgggacaatgccaccacctcccggccagtctcctggcttcccgctctcaaccccttgcaggctgttcgctttccactcagcactggggaacctctttctctttctccagaatctaatgtgatgcaggtggtccccaacttttaacaattttgtaacttggtgcaaaggtgatgcacattcagcagaaactttacttcgagtcccatgcttttccctttcagtgcaggattcaatgagttacatgagataatcagcactgtattccacaataggctttgtgttcaatgcttttgcccaactgtaggctaacacaagtgttctgagcacgtgaatcggatggctttactctcacctctgctggaccttgggccacctgcagatctgatggaggaaggggtactgcctcaacccaaaatacgtcttgcctcgatggccccgcccacctctcttgtctcttctaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgaggtagcacccggctgtctgccaccccagaccccccttctcctcaccccagccccctgcgtgcccgccttagctctgcagcgtccttgtgcttcccctccccagatagaacaggagcggctggacaaggtgtggcccaagctgagggtgctggcccggtcgtctcccaccgacaagcacacactggtcaaaggtagccgagcccccacacccctttcctggggtggccagcccgaggttgtctgcttcctgacaccaaaagccaggttcccaaacaggtccccagggcctgcctaggaagctgggtccatttgtcccattagcccagagcagcagggcaggggcccatgagggaaccagggttcggggagggctagtgactcactccaagtcacacagtgagtctctagaagcagtgggtctagagccagggacccaggattgtgtccccaggccctaaccagatccctatcctcccaccctggccctgtcactcagtgagatttgcttacttatttggggataggagatgatccaggtgacggggagcacagataattgggacagtcaggacggggtaatcccaaagggttttcacagccaacctacccccatagctccctgggcagggctacacagggttgtggtgacagatggccccagccctgccctgccctgatctgtcttccagggattatcgacagcaccactggtgagcagcggcaggtggtggctgtgacaggggatggcaccaacgatgggccggccctcaagaaggcggacgtgggcttcgccatggtaagccacctggtgcccgcccagctcaccacggcagatggggcctgcatctgtcccatggacattagctttgtaccaggaagtgggagccagtgtcggggcaggttacagagtgcctgaaggttctttctttcacatcctggccacttgggcctgcgtgggctctgccagtcgggggacatgtggttaaaggcatctgctgtgatgcccaaggtgacagtgggccccagacatactgtggagaggaaggggaatggggggtgggggctcatcactgatggcattgcccacccccgtcctctctaaatggactctcagccccagatgaggtgagcagagtccccagatgtgctcttcctctgcacttccttcctgttgctcacccactgagcagggtagccctgcagacgccacccacatggctggttgcggcccctcagtggccccacagccactgaacgcagcaacctggtgagcccctctccctgccctaccgaaaaggagtgtcacccagggaacccagcccagtccttcccagcacccgtagcccagaagggagctccagcccaagcttcgagaggtggcagctctcacggggccaggcttggggcagaggagaggactgcgcagcttggcacagctgcagctgcgcctccatgggacagggactcctctgcaaggagccgccccgcccagggtgtccccatgcaggacttcccagggctccttagccagcaagcctctctggagtgctaagaacagaccacgctgcttggtggccacgtggtggcagctgggctttatgtgtaaagctgtgttgatgccatgtcatcagcaccctctgtgtttatgagcaaagcccccccccccaccgtgacatgtgacaacttactgtttgtagtacaagaatgtgttgcattaaaaaaaagcaacaaaaaacagtgctgttcttggctttggggggcggggtgggatgttattcagaaggggagagcagggagccagcccaggcgggccaggtgatcaaggggggctggggaaggggcccccacaaacactctgtgtgagtgtgtgtgtcacccccccagggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggtgggtactgggggctgccatgccccagctaggacacctgggctcaggcctgagggccagattgtgagagtgagggttttgttttctttgctgcagattattttaattgagatcaaattcatatgccaaaaattcaccattttcaagtacataattcagcactcgaatttgtaggacattcaccacgttgtgcaaccattggctctatctagttccagaagattgtcatcatcttaaaaagaaaccctgtgctcttgagcagtcatttccccatttctcccccaaacatcccagcccccggcaaccactcacaggcttcctgggtctatggatttgcctgttccggacatttcattcctatgggatcaaataatatgtggcctcttgtgtctggcatctcgcttagcaccgtgttttcaggctcacacacaccgtagcatagggcaggactttctgccttttcatggcctcataacactccacggcacagactgccacattatgtatgtctgccctgatggacacatggctcgttcccactttttggctcttgtgaatggtgctgccaggagcatctgtgtatgagtttctgcgtgggctatgcgtcccatgggaaccctttctcaacagtcccattttccccattggtgagtgtccagattttcttcaccccgccttagaaagggggtgtttaaattgcctgctgatcaacttggtcttttcaaaacaattttttaaattgagataaaaaatcacataacaaacttcaacagaaccattttaaccttttgaaagtacataactccgaggtttatatccctccactgtctattcccagaacattctcatcaccccaaaaggacacccagaccccgtgagcagtcactctctactccccaaaccccagcccctggcacccactcatctgctttctctctctatggatttgtcagttctggaagtttcctatgaatggaatcagacagtacgtggccttgtgtgtctggcttctgtgaggctgatttttaacgaacaactcagaggagctgagaaggaaggtccagttcagagtttctgcctcctcctgcccctgaggtgcaggagacaaggagagcagccctcactctgttgccccaaatggcagaccccatcgtcgggctgttttgtggtctggggtttttcacctcctgcgagggatttggagcacacctgctgccaggtgagagaagggaggcgggcacgtgacagcccaaagaaaacgccccactagcgtaaaggcgatgtagggatggagatgtctgttttcatgggcatgaaatcctggtgatgtggaccccatgaggagcccccaggagctactgggtttccacccccaaccttcccgggcaggcggcccatggaaaggtgactgcctcctctccataggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggtaggctggccaggggcacccgggaggacttcaggacactgttgccaccacctcgggctcagattctgtctggtgtgtctccacctgtgtctccgcacccagtacggggtgggacgctgcacttcctgactggacagcacacaggggaaggagcagatgggccaggctagcaaccctgcagccaggcctgctggtggcctacagctctttcgcaagcctctcctcccaggccgctgagcagctgagaaacagttcatgtcttgacatcctgcccacggctgtgtagctgtgtagagtaggcagcttctacccagccccagagtggccacggtaaccctaggaacagaacagcccacatttaccctgtgaagattgctcctgtggagtgactggggtgccgtgctggaagctgtgaggtgggtggggggtgaccgcaagagagaggaagaggaggagggcgtccgaggaaagccagccttaagaacttcccttcttaatctcttccttcctgccctcaggctcagggtctggcccctggcccagaggggtctcaggactctggttggttgagcctggggtgggtgtggctgccttgggccttggccgtgagctggaagtggccatcccctgggacaagggacccatctcgggagctacacaccgaagtctcgctcctgagtaatgcgtcatgcgctgagatgactgtgcctgagtggggaatgttgctttccaggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcaggtaggaggggcggctccactcttggcctctgccacttgcaaaaagtggaggtggtgggcttcaagacccctcgtccacccctagtactggcctccccacctccactcccagaaggagccccaccccacctggctttcctgtagcccccgtcctctctgcatgtcggagagggccttcttcatcttccaaacattgccggccttgccctgggtgagcgcgctggcttccagaagggtttcgtgagccctcatcggaacgaagttttctcacagatgctggaaggagtcctccctggctccctctaggtctgccattcccatttctagcacttaattccttggcatgaggctgccataactccagaagtttcttttggagatgacctctgtgcccagtgctgacacactaacctctgcttcccacagtgctgtggacaggctggtcagccccactgtctaggaggggctaagtgttctaaaatatagtgtatttgtagaaaaattgaggtatagtaaggccaaaaggtcaagagacagttgccactgaaagacagtttatgactcagagaccccaagaggaggacacatgccacaccataggggcccacatgggagagcgccaggcaggaggtggggtgtgagagctgtggacaagagcctttgctgtggttccctcggggaggagcaggtgaggcagggctggtaggctcaggactggctaggttgcgtcattgcagcggttccagggcatacgggtgctccctggctgtctggtacctggtcctgggtaatgagtgcaaggggatagtggcccggaatgtgacagtccaacagaggacggggtcagtttgcatttggacagcttgcccctgcaaattggatgcctcccgaggaggcaggaggccaagacaaggtgacctcggcaggttctagggtcctccagaatgaggcatgtccagcgtgcccgcagggtgggtgtcacagcctccgtcttgctgaaaataggagcatggtcagtggagctgggccccactccgaggctggagtcagtaggtgcctggcacccaggggcgctgggggccatgcactgctctgtcatcacgcccccggccttgtggtcctctcgcaaggagcagcccgtgcaactgggggaaccaaccagggtggctgggtcttcaaggggttggaggacaagggtggctcaggagccgcggctggacctgcctctctcccacttgcccttcgcagattgtcatcgtccagtttggcgggaagcccttcagctgctccccactatccacagaacagtggctctggtgcctgtttgttggtgttggggagctggtctggggacaggtgagtgacagccctgcccctcatttcagactgccctgcagacagcttctgtgatgggcccacttgccctaaccctgcttcagagccttggggtcctcaccctaggaagcacactgagggctcaggcctgtgacacaccaggacccagggacaggacgcaagggaaggtgtcagcaaaagaatgcaaaggaacatggctgggatgtgacagggcccaggaaaactgcccgcagctcccctttctatgataagagccaaaaattgccccttccaattgggtgggtagcttgggaaatccccacatattttaaatcaatcaaacagcaccctgatcaataatccatggggcgaaaagaaagtctccagagaaattaggaaatattttgacctgatggaaaggacagagagtcccacatcgagctctgtgggctgcagctgaagccgcacactggcaggtttctaggaccccacaattagatcaggaagaaacagcctgggtatttaggatccgcttatctctgtcttcatcagctccgactgccatagcaaaataccatagactgggaggcttagacaacagacacttactttctcgaagtcccggaggctggatatccaaggccagggagccagcggggccagttcctggtgagggctccttcctggcttgcagacagccgcctcctcactctgtgctcacatggtggacagagggagcaaggtctctggtgtttcctctcctaggagcattaatccagtaggatcagggccccaccttggtgacctcatttaaccttgatcacttccttactccaaatccagccacactgggcactaggacttcaacacatgaactggagagcacagttcagtccatagcattctggcttttcctttttttttttttttttttttttgagacagggtcttgttctgttgcccaatgtggagtgcagtggtacaatcacagctcactgtagcctcgaactcccaggctcaagtgatcctcctatctcagcctcccaagcagctgggaccacaggcacatgccaccacaccaggctaagttttgtattttttgtagagatgtgttgtgccatgttgcccaggctggtcttgaactcctgaactcaagtgatctgcctgcctcagcctcccaaagtgctgggattacaggcgggagccaccatgctcggcctggcttttgtttcttgatctctgtgccggccacaggggctgctgcagctgctgcagatgccagccttcttgctggccccagcattagtgtcctcggggacagcccacccagttcctgtttcattttcagaattctcctttccctctgctactgcacctcacctccgaatcacacttgaacctggttgctccatggagtcccttcacttcccgaaacctggactctaaccacagcccagaggggtgccaggccctcttcttgctcttcaagctcccaggccactggccttctggtccccccaggaatgtggcaccagcctgtagctcggcctctcagggctactgggttgtccttttcatttttaaccttgttcagttacaaagataaaacatgttcaagagaaaaacgaaaagaagggaatctctgtgaaccagtcctcaagtcccctcctggccatgttcgacaaatacactggcatagacacacaagacagacgagacgtcttgctctagaactccagatgcccatcatccctttctgtggcttcccctgcgtccttctagactgttccccccacttcccagtggcctacaatatgcgaagccatgccctctctttactcctgccaggctccttatccagtcaccctttccagctgtcaccctccttgtcacctcccaccctctctagcccccaatgcacaggtcttctctaggctggtgttcctccaggagatgccctctccaggagagactaggccagagctccagctgtcctctcccaggggagttgcgcaaacagcgcctgtgtctcccagcaacggtgtggagcgacatgcagggagtattgtcaaccagggcagctcacccaggccccggtgtccagggcttttcttgcggtggttcacagagccatgctgtggtcacgtggctggcctccatctccagccctctggaggtccagctgttagtgtagcctacggggcacggtccccagccccctgccccactgagccatgctgctctcaagcaggatgttccaggggcttagcgatccctcccaggagcccttgctgcaccgcgttccactcgggccactccctgggccctttggctgaatggagctccatggaggatccgcttatctctgtcttcatcagctctgactgccatagcaaaataccatagactgggaggcttagacaacagacacttactttctcgaagtcccggaggctggcccagagctccacgtactcctgaaaatgcatctcagccccccgggggaacactacgccagttctccaagggctgccagttcccggggggactgctctagctttactccctttgcttagtcacaaaaacaaatgacatcctttggaagaaggaggccggcgtctccctctggagagggaccttacaccaggcagatgctgctcagcctggctctcacggccacttccgtgtggctcccccaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcaggtaagccccgactcgctctcgccctggcacttccaccccaagagggtagaggcaagctggccagcagcagccgagagccggccgtctgcacccgacacccacagggaaaccctttggtcttgctgccaaggtcacaaaagcagctgccagtgtcccctttgccattccgggctgtgcccgctgatggctgtggcactgagatcgcctctccctgacagctccttcagagcccaggcatcccctgtagctaaaggtgtgtgtgggtgactaatggctctctcagaggcacaggccagcaccgtcctcatcactgctggggctcccttcacttggtgggaacggccccaggtcataggcaagtgacagtatcgggaagagaggcccatttcaaacagccaccagcgagctcaaggttcactggttgacactgtaaatgcgatggggagacttcatttgggaagtggactctggccaccgagttggtcctttctggtcatccaaatcaccaagggttagggccggccaagaccaagggcgtcagctgtgttcctctctgaagtcagatggccaccactgccaccagtatcaggcgcttgccagagctaccatgctcccttgttcccatctcctcccggccaacagttttgccagaatgctccagactcgctgtgtctccacacccctccctggaactctcttgtgatcccactacagcctggcctctgcccaccactccccagaaacggcgctcgcctaggcctgcgaggctcccttccggctcgtggggtcgggctgtccctgcatcgttcctgcctgctgtgggcactgcctggagacttgctgtcctcacccgcctggcacccccacctcctgctcagccctcgccccaccctgctgtggcccttgagtgctgaaaatcctggccggggaggaagaaagggcccatggggaccccacctgcggcctggcccctctcccaccgcagcccctgcagcctctccttcatggcctgcccctcccccagcagcctccagagggccacccagcatgcttcacactccacctccttctgcaaggcctgggccaccatctctcaggtcacagccatcactccctgcccctccaggccctgtccaggatccccagttgcaatgcccctgacatggagcgactgaccctcctccctgaggtcctgccagagtaaggacaccactgcacacttggctgcggagccagggcccgcctgagccaccagccccagctcaagcgggaataggcggggcctgaggccacaccccttcccagggtcagtcacacatcaccaagggcctgtcccaaagaatcatccatgcaacttgcacaaagctgttcttggtgccctgggtcctgtgttccctcccagtggtctcaagggccgagtctcaagggacccagcctcagggcaaccccactccctgggcctcagcctcctttgcttgccttggctcagctcagcccctccaacaccaccctctgcagtgggactggtggagcctctctccattgtcctaaggatgaagtctacgctcctgaccatggccttcaagcccctgcctcttggtgtcaccccaaccttcctgcacacctgcacccctgcacccccggctgcctttccaatcatgccctctgcccgcctgtgccactgcacctccccaactcccgctgcgtcccctgggccctcatgcttacaaagccctctttgactcctctcactctcaccacgggctccttgcaaaactttccagagctacagagtcccccagagaccacgatcacgcagggctaggtcaaggggcaacaaagaactccacatttcaagagccccccaggggtccaaggggcctctccagctgagaaccgggaggcgaggctggcatcctaggcaccgaacacagcgtagcctgggaaggatgtgttaggtctggactctgaacactgtcacctatgccctggcctggccagaacacagagagccccggtgaggaaggggagcaggctttgtcgccagatggcctgcgtctcccctcccacgtgcaggggctactgcctcaagcacaatgctcggacaggccaggggtgcagcacagatagtctgttctcgttccctgcaataaatatttctgcgctaaatcttaaacacatcgaatgttagaagcagcattcacatctcccccagtgccctcctagcggcccaactgtgccttctacgagaccatgcctatgggccccccagctgcccccagatgggctcttatctatcgtacccctgttgtgctacagagcccagagctgcccaagcctggggtggggggtgaggacagcaggaccttgcccctcggcggcccacttcactcctgccgccgcagccgaaggcgacgttaggttttccagcagctgagacaacagccctgccctgacctgaagcatcagtggtgtcagtggtaccccggccacctgtgtgtctcgtgtcctctgtatgtgggggccgctgcagcctggctagtagaagcgagtcccatcggtcagagtcttagagttccaggctgttccaattgtcggtgctcacagagacacgggcagctgagtcccctgttttgcgtatgaggaaacagggtgcactctttccccttggcaccagccgatccgactcttccacgggctcctgacccccatggcttttcgctttgactttgtcacatccaactcaccatgtttctcaggaatgctgaaccagtcggttcttttagccagctatgtaagagcatctgctctctttgattcgaaacacctgcttgaaaaatggagctaaagcttgggagaagcccgtcaggttgtacgtatgccccaagccaagaaaaacatttcctaggcagctggccccaggtttctgctttttgggaaccacaaaatcgctccccagattttggaggccggcacaagcttttctgttgctaagtgaaggcattttgtaacctgctcgcaccatggttccatactaacatatcaacgcaccagatggacagggtgtcattccagaataaaagagtccttcaaacccagaacatgtagctttctgaagcgctcatgactcggtctgtcttttttgcatcccattataatgcaaagagaagcttcgtcagcaactgggccttgctcccggctcagctcttgggcttccaggtgtggggtggtggcgactgtggtattgtcactgatgtggctctcccactgggacaccatctgtagccaggccagaccaatgcaaatctgaggcaggaaaggcatctttcctatccctcatcacttttgccgcagcgagagtcctctcctgaatctagacaggagaccccccaccccgcaagccaccgcgacgccatcacatcaaccatcctccttccgtgcgctgacacactcagtatgcattcctcacggtcgcagcaagtgccatgaggttccccttgtgacaagcaagcgagtgggatgtgctgggcggaaggggactgggcaggctgagaagaaggaggagtcctttccacagcgcgtcaaaggctgaagtggcgtacatcctcattttggccggtgcagggggagtctgaacactcaagctgccttcttccacgaagccctggcccgtttcaagacacccaggtgaacctggtggccaccacatagcactgcagggctcgggctggagcaggtagctttgggctccagatgcgcacactggctttgctgttcacatcatctccagtgagacggacatgagtccccatcccagccaagggcaggtcaggaaatccaaagacactgggtcaaggccctcctgcaggcctcagtttccccagccttgcttccccttcaatttgcaggaagctgtaagagtggggacaaagcgaagccacggctgccagtcggtgggaaaaccccctcctccgctaggtccattcttctgctgaagtttcgagggggcgccccctgcccagtcactcagatgagccacagaagctggcggagacgggcaggcggatggagcatggggcataagtcctccgggtttagaggaagcagggcgggttctaataggagcgtgtcatgtccctcaggtgtgttggagaggaaaaacaaggttgagaactatgaagtacttcctgataagtggcttgcaaggggcatttctgacatgtttgcagtgtgccctgacttgtgacccccttcccttcccaatctcatgaccactaaccatctgctcagcaaaccctctctcggtgggtggcacagaggctggcctcagtcagggccctgtccaaacatcgccagctcccagtgagcggggtgacccgatgaggctttgctgtcaccctatgtgcccagtggtggcccctatcctcgcccagccctcccctccgtgatagcctggacaacagtgcaagccaaactttatctcattttctctcccacagatggaggtagtgagtaccttcaagagaagcggttcagttcagggtgctgtgcgccggcggtcttcggtcctcagccagcttcatgacgtaaccaatctttctacccctactcacgcaattctctctgctgccaatcctaccagtgctgctgggagtgagtcttgacttcccttttctctcataaatggcatctctggggaagaataagcctccccagctcggccttctctcttttgcagtcttgcattccgctcaccgtggcttttctgttctttctttaccgccctgtccagtccttcccgcccagacggtgtctctcgaaagccatattcttttatgaaacgtattcaacccatggcacttccggacctcccgttctttgctttgtttggtttttcggtttgtgtttagtgctccttgtgccattggttctcttttcttgaacttgtctgcctttgccgatggttcttcatgaacttgggccgcttctgggggtgtctggtgtcaggctagggccttgctcagtgttcagtggtgcagcatcagggcagcacgcgggctcagggccgccttcccggggctggaggggtggcgggtgcctttcccacactgtttgccacagaagaatctagcccacgtacccaggaactggagcggcgcttccagcatcctccttgaagtggtttcctaaggatgccgctgtcacctgtccccaggtgggctcagtgctgaccaatcactactgcacaggtggtgcctgccctgtaggccttgccccaagccaccgggtgttagaggtttccccagaactggcactcagaggcctcttcaagacgttgccaggaaaatttcccaccatgttggtcacagtttaaagagaacccaggggctgtcctaaggaggtagaaacttccagaattgctcacatctttttacaaagacaaagggaaggccactccaccgctgaccccactaccctgatgggagagaatgcagggaacccagtgggcccagccaggcagcctgctttttccagcaaactcaagagagtttatacaccaaagagtaaactttcgcgcgtgggcccagggcctttgccaggatggttctatgctacctctttcctttccttctagcaagcccccgaagcgctcccctctgccaacacgaacacgccactcccctgcaggtgggagtccttaaccacgcctttttccatcacagactcttccagcttgattgcttttcttttcctttctttttttttttaggaactggtgagaggtccctggtgggggtcacccctcctcttgcataagctgtcattttgggccactctgtcctttaaggaagggaggaggcccatcctgtcccccttgggaacagagcacgtgcgcgcgtacacacacacacacacacacacacacacacacacactccttctccaaaccacaggccacgtacacctccagcttgctccacactcatcatggggccacctacccttgtcacaaatattggctgacaccgtggcagttgggctgaaaagcagtcggcgcctccagtgccctagacgtgggcccaaaggggcctcgccgccactccacccagagaggcggacaggaggctctgccaagtcagttaaagccagaaatggttcgtggcctcccagcaccttccttcctgggagctgagggcagcagggggcatggctgtgcctccgcctccctcccccttgacttcctccgtatgtctctttgccatctctctctgtgcttcctgtctgtctgtccatttgcccatttgttgagttaaggggaaggcagccaccacggccccactccacgcgttcctcgagccttctccacagctctggcctcatcccaccccaggaccagctccttgtccctctccaggtccagcccagcctctgtggggcctgctgtcttttctccctctggattcctcctgcttcctccctggggcagcctcttgctcctctcttccttggctcctagcacttccttcctgccttcattccgtggccatctgtccccctcctccccacctccggagcctggcagtgcggggtaagtagagtgggagagacgccacccctcctgctgttcacaagctattccatgggggccctaagtggcggatagccagaaggagggcagctgtcccttgcacactgtgtgctccagcagaaggtgggtggcagggccctctgaagaggcccatcccagctgaacatcagcatcccagaaaggactctgccgtggaggaagatgctggctggggacctggcaacaccaaggacatgcccacttctggaagccacctgccagaaccacctcctgccatcatcacagtgcagcggattggtttagaactcagaacccaacccccactccacgcttcaaggaccccaagcaatcaccaagcccagcactctcatcctagagatcaggggaaggaggttgtccccaagggccaggacctgcactgggtcccataagcagccaggcctggcagagtggggactagcaccagcgcccaccctctacttggaactttctggtggatgagagatgctctgaaggctgtgacggagctcccctagacaagagggctgccccaactaggcctgcaggggcgtcgagtcacgtggtttcctaaggcaagcccacagtttcccatcctctttgcctgctccaggccaggctgcctttcagcccaccaggagtctggggcctttctgggcactggagctgcctccgtcccaagcctttcctactaaggacctcaggtcctccagagagaagggccggtggttggtagcatgacatcccctcaccctgtgcccctggggccaatgcaggaagtagcaagggggtggctaggaggggtcgagagatttgggatcgctggggctcagtgctcacacactcgagccctccccaccctgtctaacctcccacacctttgctgcttctggactcaggagtcccaacacaggccccatatccctcctctgcatgcattgtcagactgtgccggccacaacttctgacccccagctccaggcagcctccactgcccctcccctgcccagcctggtgactaccccacaccatgccccaaccacacactcacacaccgaggccacagtatcaccctccctgttgggtgtccatattccggagagctggtcagggacagctggttcagtcactcgggtctaccaagggcagcaggcacagggggctgcgcgtctgccactaggaggcacgggagggtgcgcgatcatttggaaagccccatcaaagccacttgagaggccttttatgtctgttttccactgggacacacagacaaaccccagccacgcatccaaagtctatccttccagcagcgccacaccaggcctgtgtgagatgcttactgttggagtcgttcctgagatgcctcctgacctggcccagcaaaggagcaggggttaggcagcaggccatgagtctggtcccatgtggccaccgggggtccctccgggccgtttagttccagttaatcatgctggaaacagatcacagcagttgcttggttttattggctttggcaacatgaaaaccgtgtggccaaaggggccaaaccgggccacgtgagtcccaggctttccctggacactcctttccagggcccagggcgacatgctcaccacactcccagccccgtggtggaaggagtcttgttttctggagtttgctccattctcaggaaggtcatgtgctttgagccaagcctccctacctggtttctgggaacggtgtattggcattttttctcagatctttgacagtctgcaccctgcctccatgctggaagcagtagcaaccctcccccaagagccctgccctaggctttcctggaaccctgggccctaccacaggggaatgcccttccaggcaaaccctaaagtaggcaccagaacgcagcctagggcagaccccaggacccctggtccaaggccctccccatcaggcactccgagtgtggactcccaagctgggaacctgggcagagacctctcaagactaattggaggtcccgcagctggattcagccagtacggaggcaagggctcagctgggccttcctcctgggtcctctttagtccgaccacccgacactgactcgccgcgcccaggtcagttcagcttgctggtgttgggagcacaggtctaggctcacacggtcctgggcatgagtgtgcacacaaggtgggaggcaattttcatgaaacttgccagctgcaagcagttctggcttgccaacacacacacagccatgtcttgtcttttccgttctttggttcaattccttggggaaagagccagctgtggagtttgcattttcattgttcctaattcaagcatgtgacatccccatggggtagaaaggggccttccccttgctcttcccccacatagagaagtgaggccgaagccatcttctcctcagtgttcaggctatctgagcttggcttctcattgcccgagttgactgatggttcctattgccacaggctcttgaggacacctttgtctcgctttcaagttgtgattcaccttcacgcctacaggggttgttttgagcctggaaaccctaaagttcttgacaagaagttccccatgggtctccctggctgctgtgttcagaatctgctctaaattcaaagctcagatgcctggggagctgacaggtccctgcctccaaaggaaggttctggaccagtggttggtgctgagcagtggataggtagggaggaaatcgaccagaagcatccgagttctgtgaaccttagcggctgagactgagcagagagcatggagcccctcgggtcggctggtgcccagcacagaggcagcaggatagggcttgtttctgcttgaggaattagaaggaagagtgagaaggtgtcaggcacagcttctgtcgtttcgttgtcactgcggtcaggagtctttgctttgattgttctcttttcctttcctttttctactcttctcggtccttcgcttgtctccctgcttctgcggcccttctccaccctcatcctcctccccagccctgcactgcaaactccagcacttgaaggctaaccaggggcacgtctccccatgcacatggcgggcacctccactccagctggccggcagtggcatcgcacatggcactccacacctgcaccccttccgctttggctcagtgtggccagggatgggccttgtcagtctgcagcgtcacccgccctgtgtaaggctcagaactgctcatccacgcaagtcgggagcccgggccaagcccacagcactcagcatgtctcctctgggcagctggtaacaaactgcccgggacagcctctctaaggatgcgtacttgagctaagttcagaggaaggagaaaggccagccaggcagcagaaagggcaggggtcatggctccggggagcccctgcgtggggtgttcagaaacagctccagccggctgggcattgcaaagtgggcaaagagctatggggagggccgaagccagcacaggaggctggtgcaaagccgtgtgggccccagacattcagccccgtccactgagcccctgctgggtgcagcgagccagacagacagacccctgccccagggggattaccttccagtgaaaggtggatggatgtagggggcacttgaaggaaggagcagaagtgggcaccatgctgctggggaagacaagagtgaggggagccttcctggtgtggggtgcagccacagcaaaggtccccaggtgggatgtgccggaggctgaggggtaaaagagggcagagtgagaaagactggggccggctccgagggccacagccagtggagggcttgtagcgggggagaccaagacacgctctggttttcgggccgccgtgctaagggcatggaggggtgggggcgaagtgcaggttctggatggcgtttgaagggagccacggggctggggccgggggggttgggcctgctaagtttgagacccagcttagatgcccaagtctggagccggagccgagaggctgttagccgacaggtggaatggaaggccgagagccagaagagagtacctagacccagaggaggggccctcgggtgtcagggatgggagaggaggaggggctggagcagtgtcggacagcgctgggggactgtgaggagtaaaggactgtggcctctcagggccatcagccatgatggggaacggagaagtgtggcagagggagacagcaggaggacacaaggaggtggggacacacagtggggagccacctcgcctcacccggatgagatggggagtcctccagcccaacctgaccctcctaggggcatctctcccggaagagtgctttcatttcctttctttttaaattgtcacagtaaaacgggcttttgggggtacagttcaatgaatttccacacagtcaggacacgggccagttccatcgcctactggaaggtttagagccagatgggggaccaagagtctgacttggcagccagagagagctcggaaactccacctagagaagggacaggaaggatggagggctttgctggtgggggttggggtcccaatgtgaccccagggccccaggcaggacatagcagcagcaatggaggtgaggagaggctcagatgtggaagatgcttttgagttagggtagggcccacaggacacgtggatgtctggtacatagggtcagggggtcaaagtgcctctgaggtttggccagagccctgcactgggatgggaaggctgctggtgggcagagttcagctggagcactgataagagtcctcctcgggcctcctgcaatttgagaggtcccttaggcatccgagggggaacacccgggaggcagccagggcagaagtctggcagtccaggaaaaggtggacatggtgcagctggtatctgcagtatttacggtggcctgatggtctatagacagcattgacagccctgggggccatgagattcctttgggagcagtagggggcgtggcgcgtcctgggctgagagcagagcaggaggcggtgcaggagcctgagatgaggacagagtgaacccaggctggtggaaggagggcatccttgagcacccaggtaggagtgcagccctctgggatgggcctctcttagaaacgtttgttgctttccattgaaccaatctcccaggaatcgactgcatccttcagtgttgggtgggctgaaaacaccccaccttaacaccaacaccaaaacattgtttaatggcccaggattaggatgcagggaaaatagagcctggagaaagctgactcactgtcagctgtaacagactcaccaggactccagccaagcttagcacccccaaacagcagaatgttggggggcagcccttccatcctgcagcggttcactcagtcacttgtgcattccccaagtgtctgctgagcagctgctctgggccaggctctgttgttaagccacaaacaaggcagatgccatccgggaggggcacgctggagtagccggtgagaccggaggagcagtagcagcagaagcccagcctggaaggaagggctggctccgtggcctggctgtcctttatggaggtctttggagttgagccaggtgcagtgagacctgtgcataggtttgagcaggggcctggcctgatcacatgcccccaggtctgaatgaggccaccagctcagcgagatctcaccccacacagccctggggtcaaggcctgcagcactttgtcctttttgtgacttgatgggcaacagctttagcaggcgatgtcccaggcggcttccacaccacaatcctgtaccagaaaaggcctaaataatgaggcaacatctgcattggctacgaaaactgaattctgtttcttttcattaaaaacgtcaaattattctcaatttctgtgttacccctaattcagaaaccagtctggggataaaggcctgagtgagaatagctgaccatctgccgtctggcagatgtggctttcccgaatgcagagaaaatccgaaccagatttcagatggggtgctagaaaattccaatgtggagctttttggcttacttttttttattattattttaaataggaacggggagtatcactctgttgcccaggttggtctcgaacacctgagctcaagcgatcagcccgcctcggcctcccaaagtgctggaattacagccgtggaccaccaaacctggccctggctcactttttgcactggagaggtgatgaggttggcatcatttcagctgattccgaagcactgtgctttgcctagctgagcccctggagggctgaaagaaagtcaccgaaaaaaggtgattaattgtctaaacgacagagccagagaggaaatatttttagctttccaggcctggtctctgctgccgtgacacaactgtgcccttacagcatgaaacttaaaccagtaaaattttattaaccaaaactagcagagagctggggttagcccctcagcaagccctgacaccttgtctaaacccagaaaaccaaatcctaggtcgaaccttggccccagaaatgcttcagaactcctaatgtgtccacctgctcacataggcaggggtggacaggtgttggatgaaccccagggtctgcctggcagctcagcgctccgtctgctgccccctatagggatggcagtacaaggtgggccagctaccattggcggctgtgctgacactggcctgtgcgaggccaggcagaggcctccccatcaactcctggcttctagaagcaggagggggcccaggctgaggggccagggagcaaagagaggcagcaaggacttgagtgcgtgaggcaaggtggagaagccagaggagggaagggctcgctcctggagcagtgccctgccggagggtcagggggcttaagggctgccgtgcgctcagctgggggcagagggccactgtgccgggggagtctggggcacagcgggagctctttcatgcgggaagttccgctgatctgaggtctgcaaactcctgtggggagggatggccagggaacaacacagagcggagcccgggaggcagcagagacgcaagttttggaatgtctgactggaagatggaggaggagacgggagagaggacaggcggagtgaggtcagaagagcaggggcaccagattgaaccagacccagtcagacacgggggctgtgaggaggccacaggggcatctgagcagagacaggctttagtgggtgcaaatcaaaagtgtggccattttcggtctcagatacctccagctggggactgctgggctctctggcctggagctctgagtacaggcctgggccacagtttctggttatagccagatgggccccagcactgtggccagggtggagaggtatggacagagaggaggagggacagagccaggccagagctctggggcacccagggacagaagagagggcagtggaggagatggggccagggcagctggtgaggtggaagagggccaggcaggggcaatgtcaggaagccatgagaagcttccagaaagagggatgatcttctgtgttgagtgccctgagggatcaaatcagacgaagatgcagaagtggccagtggagttagccgcagggagaccctcgacatggcaggtcccggctccagccatgggagctgggggatggagggagacccatgcgagaaaggccggcagtgcccataggctgggaacttgctcataccagcaggtacttcggactttctggtaagatcgagaagacatcccactcaccagcattctctccttttcaaatcatctttcttttctaccaaattggaattcagattgggcagagaccccagaggtcaccaaagccactcgtctccccaggacagggaactgcggggtcacagccaagagcctagtgcagcactctcaagttccagaatacctgcccagctcagcctagagaaagacactgccatcttttcctgcatgcggatcggttgacgagaccaaggcccacacctgaaaactctttccaaaggcaggcagagccatcccattccgtagcagccctccaacaaatgggtggacatttctcatgccatgacccccagccattgacgtgggtggaatttaccagcaccagccggccactgactgtctccttccttccttcctaccttccttccacgtttcctttcctttcccttcctttcctccctccctgctcccacctcgcgccctgtccctccacctcccactccagatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgtctcagcacatgcgcacacgcacactcggactcacacgaagtcacacgcacacatgcacgcacacacacatatggggacctgcacacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggagaaggttcttcgtccaaaggaggaaggagaagaagtagaaagtgcgaagagctgagttccccacctttttttctattgatgcttcttttttaacaaactacagttttaccgtgtgtttgccatttgagctgtgtggtgggcagggggctggtttgggtttatggggagcttttgttgcacccatgcaggggcaatcagatcagcatcttcatgcaaaaaaaaaaaaaaagttgagtgctctgcaggcctgtgaagggtgccacctgagggagccgcctgcaagcggccctgcagccacaaagcaacccgccctctgcaaaaactaggcacatccgcagtgcgcatgtgtgtgcgtgcatgcacatatgtgtatgtgtgtggatctgtacacacacacgtatatatggccagatgcgtatttcaataaggaactatttactggcatgatatttgcattcctcttatcaggcattttcatttggaaatttcattattgaatgtagcaaggttgtagttgtttttttttttttttcagggaactagactgcaagaatatctttctggtcaacccatttttgtccctcatcaccccgcccccacctttcgctcctgccctctgcccggccctactgagattcccaaggagaaggccgagagggggcgctccaggtctggagcaggtataattggagcatttgcactgagacccctgccagagaggagaaaaccctttcaagggaaattttaatctaaaaggaaaaaaccaaaatattgatgagaaggagtcctccagttagtgaaaggggagtttcgttttcagctttctttggttcctactccaattccacatccttcatcctggccatgcccccaccttcaagagcatgaagcactcttggagttgtgggtcctgcccagagtccagagagcagcctcagctgagcacaggtccgagggggcgggggcagggccaagagttcaaaagaagccaatggagggagagggagcgtcagaagcccggaggagctggtggtgggagaatgacggcagggacgcagccacagttcagaccctgtcccctcagcacctggatggactcccactgtttgctttggcaaatgccgaggagtcctcggtagaccaccttgatgtctgctgtgacatcagaggtgccaccaccaaagcactcttcccaccctagtctttgtgtccagcggccaagcttaagccatgaagtcatggatttgtggctcagcaccaggtcctgaggggagcgtatcctggcagtgtgggcacctggtggccaagcctcagtttcccccaaatgagcaaaggggataaagaggggcccgacttttgccaccctcctgaggaagcccctaggtccacacagtgatgccatgggggacccttgccttccacacttgcaggtgtcacgttttgcagggaggtgtttgggccttgggctcagccactgggagacagttgggacctgagggacagaggatcggaatggaaaccaccaacgtgcactggcaccctcagaaggcttgtctcacctccaccggcatccacacaaaaccaaacaggagcaggcgtcatccccactattcccatgaatgccatgtcacccctgagcagaagcagtcaaatcttgggcaaaagaatttcggttagaaaagaaaatcccactttaaaatgccagctgcagataactcaaagccatcccttttttctaaagggcacattgagaatgtcacccatttgtaaactgttccctgatgtccttgtttaaacgataataagaaaaagggcaactccatttgttgagggtctttgtgttcttcaatgagaaatcaaatttgagacgttgaaattggagctgcgtgctgctgcactcaccggcttcttctcactctctgtcgtagacacaccgataggaccaatggccaatagatattaaaagcaaaccctcactgctgctgtataaagttgcctaatgtaaatgtctattgtttagtccctaggtcacctttgtgctgtgctgtggagttcagaaacggggtaccatgacctggaatcttttgctcttgtttttgcagtcttcaaggctgggggccctgtctcattgggaagcccctctttataaagcattatattacttggaatggcttggtcaactgtgttcagttcataaatatgttttacatttttatctgcctgttataaagatgaacaaaaaaacttaatgagaaagatcacagatacgtaataatttaaagtctgtagttgaatttcctaacttaaagaatagaccaaaatttctgtgtataaaaaaaaatgaaaggctccttacatcctggtctgggtaa

SEQ ID NO: 4000 - DNA, 62913 bp, human; identical to SEQ ID NO: 3998

SEQ ID NO: 4001 - DNA, 65263 bp, human; identical to SEQ ID NO: 3999

SEQ ID NO: 4002 - DNA, 46807 bp, human
tgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggtaagtccctctcaggctgcatgccacccagccctgctcccagccttcagaggagcgacctgaaggcatccttagccccaaggctggccagggtcaagggccacctgtgcccctcctctcagccatttcccttgagggggagatgccctgggtaacctgacctgaccccctcatctccacacctccacaatcaggagttctccgctctatagagcgagactggggagggggagatgggaacttcatgggacacacacacaggcggaatgggccccaaacagaaacccttccgaggaacagggcagggcagggcagggaggaggaagacagccccatctgtatatttggggatttccggtgtgctcaaccctgtgttcacttaagggggatcagaacaggaggaagggatgcagggtgcaagccttcggagtttcgggtgaccggggcctctcctgggaagagagaggatggcctggggatggcacaagccatttgggtctggcaggaaggggtgaccgaagctgggtcacgggaggcccagagtgctgatcagaggtggcactgactggccacaggctgtcccaaagaggcacaagcccagggtagtgtcggtctcactgctgagggaggctctagaaagcccggtgagcactgtctagaaagatctggggcggaggcctgactatccctgtgggaggcaatgttccacccggccttgtgaggcctgcccagccctggttgctgcggtctgccatgaagcggggacccccaggagccaggcccagccccagattccaggagccacagcattctctggcgctgcgtgcctggcagggctgctggggctatcccagcctagtgccaggcctgttccccagccagtgcgggctgatttgatctgctgcccatctgggcaacgcctgggcccacccatctcctctgctcccagccgtgaggctccttggcacctccagcctcccgctctgccctcaccctcaacccagagactgttctcttgtggctccggcctcggccccgtctgtctgcaggtggcactcaggctgcagggaggagtgaagatggaggaggggggctgcgggccaggtcaggaactccagggtctgcctgggtctccctagctttgtgccctggagctgatgcgcccgtgacacccggcctcgccgccgcacacgccctcacggtgcagctgctgctggggctgatgccttggctctgctcccgagcatctcttgccttccctcctccttgcccagcccccgaggaggctgtggagggccatttatccacaagagctctggcctctcccagatcaaaggaagcagatgggcctcagctgtctgctcttcccctgtctgccaggccttgttaaatatttaaaatgtcaaggcccctgggaacctgcccgattctgccatggagctcaggagctcttgcgtgcctgtggaggcaggggcacggagaagggcaggtgcacaggtgggtggcttggcctctgacgggcttccaagcacctgggtccccaaggccacagtgcagggagccggccaggcctggatctgctgcccacagaatgagcagcagaggaccggcccctcccctcttcaaccctcaaggtcctcgggctggagctgtcgggcttgagctgtctgggtgccaggagcgggtgactcgctccccgcatcccctagcccggccgtgcacccggaccctggtgctcagacctgcctgcccctcagtcctcctcagacacaagggcctgagccacgggggcagctggctttgttgtgccccaagccccatgccaatcccctgacaaggtgggcagacgtggggctgcccaggaggcaggcactcccccgtggggcaggtgctttatggcgcatagtgcattgcgggaaggggactttatcttctggcggtacactcatcaatccactgccctccctgtcttgggagcactccaagaggattccagaacccatcctggaaaccgcgctgctgttgtcaggaaacctgggtctcaggctgaactcagaggtgggttcgcccgggaacctggccccgcccagtgcccctctgggctccacaggcagttctggaaaggagggggcggattcgctgggagccgacacgagatgctcctaatccaattctgatggcatctggcctctgctccgggcaggccgcccatctgtgtccatgccaaccggccagcccctgcccccatgccctggacctggactgccctcgggcctgctggggaagcatgtgctcagagccagaggggccgcagctgtgttcctcctccccgtcaatgggtgctgcagtggggcagccgtcgggaccccgagcccacaggaaggctaaggagaaacgagcaaggctacagctgcaagggcaggtcaaggccaagggagaggctggcgagggcgagggagctcctggggaatgggccaggggtcccggctgctctcagggacaaactgggcatgtgaggaggggcaggcaggagagagactcgcatggaggctccaggctaagggcagtggagaccccaggtgtctggggagccctcccctgctcctctccctccgcagaagccccacggttagcacgtgcttcttcttaagtcacttggggggtcttgtactccctagtactgtccccacctggcttagctcctgtaattccaggagacagtcccagtccagagcgaggtgcacacccctcagttgggtccctggtccccagccccctccccaccacccaggagctgaggtcgtgcgttaaccccaggctcccgattggggcaggctcgggcctcagcaagaggcctttggctcctgaagaaacctgagccaggggcagagaggcacggacagctgcggctcttctgggtggggaggacgccatgtggccgtcgcctagctggggtgaatgagccacggttgtgcgggcggcagcttctgttccactgcggccagggctacccctgcccctcctcagaagccccaaggttagcatgcgcctgttctccagtcatctggagggtcttgtgtgccttcccagacccactgtgagtgccccatgggctggggctgggctctctggtcatcccgtccctgcagcagatggcaggcgtgagcccagctgcccagggctgggagctgcaagctgctgtctgtccaccaggtgtcagtgtgggtctggtcacggccgcgacagcactgggcgccgggtgagcgcccgggagggctcctcgggatcagccggggctgagaatcctggggccaagggtggggccagaggagggtgtcatcccacatgcctgccccggtagaaggtggctgagtgggtgtccaggcccggatgccagtcacgcacgtaagcttccagtaccttcaggccaaggaagactgagaagtaagcgtcctcaaggatgacaagtgacagaattggatagggacaggtggctctgattgtgaaggcaaagccaatttgggggcttctgagtggctttgggtgtcattcaagtcgccatgtagacaagctgtgagccctggctgagggatcaaagttggtgctggagttgcattagaaccaaggctgctgggtcctgagggccctgtgctcaccgggtcctgtcgggcagcgtaggttctgtcctgacctgggccacaggccagagctctgactcatggttacagggccctctccacctccggcctcagtggccttgtctgcaccctgcagagagcagctgatgagcagcccagggtgggcagtgtctccccgacccctgcgaggccatgcagcccagaaaaggcttgaagacttcccagtcccctccctcagcaccgtgactccggtttggcttctccccgcctgttccccaccaggaacccactcccattcccgtgcctctctctctcctcgcgtgacaccgttcttcttctttgggtctctggacccaagaacttgcatctcccattagctctcatgctccctccccactgcttcttccccgagaaacttctggaaagtaagcctccgctccctgttgccagcagccacaggcaccctggagactgctgattcctcggcactggccgtgctcatgccccaatccctcgggccctgcccaccctctttgcaggctgtccctgcccccacaggttgggctgtgtgacactgccagtctttgggaccggctggccccatcttacagagctggggaggggggtgttggtgacaagcctgctcagggaattcataggctgggagctagagaggtgtttcctgacaggcacagagccctggcctagtctttggcatctggtgccatcccagcctcccctgattggtggccctccccatgtctccactaaagtcccctggacactcgctctcctccccaggggaccattggctatactcttctgtcctgtctcctagcaacccttgttgacctggacataccctgctgggtcccctctgtgcccccttgttgggtcctgtcccctgccttccagtgccccctcagcggtagtgtggaggtggccaggaaagcacagggacctgggacccgctggagtccaggagcctcctggcctgttttgtcatctgtgtgtcaggaggaggatggctagggactccccatgacagcagccagagagccgcatgctcactcccacgtgcacacccccagcagtctgcagaaaggctcctgtctagagggagagccaggcgctggccagacggccccagagggctgctgccaccccaggagcagtcagtcagggccacataggaggcctgggacacacaaggccgacccgtcccatcccatcctccccttctgtgcttccggggcaccatgcaggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaaggtaaggcccgggggcctgggctggaaggaggaagaggaatggggcttgagatgagggacggtcacaggatggtgatgtctcctccactgcttcccttctgtcctccgcacagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggtgagtgccctggtcttcacccaccctgtcaaggaagctcggctcctgcttctggggagggtgagccagaggagacccccagcacaggttctccccggtggcctgcgtgtcgtcacctgccttaggaggcgggaggtggcgggggtgggggaggtgggggaacacggggcagggcagagtggtttcagacacagcaggcccccgaagaatcaactgtccccacagcctccacggcgggctttcccccctacaaaggatgcaaatgtcctcgttccccagaaggaggagggctcctgagtccctttcccaggcggcccatggcacctgacgggacctcccctggggcagccgggaggaggcggtggggagaaaggcctctgcttcccggtgctctaggcgacctgctgccagccgacggcgtgctcatccaggccaatgacctcaagatcgacgagagctccctgacgggcgagtctgaccacgtgcgcaagtcagctgacaaagatcccatgctgctctcaggtgagggccaccctccgggccagcctggcaccaaggggcgtcagcagccgtgtggcccagcatcctgtccaggctgcctgctgggctcagcctccacctccaccagggccttccagcataaccttcaggttgggaatctgaagactccgcccgtcttgaggcctgatggtggcagctccagccacagggcgaggaagctggccctccaggcccgggagagtgctttgtgtcctgaatgggaagccccaagcggagaggcttgcaggggccagcacagcgctgtgcttctctcaatccagaccctcgacaatatccagtgggggtagtgttccctttccagaaggtttcagcatagtccggtgtttatcccagttggaaacgtagtgtgaaacgggacaggaaggctggaggccctaggtgggccctgtgggcctcggggtctcctccaagccagggaggaggcttcagcctagttttaaggtggacaccgcgtccctgcttccgggagaccctgggagacaggttgtgggcgctgaatgtgtctcccactgggtgatacaaattcctgtctcagtctctgtgttgctgttccaggcactcatgtcatggaaggttctggaagaatggtggtgaccgccgttggcgtgaattcccagacaggcatcatcttcacgctgcttggagctggcggagaggaggaagagaagaaagataagaaaggtagcgcagcagtgccgccagtccctggtgctggtggcggctccttccacgctgcccattctttctttgcgggccggtgccactgggggctcagggagagccagcccaagtgggtgggaggccgggccctctcttttgattctccgtggagactcctcttctgaggatatcccccctgagagccggcaggccaagggcccctccagtgccgtggacggggagtttccctgagaccaccatccccaaaggctccgggatcccatacctacctggacaggaatggcgttagagggacaggagctacggggagcctcatgcttaccctcagggcccgtgcccagtaaggtgccgaggatcccaggccagcgtgggaggcagccagggaggtgggggtcagaggtcagaggaggctgggacaggtgagggccgggcagcccaactgtgggtggtggccctgccctggggcttacaaagctaggcaagcccgagccaggagggcccattcctcgtcctgtggctggagctgccaccatcaggccctgcagcgggcggagtcctcagaccttctaacctgagtactattcagggaggccctgatggacaagattgaatggctgccacagccccttctggctgggcagccttgctctggcctggacttgccttctggcctctcctgcagccaaaacatggtagggagccacacccgcatgggaaagctctgcttcctgccagtgacctccagccagggccctggggccagtgcgcggggtgtgggggcgtgggggcgtggggcgggcagtcagggcccggggaaaaggtcagccctgagcccaaagctccctggaggcagcaaaggagtagctggatgaccctctgtggcctagaagcttcgacgagccctgcctcctggcagcctgggcctgtgtctccctgcaccggctcttctttgtggcaccaagtcctgtagggctcagtgcagtgtctcaccccagtgagtgccctgggggtgcgcaggcagatgggcagccctgggcctcgtctgggctgggctggagtccctaggcctctgtcctgggaagcccagctgcccctgcctgggctgcctcctcatgtcttgcacacaatggccctctcccatcgtccacgggaacccacgctcctctggagtctccagccgcccttctcaggctgctcaccttctctgtaccttaaatgagtgtgtccttcctaactgttccaggcctctcctttcttttttaaattgacaagaccattcagcccctcccaggccccacctggccctcctctccagcaccctcaggctgtcctacttaggagtcagagctagagggcttcctggaggaagagaaccctgagggggccctggagggagagcagcagctggccagctgggtagagggtaccagcaagaccagggggctccctgctcgccctccccgtctctcccgccccatccccattgtttggcgcagcctgccaggtacacgcttaggatacttgccttctacctgcacccaaccccctatttcttgtctcttgaccttgactcctatgcacctttctccaagtgtgcttctcctcctcaccttccccccactcctgtctcttctggcggggcccagccctcctcttccagcaatgctcatcccagacttccccctgcctccctcctccagaggcctcccagggcctgtgtgcaggctgggtccagagtccatgcttccttcgggcccccacggccccaaggctctgccatctcccctgctgtgctgtgcggtcatcgcactgccatcttgtgtccgtgggggtctcccctccctgcaagaagggccctctgtgcccacaggaaccctgggcggagagggcctgatcaatgccccacccctggctgagtagggtcggggggggggccctccctgctccctggggaccccggatcccaaccccaactgcctgggagtgcagatgtggcccccaggaagctcctctaactgcagctctcagaaggggtgactgtgcccaccacctgagcccctggatagggccacttggggcccagcctggccttgcagggctgctgtgtgccggggctcaggctggcactcctgtgctgcagccctgggttgaccaatgacctgaaagcgccccgcagagtcctagcgtctcattcctttgtccctttaaaacacacactggggccaggcacagtggctcatgcctgtaatcccaacactttgagaggtcaaggcaggtgaatcacttgaggtcaggagttggagaccagcctggccaacatggcgaaaccccgtctctattaaaagtacaaaaattaactgggcgtggtggtgtacacctgtagtcccagctacttgggaggctgaggcaggaggatcgcttaaacctgggaggtggaggttgcagtgctcaaacacacacacactgagctaactgctggacgtgactgcagggaaaaccaatccctaggcaagggcagctgggtgctgtctgcctggcttccaggggttaggagccatctaagtgaaccccttgagctggtttgcagggagcagacgtcccgacttggggaggttccagcttccgggaacctcccactgccagccatgtgtgacccagggcccttccaaggctggctttaggggttcactgtagggctgagcttaaggccgaaggggagccctgggcagaggtctggctcaggaatgccagtgttcatggtgaccgtgtgctgggaggtggtgacggggtgagcctggagaggacggggcatgaagaaggccaccagcaatcaggcccctcctccccaccccctctgccacgcggcccccaggctggtgtcctcaagccttcgtgtctgtcatccctcttccattgtaggcaagcagcaggatggggccatggagagtagccagaccaaaggtaacgggcgccgctgcttgggcacaacaagcttggagccctgggggtggggctggtggagggcacagtgttgggggaggttcacctgcctcggtggcaggagcaacacttggagaccaggtgagtgggctggctgcacagtcccgtcccagtgcagagggaggagagagcacacccctggggctgctcagggcatcctggccacagacactgctggcagctcagcccagccacctagaggagaccttagcccagcatgggcataaggatcacctgtgagtgggcgccccgagtccactctggccagatgagaaaactgaggcccagaagggctgactcacctgaagctctgggtcccagtcagtgtgtttcccaggccagcttcctttcagccaagcctgaggacctgggagacagagtggtcggctgagggccagaggcccggctctcctctcagccccggacagctggcaggtgccgacaccctggggccagcatgagcctggctgtgagacgcaggaagcaggagaaggggtgggaggagcggggaggaggccagccgtggcccacggaggacaggagatgtcggccaatgcagcagccagctctaggtgctggagtccatggggaacaaggcaggtcctgaccctcaggaaggtcacaggcagagatgacccaggcaacgccctgtgcggagctgggtttgggagggcagtggggggacagcccgatggctgcagccctgggttgaggaggtggcagcaggtggggcacaaagctggaggggcccagctgggtggggcaattgtgtcctgacgccactgggaagaggagccgtggcgaatggccttgggctggcaagtgaggaggagcaggaggaggcagaggtgatggcggtagtgccaagagccccagtggatcggggaccagagtagtgagggagaaagacgagtctgctctccccaggtcgctgcgtcggtcccggggcagaagagggaggtggggtggccaggattactctgggccgtggagtgggtgcggccagagcttggcagggagggagatgaggaagtgacagaagcagaggagtggggagaggagggagccggagtgggggacacaccaccaccatgtcgagggcagcaaggatgaggagcacaggacccaccagggaagaagggagaggagccgtctgctccaggggagaggcagggagggtgctggagggacagatggagcccgaacaggcgcagggctggctggtgggaggagagtgcatggggcttctgggcctccctaagggaggtaggaggtggctcggacaccagtaagcagatgagtcagctcagggttctggaagattcctcgggccacaggcctctgctctcaggtattatttggggcattccaggaccagtcaccctgtctgtgtgcccaaaagccttgtgctgtgtctgtcctcccttctcccgagagaaccatctctgtcccacctagaacagtgctggagccaccccacccaccccaagagggcctgggcttaggaggcgagagaagggaagctgatagacttggaaataggagagctccactgaatcccgtctcctctctatggtgtggcatgtctttcccccacaaaagccccttataacgccttctccccagccaggcactgaccttggccatggggttcctctgtgtgcagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcaggtagggacagcaggaggtggtgggcccaggccattgactgggcgtggaggatgctgggctcctggagatgagcccaggctgtgtagagcaggtgggaagggatgtggcaggtgatgtgtgggccaggcaggcaagggcacaggccaggccggcagtggccatcagggcctggcgcagcccttccctagtgagcagaagtcccaaaccctcgacgaaagcccgggtcacacactgagccactgcccatgaggtgcccctacccaaggctccaggctctgcccctggcaccctcaaaaggcagctgggggcatgcagggctggtaccccaacttctggggtgcagtgggggattgactcttgctagtcctccccagcggtgcttctcctgccatcagaccacaaagtccactccccaaccccagcagcactccagaagaggccacacagagcccccttgcaaacaggccccagctcacctgctgagccaaacctgggctgtttatcctgaaacgcaaggcaaatctacaaggccttcacaaatgcctccgagaccgtgtccatacctcttcttccctcttcctgtccccctccttccctcacccgtggcaacccctttcgtctcctccccgctctgtggcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaaggtaatcataaaacttacagttgatactgtttacagactcggaaactggggtaagaagtcattgggcgccttggtggcagtataaactggggacgtttgggatagctcaagggaggagaggaggtgccgagcagggacccagggggcagctttgctgatctgtcagctcaggtccctcggcatgagatgggccagaaagcaggcaggcggtgagatacccaggggttcagcatctgcacaatgtgggcagtaggacggaggggctgggaggcagcggggaagcggagaatcagcagagggcccgggacactgggaggcagtgggaggaggtggggggagccaggtgtggggtggtggggtggtggggtggtggggtgggagagctgcagggctggtgggtaactgagagggggctcgggcaggggaggtcccgggtgcgcatcccgcccccaccattggatgaggttgctgatgccttacagcctcgctattggctcagggctgaccaggtgcccagtgggcttagtgccacacgtggagctagctgagcagaacagagtcacgcgatgtttgtgttgacatctctcactcctccaccccaacaagcacctgggccaaatgcccacaccctcgccctttgcagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactagtgagctggggcaggagcgggcgggcagggccgggggcaggagcaggggagggtcctggccagggtgccaggtgagctgttgcaaggtgctcattaggcccccccttgagaacttttgcccatccctggcctcacaggtggctctggctgggaaactgcctgtagctaaggccgaccttcctctgctccctgccgcccacaccctaacaatgtggtgaccacgagggggcagagctggggctccaggggcagcatggagggtggtctcaggcccccagtgcctgctagccctcgtcatcttgcagcctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgagtgagcagcagggaggtgccggggtacgcacggagtttctgattctattgtcgtggtaaaagaggccgaacgtaaaattcaccatttcaaccactttacagtgtacagttgaatggcattaagcacgttcacaatatcatgcaaccgtcaccactacccagttccaaaacacctccatcaacccggaaagaaaccccaggcccatgagcagccctccccacgcccctccccagcctcatgtgcttcctgtctgtatggatttgcctgtctggacatttcctatcaagggactcatacactgtgtggccttttgtgtctggcttctttccttagtgtaaagtttttccgtttccctcagatattagaccttcctttctttttttgttttgttttgttttttccctcaagccatcctcctacgtcagtgtcccccgtagctgggattacatgtgcatgccaccacgcccagcgaattttcaaattttttgtagagctggggtctcctcatgttgcccagggtggtcttgaagtcttgggctcaagcgatccacccacccggcctccctaagtgctaggattacaggaatgagccactgccaccagcccgaacttccattctttctaaggctgagtaatatccattgtatgctaaagagcattgtgttggtccatccatcccttcatctgtctaccagcacgtctaccagcacgtgagtcgtttccaccttttggctgtcacgagtcacgctgctgtgaatattcacgtacaagtttttgtttgaacccatgttttcaattcttttgcgtggacatctaggagaggaatggctgggtcgtggtgtccacgaaactgttttccacaggggcagcaccgtttcacattcccaccagcgacataggagggttccaccttctccccatcttcaacagcacttattttctggtgtgacaatgctgatgggggccatccttgtgggtgtgaggcaatatctcctggtggttttgatctgtgtttccttgatgactaacaacgctgagcctcttttgctgtgctgactggccatttgcctgtcttccttggggaaatgtctgtcctagccctttgctcattgctgagttgggttgtttgtctttttattgttgggctgtaacattttttctgtattctggatcctagatccttatcagctatgcgatttctacacattctgtcccattctgtggcctgtcttcactctcttgatagtgtccttaggtgcacaaatgttttaaatcgtgatgacgtccagttgatctattttcttgttgttgcttagagatgatgaaaattttcttagagatgatgaaaattttctggaattggagactggtgatggtcgtgcagctctgtgactatactaaaaaccatcgaattatctactttaaatgggtggactgtgtggtgcgtgaattatatcccaataaagctattagaacaaagtaagggagagtgcacagcgtcacctccaaatgccctggcttccccactcccactcagccttcccggactccacacccttggccttggcgtctctgtccacaagtcacctcgctcctcatgactgccgtcccagggccctcagggcaaggtcctctgcaggacgcccagggctccccaaaggcccaggcccacgctccttcctgtgttctgcggactggaccaccaagtgcaccctgcctggccgccccacccacagcgctctcccagaactctgccaggtgcagcgctcactgccagggccaggaccacctcctccctggagccatccctgctggtgtgggggcctcagccctctttctgtgcttcttttttggtgggcactgagggacactgaggcactgcggacaaaaggcccagcccagcttcactcccccttactcccatgcctcagtttccctggtggcatggagatcacagaatacttatctctggggaggggtgtgagggttccgtgggtgaatccacatccataggaggctctccgtccacacagcttctgttatgatcatttccttcgtcaccagcctcccatgcagtggcagcacctggcactcacagccccactggcttcttccaccatgcccgcctctgtgaccctcggctcctttgctccctcctctccccacctgaatcctcccaagtcctgtcccttttgagaagctcctggagtcatgagcgctctactgaggctgtggctgcctggacgtggttatagcgattgtccacagacttcagtttttgcccaggttccacccgcttgccctatgaagtctgtggtggagctgccatgagccacatgctcctgcctccctcccggtctctcagcctgcagcagtgcatgagcgtcctggtgccctcaagcaacagaaatggattctcccccagttctggaggccggaagtccaaaagcagggcgtgggcagggccgaagcgcctccaaagcatctcagagaggatgcatcctgcatcctccagcttctggtggtggctgccagtcctcgcgttcctcagcttgcagctgaccctctctaatctctgcctgttgtcacacgcccttctccctgtgtgtctgtgttctcacacggggcactcctctctgataaggaccccagtccttgactaagcccccaatccagtgtgaccagcgctgttccttgttgttctctccccacctccacctcatctctgcccaccccctgcctaggtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtagccaccaccttctctgtgagctgccctggtaactgtgccctctgcccgagcttgtccggactggtaggggcggccttccttcacacacagctgctgcggtccctccgtagtacacttgagccccgtcctgggtgctctcaccctgacacccgcacaaaggctctgtcctgcctgctggaaagcccttcccgcttgacctatgggcccagctcaggctccaccttctaccaggtgagaaggtggcagtggcggagagaccgtcgacatttgggatctgatccacccaggaccgatggactggaggtggtgctgaagcctgaggggacacaggtttggggcacagggtgggcgtttattggttgagggtttggctggggctactctacggtcaggacgtcctgtggcgagctcacagcaaaggtcctggcgggaaagggagcccagaagcatatccccatatggacgatgccaccaggggagtccagatgaggggacctcgagggccgcgtggcagatgccatggccttgacactgggaagtcactttgttgttgaaagatcccagaccctggagagtgtggaggatggccggccccggagggagaatgcaaggcatggggtgcccctctgtctccccagggcctctgcatggcacccacctgtgtcacaagcagggccactgtgaccctgacaacttgtctttgtaggagccaccctgggggtgcaggtgcaacctgggaggagaagcttctgggctctccttcgggagacaggcattcatgtattggatcatgtagcaaaaacactcaattcaaagacagtgcgtctaaacgccagccatggctcatgtcaacagagcagccccgtgccccgaggagaacatggtcactgcgcccagagagggagcacctcgagcttgccctgggagaaaatgggtggtagcggaggacaggggacagaagtccagcgagggaaatgggccccgcaaaggcgggcagcggcatgagtcccgggccccactgagcctgggagagcagaaggagagggtgctggtgaggcgaagcaaggccacacttggggacaggagccatcgagtccctctgttggaccagggagcaactgaagcacagagcagaggaaggaatcttgccagaggggcctggggaatagggacagctcctttccagcttaagagtggctgagagagagtccaaggggtagaccacagtgacagggccaggctgcggaggctgggcagacccccacaaagactggccagcctggtggtggctgaggaggacgcacagaaggcccagcgaagtcctgggtgccggcaacaggcagtaggacacaagggcctcactgaaaccgccagggtgcttggagatgcggcacggctgcagccagaggagggcccgtgaggctgggccctggggagccataggaagcctgtggctggggtggtattgatgctggagctgggccggccgggggcactggcaacttctccagacacctggctggctgctgtgctgtggggccttggggagaaggcagggagcagggctgagcaggcgaggaaggacagcctggcctggccctttggggccatggggaaggaactgggctacacacactgggcctgaggagggaggaggcctgggttcgcagctgctggttttcaggctcgtcacggccacttggtggcagcagaggggtggcttccagacttttcagggacaggcattcgctggctcaaaggagaattgtcttcttgtggctcgtgatcttgttatccagcaccccaagatcctcagagagtacgaagtgtccccgaggctggcagtgaggccacttagtggtatatgctgcaggaaccattggatcaccctgtcacagcttagagtggggcccccagctgtctccctggcaaagatcacagcccccctgcccatggcctcagggggcgccaggattcagggactcccaggtcaatgtcctcccctggtgtctcccggctgccctacccctggctcccactcctgcgtgtctactccccaccgccgcaggctccccaggcctggcggctcggccacacctaggcttctacacttacccgacggtgctcacaagccccactgcctaggcttgacctcctcattcaggttcccaaactctgaacctggctcctcttctcctctccccctgcccgtctacctcagtggcatcagctgcctgaccctgtctctctgtccccgagcctgaagagccacatacctcttcatttgggaactgtcttccctgtccccccaccactgggacaatgccaccacctcccggccagtctcctggcttcccgctctcaaccccttgcaggctgttcgctttccactcagcactggggaacctctttctctttctccagaatctaatgtgatgcaggtggtccccaacttttaacaattttgtaacttggtgcaaaggtgatgcacattcagcagaaactttacttcgagtcccatgcttttccctttcagtgcaggattcaatgagttacatgagataatcagcactgtattccacaataggctttgtgttcaatgcttttgcccaactgtaggctaacacaagtgttctgagcacgtgaatcggatggctttactctcacctctgctggaccttgggccacctgcagatctgatggaggaaggggtactgcctcaacccaaaatacgtcttgcctcgatggccccgcccacctctcttgtctcttctaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgaggtagcacccggctgtctgccaccccagaccccccttctcctcaccccagccccctgcgtgcccgccttagctctgcagcgtccttgtgcttcccctccccagatagaacaggagcggctggacaaggtgtggcccaagctgagggtgctggcccggtcgtctcccaccgacaagcacacactggtcaaaggtagccgagcccccacacccctttcctggggtggccagcccgaggttgtctgcttcctgacaccaaaagccaggttcccaaacaggtccccagggcctgcctaggaagctgggtccatttgtcccattagcccagagcagcagggcaggggcccatgagggaaccagggttcggggagggctagtgactcactccaagtcacacagtgagtctctagaagcagtgggtctagagccagggacccaggattgtgtccccaggccctaaccagatccctatcctcccaccctggccctgtcactcagtgagatttgcttacttatttggggataggagatgatccaggtgacggggagcacagataattgggacagtcaggacggggtaatcccaaagggttttcacagccaacctacccccatagctccctgggcagggctacacagggttgtggtgacagatggccccagccctgccctgccctgatctgtcttccagggattatcgacagcaccactggtgagcagcggcaggtggtggctgtgacaggggatggcaccaacgatgggccggccctcaagaaggcggacgtgggcttcgccatggtaagccacctggtgcccgcccagctcaccacggcagatggggcctgcatctgtcccatggacattagctttgtaccaggaagtgggagccagtgtcggggcaggttacagagtgcctgaaggttctttctttcacatcctggccacttgggcctgcgtgggctctgccagtcgggggacatgtggttaaaggcatctgctgtgatgcccaaggtgacagtgggccccagacatactgtggagaggaaggggaatggggggtgggggctcatcactgatggcattgcccacccccgtcctctctaaatggactctcagccccagatgaggtgagcagagtccccagatgtgctcttcctctgcacttccttcctgttgctcacccactgagcagggtagccctgcagacgccacccacatggctggttgcggcccctcagtggccccacagccactgaacgcagcaacctggtgagcccctctccctgccctaccgaaaaggagtgtcacccagggaacccagcccagtccttcccagcacccgtagcccagaagggagctccagcccaagcttcgagaggtggcagctctcacggggccaggcttggggcagaggagaggactgcgcagcttggcacagctgcagctgcgcctccatgggacagggactcctctgcaaggagccgccccgcccagggtgtccccatgcaggacttcccagggctccttagccagcaagcctctctggagtgctaagaacagaccacgctgcttggtggccacgtggtggcagctgggctttatgtgtaaagctgtgttgatgccatgtcatcagcaccctctgtgtttatgagcaaagcccccccccccaccgtgacatgtgacaacttactgtttgtagtacaagaatgtgttgcattaaaaaaaagcaacaaaaaacagtgctgttcttggctttggggggcggggtgggatgttattcagaaggggagagcagggagccagcccaggcgggccaggtgatcaaggggggctggggaaggggcccccacaaacactctgtgtgagtgtgtgtgtcacccccccagggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggtgggtactgggggctgccatgccccagctaggacacctgggctcaggcctgagggccagattgtgagagtgagggttttgttttctttgctgcagattattttaattgagatcaaattcatatgccaaaaattcaccattttcaagtacataattcagcactcgaatttgtaggacattcaccacgttgtgcaaccattggctctatctagttccagaagattgtcatcatcttaaaaagaaaccctgtgctcttgagcagtcatttccccatttctcccccaaacatcccagcccccggcaaccactcacaggcttcctgggtctatggatttgcctgttccggacatttcattcctatgggatcaaataatatgtggcctcttgtgtctggcatctcgcttagcaccgtgttttcaggctcacacacaccgtagcatagggcaggactttctgccttttcatggcctcataacactccacggcacagactgccacattatgtatgtctgccctgatggacacatggctcgttcccactttttggctcttgtgaatggtgctgccaggagcatctgtgtatgagtttctgcgtgggctatgcgtcccatgggaaccctttctcaacagtcccattttccccattggtgagtgtccagattttcttcaccccgccttagaaagggggtgtttaaattgcctgctgatcaacttggtcttttcaaaacaattttttaaattgagataaaaaatcacataacaaacttcaacagaaccattttaaccttttgaaagtacataactccgaggtttatatccctccactgtctattcccagaacattctcatcaccccaaaaggacacccagaccccgtgagcagtcactctctactccccaaaccccagcccctggcacccactcatctgctttctctctctatggatttgtcagttctggaagtttcctatgaatggaatcagacagtacgtggccttgtgtgtctggcttctgtgaggctgatttttaacgaacaactcagaggagctgagaaggaaggtccagttcagagtttctgcctcctcctgcccctgaggtgcaggagacaaggagagcagccctcactctgttgccccaaatggcagaccccatcgtcgggctgttttgtggtctggggtttttcacctcctgcgagggatttggagcacacctgctgccaggtgagagaagggaggcgggcacgtgacagcccaaagaaaacgccccactagcgtaaaggcgatgtagggatggagatgtctgttttcatgggcatgaaatcctggtgatgtggaccccatgaggagcccccaggagctactgggtttccacccccaaccttcccgggcaggcggcccatggaaaggtgactgcctcctctccataggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggtaggctggccaggggcacccgggaggacttcaggacactgttgccaccacctcgggctcagattctgtctggtgtgtctccacctgtgtctccgcacccagtacggggtgggacgctgcacttcctgactggacagcacacaggggaaggagcagatgggccaggctagcaaccctgcagccaggcctgctggtggcctacagctctttcgcaagcctctcctcccaggccgctgagcagctgagaaacagttcatgtcttgacatcctgcccacggctgtgtagctgtgtagagtaggcagcttctacccagccccagagtggccacggtaaccctaggaacagaacagcccacatttaccctgtgaagattgctcctgtggagtgactggggtgccgtgctggaagctgtgaggtgggtggggggtgaccgcaagagagaggaagaggaggagggcgtccgaggaaagccagccttaagaacttcccttcttaatctcttccttcctgccctcaggctcagggtctggcccctggcccagaggggtctcaggactctggttggttgagcctggggtgggtgtggctgccttgggccttggccgtgagctggaagtggccatcccctgggacaagggacccatctcgggagctacacaccgaagtctcgctcctgagtaatgcgtcatgcgctgagatgactgtgcctgagtggggaatgttgctttccaggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcaggtaggaggggcggctccactcttggcctctgccacttgcaaaaagtggaggtggtgggcttcaagacccctcgtccacccctagtactggcctccccacctccactcccagaaggagccccaccccacctggctttcctgtagcccccgtcctctctgcatgtcggagagggccttcttcatcttccaaacattgccggccttgccctgggtgagcgcgctggcttccagaagggtttcgtgagccctcatcggaacgaagttttctcacagatgctggaaggagtcctccctggctccctctaggtctgccattcccatttctagcacttaattccttggcatgaggctgccataactccagaagtttcttttggagatgacctctgtgcccagtgctgacacactaacctctgcttcccacagtgctgtggacaggctggtcagccccactgtctaggaggggctaagtgttctaaaatatagtgtatttgtagaaaaattgaggtatagtaaggccaaaaggtcaagagacagttgccactgaaagacagtttatgactcagagaccccaagaggaggacacatgccacaccataggggcccacatgggagagcgccaggcaggaggtggggtgtgagagctgtggacaagagcctttgctgtggttccctcggggaggagcaggtgaggcagggctggtaggctcaggactggctaggttgcgtcattgcagcggttccagggcatacgggtgctccctggctgtctggtacctggtcctgggtaatgagtgcaaggggatagtggcccggaatgtgacagtccaacagaggacggggtcagtttgcatttggacagcttgcccctgcaaattggatgcctcccgaggaggcaggaggccaagacaaggtgacctcggcaggttctagggtcctccagaatgaggcatgtccagcgtgcccgcagggtgggtgtcacagcctccgtcttgctgaaaataggagcatggtcagtggagctgggccccactccgaggctggagtcagtaggtgcctggcacccaggggcgctgggggccatgcactgctctgtcatcacgcccccggccttgtggtcctctcgcaaggagcagcccgtgcaactgggggaaccaaccagggtggctgggtcttcaaggggttggaggacaagggtggctcaggagccgcggctggacctgcctctctcccacttgcccttcgcagattgtcatcgtccagtttggcgggaagcccttcagctgctccccactatccacagaacagtggctctggtgcctgtttgttggtgttggggagctggtctggggacaggtgagtgacagccctgcccctcatttcagactgccctgcagacagcttctgtgatgggcccacttgccctaaccctgcttcagagccttggggtcctcaccctaggaagcacactgagggctcaggcctgtgacacaccaggacccagggacaggacgcaagggaaggtgtcagcaaaagaatgcaaaggaacatggctgggatgtgacagggcccaggaaaactgcccgcagctcccctttctatgataagagccaaaaattgccccttccaattgggtgggtagcttgggaaatccccacatattttaaatcaatcaaacagcaccctgatcaataatccatggggcgaaaagaaagtctccagagaaattaggaaatattttgacctgatggaaaggacagagagtcccacatcgagctctgtgggctgcagctgaagccgcacactggcaggtttctaggaccccacaattagatcaggaagaaacagcctgggtatttaggatccgcttatctctgtcttcatcagctccgactgccatagcaaaataccatagactgggaggcttagacaacagacacttactttctcgaagtcccggaggctggatatccaaggccagggagccagcggggccagttcctggtgagggctccttcctggcttgcagacagccgcctcctcactctgtgctcacatggtggacagagggagcaaggtctctggtgtttcctctcctaggagcattaatccagtaggatcagggccccaccttggtgacctcatttaaccttgatcacttccttactccaaatccagccacactgggcactaggacttcaacacatgaactggagagcacagttcagtccatagcattctggcttttcctttttttttttttttttttttttgagacagggtcttgttctgttgcccaatgtggagtgcagtggtacaatcacagctcactgtagcctcgaactcccaggctcaagtgatcctcctatctcagcctcccaagcagctgggaccacaggcacatgccaccacaccaggctaagttttgtattttttgtagagatgtgttgtgccatgttgcccaggctggtcttgaactcctgaactcaagtgatctgcctgcctcagcctcccaaagtgctgggattacaggcgggagccaccatgctcggcctggcttttgtttcttgatctctgtgccggccacaggggctgctgcagctgctgcagatgccagccttcttgctggccccagcattagtgtcctcggggacagcccacccagttcctgtttcattttcagaattctcctttccctctgctactgcacctcacctccgaatcacacttgaacctggttgctccatggagtcccttcacttcccgaaacctggactctaaccacagcccagaggggtgccaggccctcttcttgctcttcaagctcccaggccactggccttctggtccccccaggaatgtggcaccagcctgtagctcggcctctcagggctactgggttgtccttttcatttttaaccttgttcagttacaaagataaaacatgttcaagagaaaaacgaaaagaagggaatctctgtgaaccagtcctcaagtcccctcctggccatgttcgacaaatacactggcatagacacacaagacagacgagacgtcttgctctagaactccagatgcccatcatccctttctgtggcttcccctgcgtccttctagactgttccccccacttcccagtggcctacaatatgcgaagccatgccctctctttactcctgccaggctccttatccagtcaccctttccagctgtcaccctccttgtcacctcccaccctctctagcccccaatgcacaggtcttctctaggctggtgttcctccaggagatgccctctccaggagagactaggccagagctccagctgtcctctcccaggggagttgcgcaaacagcgcctgtgtctcccagcaacggtgtggagcgacatgcagggagtattgtcaaccagggcagctcacccaggccccggtgtccagggcttttcttgcggtggttcacagagccatgctgtggtcacgtggctggcctccatctccagccctctggaggtccagctgttagtgtagcctacggggcacggtccccagccccctgccccactgagccatgctgctctcaagcaggatgttccaggggcttagcgatccctcccaggagcccttgctgcaccgcgttccactcgggccactccctgggccctttggctgaatggagctccatggaggatccgcttatctctgtcttcatcagctctgactgccatagcaaaataccatagactgggaggcttagacaacagacacttactttctcgaagtcccggaggctggcccagagctccacgtactcctgaaaatgcatctcagccccccgggggaacactacgccagttctccaagggctgccagttcccggggggactgctctagctttactccctttgcttagtcacaaaaacaaatgacatcctttggaagaaggaggccggcgtctccctctggagagggaccttacaccaggcagatgctgctcagcctggctctcacggccacttccgtgtggctcccccaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcaggtaagccccgactcgctctcgccctggcacttccaccccaagagggtagaggcaagctggccagcagcagccgagagccggccgtctgcacccgacacccacagggaaaccctttggtcttgctgccaaggtcacaaaagcagctgccagtgtcccctttgccattccgggctgtgcccgctgatggctgtggcactgagatcgcctctccctgacagctccttcagagcccaggcatcccctgtagctaaaggtgtgtgtgggtgactaatggctctctcagaggcacaggccagcaccgtcctcatcactgctggggctcccttcacttggtgggaacggccccaggtcataggcaagtgacagtatcgggaagagaggcccatttcaaacagccaccagcgagctcaaggttcactggttgacactgtaaatgcgatggggagacttcatttgggaagtggactctggccaccgagttggtcctttctggtcatccaaatcaccaagggttagggccggccaagaccaagggcgtcagctgtgttcctctctgaagtcagatggccaccactgccaccagtatcaggcgcttgccagagctaccatgctcccttgttcccatctcctcccggccaacagttttgccagaatgctccagactcgctgtgtctccacacccctccctggaactctcttgtgatcccactacagcctggcctctgcccaccactccccagaaacggcgctcgcctaggcctgcgaggctcccttccggctcgtggggtcgggctgtccctgcatcgttcctgcctgctgtgggcactgcctggagacttgctgtcctcacccgcctggcacccccacctcctgctcagccctcgccccaccctgctgtggcccttgagtgctgaaaatcctggccggggaggaagaaagggcccatggggaccccacctgcggcctggcccctctcccaccgcagcccctgcagcctctccttcatggcctgcccctcccccagcagcctccagagggccacccagcatgcttcacactccacctccttctgcaaggcctgggccaccatctctcaggtcacagccatcactccctgcccctccaggccctgtccaggatccccagttgcaatgcccctgacatggagcgactgaccctcctccctgaggtcctgccagagtaaggacaccactgcacacttggctgcggagccagggcccgcctgagccaccagccccagctcaagcgggaataggcggggcctgaggccacaccccttcccagggtcagtcacacatcaccaagggcctgtcccaaagaatcatccatgcaacttgcacaaagctgttcttggtgccctgggtcctgtgttccctcccagtggtctcaagggccgagtctcaagggacccagcctcagggcaaccccactccctgggcctcagcctcctttgcttgccttggctcagctcagcccctccaacaccaccctctgcagtgggactggtggagcctctctccattgtcctaaggatgaagtctacgctcctgaccatggccttcaagcccctgcctcttggtgtcaccccaaccttcctgcacacctgcacccctgcacccccggctgcctttccaatcatgccctctgcccgcctgtgccactgcacctccccaactcccgctgcgtcccctgggccctcatgcttacaaagccctctttgactcctctcactctcaccacgggctccttgcaaaactttccagagctacagagtcccccagagaccacgatcacgcagggctaggtcaaggggcaacaaagaactccacatttcaagagccccccaggggtccaaggggcctctccagctgagaaccgggaggcgaggctggcatcctaggcaccgaacacagcgtagcctgggaaggatgtgttaggtctggactctgaacactgtcacctatgccctggcctggccagaacacagagagccccggtgaggaaggggagcaggctttgtcgccagatggcctgcgtctcccctcccacgtgcaggggctactgcctcaagcacaatgctcggacaggccaggggtgcagcacagatagtctgttctcgttccctgcaataaatatttctgcgctaaatcttaaacacatcgaatgttagaagcagcattcacatctcccccagtgccctcctagcggcccaactgtgccttctacgagaccatgcctatgggccccccagctgcccccagatgggctcttatctatcgtacccctgttgtgctacagagcccagagctgcccaagcctggggtggggggtgaggacagcaggaccttgcccctcggcggcccacttcactcctgccgccgcagccgaaggcgacgttaggttttccagcagctgagacaacagccctgccctgacctgaagcatcagtggtgtcagtggtaccccggccacctgtgtgtctcgtgtcctctgtatgtgggggccgctgcagcctggctagtagaagcgagtcccatcggtcagagtcttagagttccaggctgttccaattgtcggtgctcacagagacacgggcagctgagtcccctgttttgcgtatgaggaaacagggtgcactctttccccttggcaccagccgatccgactcttccacgggctcctgacccccatggcttttcgctttgactttgtcacatccaactcaccatgtttctcaggaatgctgaaccagtcggttcttttagccagctatgtaagagcatctgctctctttgattcgaaacacctgcttgaaaaatggagctaaagcttgggagaagcccgtcaggttgtacgtatgccccaagccaagaaaaacatttcctaggcagctggccccaggtttctgctttttgggaaccacaaaatcgctccccagattttggaggccggcacaagcttttctgttgctaagtgaaggcattttgtaacctgctcgcaccatggttccatactaacatatcaacgcaccagatggacagggtgtcattccagaataaaagagtccttcaaacccagaacatgtagctttctgaagcgctcatgactcggtctgtcttttttgcatcccattataatgcaaagagaagcttcgtcagcaactgggccttgctcccggctcagctcttgggcttccaggtgtggggtggtggcgactgtggtattgtcactgatgtggctctcccactgggacaccatctgtagccaggccagaccaatgcaaatctgaggcaggaaaggcatctttcctatccctcatcacttttgccgcagcgagagtcctctcctgaatctagacaggagaccccccaccccgcaagccaccgcgacgccatcacatcaaccatcctccttccgtgcgctgacacactcagtatgcattcctcacggtcgcagcaagtgccatgaggttccccttgtgacaagcaagcgagtgggatgtgctgggcggaaggggactgggcaggctgagaagaaggaggagtcctttccacagcgcgtcaaaggctgaagtggcgtacatcctcattttggccggtgcagggggagtctgaacactcaagctgccttcttccacgaagccctggcccgtttcaagacacccaggtgaacctggtggccaccacatagcactgcagggctcgggctggagcaggtagctttgggctccagatgcgcacactggctttgctgttcacatcatctccagtgagacggacatgagtccccatcccagccaagggcaggtcaggaaatccaaagacactgggtcaaggccctcctgcaggcctcagtttccccagccttgcttccccttcaatttgcaggaagctgtaagagtggggacaaagcgaagccacggctgccagtcggtgggaaaaccccctcctccgctaggtccattcttctgctgaagtttcgagggggcgccccctgcccagtcactcagatgagccacagaagctggcggagacgggcaggcggatggagcatggggcataagtcctccgggtttagaggaagcagggcgggttctaataggagcgtgtcatgtccctcaggtgtgttggagaggaaaaacaaggttgagaactatgaagtacttcctgataagtggcttgcaaggggcatttctgacatgtttgcagtgtgccctgacttgtgacccccttcccttcccaatctcatgaccactaaccatctgctcagcaaaccctctctcggtgggtggcacagaggctggcctcagtcagggccctgtccaaacatcgccagctcccagtgagcggggtgacccgatgaggctttgctgtcaccctatgtgcccagtggtggcccctatcctcgcccagccctcccctccgtgatagcctggacaacagtgcaagccaaactttatctcattttctctcccacagatggaggtagtgagtaccttcaagagaagcggttcagttcagggtgctgtgcgccggcggtcttcggtcctcagccagcttcatgacgtaaccaatctttctacccctactcacgcaattctctctgctgccaatcctaccagtgctgctgggagtgagtcttgacttcccttttctctcataaatggcatctctggggaagaataagcctccccagctcggccttctctcttttgcagtcttgcattccgctcaccgtggcttttctgttctttctttaccgccctgtccagtccttcccgcccagacggtgtctctcgaaagccatattcttttatgaaacgtattcaacccatggcacttccggacctcccgttctttgctttgtttggtttttcggtttgtgtttagtgctccttgtgccattggttctcttttcttgaacttgtctgcctttgccgatggttcttcatgaacttgggccgcttctgggggtgtctggtgtcaggctagggccttgctcagtgttcagtggtgcagcatcagggcagcacgcgggctcagggccgccttcccggggctggaggggtggcgggtgcctttcccacactgtttgccacagaagaatctagcccacgtacccaggaactggagcggcgcttccagcatcctccttgaagtggtttcctaaggatgccgctgtcacctgtccccaggtgggctcagtgctgaccaatcactactgcacaggtggtgcctgccctgtaggccttgccccaagccaccgggtgttagaggtttccccagaactggcactcagaggcctcttcaagacgttgccaggaaaatttcccaccatgttggtcacagtttaaagagaacccaggggctgtcctaaggaggtagaaacttccagaattgctcacatctttttacaaagacaaagggaaggccactccaccgctgaccccactaccctgatgggagagaatgcagggaacccagtgggcccagccaggcagcctgctttttccagcaaactcaagagagtttatacaccaaagagtaaactttcgcgcgtgggcccagggcctttgccaggatggttctatgctacctctttcctttccttctagcaagcccccgaagcgctcccctctgccaacacgaacacgccactcccctgcaggtgggagtccttaaccacgcctttttccatcacagactcttccagcttgattgcttttcttttcctttctttttttttttaggaactggtgagaggtccctggtgggggtcacccctcctcttgcataagctgtcattttgggccactctgtcctttaaggaagggaggaggcccatcctgtcccccttgggaacagagcacgtgcgcgcgtacacacacacacacacacacacacacacacacacactccttctccaaaccacaggccacgtacacctccagcttgctccacactcatcatggggccacctacccttgtcacaaatattggctgacaccgtggcagttgggctgaaaagcagtcggcgcctccagtgccctagacgtgggcccaaaggggcctcgccgccactccacccagagaggcggacaggaggctctgccaagtcagttaaagccagaaatggttcgtggcctcccagcaccttccttcctgggagctgagggcagcagggggcatggctgtgcctccgcctccctcccccttgacttcctccgtatgtctctttgccatctctctctgtgcttcctgtctgtctgtccatttgcccatttgttgagttaaggggaaggcagccaccacggccccactccacgcgttcctcgagccttctccacagctctggcctcatcccaccccaggaccagctccttgtccctctccaggtccagcccagcctctgtggggcctgctgtcttttctccctctggattcctcctgcttcctccctggggcagcctcttgctcctctcttccttggctcctagcacttccttcctgccttcattccgtggccatctgtccccctcctccccacctccggagcctggcagtgcggggtaagtagagtgggagagacgccacccctcctgctgttcacaagctattccatgggggccctaagtggcggatagccagaaggagggcagctgtcccttgcacactgtgtgctccagcagaaggtgggtggcagggccctctgaagaggcccatcccagctgaacatcagcatcccagaaaggactctgccgtggaggaagatgctggctggggacctggcaacaccaaggacatgcccacttctggaagccacctgccagaaccacctcctgccatcatcacagtgcagcggattggtttagaactcagaacccaacccccactccacgcttcaaggaccccaagcaatcaccaagcccagcactctcatcctagagatcaggggaaggaggttgtccccaagggccaggacctgcactgggtcccataagcagccaggcctggcagagtggggactagcaccagcgcccaccctctacttggaactttctggtggatgagagatgctctgaaggctgtgacggagctcccctagacaagagggctgccccaactaggcctgcaggggcgtcgagtcacgtggtttcctaaggcaagcccacagtttcccatcctctttgcctgctccaggccaggctgcctttcagcccaccaggagtctggggcctttctgggcactggagctgcctccgtcccaagcctttcctactaaggacctcaggtcctccagagagaagggccggtggttggtagcatgacatcccctcaccctgtgcccctggggccaatgcaggaagtagcaagggggtggctaggaggggtcgagagatttgggatcgctggggctcagtgctcacacactcgagccctccccaccctgtctaacctcccacacctttgctgcttctggactcaggagtcccaacacaggccccatatccctcctctgcatgcattgtcagactgtgccggccacaacttctgacccccagctccaggcagcctccactgcccctcccctgcccagcctggtgactaccccacaccatgccccaaccacacactcacacaccgaggccacagtatcaccctccctgttgggtgtccatattccggagagctggtcagggacagctggttcagtcactcgggtctaccaagggcagcaggcacagggggctgcgcgtctgccactaggaggcacgggagggtgcgcgatcatttggaaagccccatcaaagccacttgagaggccttttatgtctgttttccactgggacacacagacaaaccccagccacgcatccaaagtctatccttccagcagcgccacaccaggcctgtgtgagatgcttactgttggagtcgttcctgagatgcctcctgacctggcccagcaaaggagcaggggttaggcagcaggccatgagtctggtcccatgtggccaccgggggtccctccgggccgtttagttccagttaatcatgctggaaacagatcacagcagttgcttggttttattggctttggcaacatgaaaaccgtgtggccaaaggggccaaaccgggccacgtgagtcccaggctttccctggacactcctttccagggcccagggcgacatgctcaccacactcccagccccgtggtggaaggagtcttgttttctggagtttgctccattctcaggaaggtcatgtgctttgagccaagcctccctacctggtttctgggaacggtgtattggcattttttctcagatctttgacagtctgcaccctgcctccatgctggaagcagtagcaaccctcccccaagagccctgccctaggctttcctggaaccctgggccctaccacaggggaatgcccttccaggcaaaccctaaagtaggcaccagaacgcagcctagggcagaccccaggacccctggtccaaggccctccccatcaggcactccgagtgtggactcccaagctgggaacctgggcagagacctctcaagactaattggaggtcccgcagctggattcagccagtacggaggcaagggctcagctgggccttcctcctgggtcctctttagtccgaccacccgacactgactcgccgcgcccaggtcagttcagcttgctggtgttgggagcacaggtctaggctcacacggtcctgggcatgagtgtgcacacaaggtgggaggcaattttcatgaaacttgccagctgcaagcagttctggcttgccaacacacacacagccatgtcttgtcttttccgttctttggttcaattccttggggaaagagccagctgtggagtttgcattttcattgttcctaattcaagcatgtgacatccccatggggtagaaaggggccttccccttgctcttcccccacatagagaagtgaggccgaagccatcttctcctcagtgttcaggctatctgagcttggcttctcattgcccgagttgactgatggttcctattgccacaggctcttgaggacacctttgtctcgctttcaagttgtgattcaccttcacgcctacaggggttgttttgagcctggaaaccctaaagttcttgacaagaagttccccatgggtctccctggctgctgtgttcagaatctgctctaaattcaaagctcagatgcctggggagctgacaggtccctgcctccaaaggaaggttctggaccagtggttggtgctgagcagtggataggtagggaggaaatcgaccagaagcatccgagttctgtgaaccttagcggctgagactgagcagagagcatggagcccctcgggtcggctggtgcccagcacagaggcagcaggatagggcttgtttctgcttgaggaattagaaggaagagtgagaaggtgtcaggcacagcttctgtcgtttcgttgtcactgcggtcaggagtctttgctttgattgttctcttttcctttcctttttctactcttctcggtccttcgcttgtctccctgcttctgcggcccttctccaccctcatcctcctccccagccctgcactgcaaactccagcacttgaaggctaaccaggggcacgtctccccatgcacatggcgggcacctccactccagctggccggcagtggcatcgcacatggcactccacacctgcaccccttccgctttggctcagtgtggccagggatgggccttgtcagtctgcagcgtcacccgccctgtgtaaggctcagaactgctcatccacgcaagtcgggagcccgggccaagcccacagcactcagcatgtctcctctgggcagctggtaacaaactgcccgggacagcctctctaaggatgcgtacttgagctaagttcagaggaaggagaaaggccagccaggcagcagaaagggcaggggtcatggctccggggagcccctgcgtggggtgttcagaaacagctccagccggctgggcattgcaaagtgggcaaagagctatggggagggccgaagccagcacaggaggctggtgcaaagccgtgtgggccccagacattcagccccgtccactgagcccctgctgggtgcagcgagccagacagacagacccctgccccagggggattaccttccagtgaaaggtggatggatgtagggggcacttgaaggaaggagcagaagtgggcaccatgctgctggggaagacaagagtgaggggagccttcctggtgtggggtgcagccacagcaaaggtccccaggtgggatgtgccggaggctgaggggtaaaagagggcagagtgagaaagactggggccggctccgagggccacagccagtggagggcttgtagcgggggagaccaagacacgctctggttttcgggccgccgtgctaagggcatggaggggtgggggcgaagtgcaggttctggatggcgtttgaagggagccacggggctggggccgggggggttgggcctgctaagtttgagacccagcttagatgcccaagtctggagccggagccgagaggctgttagccgacaggtggaatggaaggccgagagccagaagagagtacctagacccagaggaggggccctcgggtgtcagggatgggagaggaggaggggctggagcagtgtcggacagcgctgggggactgtgaggagtaaaggactgtggcctctcagggccatcagccatgatggggaacggagaagtgtggcagagggagacagcaggaggacacaaggaggtggggacacacagtggggagccacctcgcctcacccggatgagatggggagtcctccagcccaacctgaccctcctaggggcatctctcccggaagagtgctttcatttcctttctttttaaattgtcacagtaaaacgggcttttgggggtacagttcaatgaatttccacacagtcaggacacgggccagttccatcgcctactggaaggtttagagccagatgggggaccaagagtctgacttggcagccagagagagctcggaaactccacctagagaagggacaggaaggatggagggctttgctggtgggggttggggtcccaatgtgaccccagggccccaggcaggacatagcagcagcaatggaggtgaggagaggctcagatgtggaagatgcttttgagttagggtagggcccacaggacacgtggatgtctggtacatagggtcagggggtcaaagtgcctctgaggtttggccagagccctgcactgggatgggaaggctgctggtgggcagagttcagctggagcactgataagagtcctcctcgggcctcctgcaatttgagaggtcccttaggcatccgagggggaacacccgggaggcagccagggcagaagtctggcagtccaggaaaaggtggacatggtgcagctggtatctgcagtatttacggtggcctgatggtctatagacagcattgacagccctgggggccatgagattcctttgggagcagtagggggcgtggcgcgtcctgggctgagagcagagcaggaggcggtgcaggagcctgagatgaggacagagtgaacccaggctggtggaaggagggcatccttgagcacccaggtaggagtgcagccctctgggatgggcctctcttagaaacgtttgttgctttccattgaaccaatctcccaggaatcgactgcatccttcagtgttgggtgggctgaaaacaccccaccttaacaccaacaccaaaacattgtttaatggcccaggattaggatgcagggaaaatagagcctggagaaagctgactcactgtcagctgtaacagactcaccaggactccagccaagcttagcacccccaaacagcagaatgttggggggcagcccttccatcctgcagcggttcactcagtcacttgtgcattccccaagtgtctgctgagcagctgctctgggccaggctctgttgttaagccacaaacaaggcagatgccatccgggaggggcacgctggagtagccggtgagaccggaggagcagtagcagcagaagcccagcctggaaggaagggctggctccgtggcctggctgtcctttatggaggtctttggagttgagccaggtgcagtgagacctgtgcataggtttgagcaggggcctggcctgatcacatgcccccaggtctgaatgaggccaccagctcagcgagatctcaccccacacagccctggggtcaaggcctgcagcactttgtcctttttgtgacttgatgggcaacagctttagcaggcgatgtcccaggcggcttccacaccacaatcctgtaccagaaaaggcctaaataatgaggcaacatctgcattggctacgaaaactgaattctgtttcttttcattaaaaacgtcaaattattctcaatttctgtgttacccctaattcagaaaccagtctggggataaaggcctgagtgagaatagctgaccatctgccgtctggcagatgtggctttcccgaatgcagagaaaatccgaaccagatttcagatggggtgctagaaaattccaatgtggagctttttggcttacttttttttattattattttaaataggaacggggagtatcactctgttgcccaggttggtctcgaacacctgagctcaagcgatcagcccgcctcggcctcccaaagtgctggaattacagccgtggaccaccaaacctggccctggctcactttttgcactggagaggtgatgaggttggcatcatttcagctgattccgaagcactgtgctttgcctagctgagcccctggagggctgaaagaaagtcaccgaaaaaaggtgattaattgtctaaacgacagagccagagaggaaatatttttagctttccaggcctggtctctgctgccgtgacacaactgtgcccttacagcatgaaacttaaaccagtaaaattttattaaccaaaactagcagagagctggggttagcccctcagcaagccctgacaccttgtctaaacccagaaaaccaaatcctaggtcgaaccttggccccagaaatgcttcagaactcctaatgtgtccacctgctcacataggcaggggtggacaggtgttggatgaaccccagggtctgcctggcagctcagcgctccgtctgctgccccctatagggatggcagtacaaggtgggccagctaccattggcggctgtgctgacactggcctgtgcgaggccaggcagaggcctccccatcaactcctggcttctagaagcaggagggggcccaggctgaggggccagggagcaaagagaggcagcaaggacttgagtgcgtgaggcaaggtggagaagccagaggagggaagggctcgctcctggagcagtgccctgccggagggtcagggggcttaagggctgccgtgcgctcagctgggggcagagggccactgtgccgggggagtctggggcacagcgggagctctttcatgcgggaagttccgctgatctgaggtctgcaaactcctgtggggagggatggccagggaacaacacagagcggagcccgggaggcagcagagacgcaagttttggaatgtctgactggaagatggaggaggagacgggagagaggacaggcggagtgaggtcagaagagcaggggcaccagattgaaccagacccagtcagacacgggggctgtgaggaggccacaggggcatctgagcagagacaggctttagtgggtgcaaatcaaaagtgtggccattttcggtctcagatacctccagctggggactgctgggctctctggcctggagctctgagtacaggcctgggccacagtttctggttatagccagatgggccccagcactgtggccagggtggagaggtatggacagagaggaggagggacagagccaggccagagctctggggcacccagggacagaagagagggcagtggaggagatggggccagggcagctggtgaggtggaagagggccaggcaggggcaatgtcaggaagccatgagaagcttccagaaagagggatgatcttctgtgttgagtgccctgagggatcaaatcagacgaagatgcagaagtggccagtggagttagccgcagggagaccctcgacatggcaggtcccggctccagccatgggagctgggggatggagggagacccatgcgagaaaggccggcagtgcccataggctgggaacttgctcataccagcaggtacttcggactttctggtaagatcgagaagacatcccactcaccagcattctctccttttcaaatcatctttcttttctaccaaattggaattcagattgggcagagaccccagaggtcaccaaagccactcgtctccccaggacagggaactgcggggtcacagccaagagcctagtgcagcactctcaagttccagaatacctgcccagctcagcctagagaaagacactgccatcttttcctgcatgcggatcggttgacgagaccaaggcccacacctgaaaactctttccaaaggcaggcagagccatcccattccgtagcagccctccaacaaatgggtggacatttctcatgccatgacccccagccattgacgtgggtggaatttaccagcaccagccggccactgactgtctccttccttccttcctaccttccttccacgtttcctttcctttcccttcctttcctccctccctgctcccacctcgcgccctgtccctccacctcccactccagatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgtctcagcacatgcgcacacgcacactcggactcacacgaagtcacacgcacacatgcacgcacacacacatatggggacctgcacacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggagaaggttcttcgtccaaaggaggaaggagaagaagtagaaagtgcgaagagctgagttccccacctttttttctattgatgcttcttttttaacaaactacagttttaccgtgtgtttgccatttgagctgtgtggtgggcagggggctggtttgggtttatggggagcttttgttgcacccatgcaggggcaatcagatcagcatcttcatgcaaaaaaaaaaaaaaagttgagtgctctgcaggcctgtgaagggtgccacctgagggagccgcctgcaagcggccctgcagccacaaagcaacccgccctctgcaaaaactaggcacatccgcagtgcgcatgtgtgtgcgtgcatgcacatatgtgtatgtgtgtggatctgtacacacacacgtatatatggccagatgcgtatttcaataaggaactatttactggcatgatatttgcattcctcttatcaggcattttcatttggaaatttcattattgaatgtagcaaggttgtagttgtttttttttttttttcagggaactagactgcaagaatatctttctggtcaacccatttttgtccctcatcaccccgcccccacctttcgctcctgccctctgcccggccctactgagattcccaaggagaaggccgagagggggcgctccaggtctggagcaggtataattggagcatttgcactgagacccctgccagagaggagaaaaccctttcaagggaaattttaatctaaaaggaaaaaaccaaaatattgatgagaaggagtcctccagttagtgaaaggggagtttcgttttcagctttctttggttcctactccaattccacatccttcatcctggccatgcccccaccttcaagagcatgaagcactcttggagttgtgggtcctgcccagagtccagagagcagcctcagctgagcacaggtccgagggggcgggggcagggccaagagttcaaaagaagccaatggagggagagggagcgtcagaagcccggaggagctggtggtgggagaatgacggcagggacgcagccacagttcagaccctgtcccctcagcacctggatggactcccactgtttgctttggcaaatgccgaggagtcctcggtagaccaccttgatgtctgctgtgacatcagaggtgccaccaccaaagcactcttcccaccctagtctttgtgtccagcggccaagcttaagccatgaagtcatggatttgtggctcagcaccaggtcctgaggggagcgtatcctggcagtgtgggcacctggtggccaagcctcagtttcccccaaatgagcaaaggggataaagaggggcccgacttttgccaccctcctgaggaagcccctaggtccacacagtgatgccatgggggacccttgccttccacacttgcaggtgtcacgttttgcagggaggtgtttgggccttgggctcagccactgggagacagttgggacctgagggacagaggatcggaatggaaaccaccaacgtgcactggcaccctcagaaggcttgtctcacctccaccggcatccacacaaaaccaaacaggagcaggcgtcatccccactattcccatgaatgccatgtcacccctgagcagaagcagtcaaatcttgggcaaaagaatttcggttagaaaagaaaatcccactttaaaatgccagctgcagataactcaaagccatcccttttttctaaagggcacattgagaatgtcacccatttgtaaactgttccctgatgtccttgtttaaacgataataagaaaaagggcaactccatttgttgagggtctttgtgttcttcaatgagaaatcaaatttgagacgttgaaattggagctgcgtgctgctgcactcaccggcttcttctcactctctgtcgtagacacaccgataggaccaatggccaatagatattaaaagcaaaccctcactgctgctgtataaagttgcctaatgtaaatgtctattgtttagtccctaggtcacctttgtgctgtgctgtggagttcagaaacggggtaccatgacctggaatcttttgctcttgtttttgcagtcttcaaggctgggggccctgtctcattgggaagcccctctttataaagcattatattacttggaatggcttggtcaactgtgttcagttcataaatatgttttacatttttatctgcctgttataaagatgaacaaaaaaacttaatgagaaagatcacagatacgtaataatttaaagtctgtagttgaatttcctaacttaaagaatagaccaaaatttctgtgtataaaaaaaaatgaaaggctccttacatcctg

SEQ ID NO: 4003 - DNA, 62913 bp, human; identical to SEQ ID NO: 3998

SEQ ID NO: 4004 - DNA, 44467 bp, human
tgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggtaagtccctctcaggctgcatgccacccagccctgctcccagccttcagaggagcgacctgaaggcatccttagccccaaggctggccagggtcaagggccacctgtgcccctcctctcagccatttcccttgagggggagatgccctgggtaacctgacctgaccccctcatctccacacctccacaatcaggagttctccgctctatagagcgagactggggagggggagatgggaacttcatgggacacacacacaggcggaatgggccccaaacagaaacccttccgaggaacagggcagggcagggcagggaggaggaagacagccccatctgtatatttggggatttccggtgtgctcaaccctgtgttcacttaagggggatcagaacaggaggaagggatgcagggtgcaagccttcggagtttcgggtgaccggggcctctcctgggaagagagaggatggcctggggatggcacaagccatttgggtctggcaggaaggggtgaccgaagctgggtcacgggaggcccagagtgctgatcagaggtggcactgactggccacaggctgtcccaaagaggcacaagcccagggtagtgtcggtctcactgctgagggaggctctagaaagcccggtgagcactgtctagaaagatctggggcggaggcctgactatccctgtgggaggcaatgttccacccggccttgtgaggcctgcccagccctggttgctgcggtctgccatgaagcggggacccccaggagccaggcccagccccagattccaggagccacagcattctctggcgctgcgtgcctggcagggctgctggggctatcccagcctagtgccaggcctgttccccagccagtgcgggctgatttgatctgctgcccatctgggcaacgcctgggcccacccatctcctctgctcccagccgtgaggctccttggcacctccagcctcccgctctgccctcaccctcaacccagagactgttctcttgtggctccggcctcggccccgtctgtctgcaggtggcactcaggctgcagggaggagtgaagatggaggaggggggctgcgggccaggtcaggaactccagggtctgcctgggtctccctagctttgtgccctggagctgatgcgcccgtgacacccggcctcgccgccgcacacgccctcacggtgcagctgctgctggggctgatgccttggctctgctcccgagcatctcttgccttccctcctccttgcccagcccccgaggaggctgtggagggccatttatccacaagagctctggcctctcccagatcaaaggaagcagatgggcctcagctgtctgctcttcccctgtctgccaggccttgttaaatatttaaaatgtcaaggcccctgggaacctgcccgattctgccatggagctcaggagctcttgcgtgcctgtggaggcaggggcacggagaagggcaggtgcacaggtgggtggcttggcctctgacgggcttccaagcacctgggtccccaaggccacagtgcagggagccggccaggcctggatctgctgcccacagaatgagcagcagaggaccggcccctcccctcttcaaccctcaaggtcctcgggctggagctgtcgggcttgagctgtctgggtgccaggagcgggtgactcgctccccgcatcccctagcccggccgtgcacccggaccctggtgctcagacctgcctgcccctcagtcctcctcagacacaagggcctgagccacgggggcagctggctttgttgtgccccaagccccatgccaatcccctgacaaggtgggcagacgtggggctgcccaggaggcaggcactcccccgtggggcaggtgctttatggcgcatagtgcattgcgggaaggggactttatcttctggcggtacactcatcaatccactgccctccctgtcttgggagcactccaagaggattccagaacccatcctggaaaccgcgctgctgttgtcaggaaacctgggtctcaggctgaactcagaggtgggttcgcccgggaacctggccccgcccagtgcccctctgggctccacaggcagttctggaaaggagggggcggattcgctgggagccgacacgagatgctcctaatccaattctgatggcatctggcctctgctccgggcaggccgcccatctgtgtccatgccaaccggccagcccctgcccccatgccctggacctggactgccctcgggcctgctggggaagcatgtgctcagagccagaggggccgcagctgtgttcctcctccccgtcaatgggtgctgcagtggggcagccgtcgggaccccgagcccacaggaaggctaaggagaaacgagcaaggctacagctgcaagggcaggtcaaggccaagggagaggctggcgagggcgagggagctcctggggaatgggccaggggtcccggctgctctcagggacaaactgggcatgtgaggaggggcaggcaggagagagactcgcatggaggctccaggctaagggcagtggagaccccaggtgtctggggagccctcccctgctcctctccctccgcagaagccccacggttagcacgtgcttcttcttaagtcacttggggggtcttgtactccctagtactgtccccacctggcttagctcctgtaattccaggagacagtcccagtccagagcgaggtgcacacccctcagttgggtccctggtccccagccccctccccaccacccaggagctgaggtcgtgcgttaaccccaggctcccgattggggcaggctcgggcctcagcaagaggcctttggctcctgaagaaacctgagccaggggcagagaggcacggacagctgcggctcttctgggtggggaggacgccatgtggccgtcgcctagctggggtgaatgagccacggttgtgcgggcggcagcttctgttccactgcggccagggctacccctgcccctcctcagaagccccaaggttagcatgcgcctgttctccagtcatctggagggtcttgtgtgccttcccagacccactgtgagtgccccatgggctggggctgggctctctggtcatcccgtccctgcagcagatggcaggcgtgagcccagctgcccagggctgggagctgcaagctgctgtctgtccaccaggtgtcagtgtgggtctggtcacggccgcgacagcactgggcgccgggtgagcgcccgggagggctcctcgggatcagccggggctgagaatcctggggccaagggtggggccagaggagggtgtcatcccacatgcctgccccggtagaaggtggctgagtgggtgtccaggcccggatgccagtcacgcacgtaagcttccagtaccttcaggccaaggaagactgagaagtaagcgtcctcaaggatgacaagtgacagaattggatagggacaggtggctctgattgtgaaggcaaagccaatttgggggcttctgagtggctttgggtgtcattcaagtcgccatgtagacaagctgtgagccctggctgagggatcaaagttggtgctggagttgcattagaaccaaggctgctgggtcctgagggccctgtgctcaccgggtcctgtcgggcagcgtaggttctgtcctgacctgggccacaggccagagctctgactcatggttacagggccctctccacctccggcctcagtggccttgtctgcaccctgcagagagcagctgatgagcagcccagggtgggcagtgtctccccgacccctgcgaggccatgcagcccagaaaaggcttgaagacttcccagtcccctccctcagcaccgtgactccggtttggcttctccccgcctgttccccaccaggaacccactcccattcccgtgcctctctctctcctcgcgtgacaccgttcttcttctttgggtctctggacccaagaacttgcatctcccattagctctcatgctccctccccactgcttcttccccgagaaacttctggaaagtaagcctccgctccctgttgccagcagccacaggcaccctggagactgctgattcctcggcactggccgtgctcatgccccaatccctcgggccctgcccaccctctttgcaggctgtccctgcccccacaggttgggctgtgtgacactgccagtctttgggaccggctggccccatcttacagagctggggaggggggtgttggtgacaagcctgctcagggaattcataggctgggagctagagaggtgtttcctgacaggcacagagccctggcctagtctttggcatctggtgccatcccagcctcccctgattggtggccctccccatgtctccactaaagtcccctggacactcgctctcctccccaggggaccattggctatactcttctgtcctgtctcctagcaacccttgttgacctggacataccctgctgggtcccctctgtgcccccttgttgggtcctgtcccctgccttccagtgccccctcagcggtagtgtggaggtggccaggaaagcacagggacctgggacccgctggagtccaggagcctcctggcctgttttgtcatctgtgtgtcaggaggaggatggctagggactccccatgacagcagccagagagccgcatgctcactcccacgtgcacacccccagcagtctgcagaaaggctcctgtctagagggagagccaggcgctggccagacggccccagagggctgctgccaccccaggagcagtcagtcagggccacataggaggcctgggacacacaaggccgacccgtcccatcccatcctccccttctgtgcttccggggcaccatgcaggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaaggtaaggcccgggggcctgggctggaaggaggaagaggaatggggcttgagatgagggacggtcacaggatggtgatgtctcctccactgcttcccttctgtcctccgcacagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggtgagtgccctggtcttcacccaccctgtcaaggaagctcggctcctgcttctggggagggtgagccagaggagacccccagcacaggttctccccggtggcctgcgtgtcgtcacctgccttaggaggcgggaggtggcgggggtgggggaggtgggggaacacggggcagggcagagtggtttcagacacagcaggcccccgaagaatcaactgtccccacagcctccacggcgggctttcccccctacaaaggatgcaaatgtcctcgttccccagaaggaggagggctcctgagtccctttcccaggcggcccatggcacctgacgggacctcccctggggcagccgggaggaggcggtggggagaaaggcctctgcttcccggtgctctaggcgacctgctgccagccgacggcgtgctcatccaggccaatgacctcaagatcgacgagagctccctgacgggcgagtctgaccacgtgcgcaagtcagctgacaaagatcccatgctgctctcaggtgagggccaccctccgggccagcctggcaccaaggggcgtcagcagccgtgtggcccagcatcctgtccaggctgcctgctgggctcagcctccacctccaccagggccttccagcataaccttcaggttgggaatctgaagactccgcccgtcttgaggcctgatggtggcagctccagccacagggcgaggaagctggccctccaggcccgggagagtgctttgtgtcctgaatgggaagccccaagcggagaggcttgcaggggccagcacagcgctgtgcttctctcaatccagaccctcgacaatatccagtgggggtagtgttccctttccagaaggtttcagcatagtccggtgtttatcccagttggaaacgtagtgtgaaacgggacaggaaggctggaggccctaggtgggccctgtgggcctcggggtctcctccaagccagggaggaggcttcagcctagttttaaggtggacaccgcgtccctgcttccgggagaccctgggagacaggttgtgggcgctgaatgtgtctcccactgggtgatacaaattcctgtctcagtctctgtgttgctgttccaggcactcatgtcatggaaggttctggaagaatggtggtgaccgccgttggcgtgaattcccagacaggcatcatcttcacgctgcttggagctggcggagaggaggaagagaagaaagataagaaaggtagcgcagcagtgccgccagtccctggtgctggtggcggctccttccacgctgcccattctttctttgcgggccggtgccactgggggctcagggagagccagcccaagtgggtgggaggccgggccctctcttttgattctccgtggagactcctcttctgaggatatcccccctgagagccggcaggccaagggcccctccagtgccgtggacggggagtttccctgagaccaccatccccaaaggctccgggatcccatacctacctggacaggaatggcgttagagggacaggagctacggggagcctcatgcttaccctcagggcccgtgcccagtaaggtgccgaggatcccaggccagcgtgggaggcagccagggaggtgggggtcagaggtcagaggaggctgggacaggtgagggccgggcagcccaactgtgggtggtggccctgccctggggcttacaaagctaggcaagcccgagccaggagggcccattcctcgtcctgtggctggagctgccaccatcaggccctgcagcgggcggagtcctcagaccttctaacctgagtactattcagggaggccctgatggacaagattgaatggctgccacagccccttctggctgggcagccttgctctggcctggacttgccttctggcctctcctgcagccaaaacatggtagggagccacacccgcatgggaaagctctgcttcctgccagtgacctccagccagggccctggggccagtgcgcggggtgtgggggcgtgggggcgtggggcgggcagtcagggcccggggaaaaggtcagccctgagcccaaagctccctggaggcagcaaaggagtagctggatgaccctctgtggcctagaagcttcgacgagccctgcctcctggcagcctgggcctgtgtctccctgcaccggctcttctttgtggcaccaagtcctgtagggctcagtgcagtgtctcaccccagtgagtgccctgggggtgcgcaggcagatgggcagccctgggcctcgtctgggctgggctggagtccctaggcctctgtcctgggaagcccagctgcccctgcctgggctgcctcctcatgtcttgcacacaatggccctctcccatcgtccacgggaacccacgctcctctggagtctccagccgcccttctcaggctgctcaccttctctgtaccttaaatgagtgtgtccttcctaactgttccaggcctctcctttcttttttaaattgacaagaccattcagcccctcccaggccccacctggccctcctctccagcaccctcaggctgtcctacttaggagtcagagctagagggcttcctggaggaagagaaccctgagggggccctggagggagagcagcagctggccagctgggtagagggtaccagcaagaccagggggctccctgctcgccctccccgtctctcccgccccatccccattgtttggcgcagcctgccaggtacacgcttaggatacttgccttctacctgcacccaaccccctatttcttgtctcttgaccttgactcctatgcacctttctccaagtgtgcttctcctcctcaccttccccccactcctgtctcttctggcggggcccagccctcctcttccagcaatgctcatcccagacttccccctgcctccctcctccagaggcctcccagggcctgtgtgcaggctgggtccagagtccatgcttccttcgggcccccacggccccaaggctctgccatctcccctgctgtgctgtgcggtcatcgcactgccatcttgtgtccgtgggggtctcccctccctgcaagaagggccctctgtgcccacaggaaccctgggcggagagggcctgatcaatgccccacccctggctgagtagggtcggggggggggccctccctgctccctggggaccccggatcccaaccccaactgcctgggagtgcagatgtggcccccaggaagctcctctaactgcagctctcagaaggggtgactgtgcccaccacctgagcccctggatagggccacttggggcccagcctggccttgcagggctgctgtgtgccggggctcaggctggcactcctgtgctgcagccctgggttgaccaatgacctgaaagcgccccgcagagtcctagcgtctcattcctttgtccctttaaaacacacactggggccaggcacagtggctcatgcctgtaatcccaacactttgagaggtcaaggcaggtgaatcacttgaggtcaggagttggagaccagcctggccaacatggcgaaaccccgtctctattaaaagtacaaaaattaactgggcgtggtggtgtacacctgtagtcccagctacttgggaggctgaggcaggaggatcgcttaaacctgggaggtggaggttgcagtgctcaaacacacacacactgagctaactgctggacgtgactgcagggaaaaccaatccctaggcaagggcagctgggtgctgtctgcctggcttccaggggttaggagccatctaagtgaaccccttgagctggtttgcagggagcagacgtcccgacttggggaggttccagcttccgggaacctcccactgccagccatgtgtgacccagggcccttccaaggctggctttaggggttcactgtagggctgagcttaaggccgaaggggagccctgggcagaggtctggctcaggaatgccagtgttcatggtgaccgtgtgctgggaggtggtgacggggtgagcctggagaggacggggcatgaagaaggccaccagcaatcaggcccctcctccccaccccctctgccacgcggcccccaggctggtgtcctcaagccttcgtgtctgtcatccctcttccattgtaggcaagcagcaggatggggccatggagagtagccagaccaaaggtaacgggcgccgctgcttgggcacaacaagcttggagccctgggggtggggctggtggagggcacagtgttgggggaggttcacctgcctcggtggcaggagcaacacttggagaccaggtgagtgggctggctgcacagtcccgtcccagtgcagagggaggagagagcacacccctggggctgctcagggcatcctggccacagacactgctggcagctcagcccagccacctagaggagaccttagcccagcatgggcataaggatcacctgtgagtgggcgccccgagtccactctggccagatgagaaaactgaggcccagaagggctgactcacctgaagctctgggtcccagtcagtgtgtttcccaggccagcttcctttcagccaagcctgaggacctgggagacagagtggtcggctgagggccagaggcccggctctcctctcagccccggacagctggcaggtgccgacaccctggggccagcatgagcctggctgtgagacgcaggaagcaggagaaggggtgggaggagcggggaggaggccagccgtggcccacggaggacaggagatgtcggccaatgcagcagccagctctaggtgctggagtccatggggaacaaggcaggtcctgaccctcaggaaggtcacaggcagagatgacccaggcaacgccctgtgcggagctgggtttgggagggcagtggggggacagcccgatggctgcagccctgggttgaggaggtggcagcaggtggggcacaaagctggaggggcccagctgggtggggcaattgtgtcctgacgccactgggaagaggagccgtggcgaatggccttgggctggcaagtgaggaggagcaggaggaggcagaggtgatggcggtagtgccaagagccccagtggatcggggaccagagtagtgagggagaaagacgagtctgctctccccaggtcgctgcgtcggtcccggggcagaagagggaggtggggtggccaggattactctgggccgtggagtgggtgcggccagagcttggcagggagggagatgaggaagtgacagaagcagaggagtggggagaggagggagccggagtgggggacacaccaccaccatgtcgagggcagcaaggatgaggagcacaggacccaccagggaagaagggagaggagccgtctgctccaggggagaggcagggagggtgctggagggacagatggagcccgaacaggcgcagggctggctggtgggaggagagtgcatggggcttctgggcctccctaagggaggtaggaggtggctcggacaccagtaagcagatgagtcagctcagggttctggaagattcctcgggccacaggcctctgctctcaggtattatttggggcattccaggaccagtcaccctgtctgtgtgcccaaaagccttgtgctgtgtctgtcctcccttctcccgagagaaccatctctgtcccacctagaacagtgctggagccaccccacccaccccaagagggcctgggcttaggaggcgagagaagggaagctgatagacttggaaataggagagctccactgaatcccgtctcctctctatggtgtggcatgtctttcccccacaaaagccccttataacgccttctccccagccaggcactgaccttggccatggggttcctctgtgtgcagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcaggtagggacagcaggaggtggtgggcccaggccattgactgggcgtggaggatgctgggctcctggagatgagcccaggctgtgtagagcaggtgggaagggatgtggcaggtgatgtgtgggccaggcaggcaagggcacaggccaggccggcagtggccatcagggcctggcgcagcccttccctagtgagcagaagtcccaaaccctcgacgaaagcccgggtcacacactgagccactgcccatgaggtgcccctacccaaggctccaggctctgcccctggcaccctcaaaaggcagctgggggcatgcagggctggtaccccaacttctggggtgcagtgggggattgactcttgctagtcctccccagcggtgcttctcctgccatcagaccacaaagtccactccccaaccccagcagcactccagaagaggccacacagagcccccttgcaaacaggccccagctcacctgctgagccaaacctgggctgtttatcctgaaacgcaaggcaaatctacaaggccttcacaaatgcctccgagaccgtgtccatacctcttcttccctcttcctgtccccctccttccctcacccgtggcaacccctttcgtctcctccccgctctgtggcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaaggtaatcataaaacttacagttgatactgtttacagactcggaaactggggtaagaagtcattgggcgccttggtggcagtataaactggggacgtttgggatagctcaagggaggagaggaggtgccgagcagggacccagggggcagctttgctgatctgtcagctcaggtccctcggcatgagatgggccagaaagcaggcaggcggtgagatacccaggggttcagcatctgcacaatgtgggcagtaggacggaggggctgggaggcagcggggaagcggagaatcagcagagggcccgggacactgggaggcagtgggaggaggtggggggagccaggtgtggggtggtggggtggtggggtggtggggtgggagagctgcagggctggtgggtaactgagagggggctcgggcaggggaggtcccgggtgcgcatcccgcccccaccattggatgaggttgctgatgccttacagcctcgctattggctcagggctgaccaggtgcccagtgggcttagtgccacacgtggagctagctgagcagaacagagtcacgcgatgtttgtgttgacatctctcactcctccaccccaacaagcacctgggccaaatgcccacaccctcgccctttgcagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactagtgagctggggcaggagcgggcgggcagggccgggggcaggagcaggggagggtcctggccagggtgccaggtgagctgttgcaaggtgctcattaggcccccccttgagaacttttgcccatccctggcctcacaggtggctctggctgggaaactgcctgtagctaaggccgaccttcctctgctccctgccgcccacaccctaacaatgtggtgaccacgagggggcagagctggggctccaggggcagcatggagggtggtctcaggcccccagtgcctgctagccctcgtcatcttgcagcctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgagtgagcagcagggaggtgccggggtacgcacggagtttctgattctattgtcgtggtaaaagaggccgaacgtaaaattcaccatttcaaccactttacagtgtacagttgaatggcattaagcacgttcacaatatcatgcaaccgtcaccactacccagttccaaaacacctccatcaacccggaaagaaaccccaggcccatgagcagccctccccacgcccctccccagcctcatgtgcttcctgtctgtatggatttgcctgtctggacatttcctatcaagggactcatacactgtgtggccttttgtgtctggcttctttccttagtgtaaagtttttccgtttccctcagatattagaccttcctttctttttttgttttgttttgttttttccctcaagccatcctcctacgtcagtgtcccccgtagctgggattacatgtgcatgccaccacgcccagcgaattttcaaattttttgtagagctggggtctcctcatgttgcccagggtggtcttgaagtcttgggctcaagcgatccacccacccggcctccctaagtgctaggattacaggaatgagccactgccaccagcccgaacttccattctttctaaggctgagtaatatccattgtatgctaaagagcattgtgttggtccatccatcccttcatctgtctaccagcacgtctaccagcacgtgagtcgtttccaccttttggctgtcacgagtcacgctgctgtgaatattcacgtacaagtttttgtttgaacccatgttttcaattcttttgcgtggacatctaggagaggaatggctgggtcgtggtgtccacgaaactgttttccacaggggcagcaccgtttcacattcccaccagcgacataggagggttccaccttctccccatcttcaacagcacttattttctggtgtgacaatgctgatgggggccatccttgtgggtgtgaggcaatatctcctggtggttttgatctgtgtttccttgatgactaacaacgctgagcctcttttgctgtgctgactggccatttgcctgtcttccttggggaaatgtctgtcctagccctttgctcattgctgagttgggttgtttgtctttttattgttgggctgtaacattttttctgtattctggatcctagatccttatcagctatgcgatttctacacattctgtcccattctgtggcctgtcttcactctcttgatagtgtccttaggtgcacaaatgttttaaatcgtgatgacgtccagttgatctattttcttgttgttgcttagagatgatgaaaattttcttagagatgatgaaaattttctggaattggagactggtgatggtcgtgcagctctgtgactatactaaaaaccatcgaattatctactttaaatgggtggactgtgtggtgcgtgaattatatcccaataaagctattagaacaaagtaagggagagtgcacagcgtcacctccaaatgccctggcttccccactcccactcagccttcccggactccacacccttggccttggcgtctctgtccacaagtcacctcgctcctcatgactgccgtcccagggccctcagggcaaggtcctctgcaggacgcccagggctccccaaaggcccaggcccacgctccttcctgtgttctgcggactggaccaccaagtgcaccctgcctggccgccccacccacagcgctctcccagaactctgccaggtgcagcgctcactgccagggccaggaccacctcctccctggagccatccctgctggtgtgggggcctcagccctctttctgtgcttcttttttggtgggcactgagggacactgaggcactgcggacaaaaggcccagcccagcttcactcccccttactcccatgcctcagtttccctggtggcatggagatcacagaatacttatctctggggaggggtgtgagggttccgtgggtgaatccacatccataggaggctctccgtccacacagcttctgttatgatcatttccttcgtcaccagcctcccatgcagtggcagcacctggcactcacagccccactggcttcttccaccatgcccgcctctgtgaccctcggctcctttgctccctcctctccccacctgaatcctcccaagtcctgtcccttttgagaagctcctggagtcatgagcgctctactgaggctgtggctgcctggacgtggttatagcgattgtccacagacttcagtttttgcccaggttccacccgcttgccctatgaagtctgtggtggagctgccatgagccacatgctcctgcctccctcccggtctctcagcctgcagcagtgcatgagcgtcctggtgccctcaagcaacagaaatggattctcccccagttctggaggccggaagtccaaaagcagggcgtgggcagggccgaagcgcctccaaagcatctcagagaggatgcatcctgcatcctccagcttctggtggtggctgccagtcctcgcgttcctcagcttgcagctgaccctctctaatctctgcctgttgtcacacgcccttctccctgtgtgtctgtgttctcacacggggcactcctctctgataaggaccccagtccttgactaagcccccaatccagtgtgaccagcgctgttccttgttgttctctccccacctccacctcatctctgcccaccccctgcctaggtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtagccaccaccttctctgtgagctgccctggtaactgtgccctctgcccgagcttgtccggactggtaggggcggccttccttcacacacagctgctgcggtccctccgtagtacacttgagccccgtcctgggtgctctcaccctgacacccgcacaaaggctctgtcctgcctgctggaaagcccttcccgcttgacctatgggcccagctcaggctccaccttctaccaggtgagaaggtggcagtggcggagagaccgtcgacatttgggatctgatccacccaggaccgatggactggaggtggtgctgaagcctgaggggacacaggtttggggcacagggtgggcgtttattggttgagggtttggctggggctactctacggtcaggacgtcctgtggcgagctcacagcaaaggtcctggcgggaaagggagcccagaagcatatccccatatggacgatgccaccaggggagtccagatgaggggacctcgagggccgcgtggcagatgccatggccttgacactgggaagtcactttgttgttgaaagatcccagaccctggagagtgtggaggatggccggccccggagggagaatgcaaggcatggggtgcccctctgtctccccagggcctctgcatggcacccacctgtgtcacaagcagggccactgtgaccctgacaacttgtctttgtaggagccaccctgggggtgcaggtgcaacctgggaggagaagcttctgggctctccttcgggagacaggcattcatgtattggatcatgtagcaaaaacactcaattcaaagacagtgcgtctaaacgccagccatggctcatgtcaacagagcagccccgtgccccgaggagaacatggtcactgcgcccagagagggagcacctcgagcttgccctgggagaaaatgggtggtagcggaggacaggggacagaagtccagcgagggaaatgggccccgcaaaggcgggcagcggcatgagtcccgggccccactgagcctgggagagcagaaggagagggtgctggtgaggcgaagcaaggccacacttggggacaggagccatcgagtccctctgttggaccagggagcaactgaagcacagagcagaggaaggaatcttgccagaggggcctggggaatagggacagctcctttccagcttaagagtggctgagagagagtccaaggggtagaccacagtgacagggccaggctgcggaggctgggcagacccccacaaagactggccagcctggtggtggctgaggaggacgcacagaaggcccagcgaagtcctgggtgccggcaacaggcagtaggacacaagggcctcactgaaaccgccagggtgcttggagatgcggcacggctgcagccagaggagggcccgtgaggctgggccctggggagccataggaagcctgtggctggggtggtattgatgctggagctgggccggccgggggcactggcaacttctccagacacctggctggctgctgtgctgtggggccttggggagaaggcagggagcagggctgagcaggcgaggaaggacagcctggcctggccctttggggccatggggaaggaactgggctacacacactgggcctgaggagggaggaggcctgggttcgcagctgctggttttcaggctcgtcacggccacttggtggcagcagaggggtggcttccagacttttcagggacaggcattcgctggctcaaaggagaattgtcttcttgtggctcgtgatcttgttatccagcaccccaagatcctcagagagtacgaagtgtccccgaggctggcagtgaggccacttagtggtatatgctgcaggaaccattggatcaccctgtcacagcttagagtggggcccccagctgtctccctggcaaagatcacagcccccctgcccatggcctcagggggcgccaggattcagggactcccaggtcaatgtcctcccctggtgtctcccggctgccctacccctggctcccactcctgcgtgtctactccccaccgccgcaggctccccaggcctggcggctcggccacacctaggcttctacacttacccgacggtgctcacaagccccactgcctaggcttgacctcctcattcaggttcccaaactctgaacctggctcctcttctcctctccccctgcccgtctacctcagtggcatcagctgcctgaccctgtctctctgtccccgagcctgaagagccacatacctcttcatttgggaactgtcttccctgtccccccaccactgggacaatgccaccacctcccggccagtctcctggcttcccgctctcaaccccttgcaggctgttcgctttccactcagcactggggaacctctttctctttctccagaatctaatgtgatgcaggtggtccccaacttttaacaattttgtaacttggtgcaaaggtgatgcacattcagcagaaactttacttcgagtcccatgcttttccctttcagtgcaggattcaatgagttacatgagataatcagcactgtattccacaataggctttgtgttcaatgcttttgcccaactgtaggctaacacaagtgttctgagcacgtgaatcggatggctttactctcacctctgctggaccttgggccacctgcagatctgatggaggaaggggtactgcctcaacccaaaatacgtcttgcctcgatggccccgcccacctctcttgtctcttctaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgaggtagcacccggctgtctgccaccccagaccccccttctcctcaccccagccccctgcgtgcccgccttagctctgcagcgtccttgtgcttcccctccccagatagaacaggagcggctggacaaggtgtggcccaagctgagggtgctggcccggtcgtctcccaccgacaagcacacactggtcaaaggtagccgagcccccacacccctttcctggggtggccagcccgaggttgtctgcttcctgacaccaaaagccaggttcccaaacaggtccccagggcctgcctaggaagctgggtccatttgtcccattagcccagagcagcagggcaggggcccatgagggaaccagggttcggggagggctagtgactcactccaagtcacacagtgagtctctagaagcagtgggtctagagccagggacccaggattgtgtccccaggccctaaccagatccctatcctcccaccctggccctgtcactcagtgagatttgcttacttatttggggataggagatgatccaggtgacggggagcacagataattgggacagtcaggacggggtaatcccaaagggttttcacagccaacctacccccatagctccctgggcagggctacacagggttgtggtgacagatggccccagccctgccctgccctgatctgtcttccagggattatcgacagcaccactggtgagcagcggcaggtggtggctgtgacaggggatggcaccaacgatgggccggccctcaagaaggcggacgtgggcttcgccatggtaagccacctggtgcccgcccagctcaccacggcagatggggcctgcatctgtcccatggacattagctttgtaccaggaagtgggagccagtgtcggggcaggttacagagtgcctgaaggttctttctttcacatcctggccacttgggcctgcgtgggctctgccagtcgggggacatgtggttaaaggcatctgctgtgatgcccaaggtgacagtgggccccagacatactgtggagaggaaggggaatggggggtgggggctcatcactgatggcattgcccacccccgtcctctctaaatggactctcagccccagatgaggtgagcagagtccccagatgtgctcttcctctgcacttccttcctgttgctcacccactgagcagggtagccctgcagacgccacccacatggctggttgcggcccctcagtggccccacagccactgaacgcagcaacctggtgagcccctctccctgccctaccgaaaaggagtgtcacccagggaacccagcccagtccttcccagcacccgtagcccagaagggagctccagcccaagcttcgagaggtggcagctctcacggggccaggcttggggcagaggagaggactgcgcagcttggcacagctgcagctgcgcctccatgggacagggactcctctgcaaggagccgccccgcccagggtgtccccatgcaggacttcccagggctccttagccagcaagcctctctggagtgctaagaacagaccacgctgcttggtggccacgtggtggcagctgggctttatgtgtaaagctgtgttgatgccatgtcatcagcaccctctgtgtttatgagcaaagcccccccccccaccgtgacatgtgacaacttactgtttgtagtacaagaatgtgttgcattaaaaaaaagcaacaaaaaacagtgctgttcttggctttggggggcggggtgggatgttattcagaaggggagagcagggagccagcccaggcgggccaggtgatcaaggggggctggggaaggggcccccacaaacactctgtgtgagtgtgtgtgtcacccccccagggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggtgggtactgggggctgccatgccccagctaggacacctgggctcaggcctgagggccagattgtgagagtgagggttttgttttctttgctgcagattattttaattgagatcaaattcatatgccaaaaattcaccattttcaagtacataattcagcactcgaatttgtaggacattcaccacgttgtgcaaccattggctctatctagttccagaagattgtcatcatcttaaaaagaaaccctgtgctcttgagcagtcatttccccatttctcccccaaacatcccagcccccggcaaccactcacaggcttcctgggtctatggatttgcctgttccggacatttcattcctatgggatcaaataatatgtggcctcttgtgtctggcatctcgcttagcaccgtgttttcaggctcacacacaccgtagcatagggcaggactttctgccttttcatggcctcataacactccacggcacagactgccacattatgtatgtctgccctgatggacacatggctcgttcccactttttggctcttgtgaatggtgctgccaggagcatctgtgtatgagtttctgcgtgggctatgcgtcccatgggaaccctttctcaacagtcccattttccccattggtgagtgtccagattttcttcaccccgccttagaaagggggtgtttaaattgcctgctgatcaacttggtcttttcaaaacaattttttaaattgagataaaaaatcacataacaaacttcaacagaaccattttaaccttttgaaagtacataactccgaggtttatatccctccactgtctattcccagaacattctcatcaccccaaaaggacacccagaccccgtgagcagtcactctctactccccaaaccccagcccctggcacccactcatctgctttctctctctatggatttgtcagttctggaagtttcctatgaatggaatcagacagtacgtggccttgtgtgtctggcttctgtgaggctgatttttaacgaacaactcagaggagctgagaaggaaggtccagttcagagtttctgcctcctcctgcccctgaggtgcaggagacaaggagagcagccctcactctgttgccccaaatggcagaccccatcgtcgggctgttttgtggtctggggtttttcacctcctgcgagggatttggagcacacctgctgccaggtgagagaagggaggcgggcacgtgacagcccaaagaaaacgccccactagcgtaaaggcgatgtagggatggagatgtctgttttcatgggcatgaaatcctggtgatgtggaccccatgaggagcccccaggagctactgggtttccacccccaaccttcccgggcaggcggcccatggaaaggtgactgcctcctctccataggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggtaggctggccaggggcacccgggaggacttcaggacactgttgccaccacctcgggctcagattctgtctggtgtgtctccacctgtgtctccgcacccagtacggggtgggacgctgcacttcctgactggacagcacacaggggaaggagcagatgggccaggctagcaaccctgcagccaggcctgctggtggcctacagctctttcgcaagcctctcctcccaggccgctgagcagctgagaaacagttcatgtcttgacatcctgcccacggctgtgtagctgtgtagagtaggcagcttctacccagccccagagtggccacggtaaccctaggaacagaacagcccacatttaccctgtgaagattgctcctgtggagtgactggggtgccgtgctggaagctgtgaggtgggtggggggtgaccgcaagagagaggaagaggaggagggcgtccgaggaaagccagccttaagaacttcccttcttaatctcttccttcctgccctcaggctcagggtctggcccctggcccagaggggtctcaggactctggttggttgagcctggggtgggtgtggctgccttgggccttggccgtgagctggaagtggccatcccctgggacaagggacccatctcgggagctacacaccgaagtctcgctcctgagtaatgcgtcatgcgctgagatgactgtgcctgagtggggaatgttgctttccaggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcaggtaggaggggcggctccactcttggcctctgccacttgcaaaaagtggaggtggtgggcttcaagacccctcgtccacccctagtactggcctccccacctccactcccagaaggagccccaccccacctggctttcctgtagcccccgtcctctctgcatgtcggagagggccttcttcatcttccaaacattgccggccttgccctgggtgagcgcgctggcttccagaagggtttcgtgagccctcatcggaacgaagttttctcacagatgctggaaggagtcctccctggctccctctaggtctgccattcccatttctagcacttaattccttggcatgaggctgccataactccagaagtttcttttggagatgacctctgtgcccagtgctgacacactaacctctgcttcccacagtgctgtggacaggctggtcagccccactgtctaggaggggctaagtgttctaaaatatagtgtatttgtagaaaaattgaggtatagtaaggccaaaaggtcaagagacagttgccactgaaagacagtttatgactcagagaccccaagaggaggacacatgccacaccataggggcccacatgggagagcgccaggcaggaggtggggtgtgagagctgtggacaagagcctttgctgtggttccctcggggaggagcaggtgaggcagggctggtaggctcaggactggctaggttgcgtcattgcagcggttccagggcatacgggtgctccctggctgtctggtacctggtcctgggtaatgagtgcaaggggatagtggcccggaatgtgacagtccaacagaggacggggtcagtttgcatttggacagcttgcccctgcaaattggatgcctcccgaggaggcaggaggccaagacaaggtgacctcggcaggttctagggtcctccagaatgaggcatgtccagcgtgcccgcagggtgggtgtcacagcctccgtcttgctgaaaataggagcatggtcagtggagctgggccccactccgaggctggagtcagtaggtgcctggcacccaggggcgctgggggccatgcactgctctgtcatcacgcccccggccttgtggtcctctcgcaaggagcagcccgtgcaactgggggaaccaaccagggtggctgggtcttcaaggggttggaggacaagggtggctcaggagccgcggctggacctgcctctctcccacttgcccttcgcagattgtcatcgtccagtttggcgggaagcccttcagctgctccccactatccacagaacagtggctctggtgcctgtttgttggtgttggggagctggtctggggacaggtgagtgacagccctgcccctcatttcagactgccctgcagacagcttctgtgatgggcccacttgccctaaccctgcttcagagccttggggtcctcaccctaggaagcacactgagggctcaggcctgtgacacaccaggacccagggacaggacgcaagggaaggtgtcagcaaaagaatgcaaaggaacatggctgggatgtgacagggcccaggaaaactgcccgcagctcccctttctatgataagagccaaaaattgccccttccaattgggtgggtagcttgggaaatccccacatattttaaatcaatcaaacagcaccctgatcaataatccatggggcgaaaagaaagtctccagagaaattaggaaatattttgacctgatggaaaggacagagagtcccacatcgagctctgtgggctgcagctgaagccgcacactggcaggtttctaggaccccacaattagatcaggaagaaacagcctgggtatttaggatccgcttatctctgtcttcatcagctccgactgccatagcaaaataccatagactgggaggcttagacaacagacacttactttctcgaagtcccggaggctggatatccaaggccagggagccagcggggccagttcctggtgagggctccttcctggcttgcagacagccgcctcctcactctgtgctcacatggtggacagagggagcaaggtctctggtgtttcctctcctaggagcattaatccagtaggatcagggccccaccttggtgacctcatttaaccttgatcacttccttactccaaatccagccacactgggcactaggacttcaacacatgaactggagagcacagttcagtccatagcattctggcttttcctttttttttttttttttttttttgagacagggtcttgttctgttgcccaatgtggagtgcagtggtacaatcacagctcactgtagcctcgaactcccaggctcaagtgatcctcctatctcagcctcccaagcagctgggaccacaggcacatgccaccacaccaggctaagttttgtattttttgtagagatgtgttgtgccatgttgcccaggctggtcttgaactcctgaactcaagtgatctgcctgcctcagcctcccaaagtgctgggattacaggcgggagccaccatgctcggcctggcttttgtttcttgatctctgtgccggccacaggggctgctgcagctgctgcagatgccagccttcttgctggccccagcattagtgtcctcggggacagcccacccagttcctgtttcattttcagaattctcctttccctctgctactgcacctcacctccgaatcacacttgaacctggttgctccatggagtcccttcacttcccgaaacctggactctaaccacagcccagaggggtgccaggccctcttcttgctcttcaagctcccaggccactggccttctggtccccccaggaatgtggcaccagcctgtagctcggcctctcagggctactgggttgtccttttcatttttaaccttgttcagttacaaagataaaacatgttcaagagaaaaacgaaaagaagggaatctctgtgaaccagtcctcaagtcccctcctggccatgttcgacaaatacactggcatagacacacaagacagacgagacgtcttgctctagaactccagatgcccatcatccctttctgtggcttcccctgcgtccttctagactgttccccccacttcccagtggcctacaatatgcgaagccatgccctctctttactcctgccaggctccttatccagtcaccctttccagctgtcaccctccttgtcacctcccaccctctctagcccccaatgcacaggtcttctctaggctggtgttcctccaggagatgccctctccaggagagactaggccagagctccagctgtcctctcccaggggagttgcgcaaacagcgcctgtgtctcccagcaacggtgtggagcgacatgcagggagtattgtcaaccagggcagctcacccaggccccggtgtccagggcttttcttgcggtggttcacagagccatgctgtggtcacgtggctggcctccatctccagccctctggaggtccagctgttagtgtagcctacggggcacggtccccagccccctgccccactgagccatgctgctctcaagcaggatgttccaggggcttagcgatccctcccaggagcccttgctgcaccgcgttccactcgggccactccctgggccctttggctgaatggagctccatggaggatccgcttatctctgtcttcatcagctctgactgccatagcaaaataccatagactgggaggcttagacaacagacacttactttctcgaagtcccggaggctggcccagagctccacgtactcctgaaaatgcatctcagccccccgggggaacactacgccagttctccaagggctgccagttcccggggggactgctctagctttactccctttgcttagtcacaaaaacaaatgacatcctttggaagaaggaggccggcgtctccctctggagagggaccttacaccaggcagatgctgctcagcctggctctcacggccacttccgtgtggctcccccaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcaggtaagccccgactcgctctcgccctggcacttccaccccaagagggtagaggcaagctggccagcagcagccgagagccggccgtctgcacccgacacccacagggaaaccctttggtcttgctgccaaggtcacaaaagcagctgccagtgtcccctttgccattccgggctgtgcccgctgatggctgtggcactgagatcgcctctccctgacagctccttcagagcccaggcatcccctgtagctaaaggtgtgtgtgggtgactaatggctctctcagaggcacaggccagcaccgtcctcatcactgctggggctcccttcacttggtgggaacggccccaggtcataggcaagtgacagtatcgggaagagaggcccatttcaaacagccaccagcgagctcaaggttcactggttgacactgtaaatgcgatggggagacttcatttgggaagtggactctggccaccgagttggtcctttctggtcatccaaatcaccaagggttagggccggccaagaccaagggcgtcagctgtgttcctctctgaagtcagatggccaccactgccaccagtatcaggcgcttgccagagctaccatgctcccttgttcccatctcctcccggccaacagttttgccagaatgctccagactcgctgtgtctccacacccctccctggaactctcttgtgatcccactacagcctggcctctgcccaccactccccagaaacggcgctcgcctaggcctgcgaggctcccttccggctcgtggggtcgggctgtccctgcatcgttcctgcctgctgtgggcactgcctggagacttgctgtcctcacccgcctggcacccccacctcctgctcagccctcgccccaccctgctgtggcccttgagtgctgaaaatcctggccggggaggaagaaagggcccatggggaccccacctgcggcctggcccctctcccaccgcagcccctgcagcctctccttcatggcctgcccctcccccagcagcctccagagggccacccagcatgcttcacactccacctccttctgcaaggcctgggccaccatctctcaggtcacagccatcactccctgcccctccaggccctgtccaggatccccagttgcaatgcccctgacatggagcgactgaccctcctccctgaggtcctgccagagtaaggacaccactgcacacttggctgcggagccagggcccgcctgagccaccagccccagctcaagcgggaataggcggggcctgaggccacaccccttcccagggtcagtcacacatcaccaagggcctgtcccaaagaatcatccatgcaacttgcacaaagctgttcttggtgccctgggtcctgtgttccctcccagtggtctcaagggccgagtctcaagggacccagcctcagggcaaccccactccctgggcctcagcctcctttgcttgccttggctcagctcagcccctccaacaccaccctctgcagtgggactggtggagcctctctccattgtcctaaggatgaagtctacgctcctgaccatggccttcaagcccctgcctcttggtgtcaccccaaccttcctgcacacctgcacccctgcacccccggctgcctttccaatcatgccctctgcccgcctgtgccactgcacctccccaactcccgctgcgtcccctgggccctcatgcttacaaagccctctttgactcctctcactctcaccacgggctccttgcaaaactttccagagctacagagtcccccagagaccacgatcacgcagggctaggtcaaggggcaacaaagaactccacatttcaagagccccccaggggtccaaggggcctctccagctgagaaccgggaggcgaggctggcatcctaggcaccgaacacagcgtagcctgggaaggatgtgttaggtctggactctgaacactgtcacctatgccctggcctggccagaacacagagagccccggtgaggaaggggagcaggctttgtcgccagatggcctgcgtctcccctcccacgtgcaggggctactgcctcaagcacaatgctcggacaggccaggggtgcagcacagatagtctgttctcgttccctgcaataaatatttctgcgctaaatcttaaacacatcgaatgttagaagcagcattcacatctcccccagtgccctcctagcggcccaactgtgccttctacgagaccatgcctatgggccccccagctgcccccagatgggctcttatctatcgtacccctgttgtgctacagagcccagagctgcccaagcctggggtggggggtgaggacagcaggaccttgcccctcggcggcccacttcactcctgccgccgcagccgaaggcgacgttaggttttccagcagctgagacaacagccctgccctgacctgaagcatcagtggtgtcagtggtaccccggccacctgtgtgtctcgtgtcctctgtatgtgggggccgctgcagcctggctagtagaagcgagtcccatcggtcagagtcttagagttccaggctgttccaattgtcggtgctcacagagacacgggcagctgagtcccctgttttgcgtatgaggaaacagggtgcactctttccccttggcaccagccgatccgactcttccacgggctcctgacccccatggcttttcgctttgactttgtcacatccaactcaccatgtttctcaggaatgctgaaccagtcggttcttttagccagctatgtaagagcatctgctctctttgattcgaaacacctgcttgaaaaatggagctaaagcttgggagaagcccgtcaggttgtacgtatgccccaagccaagaaaaacatttcctaggcagctggccccaggtttctgctttttgggaaccacaaaatcgctccccagattttggaggccggcacaagcttttctgttgctaagtgaaggcattttgtaacctgctcgcaccatggttccatactaacatatcaacgcaccagatggacagggtgtcattccagaataaaagagtccttcaaacccagaacatgtagctttctgaagcgctcatgactcggtctgtcttttttgcatcccattataatgcaaagagaagcttcgtcagcaactgggccttgctcccggctcagctcttgggcttccaggtgtggggtggtggcgactgtggtattgtcactgatgtggctctcccactgggacaccatctgtagccaggccagaccaatgcaaatctgaggcaggaaaggcatctttcctatccctcatcacttttgccgcagcgagagtcctctcctgaatctagacaggagaccccccaccccgcaagccaccgcgacgccatcacatcaaccatcctccttccgtgcgctgacacactcagtatgcattcctcacggtcgcagcaagtgccatgaggttccccttgtgacaagcaagcgagtgggatgtgctgggcggaaggggactgggcaggctgagaagaaggaggagtcctttccacagcgcgtcaaaggctgaagtggcgtacatcctcattttggccggtgcagggggagtctgaacactcaagctgccttcttccacgaagccctggcccgtttcaagacacccaggtgaacctggtggccaccacatagcactgcagggctcgggctggagcaggtagctttgggctccagatgcgcacactggctttgctgttcacatcatctccagtgagacggacatgagtccccatcccagccaagggcaggtcaggaaatccaaagacactgggtcaaggccctcctgcaggcctcagtttccccagccttgcttccccttcaatttgcaggaagctgtaagagtggggacaaagcgaagccacggctgccagtcggtgggaaaaccccctcctccgctaggtccattcttctgctgaagtttcgagggggcgccccctgcccagtcactcagatgagccacagaagctggcggagacgggcaggcggatggagcatggggcataagtcctccgggtttagaggaagcagggcgggttctaataggagcgtgtcatgtccctcaggtgtgttggagaggaaaaacaaggttgagaactatgaagtacttcctgataagtggcttgcaaggggcatttctgacatgtttgcagtgtgccctgacttgtgacccccttcccttcccaatctcatgaccactaaccatctgctcagcaaaccctctctcggtgggtggcacagaggctggcctcagtcagggccctgtccaaacatcgccagctcccagtgagcggggtgacccgatgaggctttgctgtcaccctatgtgcccagtggtggcccctatcctcgcccagccctcccctccgtgatagcctggacaacagtgcaagccaaactttatctcattttctctcccacagatggaggtagtgagtaccttcaagagaagcggttcagttcagggtgctgtgcgccggcggtcttcggtcctcagccagcttcatgacgtaaccaatctttctacccctactcacgcaattctctctgctgccaatcctaccagtgctgctgggagtgagtcttgacttcccttttctctcataaatggcatctctggggaagaataagcctccccagctcggccttctctcttttgcagtcttgcattccgctcaccgtggcttttctgttctttctttaccgccctgtccagtccttcccgcccagacggtgtctctcgaaagccatattcttttatgaaacgtattcaacccatggcacttccggacctcccgttctttgctttgtttggtttttcggtttgtgtttagtgctccttgtgccattggttctcttttcttgaacttgtctgcctttgccgatggttcttcatgaacttgggccgcttctgggggtgtctggtgtcaggctagggccttgctcagtgttcagtggtgcagcatcagggcagcacgcgggctcagggccgccttcccggggctggaggggtggcgggtgcctttcccacactgtttgccacagaagaatctagcccacgtacccaggaactggagcggcgcttccagcatcctccttgaagtggtttcctaaggatgccgctgtcacctgtccccaggtgggctcagtgctgaccaatcactactgcacaggtggtgcctgccctgtaggccttgccccaagccaccgggtgttagaggtttccccagaactggcactcagaggcctcttcaagacgttgccaggaaaatttcccaccatgttggtcacagtttaaagagaacccaggggctgtcctaaggaggtagaaacttccagaattgctcacatctttttacaaagacaaagggaaggccactccaccgctgaccccactaccctgatgggagagaatgcagggaacccagtgggcccagccaggcagcctgctttttccagcaaactcaagagagtttatacaccaaagagtaaactttcgcgcgtgggcccagggcctttgccaggatggttctatgctacctctttcctttccttctagcaagcccccgaagcgctcccctctgccaacacgaacacgccactcccctgcaggtgggagtccttaaccacgcctttttccatcacagactcttccagcttgattgcttttcttttcctttctttttttttttaggaactggtgagaggtccctggtgggggtcacccctcctcttgcataagctgtcattttgggccactctgtcctttaaggaagggaggaggcccatcctgtcccccttgggaacagagcacgtgcgcgcgtacacacacacacacacacacacacacacacacacactccttctccaaaccacaggccacgtacacctccagcttgctccacactcatcatggggccacctacccttgtcacaaatattggctgacaccgtggcagttgggctgaaaagcagtcggcgcctccagtgccctagacgtgggcccaaaggggcctcgccgccactccacccagagaggcggacaggaggctctgccaagtcagttaaagccagaaatggttcgtggcctcccagcaccttccttcctgggagctgagggcagcagggggcatggctgtgcctccgcctccctcccccttgacttcctccgtatgtctctttgccatctctctctgtgcttcctgtctgtctgtccatttgcccatttgttgagttaaggggaaggcagccaccacggccccactccacgcgttcctcgagccttctccacagctctggcctcatcccaccccaggaccagctccttgtccctctccaggtccagcccagcctctgtggggcctgctgtcttttctccctctggattcctcctgcttcctccctggggcagcctcttgctcctctcttccttggctcctagcacttccttcctgccttcattccgtggccatctgtccccctcctccccacctccggagcctggcagtgcggggtaagtagagtgggagagacgccacccctcctgctgttcacaagctattccatgggggccctaagtggcggatagccagaaggagggcagctgtcccttgcacactgtgtgctccagcagaaggtgggtggcagggccctctgaagaggcccatcccagctgaacatcagcatcccagaaaggactctgccgtggaggaagatgctggctggggacctggcaacaccaaggacatgcccacttctggaagccacctgccagaaccacctcctgccatcatcacagtgcagcggattggtttagaactcagaacccaacccccactccacgcttcaaggaccccaagcaatcaccaagcccagcactctcatcctagagatcaggggaaggaggttgtccccaagggccaggacctgcactgggtcccataagcagccaggcctggcagagtggggactagcaccagcgcccaccctctacttggaactttctggtggatgagagatgctctgaaggctgtgacggagctcccctagacaagagggctgccccaactaggcctgcaggggcgtcgagtcacgtggtttcctaaggcaagcccacagtttcccatcctctttgcctgctccaggccaggctgcctttcagcccaccaggagtctggggcctttctgggcactggagctgcctccgtcccaagcctttcctactaaggacctcaggtcctccagagagaagggccggtggttggtagcatgacatcccctcaccctgtgcccctggggccaatgcaggaagtagcaagggggtggctaggaggggtcgagagatttgggatcgctggggctcagtgctcacacactcgagccctccccaccctgtctaacctcccacacctttgctgcttctggactcaggagtcccaacacaggccccatatccctcctctgcatgcattgtcagactgtgccggccacaacttctgacccccagctccaggcagcctccactgcccctcccctgcccagcctggtgactaccccacaccatgccccaaccacacactcacacaccgaggccacagtatcaccctccctgttgggtgtccatattccggagagctggtcagggacagctggttcagtcactcgggtctaccaagggcagcaggcacagggggctgcgcgtctgccactaggaggcacgggagggtgcgcgatcatttggaaagccccatcaaagccacttgagaggccttttatgtctgttttccactgggacacacagacaaaccccagccacgcatccaaagtctatccttccagcagcgccacaccaggcctgtgtgagatgcttactgttggagtcgttcctgagatgcctcctgacctggcccagcaaaggagcaggggttaggcagcaggccatgagtctggtcccatgtggccaccgggggtccctccgggccgtttagttccagttaatcatgctggaaacagatcacagcagttgcttggttttattggctttggcaacatgaaaaccgtgtggccaaaggggccaaaccgggccacgtgagtcccaggctttccctggacactcctttccagggcccagggcgacatgctcaccacactcccagccccgtggtggaaggagtcttgttttctggagtttgctccattctcaggaaggtcatgtgctttgagccaagcctccctacctggtttctgggaacggtgtattggcattttttctcagatctttgacagtctgcaccctgcctccatgctggaagcagtagcaaccctcccccaagagccctgccctaggctttcctggaaccctgggccctaccacaggggaatgcccttccaggcaaaccctaaagtaggcaccagaacgcagcctagggcagaccccaggacccctggtccaaggccctccccatcaggcactccgagtgtggactcccaagctgggaacctgggcagagacctctcaagactaattggaggtcccgcagctggattcagccagtacggaggcaagggctcagctgggccttcctcctgggtcctctttagtccgaccacccgacactgactcgccgcgcccaggtcagttcagcttgctggtgttgggagcacaggtctaggctcacacggtcctgggcatgagtgtgcacacaaggtgggaggcaattttcatgaaacttgccagctgcaagcagttctggcttgccaacacacacacagccatgtcttgtcttttccgttctttggttcaattccttggggaaagagccagctgtggagtttgcattttcattgttcctaattcaagcatgtgacatccccatggggtagaaaggggccttccccttgctcttcccccacatagagaagtgaggccgaagccatcttctcctcagtgttcaggctatctgagcttggcttctcattgcccgagttgactgatggttcctattgccacaggctcttgaggacacctttgtctcgctttcaagttgtgattcaccttcacgcctacaggggttgttttgagcctggaaaccctaaagttcttgacaagaagttccccatgggtctccctggctgctgtgttcagaatctgctctaaattcaaagctcagatgcctggggagctgacaggtccctgcctccaaaggaaggttctggaccagtggttggtgctgagcagtggataggtagggaggaaatcgaccagaagcatccgagttctgtgaaccttagcggctgagactgagcagagagcatggagcccctcgggtcggctggtgcccagcacagaggcagcaggatagggcttgtttctgcttgaggaattagaaggaagagtgagaaggtgtcaggcacagcttctgtcgtttcgttgtcactgcggtcaggagtctttgctttgattgttctcttttcctttcctttttctactcttctcggtccttcgcttgtctccctgcttctgcggcccttctccaccctcatcctcctccccagccctgcactgcaaactccagcacttgaaggctaaccaggggcacgtctccccatgcacatggcgggcacctccactccagctggccggcagtggcatcgcacatggcactccacacctgcaccccttccgctttggctcagtgtggccagggatgggccttgtcagtctgcagcgtcacccgccctgtgtaaggctcagaactgctcatccacgcaagtcgggagcccgggccaagcccacagcactcagcatgtctcctctgggcagctggtaacaaactgcccgggacagcctctctaaggatgcgtacttgagctaagttcagaggaaggagaaaggccagccaggcagcagaaagggcaggggtcatggctccggggagcccctgcgtggggtgttcagaaacagctccagccggctgggcattgcaaagtgggcaaagagctatggggagggccgaagccagcacaggaggctggtgcaaagccgtgtgggccccagacattcagccccgtccactgagcccctgctgggtgcagcgagccagacagacagacccctgccccagggggattaccttccagtgaaaggtggatggatgtagggggcacttgaaggaaggagcagaagtgggcaccatgctgctggggaagacaagagtgaggggagccttcctggtgtggggtgcagccacagcaaaggtccccaggtgggatgtgccggaggctgaggggtaaaagagggcagagtgagaaagactggggccggctccgagggccacagccagtggagggcttgtagcgggggagaccaagacacgctctggttttcgggccgccgtgctaagggcatggaggggtgggggcgaagtgcaggttctggatggcgtttgaagggagccacggggctggggccgggggggttgggcctgctaagtttgagacccagcttagatgcccaagtctggagccggagccgagaggctgttagccgacaggtggaatggaaggccgagagccagaagagagtacctagacccagaggaggggccctcgggtgtcagggatgggagaggaggaggggctggagcagtgtcggacagcgctgggggactgtgaggagtaaaggactgtggcctctcagggccatcagccatgatggggaacggagaagtgtggcagagggagacagcaggaggacacaaggaggtggggacacacagtggggagccacctcgcctcacccggatgagatggggagtcctccagcccaacctgaccctcctaggggcatctctcccggaagagtgctttcatttcctttctttttaaattgtcacagtaaaacgggcttttgggggtacagttcaatgaatttccacacagtcaggacacgggccagttccatcgcctactggaaggtttagagccagatgggggaccaagagtctgacttggcagccagagagagctcggaaactccacctagagaagggacaggaaggatggagggctttgctggtgggggttggggtcccaatgtgaccccagggccccaggcaggacatagcagcagcaatggaggtgaggagaggctcagatgtggaagatgcttttgagttagggtagggcccacaggacacgtggatgtctggtacatagggtcagggggtcaaagtgcctctgaggtttggccagagccctgcactgggatgggaaggctgctggtgggcagagttcagctggagcactgataagagtcctcctcgggcctcctgcaatttgagaggtcccttaggcatccgagggggaacacccgggaggcagccagggcagaagtctggcagtccaggaaaaggtggacatggtgcagctggtatctgcagtatttacggtggcctgatggtctatagacagcattgacagccctgggggccatgagattcctttgggagcagtagggggcgtggcgcgtcctgggctgagagcagagcaggaggcggtgcaggagcctgagatgaggacagagtgaacccaggctggtggaaggagggcatccttgagcacccaggtaggagtgcagccctctgggatgggcctctcttagaaacgtttgttgctttccattgaaccaatctcccaggaatcgactgcatccttcagtgttgggtgggctgaaaacaccccaccttaacaccaacaccaaaacattgtttaatggcccaggattaggatgcagggaaaatagagcctggagaaagctgactcactgtcagctgtaacagactcaccaggactccagccaagcttagcacccccaaacagcagaatgttggggggcagcccttccatcctgcagcggttcactcagtcacttgtgcattccccaagtgtctgctgagcagctgctctgggccaggctctgttgttaagccacaaacaaggcagatgccatccgggaggggcacgctggagtagccggtgagaccggaggagcagtagcagcagaagcccagcctggaaggaagggctggctccgtggcctggctgtcctttatggaggtctttggagttgagccaggtgcagtgagacctgtgcataggtttgagcaggggcctggcctgatcacatgcccccaggtctgaatgaggccaccagctcagcgagatctcaccccacacagccctggggtcaaggcctgcagcactttgtcctttttgtgacttgatgggcaacagctttagcaggcgatgtcccaggcggcttccacaccacaatcctgtaccagaaaaggcctaaataatgaggcaacatctgcattggctacgaaaactgaattctgtttcttttcattaaaaacgtcaaattattctcaatttctgtgttacccctaattcagaaaccagtctggggataaaggcctgagtgagaatagctgaccatctgccgtctggcagatgtggctttcccgaatgcagagaaaatccgaaccagatttcagatggggtgctagaaaattccaatgtggagctttttggcttacttttttttattattattttaaataggaacggggagtatcactctgttgcccaggttggtctcgaacacctgagctcaagcgatcagcccgcctcggcctcccaaagtgctggaattacagccgtggaccaccaaacctggccctggctcactttttgcactggagaggtgatgaggttggcatcatttcagctgattccgaagcactgtgctttgcctagctgagcccctggagggctgaaagaaagtcaccgaaaaaaggtgattaattgtctaaacgacagagccagagaggaaatatttttagctttccaggcctggtctctgctgccgtgacacaactgtgcccttacagcatgaaacttaaaccagtaaaattttattaaccaaaactagcagagagctggggttagcccctcagcaagccctgacaccttgtctaaacccagaaaaccaaatcctaggtcgaaccttggccccagaaatgcttcagaactcctaatgtgtccacctgctcacataggcaggggtggacaggtgttggatgaaccccagggtctgcctggcagctcagcgctccgtctgctgccccctatagggatggcagtacaaggtgggccagctaccattggcggctgtgctgacactggcctgtgcgaggccaggcagaggcctccccatcaactcctggcttctagaagcaggagggggcccaggctgaggggccagggagcaaagagaggcagcaaggacttgagtgcgtgaggcaaggtggagaagccagaggagggaagggctcgctcctggagcagtgccctgccggagggtcagggggcttaagggctgccgtgcgctcagctgggggcagagggccactgtgccgggggagtctggggcacagcgggagctctttcatgcgggaagttccgctgatctgaggtctgcaaactcctgtggggagggatggccagggaacaacacagagcggagcccgggaggcagcagagacgcaagttttggaatgtctgactggaagatggaggaggagacgggagagaggacaggcggagtgaggtcagaagagcaggggcaccagattgaaccagacccagtcagacacgggggctgtgaggaggccacaggggcatctgagcagagacaggctttagtgggtgcaaatcaaaagtgtggccattttcggtctcagatacctccagctggggactgctgggctctctggcctggagctctgagtacaggcctgggccacagtttctggttatagccagatgggccccagcactgtggccagggtggagaggtatggacagagaggaggagggacagagccaggccagagctctggggcacccagggacagaagagagggcagtggaggagatggggccagggcagctggtgaggtggaagagggccaggcaggggcaatgtcaggaagccatgagaagcttccagaaagagggatgatcttctgtgttgagtgccctgagggatcaaatcagacgaagatgcagaagtggccagtggagttagccgcagggagaccctcgacatggcaggtcccggctccagccatgggagctgggggatggagggagacccatgcgagaaaggccggcagtgcccataggctgggaacttgctcataccagcaggtacttcggactttctggtaagatcgagaagacatcccactcaccagcattctctccttttcaaatcatctttcttttctaccaaattggaattcagattgggcagagaccccagaggtcaccaaagccactcgtctccccaggacagggaactgcggggtcacagccaagagcctagtgcagcactctcaagttccagaatacctgcccagctcagcctagagaaagacactgccatcttttcctgcatgcggatcggttgacgagaccaaggcccacacctgaaaactctttccaaaggcaggcagagccatcccattccgtagcagccctccaacaaatgggtggacatttctcatgccatgacccccagccattgacgtgggtggaatttaccagcaccagccggccactgactgtctccttccttccttcctaccttccttccacgtttcctttcctttcccttcctttcctccctccctgctcccacctcgcgccctgtccctccacctcccactccagatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgtctcagcacatgcgcacacgcacactcggactcacacgaagtcacacgcacacatgcacgcacacacacatatggggacctgcacacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggagaaggttcttcgtccaaaggag

SEQ ID NO: 4005 - DNA, 46807 bp, human; identical to SEQ ID NO: 4002

SEQ ID NO: 4006 - DNA, 37028 bp, human
agccaacagtcgctctaaatgggccttactctaactgatggatcctgtctgccctatagcctgttgcattcatgaagacagtgagggttagcagagcaccccgaccccaccctgtcctccaggatggagactccacctcccaggactccaagttcctcccctgtgggccaggcccccattcactcattcctccaggcccccggccacatgcgggactgaccacgcggtagacttcctgccgactccataccacgtgtctcaaagagcttagggcccagctggtgggagacaagctcacagatcatcgcagcgccaagcagagtgaaataggaatgggtcgcgggattatagactcaggcgcaatcagttttggctggggaactggcagagactcctggagaatgttccacttgaattgtgactaagaggattcatcggaggtcagcaggtggagctggaacagagggcgtgcggtcggggctcagagctggcagggctgtgtggctggggtgggagtggggctgggaagtgctcagaaggaatctggccttttgcttgatggggatgggagactgaaacaggggctcgctggagtgatggtgcctgaaccaggaaagtggtgactcacagcagggtcatgaccagttgctggactagagagagacctaagaggtggtccacaggacgtggagcttgcttgctgaggggtggggatcctgcagtggggagggccagcagggccagccgaggagaaggaagttggccccgggaccatggcagaggggaggactgcctccttgcccactgccctccccatgagtcactgtgggtccagtcagacacagccatggctgcaccagtcaggagcagctgtacgacctggtatggttctgtctgggccaccgctgtggggtcaggggcagggaccgggtgggggaggacagagctggccttgggtatgccatggtcagaggagggaggatgagcacatgccaggggagggccaccaggcctcggtgaccgtgccacgaggaacccctgctctgaggaacaagcatttctgtcatggccgtgtgccacccaagagcctaccacacaagccattcactctgtcacccgctgggggcacagagcctgaacctgacagtggcacaaagttgctacatggtgggattgttgaggcatgaggtgactggagctcaggaaggcagggagaaggcgccctggcaggtgcaccgtcacaagcaaaggtcctggggtggggaggggaggctgtctcgagaagacgaggagtccaggtgagagccgaaagctgccattgctgccttgaggggtcagaagtgggacacccagctgtcctctggctctgccacttccccaagccagcctcagtttcccgcatcagaaaagcaagggcaattcgtccacacagcacccccagaaggagcccgcctcacctgggacagcttcgcttgctgtcctggccccctctcctcagctttcactccttctagtcttttccccccaatgcctgtccccagacgccttgcctcacctttgccccagctgcaaccccacagctcttggccctcgggcctgctgttctccctgtcccagctagagagggacggggttagttgaaacttgttgagcacctgtcccagcacatcaagccagtgccaggcatgtagtagctgctcggtgaatatgtgtcaggtgaccaactgcaagacagggcggggagaggtggggagagaggacggcacaggcacatggccatcattttgtccccacatctcccagaagtgaaggctgcttcatgtgcaatgtgtcgcgagagtaaacgcgcaggtgcccacgcttttcaaacatgggtcactgtggatggatgtttcgtgaagtatccaccagggcctctcctgagaataaggccatggacttggccgtgtctgctttggctgcctgagggctttctcccctttcttcagggctctgggccactcgtttccaacggatgcttctgagccaggagcttccccagagacgggggttcagggccctgctgagctgccaggagggctcttggctgatgtcaaggccaggccatgtgcactgaggccatttcagttccatgaggatgtgacaggcttagctcgggccgggaaggagcggagagagaggagctgcagtgggccccgccaaacactgtgatggctgcagaaggggcagcctgggccctagcggatccttgggtaaggtgacggggacagggagagggatgacaactttgcgatgctcggcagagtggggccagggccgtggcctggatgctttcagtgtggggagactttggctccttactttgtcatctggagggaagaagagcgtggaggggagtgggtggcaccatgctgtgggctgggacgttggcagactcaccagcgacctgtggctgctttggctttctcctgtgtaccctctcctcctctcctcctcagccactccctttatcccctccctcttctccctccctccatccccctttccctccctctctttgcctttccgtcttgtccctctctcccctcccctgtttcccacccttcctccgggcctcctcctttcctcgcccctggccccccaggtactctcagggccacagaaaccgtgagccactaaggccacaccagaagaccaccagggactcatggcatgcccgctgcacagggcgcatcttaaccaggcaagagcagggagtgaaccggagtgaacaagcgcaggactggtggtggggcgcgggcaagaccagccactgatcagtcccagcacgctgccctcacttcagcgtgggttcccgaatggatctggggggcagtgacagcctctgcctccagctagctagtgttaaccactgcagggtcctggcaggaggcatcgacacttcccctcccccacctgggcaagccctccaggttctgggcacccatggtgggcaggacccgggagtggcctggctggtggggcctggcagagcatgagggccactggcccagcctgggaggtgatttctgcacttcgagggtcatggcacagactgagtgaagatttgccgagaatattctggaagatgggacctcagttttgtctcaaccactcccctggcttcttctcgcctccatctccccaggtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggtaagtccctctcaggctgcatgccacccagccctgctcccagccttcagaggagcgacctgaaggcatccttagccccaaggctggccagggtcaagggccacctgtgcccctcctctcagccatttcccttgagggggagatgccctgggtaacctgacctgaccccctcatctccacacctccacaatcaggagttctccgctctatagagcgagactggggagggggagatgggaacttcatgggacacacacacaggcggaatgggccccaaacagaaacccttccgaggaacagggcagggcagggcagggaggaggaagacagccccatctgtatatttggggatttccggtgtgctcaaccctgtgttcacttaagggggatcagaacaggaggaagggatgcagggtgcaagccttcggagtttcgggtgaccggggcctctcctgggaagagagaggatggcctggggatggcacaagccatttgggtctggcaggaaggggtgaccgaagctgggtcacgggaggcccagagtgctgatcagaggtggcactgactggccacaggctgtcccaaagaggcacaagcccagggtagtgtcggtctcactgctgagggaggctctagaaagcccggtgagcactgtctagaaagatctggggcggaggcctgactatccctgtgggaggcaatgttccacccggccttgtgaggcctgcccagccctggttgctgcggtctgccatgaagcggggacccccaggagccaggcccagccccagattccaggagccacagcattctctggcgctgcgtgcctggcagggctgctggggctatcccagcctagtgccaggcctgttccccagccagtgcgggctgatttgatctgctgcccatctgggcaacgcctgggcccacccatctcctctgctcccagccgtgaggctccttggcacctccagcctcccgctctgccctcaccctcaacccagagactgttctcttgtggctccggcctcggccccgtctgtctgcaggtggcactcaggctgcagggaggagtgaagatggaggaggggggctgcgggccaggtcaggaactccagggtctgcctgggtctccctagctttgtgccctggagctgatgcgcccgtgacacccggcctcgccgccgcacacgccctcacggtgcagctgctgctggggctgatgccttggctctgctcccgagcatctcttgccttccctcctccttgcccagcccccgaggaggctgtggagggccatttatccacaagagctctggcctctcccagatcaaaggaagcagatgggcctcagctgtctgctcttcccctgtctgccaggccttgttaaatatttaaaatgtcaaggcccctgggaacctgcccgattctgccatggagctcaggagctcttgcgtgcctgtggaggcaggggcacggagaagggcaggtgcacaggtgggtggcttggcctctgacgggcttccaagcacctgggtccccaaggccacagtgcagggagccggccaggcctggatctgctgcccacagaatgagcagcagaggaccggcccctcccctcttcaaccctcaaggtcctcgggctggagctgtcgggcttgagctgtctgggtgccaggagcgggtgactcgctccccgcatcccctagcccggccgtgcacccggaccctggtgctcagacctgcctgcccctcagtcctcctcagacacaagggcctgagccacgggggcagctggctttgttgtgccccaagccccatgccaatcccctgacaaggtgggcagacgtggggctgcccaggaggcaggcactcccccgtggggcaggtgctttatggcgcatagtgcattgcgggaaggggactttatcttctggcggtacactcatcaatccactgccctccctgtcttgggagcactccaagaggattccagaacccatcctggaaaccgcgctgctgttgtcaggaaacctgggtctcaggctgaactcagaggtgggttcgcccgggaacctggccccgcccagtgcccctctgggctccacaggcagttctggaaaggagggggcggattcgctgggagccgacacgagatgctcctaatccaattctgatggcatctggcctctgctccgggcaggccgcccatctgtgtccatgccaaccggccagcccctgcccccatgccctggacctggactgccctcgggcctgctggggaagcatgtgctcagagccagaggggccgcagctgtgttcctcctccccgtcaatgggtgctgcagtggggcagccgtcgggaccccgagcccacaggaaggctaaggagaaacgagcaaggctacagctgcaagggcaggtcaaggccaagggagaggctggcgagggcgagggagctcctggggaatgggccaggggtcccggctgctctcagggacaaactgggcatgtgaggaggggcaggcaggagagagactcgcatggaggctccaggctaagggcagtggagaccccaggtgtctggggagccctcccctgctcctctccctccgcagaagccccacggttagcacgtgcttcttcttaagtcacttggggggtcttgtactccctagtactgtccccacctggcttagctcctgtaattccaggagacagtcccagtccagagcgaggtgcacacccctcagttgggtccctggtccccagccccctccccaccacccaggagctgaggtcgtgcgttaaccccaggctcccgattggggcaggctcgggcctcagcaagaggcctttggctcctgaagaaacctgagccaggggcagagaggcacggacagctgcggctcttctgggtggggaggacgccatgtggccgtcgcctagctggggtgaatgagccacggttgtgcgggcggcagcttctgttccactgcggccagggctacccctgcccctcctcagaagccccaaggttagcatgcgcctgttctccagtcatctggagggtcttgtgtgccttcccagacccactgtgagtgccccatgggctggggctgggctctctggtcatcccgtccctgcagcagatggcaggcgtgagcccagctgcccagggctgggagctgcaagctgctgtctgtccaccaggtgtcagtgtgggtctggtcacggccgcgacagcactgggcgccgggtgagcgcccgggagggctcctcgggatcagccggggctgagaatcctggggccaagggtggggccagaggagggtgtcatcccacatgcctgccccggtagaaggtggctgagtgggtgtccaggcccggatgccagtcacgcacgtaagcttccagtaccttcaggccaaggaagactgagaagtaagcgtcctcaaggatgacaagtgacagaattggatagggacaggtggctctgattgtgaaggcaaagccaatttgggggcttctgagtggctttgggtgtcattcaagtcgccatgtagacaagctgtgagccctggctgagggatcaaagttggtgctggagttgcattagaaccaaggctgctgggtcctgagggccctgtgctcaccgggtcctgtcgggcagcgtaggttctgtcctgacctgggccacaggccagagctctgactcatggttacagggccctctccacctccggcctcagtggccttgtctgcaccctgcagagagcagctgatgagcagcccagggtgggcagtgtctccccgacccctgcgaggccatgcagcccagaaaaggcttgaagacttcccagtcccctccctcagcaccgtgactccggtttggcttctccccgcctgttccccaccaggaacccactcccattcccgtgcctctctctctcctcgcgtgacaccgttcttcttctttgggtctctggacccaagaacttgcatctcccattagctctcatgctccctccccactgcttcttccccgagaaacttctggaaagtaagcctccgctccctgttgccagcagccacaggcaccctggagactgctgattcctcggcactggccgtgctcatgccccaatccctcgggccctgcccaccctctttgcaggctgtccctgcccccacaggttgggctgtgtgacactgccagtctttgggaccggctggccccatcttacagagctggggaggggggtgttggtgacaagcctgctcagggaattcataggctgggagctagagaggtgtttcctgacaggcacagagccctggcctagtctttggcatctggtgccatcccagcctcccctgattggtggccctccccatgtctccactaaagtcccctggacactcgctctcctccccaggggaccattggctatactcttctgtcctgtctcctagcaacccttgttgacctggacataccctgctgggtcccctctgtgcccccttgttgggtcctgtcccctgccttccagtgccccctcagcggtagtgtggaggtggccaggaaagcacagggacctgggacccgctggagtccaggagcctcctggcctgttttgtcatctgtgtgtcaggaggaggatggctagggactccccatgacagcagccagagagccgcatgctcactcccacgtgcacacccccagcagtctgcagaaaggctcctgtctagagggagagccaggcgctggccagacggccccagagggctgctgccaccccaggagcagtcagtcagggccacataggaggcctgggacacacaaggccgacccgtcccatcccatcctccccttctgtgcttccggggcaccatgcaggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaaggtaaggcccgggggcctgggctggaaggaggaagaggaatggggcttgagatgagggacggtcacaggatggtgatgtctcctccactgcttcccttctgtcctccgcacagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggtgagtgccctggtcttcacccaccctgtcaaggaagctcggctcctgcttctggggagggtgagccagaggagacccccagcacaggttctccccggtggcctgcgtgtcgtcacctgccttaggaggcgggaggtggcgggggtgggggaggtgggggaacacggggcagggcagagtggtttcagacacagcaggcccccgaagaatcaactgtccccacagcctccacggcgggctttcccccctacaaaggatgcaaatgtcctcgttccccagaaggaggagggctcctgagtccctttcccaggcggcccatggcacctgacgggacctcccctggggcagccgggaggaggcggtggggagaaaggcctctgcttcccggtgctctaggcgacctgctgccagccgacggcgtgctcatccaggccaatgacctcaagatcgacgagagctccctgacgggcgagtctgaccacgtgcgcaagtcagctgacaaagatcccatgctgctctcaggtgagggccaccctccgggccagcctggcaccaaggggcgtcagcagccgtgtggcccagcatcctgtccaggctgcctgctgggctcagcctccacctccaccagggccttccagcataaccttcaggttgggaatctgaagactccgcccgtcttgaggcctgatggtggcagctccagccacagggcgaggaagctggccctccaggcccgggagagtgctttgtgtcctgaatgggaagccccaagcggagaggcttgcaggggccagcacagcgctgtgcttctctcaatccagaccctcgacaatatccagtgggggtagtgttccctttccagaaggtttcagcatagtccggtgtttatcccagttggaaacgtagtgtgaaacgggacaggaaggctggaggccctaggtgggccctgtgggcctcggggtctcctccaagccagggaggaggcttcagcctagttttaaggtggacaccgcgtccctgcttccgggagaccctgggagacaggttgtgggcgctgaatgtgtctcccactgggtgatacaaattcctgtctcagtctctgtgttgctgttccaggcactcatgtcatggaaggttctggaagaatggtggtgaccgccgttggcgtgaattcccagacaggcatcatcttcacgctgcttggagctggcggagaggaggaagagaagaaagataagaaaggtagcgcagcagtgccgccagtccctggtgctggtggcggctccttccacgctgcccattctttctttgcgggccggtgccactgggggctcagggagagccagcccaagtgggtgggaggccgggccctctcttttgattctccgtggagactcctcttctgaggatatcccccctgagagccggcaggccaagggcccctccagtgccgtggacggggagtttccctgagaccaccatccccaaaggctccgggatcccatacctacctggacaggaatggcgttagagggacaggagctacggggagcctcatgcttaccctcagggcccgtgcccagtaaggtgccgaggatcccaggccagcgtgggaggcagccagggaggtgggggtcagaggtcagaggaggctgggacaggtgagggccgggcagcccaactgtgggtggtggccctgccctggggcttacaaagctaggcaagcccgagccaggagggcccattcctcgtcctgtggctggagctgccaccatcaggccctgcagcgggcggagtcctcagaccttctaacctgagtactattcagggaggccctgatggacaagattgaatggctgccacagccccttctggctgggcagccttgctctggcctggacttgccttctggcctctcctgcagccaaaacatggtagggagccacacccgcatgggaaagctctgcttcctgccagtgacctccagccagggccctggggccagtgcgcggggtgtgggggcgtgggggcgtggggcgggcagtcagggcccggggaaaaggtcagccctgagcccaaagctccctggaggcagcaaaggagtagctggatgaccctctgtggcctagaagcttcgacgagccctgcctcctggcagcctgggcctgtgtctccctgcaccggctcttctttgtggcaccaagtcctgtagggctcagtgcagtgtctcaccccagtgagtgccctgggggtgcgcaggcagatgggcagccctgggcctcgtctgggctgggctggagtccctaggcctctgtcctgggaagcccagctgcccctgcctgggctgcctcctcatgtcttgcacacaatggccctctcccatcgtccacgggaacccacgctcctctggagtctccagccgcccttctcaggctgctcaccttctctgtaccttaaatgagtgtgtccttcctaactgttccaggcctctcctttcttttttaaattgacaagaccattcagcccctcccaggccccacctggccctcctctccagcaccctcaggctgtcctacttaggagtcagagctagagggcttcctggaggaagagaaccctgagggggccctggagggagagcagcagctggccagctgggtagagggtaccagcaagaccagggggctccctgctcgccctccccgtctctcccgccccatccccattgtttggcgcagcctgccaggtacacgcttaggatacttgccttctacctgcacccaaccccctatttcttgtctcttgaccttgactcctatgcacctttctccaagtgtgcttctcctcctcaccttccccccactcctgtctcttctggcggggcccagccctcctcttccagcaatgctcatcccagacttccccctgcctccctcctccagaggcctcccagggcctgtgtgcaggctgggtccagagtccatgcttccttcgggcccccacggccccaaggctctgccatctcccctgctgtgctgtgcggtcatcgcactgccatcttgtgtccgtgggggtctcccctccctgcaagaagggccctctgtgcccacaggaaccctgggcggagagggcctgatcaatgccccacccctggctgagtagggtcggggggggggccctccctgctccctggggaccccggatcccaaccccaactgcctgggagtgcagatgtggcccccaggaagctcctctaactgcagctctcagaaggggtgactgtgcccaccacctgagcccctggatagggccacttggggcccagcctggccttgcagggctgctgtgtgccggggctcaggctggcactcctgtgctgcagccctgggttgaccaatgacctgaaagcgccccgcagagtcctagcgtctcattcctttgtccctttaaaacacacactggggccaggcacagtggctcatgcctgtaatcccaacactttgagaggtcaaggcaggtgaatcacttgaggtcaggagttggagaccagcctggccaacatggcgaaaccccgtctctattaaaagtacaaaaattaactgggcgtggtggtgtacacctgtagtcccagctacttgggaggctgaggcaggaggatcgcttaaacctgggaggtggaggttgcagtgctcaaacacacacacactgagctaactgctggacgtgactgcagggaaaaccaatccctaggcaagggcagctgggtgctgtctgcctggcttccaggggttaggagccatctaagtgaaccccttgagctggtttgcagggagcagacgtcccgacttggggaggttccagcttccgggaacctcccactgccagccatgtgtgacccagggcccttccaaggctggctttaggggttcactgtagggctgagcttaaggccgaaggggagccctgggcagaggtctggctcaggaatgccagtgttcatggtgaccgtgtgctgggaggtggtgacggggtgagcctggagaggacggggcatgaagaaggccaccagcaatcaggcccctcctccccaccccctctgccacgcggcccccaggctggtgtcctcaagccttcgtgtctgtcatccctcttccattgtaggcaagcagcaggatggggccatggagagtagccagaccaaaggtaacgggcgccgctgcttgggcacaacaagcttggagccctgggggtggggctggtggagggcacagtgttgggggaggttcacctgcctcggtggcaggagcaacacttggagaccaggtgagtgggctggctgcacagtcccgtcccagtgcagagggaggagagagcacacccctggggctgctcagggcatcctggccacagacactgctggcagctcagcccagccacctagaggagaccttagcccagcatgggcataaggatcacctgtgagtgggcgccccgagtccactctggccagatgagaaaactgaggcccagaagggctgactcacctgaagctctgggtcccagtcagtgtgtttcccaggccagcttcctttcagccaagcctgaggacctgggagacagagtggtcggctgagggccagaggcccggctctcctctcagccccggacagctggcaggtgccgacaccctggggccagcatgagcctggctgtgagacgcaggaagcaggagaaggggtgggaggagcggggaggaggccagccgtggcccacggaggacaggagatgtcggccaatgcagcagccagctctaggtgctggagtccatggggaacaaggcaggtcctgaccctcaggaaggtcacaggcagagatgacccaggcaacgccctgtgcggagctgggtttgggagggcagtggggggacagcccgatggctgcagccctgggttgaggaggtggcagcaggtggggcacaaagctggaggggcccagctgggtggggcaattgtgtcctgacgccactgggaagaggagccgtggcgaatggccttgggctggcaagtgaggaggagcaggaggaggcagaggtgatggcggtagtgccaagagccccagtggatcggggaccagagtagtgagggagaaagacgagtctgctctccccaggtcgctgcgtcggtcccggggcagaagagggaggtggggtggccaggattactctgggccgtggagtgggtgcggccagagcttggcagggagggagatgaggaagtgacagaagcagaggagtggggagaggagggagccggagtgggggacacaccaccaccatgtcgagggcagcaaggatgaggagcacaggacccaccagggaagaagggagaggagccgtctgctccaggggagaggcagggagggtgctggagggacagatggagcccgaacaggcgcagggctggctggtgggaggagagtgcatggggcttctgggcctccctaagggaggtaggaggtggctcggacaccagtaagcagatgagtcagctcagggttctggaagattcctcgggccacaggcctctgctctcaggtattatttggggcattccaggaccagtcaccctgtctgtgtgcccaaaagccttgtgctgtgtctgtcctcccttctcccgagagaaccatctctgtcccacctagaacagtgctggagccaccccacccaccccaagagggcctgggcttaggaggcgagagaagggaagctgatagacttggaaataggagagctccactgaatcccgtctcctctctatggtgtggcatgtctttcccccacaaaagccccttataacgccttctccccagccaggcactgaccttggccatggggttcctctgtgtgcagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcaggtagggacagcaggaggtggtgggcccaggccattgactgggcgtggaggatgctgggctcctggagatgagcccaggctgtgtagagcaggtgggaagggatgtggcaggtgatgtgtgggccaggcaggcaagggcacaggccaggccggcagtggccatcagggcctggcgcagcccttccctagtgagcagaagtcccaaaccctcgacgaaagcccgggtcacacactgagccactgcccatgaggtgcccctacccaaggctccaggctctgcccctggcaccctcaaaaggcagctgggggcatgcagggctggtaccccaacttctggggtgcagtgggggattgactcttgctagtcctccccagcggtgcttctcctgccatcagaccacaaagtccactccccaaccccagcagcactccagaagaggccacacagagcccccttgcaaacaggccccagctcacctgctgagccaaacctgggctgtttatcctgaaacgcaaggcaaatctacaaggccttcacaaatgcctccgagaccgtgtccatacctcttcttccctcttcctgtccccctccttccctcacccgtggcaacccctttcgtctcctccccgctctgtggcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaaggtaatcataaaacttacagttgatactgtttacagactcggaaactggggtaagaagtcattgggcgccttggtggcagtataaactggggacgtttgggatagctcaagggaggagaggaggtgccgagcagggacccagggggcagctttgctgatctgtcagctcaggtccctcggcatgagatgggccagaaagcaggcaggcggtgagatacccaggggttcagcatctgcacaatgtgggcagtaggacggaggggctgggaggcagcggggaagcggagaatcagcagagggcccgggacactgggaggcagtgggaggaggtggggggagccaggtgtggggtggtggggtggtggggtggtggggtgggagagctgcagggctggtgggtaactgagagggggctcgggcaggggaggtcccgggtgcgcatcccgcccccaccattggatgaggttgctgatgccttacagcctcgctattggctcagggctgaccaggtgcccagtgggcttagtgccacacgtggagctagctgagcagaacagagtcacgcgatgtttgtgttgacatctctcactcctccaccccaacaagcacctgggccaaatgcccacaccctcgccctttgcagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactagtgagctggggcaggagcgggcgggcagggccgggggcaggagcaggggagggtcctggccagggtgccaggtgagctgttgcaaggtgctcattaggcccccccttgagaacttttgcccatccctggcctcacaggtggctctggctgggaaactgcctgtagctaaggccgaccttcctctgctccctgccgcccacaccctaacaatgtggtgaccacgagggggcagagctggggctccaggggcagcatggagggtggtctcaggcccccagtgcctgctagccctcgtcatcttgcagcctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgagtgagcagcagggaggtgccggggtacgcacggagtttctgattctattgtcgtggtaaaagaggccgaacgtaaaattcaccatttcaaccactttacagtgtacagttgaatggcattaagcacgttcacaatatcatgcaaccgtcaccactacccagttccaaaacacctccatcaacccggaaagaaaccccaggcccatgagcagccctccccacgcccctccccagcctcatgtgcttcctgtctgtatggatttgcctgtctggacatttcctatcaagggactcatacactgtgtggccttttgtgtctggcttctttccttagtgtaaagtttttccgtttccctcagatattagaccttcctttctttttttgttttgttttgttttttccctcaagccatcctcctacgtcagtgtcccccgtagctgggattacatgtgcatgccaccacgcccagcgaattttcaaattttttgtagagctggggtctcctcatgttgcccagggtggtcttgaagtcttgggctcaagcgatccacccacccggcctccctaagtgctaggattacaggaatgagccactgccaccagcccgaacttccattctttctaaggctgagtaatatccattgtatgctaaagagcattgtgttggtccatccatcccttcatctgtctaccagcacgtctaccagcacgtgagtcgtttccaccttttggctgtcacgagtcacgctgctgtgaatattcacgtacaagtttttgtttgaacccatgttttcaattcttttgcgtggacatctaggagaggaatggctgggtcgtggtgtccacgaaactgttttccacaggggcagcaccgtttcacattcccaccagcgacataggagggttccaccttctccccatcttcaacagcacttattttctggtgtgacaatgctgatgggggccatccttgtgggtgtgaggcaatatctcctggtggttttgatctgtgtttccttgatgactaacaacgctgagcctcttttgctgtgctgactggccatttgcctgtcttccttggggaaatgtctgtcctagccctttgctcattgctgagttgggttgtttgtctttttattgttgggctgtaacattttttctgtattctggatcctagatccttatcagctatgcgatttctacacattctgtcccattctgtggcctgtcttcactctcttgatagtgtccttaggtgcacaaatgttttaaatcgtgatgacgtccagttgatctattttcttgttgttgcttagagatgatgaaaattttcttagagatgatgaaaattttctggaattggagactggtgatggtcgtgcagctctgtgactatactaaaaaccatcgaattatctactttaaatgggtggactgtgtggtgcgtgaattatatcccaataaagctattagaacaaagtaagggagagtgcacagcgtcacctccaaatgccctggcttccccactcccactcagccttcccggactccacacccttggccttggcgtctctgtccacaagtcacctcgctcctcatgactgccgtcccagggccctcagggcaaggtcctctgcaggacgcccagggctccccaaaggcccaggcccacgctccttcctgtgttctgcggactggaccaccaagtgcaccctgcctggccgccccacccacagcgctctcccagaactctgccaggtgcagcgctcactgccagggccaggaccacctcctccctggagccatccctgctggtgtgggggcctcagccctctttctgtgcttcttttttggtgggcactgagggacactgaggcactgcggacaaaaggcccagcccagcttcactcccccttactcccatgcctcagtttccctggtggcatggagatcacagaatacttatctctggggaggggtgtgagggttccgtgggtgaatccacatccataggaggctctccgtccacacagcttctgttatgatcatttccttcgtcaccagcctcccatgcagtggcagcacctggcactcacagccccactggcttcttccaccatgcccgcctctgtgaccctcggctcctttgctccctcctctccccacctgaatcctcccaagtcctgtcccttttgagaagctcctggagtcatgagcgctctactgaggctgtggctgcctggacgtggttatagcgattgtccacagacttcagtttttgcccaggttccacccgcttgccctatgaagtctgtggtggagctgccatgagccacatgctcctgcctccctcccggtctctcagcctgcagcagtgcatgagcgtcctggtgccctcaagcaacagaaatggattctcccccagttctggaggccggaagtccaaaagcagggcgtgggcagggccgaagcgcctccaaagcatctcagagaggatgcatcctgcatcctccagcttctggtggtggctgccagtcctcgcgttcctcagcttgcagctgaccctctctaatctctgcctgttgtcacacgcccttctccctgtgtgtctgtgttctcacacggggcactcctctctgataaggaccccagtccttgactaagcccccaatccagtgtgaccagcgctgttccttgttgttctctccccacctccacctcatctctgcccaccccctgcctaggtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtagccaccaccttctctgtgagctgccctggtaactgtgccctctgcccgagcttgtccggactggtaggggcggccttccttcacacacagctgctgcggtccctccgtagtacacttgagccccgtcctgggtgctctcaccctgacacccgcacaaaggctctgtcctgcctgctggaaagcccttcccgcttgacctatgggcccagctcaggctccaccttctaccaggtgagaaggtggcagtggcggagagaccgtcgacatttgggatctgatccacccaggaccgatggactggaggtggtgctgaagcctgaggggacacaggtttggggcacagggtgggcgtttattggttgagggtttggctggggctactctacggtcaggacgtcctgtggcgagctcacagcaaaggtcctggcgggaaagggagcccagaagcatatccccatatggacgatgccaccaggggagtccagatgaggggacctcgagggccgcgtggcagatgccatggccttgacactgggaagtcactttgttgttgaaagatcccagaccctggagagtgtggaggatggccggccccggagggagaatgcaaggcatggggtgcccctctgtctccccagggcctctgcatggcacccacctgtgtcacaagcagggccactgtgaccctgacaacttgtctttgtaggagccaccctgggggtgcaggtgcaacctgggaggagaagcttctgggctctccttcgggagacaggcattcatgtattggatcatgtagcaaaaacactcaattcaaagacagtgcgtctaaacgccagccatggctcatgtcaacagagcagccccgtgccccgaggagaacatggtcactgcgcccagagagggagcacctcgagcttgccctgggagaaaatgggtggtagcggaggacaggggacagaagtccagcgagggaaatgggccccgcaaaggcgggcagcggcatgagtcccgggccccactgagcctgggagagcagaaggagagggtgctggtgaggcgaagcaaggccacacttggggacaggagccatcgagtccctctgttggaccagggagcaactgaagcacagagcagaggaaggaatcttgccagaggggcctggggaatagggacagctcctttccagcttaagagtggctgagagagagtccaaggggtagaccacagtgacagggccaggctgcggaggctgggcagacccccacaaagactggccagcctggtggtggctgaggaggacgcacagaaggcccagcgaagtcctgggtgccggcaacaggcagtaggacacaagggcctcactgaaaccgccagggtgcttggagatgcggcacggctgcagccagaggagggcccgtgaggctgggccctggggagccataggaagcctgtggctggggtggtattgatgctggagctgggccggccgggggcactggcaacttctccagacacctggctggctgctgtgctgtggggccttggggagaaggcagggagcagggctgagcaggcgaggaaggacagcctggcctggccctttggggccatggggaaggaactgggctacacacactgggcctgaggagggaggaggcctgggttcgcagctgctggttttcaggctcgtcacggccacttggtggcagcagaggggtggcttccagacttttcagggacaggcattcgctggctcaaaggagaattgtcttcttgtggctcgtgatcttgttatccagcaccccaagatcctcagagagtacgaagtgtccccgaggctggcagtgaggccacttagtggtatatgctgcaggaaccattggatcaccctgtcacagcttagagtggggcccccagctgtctccctggcaaagatcacagcccccctgcccatggcctcagggggcgccaggattcagggactcccaggtcaatgtcctcccctggtgtctcccggctgccctacccctggctcccactcctgcgtgtctactccccaccgccgcaggctccccaggcctggcggctcggccacacctaggcttctacacttacccgacggtgctcacaagccccactgcctaggcttgacctcctcattcaggttcccaaactctgaacctggctcctcttctcctctccccctgcccgtctacctcagtggcatcagctgcctgaccctgtctctctgtccccgagcctgaagagccacatacctcttcatttgggaactgtcttccctgtccccccaccactgggacaatgccaccacctcccggccagtctcctggcttcccgctctcaaccccttgcaggctgttcgctttccactcagcactggggaacctctttctctttctccagaatctaatgtgatgcaggtggtccccaacttttaacaattttgtaacttggtgcaaaggtgatgcacattcagcagaaactttacttcgagtcccatgcttttccctttcagtgcaggattcaatgagttacatgagataatcagcactgtattccacaataggctttgtgttcaatgcttttgcccaactgtaggctaacacaagtgttctgagcacgtgaatcggatggctttactctcacctctgctggaccttgggccacctgcagatctgatggaggaaggggtactgcctcaacccaaaatacgtcttgcctcgatggccccgcccacctctcttgtctcttctaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgaggtagcacccggctgtctgccaccccagaccccccttctcctcaccccagccccctgcgtgcccgccttagctctgcagcgtccttgtgcttcccctccccagatagaacaggagcggctggacaaggtgtggcccaagctgagggtgctggcccggtcgtctcccaccgacaagcacacactggtcaaaggtagccgagcccccacacccctttcctggggtggccagcccgaggttgtctgcttcctgacaccaaaagccaggttcccaaacaggtccccagggcctgcctaggaagctgggtccatttgtcccattagcccagagcagcagggcaggggcccatgagggaaccagggttcggggagggctagtgactcactccaagtcacacagtgagtctctagaagcagtgggtctagagccagggacccaggattgtgtccccaggccctaaccagatccctatcctcccaccctggccctgtcactcagtgagatttgcttacttatttggggataggagatgatccaggtgacggggagcacagataattgggacagtcaggacggggtaatcccaaagggttttcacagccaacctacccccatagctccctgggcagggctacacagggttgtggtgacagatggccccagccctgccctgccctgatctgtcttccagggattatcgacagcaccactggtgagcagcggcaggtggtggctgtgacaggggatggcaccaacgatgggccggccctcaagaaggcggacgtgggcttcgccatggtaagccacctggtgcccgcccagctcaccacggcagatggggcctgcatctgtcccatggacattagctttgtaccaggaagtgggagccagtgtcggggcaggttacagagtgcctgaaggttctttctttcacatcctggccacttgggcctgcgtgggctctgccagtcgggggacatgtggttaaaggcatctgctgtgatgcccaaggtgacagtgggccccagacatactgtggagaggaaggggaatggggggtgggggctcatcactgatggcattgcccacccccgtcctctctaaatggactctcagccccagatgaggtgagcagagtccccagatgtgctcttcctctgcacttccttcctgttgctcacccactgagcagggtagccctgcagacgccacccacatggctggttgcggcccctcagtggccccacagccactgaacgcagcaacctggtgagcccctctccctgccctaccgaaaaggagtgtcacccagggaacccagcccagtccttcccagcacccgtagcccagaagggagctccagcccaagcttcgagaggtggcagctctcacggggccaggcttggggcagaggagaggactgcgcagcttggcacagctgcagctgcgcctccatgggacagggactcctctgcaaggagccgccccgcccagggtgtccccatgcaggacttcccagggctccttagccagcaagcctctctggagtgctaagaacagaccacgctgcttggtggccacgtggtggcagctgggctttatgtgtaaagctgtgttgatgccatgtcatcagcaccctctgtgtttatgagcaaagcccccccccccaccgtgacatgtgacaacttactgtttgtagtacaagaatgtgttgcattaaaaaaaagcaacaaaaaacagtgctgttcttggctttggggggcggggtgggatgttattcagaaggggagagcagggagccagcccaggcgggccaggtgatcaaggggggctggggaaggggcccccacaaacactctgtgtgagtgtgtgtgtcacccccccagggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggtgggtactgggggctgccatgccccagctaggacacctgggctcaggcctgagggccagattgtgagagtgagggttttgttttctttgctgcagattattttaattgagatcaaattcatatgccaaaaattcaccattttcaagtacataattcagcactcgaatttgtaggacattcaccacgttgtgcaaccattggctctatctagttccagaagattgtcatcatcttaaaaagaaaccctgtgctcttgagcagtcatttccccatttctcccccaaacatcccagcccccggcaaccactcacaggcttcctgggtctatggatttgcctgttccggacatttcattcctatgggatcaaataatatgtggcctcttgtgtctggcatctcgcttagcaccgtgttttcaggctcacacacaccgtagcatagggcaggactttctgccttttcatggcctcataacactccacggcacagactgccacattatgtatgtctgccctgatggacacatggctcgttcccactttttggctcttgtgaatggtgctgccaggagcatctgtgtatgagtttctgcgtgggctatgcgtcccatgggaaccctttctcaacagtcccattttccccattggtgagtgtccagattttcttcaccccgccttagaaagggggtgtttaaattgcctgctgatcaacttggtcttttcaaaacaattttttaaattgagataaaaaatcacataacaaacttcaacagaaccattttaaccttttgaaagtacataactccgaggtttatatccctccactgtctattcccagaacattctcatcaccccaaaaggacacccagaccccgtgagcagtcactctctactccccaaaccccagcccctggcacccactcatctgctttctctctctatggatttgtcagttctggaagtttcctatgaatggaatcagacagtacgtggccttgtgtgtctggcttctgtgaggctgatttttaacgaacaactcagaggagctgagaaggaaggtccagttcagagtttctgcctcctcctgcccctgaggtgcaggagacaaggagagcagccctcactctgttgccccaaatggcagaccccatcgtcgggctgttttgtggtctggggtttttcacctcctgcgagggatttggagcacacctgctgccaggtgagagaagggaggcgggcacgtgacagcccaaagaaaacgccccactagcgtaaaggcgatgtagggatggagatgtctgttttcatgggcatgaaatcctggtgatgtggaccccatgaggagcccccaggagctactgggtttccacccccaaccttcccgggcaggcggcccatggaaaggtgactgcctcctctccataggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggtaggctggccaggggcacccgggaggacttcaggacactgttgccaccacctcgggctcagattctgtctggtgtgtctccacctgtgtctccgcacccagtacggggtgggacgctgcacttcctgactggacagcacacaggggaaggagcagatgggccaggctagcaaccctgcagccaggcctgctggtggcctacagctctttcgcaagcctctcctcccaggccgctgagcagctgagaaacagttcatgtcttgacatcctgcccacggctgtgtagctgtgtagagtaggcagcttctacccagccccagagtggccacggtaaccctaggaacagaacagcccacatttaccctgtgaagattgctcctgtggagtgactggggtgccgtgctggaagctgtgaggtgggtggggggtgaccgcaagagagaggaagaggaggagggcgtccgaggaaagccagccttaagaacttcccttcttaatctcttccttcctgccctcaggctcagggtctggcccctggcccagaggggtctcaggactctggttggttgagcctggggtgggtgtggctgccttgggccttggccgtgagctggaagtggccatcccctgggacaagggacccatctcgggagctacacaccgaagtctcgctcctgagtaatgcgtcatgcgctgagatgactgtgcctgagtggggaatgttgctttccaggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcaggtaggaggggcggctccactcttggcctctgccacttgcaaaaagtggaggtggtgggcttcaagacccctcgtccacccctagtactggcctccccacctccactcccagaaggagccccaccccacctggctttcctgtagcccccgtcctctctgcatgtcggagagggccttcttcatcttccaaacattgccggccttgccctgggtgagcgcgctggcttccagaagggtttcgtgagccctcatcggaacgaagttttctcacagatgctggaaggagtcctccctggctccctctaggtctgccattcccatttctagcacttaattccttggcatgaggctgccataactccagaagtttcttttggagatgacctctgtgcccagtgctgacacactaacctctgcttcccacagtgctgtggacaggctggtcagccccactgtctaggaggggctaagtgttctaaaatatagtgtatttgtagaaaaattgaggtatagtaaggccaaaaggtcaagagacagttgccactgaaagacagtttatgactcagagaccccaagaggaggacacatgccacaccataggggcccacatgggagagcgccaggcaggaggtggggtgtgagagctgtggacaagagcctttgctgtggttccctcggggaggagcaggtgaggcagggctggtaggctcaggactggctaggttgcgtcattgcagcggttccagggcatacgggtgctccctggctgtctggtacctggtcctgggtaatgagtgcaaggggatagtggcccggaatgtgacagtccaacagaggacggggtcagtttgcatttggacagcttgcccctgcaaattggatgcctcccgaggaggcaggaggccaagacaaggtgacctcggcaggttctagggtcctccagaatgaggcatgtccagcgtgcccgcagggtgggtgtcacagcctccgtcttgctgaaaataggagcatggtcagtggagctgggccccactccgaggctggagtcagtaggtgcctggcacccaggggcgctgggggccatgcactgctctgtcatcacgcccccggccttgtggtcctctcgcaaggagcagcccgtgcaactgggggaaccaaccagggtggctgggtcttcaaggggttggaggacaagggtggctcaggagccgcggctggacctgcctctctcccacttgcccttcgcagattgtcatcgtccagtttggcgggaagcccttcagctgctccccactatccacagaacagtggctctggtgcctgtttgttggtgttggggagctggtctggggacaggtgagtgacagccctgcccctcatttcagactgccctgcagacagcttctgtgatgggcccacttgccctaaccctgcttcagagccttggggtcctcaccctaggaagcacactgagggctcaggcctgtgacacaccaggacccagggacaggacgcaagggaaggtgtcagcaaaagaatgcaaaggaacatggctgggatgtgacagggcccaggaaaactgcccgcagctcccctttctatgataagagccaaaaattgccccttccaattgggtgggtagcttgggaaatccccacatattttaaatcaatcaaacagcaccctgatcaataatccatggggcgaaaagaaagtctccagagaaattaggaaatattttgacctgatggaaaggacagagagtcccacatcgagctctgtgggctgcagctgaagccgcacactggcaggtttctaggaccccacaattagatcaggaagaaacagcctgggtatttaggatccgcttatctctgtcttcatcagctccgactgccatagcaaaataccatagactgggaggcttagacaacagacacttactttctcgaagtcccggaggctggatatccaaggccagggagccagcggggccagttcctggtgagggctccttcctggcttgcagacagccgcctcctcactctgtgctcacatggtggacagagggagcaaggtctctggtgtttcctctcctaggagcattaatccagtaggatcagggccccaccttggtgacctcatttaaccttgatcacttccttactccaaatccagccacactgggcactaggacttcaacacatgaactggagagcacagttcagtccatagcattctggcttttcctttttttttttttttttttttttgagacagggtcttgttctgttgcccaatgtggagtgcagtggtacaatcacagctcactgtagcctcgaactcccaggctcaagtgatcctcctatctcagcctcccaagcagctgggaccacaggcacatgccaccacaccaggctaagttttgtattttttgtagagatgtgttgtgccatgttgcccaggctggtcttgaactcctgaactcaagtgatctgcctgcctcagcctcccaaagtgctgggattacaggcgggagccaccatgctcggcctggcttttgtttcttgatctctgtgccggccacaggggctgctgcagctgctgcagatgccagccttcttgctggccccagcattagtgtcctcggggacagcccacccagttcctgtttcattttcagaattctcctttccctctgctactgcacctcacctccgaatcacacttgaacctggttgctccatggagtcccttcacttcccgaaacctggactctaaccacagcccagaggggtgccaggccctcttcttgctcttcaagctcccaggccactggccttctggtccccccaggaatgtggcaccagcctgtagctcggcctctcagggctactgggttgtccttttcatttttaaccttgttcagttacaaagataaaacatgttcaagagaaaaacgaaaagaagggaatctctgtgaaccagtcctcaagtcccctcctggccatgttcgacaaatacactggcatagacacacaagacagacgagacgtcttgctctagaactccagatgcccatcatccctttctgtggcttcccctgcgtccttctagactgttccccccacttcccagtggcctacaatatgcgaagccatgccctctctttactcctgccaggctccttatccagtcaccctttccagctgtcaccctccttgtcacctcccaccctctctagcccccaatgcacaggtcttctctaggctggtgttcctccaggagatgccctctccaggagagactaggccagagctccagctgtcctctcccaggggagttgcgcaaacagcgcctgtgtctcccagcaacggtgtggagcgacatgcagggagtattgtcaaccagggcagctcacccaggccccggtgtccagggcttttcttgcggtggttcacagagccatgctgtggtcacgtggctggcctccatctccagccctctggaggtccagctgttagtgtagcctacggggcacggtccccagccccctgccccactgagccatgctgctctcaagcaggatgttccaggggcttagcgatccctcccaggagcccttgctgcaccgcgttccactcgggccactccctgggccctttggctgaatggagctccatggaggatccgcttatctctgtcttcatcagctctgactgccatagcaaaataccatagactgggaggcttagacaacagacacttactttctcgaagtcccggaggctggcccagagctccacgtactcctgaaaatgcatctcagccccccgggggaacactacgccagttctccaagggctgccagttcccggggggactgctctagctttactccctttgcttagtcacaaaaacaaatgacatcctttggaagaaggaggccggcgtctccctctggagagggaccttacaccaggcagatgctgctcagcctggctctcacggccacttccgtgtggctcccccaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcaggtaagccccgactcgctctcgccctggcacttccaccccaagagggtagaggcaagctggccagcagcagccgagagccggccgtctgcacccgacacccacagggaaaccctttggtcttgctgccaaggtcacaaaagcagctgccagtgtcccctttgccattccgggctgtgcccgctgatggctgtggcactgagatcgcctctccctgacagctccttcagagcccaggcatcccctgtagctaaaggtgtgtgtgggtgactaatggctctctcagaggcacaggccagcaccgtcctcatcactgctggggctcccttcacttggtgggaacggccccaggtcataggcaagtgacagtatcgggaagagaggcccatttcaaacagccaccagcgagctcaaggttcactggttgacactgtaaatgcgatggggagacttcatttgggaagtggactctggccaccgagttggtcctttctggtcatccaaatcaccaagggttagggccggccaagaccaagggcgtcagctgtgttcctctctgaagtcagatggccaccactgccaccagtatcaggcgcttgccagagctaccatgctcccttgttcccatctcctcccggccaacagttttgccagaatgctccagactcgctgtgtctccacacccctccctggaactctcttgtgatcccactacagcctggcctctgcccaccactccccagaaacggcgctcgcctaggcctgcgaggctcccttccggctcgtggggtcgggctgtccctgcatcgttcctgcctgctgtgggcactgcctggagacttgctgtcctcacccgcctggcacccccacctcctgctcagccctcgccccaccctgctgtggcccttgagtgctgaaaatcctggccggggaggaagaaagggcccatggggaccccacctgcggcctggcccctctcccaccgcagcccctgcagcctctccttcatggcctgcccctcccccagcagcctccagagggccacccagcatgcttcacactccacctccttctgcaaggcctgggccaccatctctcaggtcacagccatcactccctgcccctccaggccctgtccaggatccccagttgcaatgcccctgacatggagcgactgaccctcctccctgaggtcctgccagagtaaggacaccactgcacacttggctgcggagccagggcccgcctgagccaccagccccagctcaagcgggaataggcggggcctgaggccacaccccttcccagggtcagtcacacatcaccaagggcctgtcccaaagaatcatccatgcaacttgcacaaagctgttcttggtgccctgggtcctgtgttccctcccagtggtctcaagggccgagtctcaagggacccagcctcagggcaaccccactccctgggcctcagcctcctttgcttgccttggctcagctcagcccctccaacaccaccctctgcagtgggactggtggagcctctctccattgtcctaaggatgaagtctacgctcctgaccatggccttcaagcccctgcctcttggtgtcaccccaaccttcctgcacacctgcacccctgcacccccggctgcctttccaatcatgccctctgcccgcctgtgccactgcacctccccaactcccgctgcgtcccctgggccctcatgcttacaaagccctctttgactcctctcactctcaccacgggctccttgcaaaactttccagagctacagagtcccccagagaccacgatcacgcagggctaggtcaaggggcaacaaagaactccacatttcaagagccccccaggggtccaaggggcctctccagctgagaaccgggaggcgaggctggcatcctaggcaccgaacacagcgtagcctgggaaggatgtgttaggtctggactctgaacactgtcacctatgccctggcctggccagaacacagagagccccggtgaggaaggggagcaggctttgtcgccagatggcctgcgtctcccctcccacgtgcaggggctactgcctcaagcacaatgctcggacaggccaggggtgcagcacagatagtctgttctcgttccctgcaataaatatttctgcgctaaatcttaaacacatcgaatgttagaagcagcattcacatctcccccagtgccctcctagcggcccaactgtgccttctacgagaccatgcctatgggccccccagctgcccccagatgggctcttatctatcgtacccctgttgtgctacagagcccagagctgcccaagcctggggtggggggtgaggacagcaggaccttgcccctcggcggcccacttcactcctgccgccgcagccgaaggcgacgttaggttttccagcagctgagacaacagccctgccctgacctgaagcatcagtggtgtcagtggtaccccggccacctgtgtgtctcgtgtcctctgtatgtgggggccgctgcagcctggctagtagaagcgagtcccatcggtcagagtcttagagttccaggctgttccaattgtcggtgctcacagagacacgggcagctgagtcccctgttttgcgtatgaggaaacagggtgcactctttccccttggcaccagccgatccgactcttccacgggctcctgacccccatggcttttcgctttgactttgtcacatccaactcaccatgtttctcaggaatgctgaaccagtcggttcttttagccagctatgtaagagcatctgctctctttgattcgaaacacctgcttgaaaaatggagctaaagcttgggagaagcccgtcaggttgtacgtatgccccaagccaagaaaaacatttcctaggcagctggccccaggtttctgctttttgggaaccacaaaatcgctccccagattttggaggccggcacaagcttttctgttgctaagtgaaggcattttgtaacctgctcgcaccatggttccatactaacatatcaacgcaccagatggacagggtgtcattccagaataaaagagtccttcaaacccagaacatgtagctttctgaagcgctcatgactcggtctgtcttttttgcatcccattataatgcaaagagaagcttcgtcagcaactgggccttgctcccggctcagctcttgggcttccaggtgtggggtggtggcgactgtggtattgtcactgatgtggctctcccactgggacaccatctgtagccaggccagaccaatgcaaatctgaggcaggaaaggcatctttcctatccctcatcacttttgccgcagcgagagtcctctcctgaatctagacaggagaccccccaccccgcaagccaccgcgacgccatcacatcaaccatcctccttccgtgcgctgacacactcagtatgcattcctcacggtcgcagcaagtgccatgaggttccccttgtgacaagcaagcgagtgggatgtgctgggcggaaggggactgggcaggctgagaagaaggaggagtcctttccacagcgcgtcaaaggctgaagtggcgtacatcctcattttggccggtgcagggggagtctgaacactcaagctgccttcttccacgaagccctggcccgtttcaagacacccaggtgaacctggtggccaccacatagcactgcagggctcgggctggagcaggtagctttgggctccagatgcgcacactggctttgctgttcacatcatctccagtgagacggacatgagtccccatcccagccaagggcaggtcaggaaatccaaagacactgggtcaaggccctcctgcaggcctcagtttccccagccttgcttccccttcaatttgcaggaagctgtaagagtggggacaaagcgaagccacggctgccagtcggtgggaaaaccccctcctccgctaggtccattcttctgctgaagtttcgagggggcgccccctgcccagtcactcagatgagccacagaagctggcggagacgggcaggcggatggagcatggggcataagtcctccgggtttagaggaagcagggcgggttctaataggagcgtgtcatgtccctcaggtgtgttggagaggaaaaacaaggttgagaactatgaagtacttcctgataagtggcttgcaaggggcatttctgacatgtttgcagtgtgccctgacttgtgacccccttcccttcccaatctcatgaccactaaccatctgctcagcaaaccctctctcggtgggtggcacagaggctggcctcagtcagggccctgtccaaacatcgccagctcccagtgagcggggtgacccgatgaggctttgctgtcaccctatgtgcccagtggtggcccctatcctcgcccagccctcccctccgtgatagcctggacaacagtgcaagccaaactttatctcattttctctcccacagatggaggtagtgagtaccttcaagagaagcggttcagttcagggtgctgtgcgccggcggtcttcggtcctcagccagcttcatgacgtaaccaatctttctacccctactcacgcaattctctctgctgccaatcctaccagtgctgctgggagtgagtcttgacttcccttttctctcataaatggcatctctggggaagaataagcctccccagctcggccttctctcttttgcagtcttgcattccgctcaccgtggcttttctgttctttctttaccgccctgtccagtccttcccgcccagacggtgtctctcgaaagccatattcttttatgaaacgtattcaacccatggca

SEQ ID NO: 4007 - DNA, 65263 bp, human; identical to SEQ ID NO: 3999

SEQ ID NO: 4008 - DNA, 3878 bp, human
ggcaggtggtggctgtgacaggggatggcaccaacgatgggccggccctcaagaaggcggacgtgggcttcgccatggtaagccacctggtgcccgcccagctcaccacggcagatggggcctgcatctgtcccatggacattagctttgtaccaggaagtgggagccagtgtcggggcaggttacagagtgcctgaaggttctttctttcacatcctggccacttgggcctgcgtgggctctgccagtcgggggacatgtggttaaaggcatctgctgtgatgcccaaggtgacagtgggccccagacatactgtggagaggaaggggaatggggggtgggggctcatcactgatggcattgcccacccccgtcctctctaaatggactctcagccccagatgaggtgagcagagtccccagatgtgctcttcctctgcacttccttcctgttgctcacccactgagcagggtagccctgcagacgccacccacatggctggttgcggcccctcagtggccccacagccactgaacgcagcaacctggtgagcccctctccctgccctaccgaaaaggagtgtcacccagggaacccagcccagtccttcccagcacccgtagcccagaagggagctccagcccaagcttcgagaggtggcagctctcacggggccaggcttggggcagaggagaggactgcgcagcttggcacagctgcagctgcgcctccatgggacagggactcctctgcaaggagccgccccgcccagggtgtccccatgcaggacttcccagggctccttagccagcaagcctctctggagtgctaagaacagaccacgctgcttggtggccacgtggtggcagctgggctttatgtgtaaagctgtgttgatgccatgtcatcagcaccctctgtgtttatgagcaaagcccccccccccaccgtgacatgtgacaacttactgtttgtagtacaagaatgtgttgcattaaaaaaaagcaacaaaaaacagtgctgttcttggctttggggggcggggtgggatgttattcagaaggggagagcagggagccagcccaggcgggccaggtgatcaaggggggctggggaaggggcccccacaaacactctgtgtgagtgtgtgtgtcacccccccagggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggtgggtactgggggctgccatgccccagctaggacacctgggctcaggcctgagggccagattgtgagagtgagggttttgttttctttgctgcagattattttaattgagatcaaattcatatgccaaaaattcaccattttcaagtacataattcagcactcgaatttgtaggacattcaccacgttgtgcaaccattggctctatctagttccagaagattgtcatcatcttaaaaagaaaccctgtgctcttgagcagtcatttccccatttctcccccaaacatcccagcccccggcaaccactcacaggcttcctgggtctatggatttgcctgttccggacatttcattcctatgggatcaaataatatgtggcctcttgtgtctggcatctcgcttagcaccgtgttttcaggctcacacacaccgtagcatagggcaggactttctgccttttcatggcctcataacactccacggcacagactgccacattatgtatgtctgccctgatggacacatggctcgttcccactttttggctcttgtgaatggtgctgccaggagcatctgtgtatgagtttctgcgtgggctatgcgtcccatgggaaccctttctcaacagtcccattttccccattggtgagtgtccagattttcttcaccccgccttagaaagggggtgtttaaattgcctgctgatcaacttggtcttttcaaaacaattttttaaattgagataaaaaatcacataacaaacttcaacagaaccattttaaccttttgaaagtacataactccgaggtttatatccctccactgtctattcccagaacattctcatcaccccaaaaggacacccagaccccgtgagcagtcactctctactccccaaaccccagcccctggcacccactcatctgctttctctctctatggatttgtcagttctggaagtttcctatgaatggaatcagacagtacgtggccttgtgtgtctggcttctgtgaggctgatttttaacgaacaactcagaggagctgagaaggaaggtccagttcagagtttctgcctcctcctgcccctgaggtgcaggagacaaggagagcagccctcactctgttgccccaaatggcagaccccatcgtcgggctgttttgtggtctggggtttttcacctcctgcgagggatttggagcacacctgctgccaggtgagagaagggaggcgggcacgtgacagcccaaagaaaacgccccactagcgtaaaggcgatgtagggatggagatgtctgttttcatgggcatgaaatcctggtgatgtggaccccatgaggagcccccaggagctactgggtttccacccccaaccttcccgggcaggcggcccatggaaaggtgactgcctcctctccataggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggtaggctggccaggggcacccgggaggacttcaggacactgttgccaccacctcgggctcagattctgtctggtgtgtctccacctgtgtctccgcacccagtacggggtgggacgctgcacttcctgactggacagcacacaggggaaggagcagatgggccaggctagcaaccctgcagccaggcctgctggtggcctacagctctttcgcaagcctctcctcccaggccgctgagcagctgagaaacagttcatgtcttgacatcctgcccacggctgtgtagctgtgtagagtaggcagcttctacccagccccagagtggccacggtaaccctaggaacagaacagcccacatttaccctgtgaagattgctcctgtggagtgactggggtgccgtgctggaagctgtgaggtgggtggggggtgaccgcaagagagaggaagaggaggagggcgtccgaggaaagccagccttaagaacttcccttcttaatctcttccttcctgccctcaggctcagggtctggcccctggcccagaggggtctcaggactctggttggttgagcctggggtgggtgtggctgccttgggccttggccgtgagctggaagtggccatcccctgggacaagggacccatctcgggagctacacaccgaagtctcgctcctgagtaatgcgtcatgcgctgagatgactgtgcctgagtggggaatgttgctttccaggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtg

SEQ ID NO: 4009 - DNA, 46807 bp, human; identical to SEQ ID NO: 4002

SEQ ID NO: 4010 - DNA, 62913 bp, human; identical to SEQ ID NO: 3998

SEQ ID NO: 4011 - DNA, 44467 bp, human; identical to SEQ ID NO: 4004

SEQ ID NO: 4012 - DNA, 46807 bp, human; identical to SEQ ID NO: 4002

SEQ ID NO: 4013 - DNA, 37028 bp, human; identical to SEQ ID NO: 4006

SEQ ID NO: 4014 - DNA, 65263 bp, human; identical to SEQ ID NO: 3999

SEQ ID NO: 4015 - DNA, 10921 bp, human
ctgtgcgccggcggtcttcggtcctcagccagcttcatgacgtaaccaatctttctacccctactcacgcaattctctctgctgccaatcctaccagtgctgctgggagtgagtcttgacttcccttttctctcataaatggcatctctggggaagaataagcctccccagctcggccttctctcttttgcagtcttgcattccgctcaccgtggcttttctgttctttctttaccgccctgtccagtccttcccgcccagacggtgtctctcgaaagccatattcttttatgaaacgtattcaacccatggcacttccggacctcccgttctttgctttgtttggtttttcggtttgtgtttagtgctccttgtgccattggttctcttttcttgaacttgtctgcctttgccgatggttcttcatgaacttgggccgcttctgggggtgtctggtgtcaggctagggccttgctcagtgttcagtggtgcagcatcagggcagcacgcgggctcagggccgccttcccggggctggaggggtggcgggtgcctttcccacactgtttgccacagaagaatctagcccacgtacccaggaactggagcggcgcttccagcatcctccttgaagtggtttcctaaggatgccgctgtcacctgtccccaggtgggctcagtgctgaccaatcactactgcacaggtggtgcctgccctgtaggccttgccccaagccaccgggtgttagaggtttccccagaactggcactcagaggcctcttcaagacgttgccaggaaaatttcccaccatgttggtcacagtttaaagagaacccaggggctgtcctaaggaggtagaaacttccagaattgctcacatctttttacaaagacaaagggaaggccactccaccgctgaccccactaccctgatgggagagaatgcagggaacccagtgggcccagccaggcagcctgctttttccagcaaactcaagagagtttatacaccaaagagtaaactttcgcgcgtgggcccagggcctttgccaggatggttctatgctacctctttcctttccttctagcaagcccccgaagcgctcccctctgccaacacgaacacgccactcccctgcaggtgggagtccttaaccacgcctttttccatcacagactcttccagcttgattgcttttcttttcctttctttttttttttaggaactggtgagaggtccctggtgggggtcacccctcctcttgcataagctgtcattttgggccactctgtcctttaaggaagggaggaggcccatcctgtcccccttgggaacagagcacgtgcgcgcgtacacacacacacacacacacacacacacacacacactccttctccaaaccacaggccacgtacacctccagcttgctccacactcatcatggggccacctacccttgtcacaaatattggctgacaccgtggcagttgggctgaaaagcagtcggcgcctccagtgccctagacgtgggcccaaaggggcctcgccgccactccacccagagaggcggacaggaggctctgccaagtcagttaaagccagaaatggttcgtggcctcccagcaccttccttcctgggagctgagggcagcagggggcatggctgtgcctccgcctccctcccccttgacttcctccgtatgtctctttgccatctctctctgtgcttcctgtctgtctgtccatttgcccatttgttgagttaaggggaaggcagccaccacggccccactccacgcgttcctcgagccttctccacagctctggcctcatcccaccccaggaccagctccttgtccctctccaggtccagcccagcctctgtggggcctgctgtcttttctccctctggattcctcctgcttcctccctggggcagcctcttgctcctctcttccttggctcctagcacttccttcctgccttcattccgtggccatctgtccccctcctccccacctccggagcctggcagtgcggggtaagtagagtgggagagacgccacccctcctgctgttcacaagctattccatgggggccctaagtggcggatagccagaaggagggcagctgtcccttgcacactgtgtgctccagcagaaggtgggtggcagggccctctgaagaggcccatcccagctgaacatcagcatcccagaaaggactctgccgtggaggaagatgctggctggggacctggcaacaccaaggacatgcccacttctggaagccacctgccagaaccacctcctgccatcatcacagtgcagcggattggtttagaactcagaacccaacccccactccacgcttcaaggaccccaagcaatcaccaagcccagcactctcatcctagagatcaggggaaggaggttgtccccaagggccaggacctgcactgggtcccataagcagccaggcctggcagagtggggactagcaccagcgcccaccctctacttggaactttctggtggatgagagatgctctgaaggctgtgacggagctcccctagacaagagggctgccccaactaggcctgcaggggcgtcgagtcacgtggtttcctaaggcaagcccacagtttcccatcctctttgcctgctccaggccaggctgcctttcagcccaccaggagtctggggcctttctgggcactggagctgcctccgtcccaagcctttcctactaaggacctcaggtcctccagagagaagggccggtggttggtagcatgacatcccctcaccctgtgcccctggggccaatgcaggaagtagcaagggggtggctaggaggggtcgagagatttgggatcgctggggctcagtgctcacacactcgagccctccccaccctgtctaacctcccacacctttgctgcttctggactcaggagtcccaacacaggccccatatccctcctctgcatgcattgtcagactgtgccggccacaacttctgacccccagctccaggcagcctccactgcccctcccctgcccagcctggtgactaccccacaccatgccccaaccacacactcacacaccgaggccacagtatcaccctccctgttgggtgtccatattccggagagctggtcagggacagctggttcagtcactcgggtctaccaagggcagcaggcacagggggctgcgcgtctgccactaggaggcacgggagggtgcgcgatcatttggaaagccccatcaaagccacttgagaggccttttatgtctgttttccactgggacacacagacaaaccccagccacgcatccaaagtctatccttccagcagcgccacaccaggcctgtgtgagatgcttactgttggagtcgttcctgagatgcctcctgacctggcccagcaaaggagcaggggttaggcagcaggccatgagtctggtcccatgtggccaccgggggtccctccgggccgtttagttccagttaatcatgctggaaacagatcacagcagttgcttggttttattggctttggcaacatgaaaaccgtgtggccaaaggggccaaaccgggccacgtgagtcccaggctttccctggacactcctttccagggcccagggcgacatgctcaccacactcccagccccgtggtggaaggagtcttgttttctggagtttgctccattctcaggaaggtcatgtgctttgagccaagcctccctacctggtttctgggaacggtgtattggcattttttctcagatctttgacagtctgcaccctgcctccatgctggaagcagtagcaaccctcccccaagagccctgccctaggctttcctggaaccctgggccctaccacaggggaatgcccttccaggcaaaccctaaagtaggcaccagaacgcagcctagggcagaccccaggacccctggtccaaggccctccccatcaggcactccgagtgtggactcccaagctgggaacctgggcagagacctctcaagactaattggaggtcccgcagctggattcagccagtacggaggcaagggctcagctgggccttcctcctgggtcctctttagtccgaccacccgacactgactcgccgcgcccaggtcagttcagcttgctggtgttgggagcacaggtctaggctcacacggtcctgggcatgagtgtgcacacaaggtgggaggcaattttcatgaaacttgccagctgcaagcagttctggcttgccaacacacacacagccatgtcttgtcttttccgttctttggttcaattccttggggaaagagccagctgtggagtttgcattttcattgttcctaattcaagcatgtgacatccccatggggtagaaaggggccttccccttgctcttcccccacatagagaagtgaggccgaagccatcttctcctcagtgttcaggctatctgagcttggcttctcattgcccgagttgactgatggttcctattgccacaggctcttgaggacacctttgtctcgctttcaagttgtgattcaccttcacgcctacaggggttgttttgagcctggaaaccctaaagttcttgacaagaagttccccatgggtctccctggctgctgtgttcagaatctgctctaaattcaaagctcagatgcctggggagctgacaggtccctgcctccaaaggaaggttctggaccagtggttggtgctgagcagtggataggtagggaggaaatcgaccagaagcatccgagttctgtgaaccttagcggctgagactgagcagagagcatggagcccctcgggtcggctggtgcccagcacagaggcagcaggatagggcttgtttctgcttgaggaattagaaggaagagtgagaaggtgtcaggcacagcttctgtcgtttcgttgtcactgcggtcaggagtctttgctttgattgttctcttttcctttcctttttctactcttctcggtccttcgcttgtctccctgcttctgcggcccttctccaccctcatcctcctccccagccctgcactgcaaactccagcacttgaaggctaaccaggggcacgtctccccatgcacatggcgggcacctccactccagctggccggcagtggcatcgcacatggcactccacacctgcaccccttccgctttggctcagtgtggccagggatgggccttgtcagtctgcagcgtcacccgccctgtgtaaggctcagaactgctcatccacgcaagtcgggagcccgggccaagcccacagcactcagcatgtctcctctgggcagctggtaacaaactgcccgggacagcctctctaaggatgcgtacttgagctaagttcagaggaaggagaaaggccagccaggcagcagaaagggcaggggtcatggctccggggagcccctgcgtggggtgttcagaaacagctccagccggctgggcattgcaaagtgggcaaagagctatggggagggccgaagccagcacaggaggctggtgcaaagccgtgtgggccccagacattcagccccgtccactgagcccctgctgggtgcagcgagccagacagacagacccctgccccagggggattaccttccagtgaaaggtggatggatgtagggggcacttgaaggaaggagcagaagtgggcaccatgctgctggggaagacaagagtgaggggagccttcctggtgtggggtgcagccacagcaaaggtccccaggtgggatgtgccggaggctgaggggtaaaagagggcagagtgagaaagactggggccggctccgagggccacagccagtggagggcttgtagcgggggagaccaagacacgctctggttttcgggccgccgtgctaagggcatggaggggtgggggcgaagtgcaggttctggatggcgtttgaagggagccacggggctggggccgggggggttgggcctgctaagtttgagacccagcttagatgcccaagtctggagccggagccgagaggctgttagccgacaggtggaatggaaggccgagagccagaagagagtacctagacccagaggaggggccctcgggtgtcagggatgggagaggaggaggggctggagcagtgtcggacagcgctgggggactgtgaggagtaaaggactgtggcctctcagggccatcagccatgatggggaacggagaagtgtggcagagggagacagcaggaggacacaaggaggtggggacacacagtggggagccacctcgcctcacccggatgagatggggagtcctccagcccaacctgaccctcctaggggcatctctcccggaagagtgctttcatttcctttctttttaaattgtcacagtaaaacgggcttttgggggtacagttcaatgaatttccacacagtcaggacacgggccagttccatcgcctactggaaggtttagagccagatgggggaccaagagtctgacttggcagccagagagagctcggaaactccacctagagaagggacaggaaggatggagggctttgctggtgggggttggggtcccaatgtgaccccagggccccaggcaggacatagcagcagcaatggaggtgaggagaggctcagatgtggaagatgcttttgagttagggtagggcccacaggacacgtggatgtctggtacatagggtcagggggtcaaagtgcctctgaggtttggccagagccctgcactgggatgggaaggctgctggtgggcagagttcagctggagcactgataagagtcctcctcgggcctcctgcaatttgagaggtcccttaggcatccgagggggaacacccgggaggcagccagggcagaagtctggcagtccaggaaaaggtggacatggtgcagctggtatctgcagtatttacggtggcctgatggtctatagacagcattgacagccctgggggccatgagattcctttgggagcagtagggggcgtggcgcgtcctgggctgagagcagagcaggaggcggtgcaggagcctgagatgaggacagagtgaacccaggctggtggaaggagggcatccttgagcacccaggtaggagtgcagccctctgggatgggcctctcttagaaacgtttgttgctttccattgaaccaatctcccaggaatcgactgcatccttcagtgttgggtgggctgaaaacaccccaccttaacaccaacaccaaaacattgtttaatggcccaggattaggatgcagggaaaatagagcctggagaaagctgactcactgtcagctgtaacagactcaccaggactccagccaagcttagcacccccaaacagcagaatgttggggggcagcccttccatcctgcagcggttcactcagtcacttgtgcattccccaagtgtctgctgagcagctgctctgggccaggctctgttgttaagccacaaacaaggcagatgccatccgggaggggcacgctggagtagccggtgagaccggaggagcagtagcagcagaagcccagcctggaaggaagggctggctccgtggcctggctgtcctttatggaggtctttggagttgagccaggtgcagtgagacctgtgcataggtttgagcaggggcctggcctgatcacatgcccccaggtctgaatgaggccaccagctcagcgagatctcaccccacacagccctggggtcaaggcctgcagcactttgtcctttttgtgacttgatgggcaacagctttagcaggcgatgtcccaggcggcttccacaccacaatcctgtaccagaaaaggcctaaataatgaggcaacatctgcattggctacgaaaactgaattctgtttcttttcattaaaaacgtcaaattattctcaatttctgtgttacccctaattcagaaaccagtctggggataaaggcctgagtgagaatagctgaccatctgccgtctggcagatgtggctttcccgaatgcagagaaaatccgaaccagatttcagatggggtgctagaaaattccaatgtggagctttttggcttacttttttttattattattttaaataggaacggggagtatcactctgttgcccaggttggtctcgaacacctgagctcaagcgatcagcccgcctcggcctcccaaagtgctggaattacagccgtggaccaccaaacctggccctggctcactttttgcactggagaggtgatgaggttggcatcatttcagctgattccgaagcactgtgctttgcctagctgagcccctggagggctgaaagaaagtcaccgaaaaaaggtgattaattgtctaaacgacagagccagagaggaaatatttttagctttccaggcctggtctctgctgccgtgacacaactgtgcccttacagcatgaaacttaaaccagtaaaattttattaaccaaaactagcagagagctggggttagcccctcagcaagccctgacaccttgtctaaacccagaaaaccaaatcctaggtcgaaccttggccccagaaatgcttcagaactcctaatgtgtccacctgctcacataggcaggggtggacaggtgttggatgaaccccagggtctgcctggcagctcagcgctccgtctgctgccccctatagggatggcagtacaaggtgggccagctaccattggcggctgtgctgacactggcctgtgcgaggccaggcagaggcctccccatcaactcctggcttctagaagcaggagggggcccaggctgaggggccagggagcaaagagaggcagcaaggacttgagtgcgtgaggcaaggtggagaagccagaggagggaagggctcgctcctggagcagtgccctgccggagggtcagggggcttaagggctgccgtgcgctcagctgggggcagagggccactgtgccgggggagtctggggcacagcgggagctctttcatgcgggaagttccgctgatctgaggtctgcaaactcctgtggggagggatggccagggaacaacacagagcggagcccgggaggcagcagagacgcaagttttggaatgtctgactggaagatggaggaggagacgggagagaggacaggcggagtgaggtcagaagagcaggggcaccagattgaaccagacccagtcagacacgggggctgtgaggaggccacaggggcatctgagcagagacaggctttagtgggtgcaaatcaaaagtgtggccattttcggtctcagatacctccagctggggactgctgggctctctggcctggagctctgagtacaggcctgggccacagtttctggttatagccagatgggccccagcactgtggccagggtggagaggtatggacagagaggaggagggacagagccaggccagagctctggggcacccagggacagaagagagggcagtggaggagatggggccagggcagctggtgaggtggaagagggccaggcaggggcaatgtcaggaagccatgagaagcttccagaaagagggatgatcttctgtgttgagtgccctgagggatcaaatcagacgaagatgcagaagtggccagtggagttagccgcagggagaccctcgacatggcaggtcccggctccagccatgggagctgggggatggagggagacccatgcgagaaaggccggcagtgcccataggctgggaacttgctcataccagcaggtacttcggactttctggtaagatcgagaagacatcccactcaccagcattctctccttttcaaatcatctttcttttctaccaaattggaattcagattgggcagagaccccagaggtcaccaaagccactcgtctccccaggacagggaactgcggggtcacagccaagagcctagtgcagcactctcaagttccagaatacctgcccagctcagcctagagaaagacactgccatcttttcctgcatgcggatcggttgacgagaccaaggcccacacctgaaaactctttccaaaggcaggcagagccatcccattccgtagcagccctccaacaaatgggtggacatttctcatgccatgacccccagccattgacgtgggtggaatttaccagcaccagccggccactgactgtctccttccttccttcctaccttccttccacgtttcctttcctttcccttcctttcctccctccctgctcccacctcgcgccctgtccctccacctcccactccagatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgtctcagcacatgcgcacacgcacactcggactcacacgaagtcacacgcacacatgcacgcacacacacatatggggacctgcacacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggaga

SEQ ID NO: 4016 - DNA, 46807 bp, human; identical to SEQ ID NO: 4002

SEQ ID NO: 4017 - DNA, 62913 bp, human; identical to SEQ ID NO: 3998

SEQ ID NO: 4018 - DNA, 44467 bp, human; identical to SEQ ID NO: 4004

SEQ ID NO: 4019 - DNA, 46807 bp, human; identical to SEQ ID NO: 4002

SEQ ID NO: 4020 - DNA, 37028 bp, human; identical to SEQ ID NO: 4006

SEQ ID NO: 4021 - DNA, 65263 bp, human; identical to SEQ ID NO: 3999

SEQ ID NO: 4022 - DNA, 10921 bp, human; identical to SEQ ID NO: 4015

SEQ ID NO: 4023 - DNA, 46807 bp, human; identical to SEQ ID NO: 4002

SEQ ID NO: 4024 - DNA, 62913 bp, human; identical to SEQ ID NO: 3998

SEQ ID NO: 4025 - DNA, 44467 bp, human; identical to SEQ ID NO: 4004

SEQ ID NO: 4026 - DNA, 46807 bp, human; identical to SEQ ID NO: 4002

SEQ ID NO: 4027 - DNA, 65263 bp, human; identical to SEQ ID NO: 3999

SEQ ID NO: 4028 - DNA, 371 bp, human
tgcggcccctggatgtcgccgagctgtcagaaccggaggaagtggaggtgctggagctggaggggggttttgagcagtttctgctcccggtcatccatgagatgccagaggacatcgcgtcgctgacaagcactggcgggcgtacctgtggaagcggagcacgctgtgggagatggacaatatgctcttccagatcaaaacccaggtggaggcttcggaggagcatcctcaaccgcctccacaacccgggcgacgcagtggagggcagggtgaccaagaggtgccagaaggccgaggagaaggccaaggaaatggtgaagatggcagagatgctggtggagctggcccagaggatagagacgaacgagtcg

SEQ ID NO: 4029 - DNA, 851 bp, human
atgagcttcaccactggctccaccttttccaccaactatcagtccctaggctctgtccaggcgcccagctacggcccctggctgttcagcagtgaggcaagcgtctatgcaggtgctgggggttctggttcctggatctccgtgtcctgctccaccagcttccagggtggcatggggtctggggcctggccacggggatggccgggggtctggcaggaatgggaggcatccagaacaagaaggagaccatgcaaagcctgaacgaccgcctggcctcctacctgggcagagtgaggagcctggagactgagaaccagaagctggagagcaaaatccgggagcatctggagaagaagggatcccaggtcagagactggagccattacttcaagaccatcgaggacctgagggctcagatctctgcaaatactgtggacaatgcccgcaccgttctgcagatcgacagtgcctgtcttgctgctgatgactttagagtcaagtatgagacagagctggccatgtgccagtctgtggagaacaacatccatgggctttgcaaggtcattgatgacaccaatgtcactcggctgcagctggagacagagatcgaggccctcaaggaggagctgctcttcatgaagaagaaccacgaagaggaagtaaaaggcctacaagcccagattgccagctctgagttgaccgtggaggtagaggccccaaatctcaggaccttgccaaaatcatggcagacatccgggcccaatatgacgagctggcttggaagaaaagagaggagctggacagtactggtctcagcagattgaggacagcaccagaggggttaccatgca

SEQ ID NO: 4030 - DNA, 283 bp, human
gcatggtggctcacacctgtagtcctagctactcgggaggttggggatgacttgagcccaggagttctgggctgtagtgtgctatgtccatcaggtgtccgtactaagttcagcatcaatattctgggagcagaggaccactaggttgcctgcggaggggtgaaacagcccaggtcggaaacggagtaggtcaaaactcgtgtgctgatcagtagtaggatcacacttgtgaagtgaatagccactgcactccagcctgggcaacacagtgagacctcatctc

SEQ ID NO: 4031 - DNA, 22343 bp, human
ctttgcggggcgtggaccagcagggccccgcggggagggaaggagacgcggggcccggagctcggacctggagcccagccccgcggcccggaacggggcttcttgcctgtgcgtggcgtgactacgtgagtgcgttcctgtgccccgtctctgtgtgcgcggaggctcccccggccccgcatttgtgtactttctgtgtgcaccctgcagactgtctagagaaatgtcccggatgctgtgggctgagacctcctagggctaagtggagggaggtcaaggtcaaggcacccaggagcagacagggctcagacaggtatgcgtttagtggcctggattcaactcccgggtttattggtctggactgggaaggaatcaagtgctttgcaggaggggtgttggcttgggagaacgtgggggaacccgtgcagggatcggcgagaactccggggcgggggcgggggcgggggaaggaggggctgggcacgggggagaattcccaggaatccggggactgacttcacgctgtgagccgagctcctctggccacctggtgcgggagccgaggggcagggcggggacgcaaatcttgccccaccctggcggagctcctggtcctctctccccggcccttctccgggggtgcgcggggccctcggcttctcccgttcgctgtcctccgccttcttccctctcagttcccggctgccactcctcgtctcttgttcccgctgtttggaaaccttgtgtggccattgccagccccctagcgggataggaatgcgaccgagagggcgtcctgtggaatccgtgttggattccagggctgggatggttggttgacggggactctggatcccatcctcctgcttccttttcgggagtcattccatcaaacggcaagcgatttctccaagcgattcctccggggccgttttgactttcctggagaaggattggtgtcgcacttcatttaaggccaacctcgtggggacgtgtggataggggagagcgacccgagctgcaccccaggcctgaaatgagccatgggacgacaccggtagcccttggggctccccacagccctccgggaaggcctcggcaggtcgggctgggcctgccttcagggaggtgaacttgggtgggccctccctgctctgcgccctaagctctccttcatggaagggacttgcccaccccaaggagacccgccaggaggagggccactgccgcatgcgccctctgtgcgctttcctgctgggctccctttgaaaccgtgggagtttggctgcaaactttcactttctacattcctccttggcccaatcaaagccgggattttacgaggagaaccatccttcacaactaagggaaaacaagaggactgaaaaaagtagatacggaaagcagtgcaagccatgagctgtcccaggggactgcgcttctgggggtggacgcatcaccaggtcccagcctcttcagaggagaaggagcttttgttccaaaagacaggtcagcttctgggaccccgtgcctgcctcccggcctccttaaacacgggtgctcccccatctttagggggcacttctccctgtcccccctgagtaacctcgtccgcaccttgtcagggtgaggcacttcatgggcctgattttcagaaagaagcacatgtgcatctgcagcgccttccatctacaatccacagaggcctgggatccccaggccaggaacccccaagtctctagcctagccttgtgttccaagccattttctgccaatgactcacaacacttccaaaattacagctgtattgagctatcattctcctactgcacaacttaccctttcaaagtgtacaagtcagtggtttttagtatactcacaaggttgtgcagcccacaccagtaattccagaacgttttcatcaccccaaaagaaaccctgcactccttagcaatcacatccccatttctccctcaaacttcctagcccctggcacccaccaatctacttcctgtctctatggatttgtttattctaaacatttcatagaaactgaccttttgtgtctggctttcattaatcataatgttttcaaggttcatccatgtatcaatagtcaatttctttttattgccaaataatatttcattttgtgatatacaacatatttatccattcgtcagttgatgagcatttggggtgcttccacccttgggctgttgtgaatagcgctgctgtgaacactggtctacttgtatctgtttgagtccttgcttttaattctttggagtgtgtgcctgtagccattgaactgttttccacagtggctggaaccagtttacattcccaccagcaacatataagggttccaatttctctatatctttgccaacagttgttattttctgggtttttgttatggccgtcctgctgggtgtgaagtggtatctcattgtgattttgatttgcacttcctgttagctaaatgatgagcaccttttcttgtgcttgttggccatttgtggatcttctttagaaaaatgtctgttcttaagccagcgccacactgctttcattactgcagctttgtagtaagttttgaagtaaggaaatgagagtcctccaactttgtacgtctttttcaagactgttttgtctattctaagtccctcaagtttccatattaatttcaggatcaggttgttaatttctggaaagaagccagttggcattttgatagagattgcatcaaatttgtggatcaatttgggtagtattgttcatgagcatggggtgcgttttccatttatttaggtctttaatttctttacatgatgttttgcacttttgtttaagtttattcatgagtattttctttatgatgctatcataaatggaatcgttttcttaattttactttcagccttctcattgctactgtatagaaatacaattgattggctgagcgtgttggctcacacctgtaatcccagcactttgggaggccaaggcgggtggctcacctgtgcttaggagttcaagaccagcctggccaacatagtggaaccccgtctctactaaaaatacaaaaaaaattaacggggcatggtgatgtgtgcctgtaatcccagctactcaggagactgaggcaagagaatcgcatgaaccccagaggcagaggttgcagtgagctgagattgcaccgctgcactccagcctgggtgacagggcaggactctgtctcaaaaaaaaaattgatttttatacattgatcctatatcttgcgaccttactaaaattgtttattaagtataatttgtttagtagattcctcaggattatctacatattaggatcatgtcattggcaaatagaaatcgtttttcttcttcctttccaatctggatggctttgatttcttttcttttctttctttctttttttttttttttttgagacacagtctcactttgtcacccagactggagtgcagtggtgcaatctcggctcactgcagcctccgcctcccgggttcaagtgattctcctgcctcagcttcccatgtagctaggattacaggcacacactaccacacccagctaatttttgtatttttagcagagacgagcttttgccatgttggccaggctagtcttgaactcctggcctcaagcaatcctgcccgcctcggcctcccaaagtgctgggattaccggtgtaaaccaccgttcctggcccttcgatttctttttcttgttaatttgctctggctggagtctctagtacaatgttgaatagaagtgcctgtgaatgtctttcccttgttcctcatcttaaaggtaaagaagcttccagtctttcactagggggtataaagttagctgtggctttttcatagctgtcctttatcagggtaaggaagttcccattctattcctagtgtgtttttatcatgagaggcattggattgtgcagtgctgcttctgtggctagtgagatgaccacatggttcctttattccacggatgtgggttgtcacaggcactttcgtgtgtcatgtcggaacctcagccccattcctatattccaatcatgtcctcctagtttggaaaatctgggacctcccctgaaaatggaggattactgcgtgttgagttaggaaaaggaagcaggctggttgcccagaatggaaggcaggaaacagcatgtccccagctccggagccttttctgcagcccatgtccctccactgccaccaggcccccttgtcatatatctcatcgtggtccacactctgctgaacttgtcttggccttggcaccccctctctgacaccatgatgtgcttgctagcatccgagcacgccggagatggtcaggggataaacccctggtacttaggactggtctcccgcccatcctactcaggctttacagggggagtgggtcaggaccgcctgtcatctcccctctgtccacatcgagggaggccaaaggacagctggccagcccttctggtgatctcccaggcattcttgcctaaagcacctgcatgtgagcccccatggtgctggcagccatcctgggtgcgtggcattcagcagggagacactgcagacagggccttgcccctcccccagactccccttttgttgttgttgttgttgttgtttgagacagagtttcgctcttgttgcccaggctggagtgcaatggtacgatctgggctcaccaaaacctccgcctccagggttcaagcgattctcctgcctcagcctcccgagtagctgggattacaggcatgcgccaccatgcctggctaattttgtatttttagtagagatggggtttctccatgttggtcaggctggtcttgaactcccgacctcaggtgatccacccacaccggcctcccaaagtgctgggattacaggagtgagccaccacgcctggccccaggctcccctttttgtaagggggagaccatcgccaacatgtaggcaactgcgggggagagaaagtactgcttgagtgcgggagcgtggctggcagccagtgtcccctcttcagcgacgtcttcctccaaactgctctcccacccaccaagccaggtggcttctctggctccctcctgcttgcatgggggcttcctgtgagcagggatttgggtctggcatgggcactctgcctccccgcctcaccagcaccagatgctgccagcacatccacgctggcctccacccttccaggggaaagctggactctcagtcaactcagtggttctgccgcagaagctgactggggaagaagcaggctctgagaaagtccttgtggagtggaagaacagagggctggacactgaattctgactgccatcttctggaccaggtcatcctgttttgtgtcattgtcccaagattgtagaatgccctttcccctctcatctcggggttcctgaggactgtccagtctgctgaaatgaaattcgatagtgccagagagcagattcgtggttgcagggatgggcagaggggcatgaggacacttttggggaagatagaaatggccactgtcctgacggtggtgatggttccccaggttcatgtatgacatatgaacacctgccctttgcacactgaagatgtgcaggttaccacccagcaacagacctcaccaaagctttagaacaggaactccatggccacatgcacgcatcctggggagaaaggtgtcctttccttccttctacttcaggggccctgccagagaaggcagtgcagtgtggagataggaatggaggcagccaccaactgacagctgtgtggccaggggcaagtcgctgcatggcccactggctcagtgactcagtttcctcaactgtgaaatggcagtgaagagtgcttgcgtccgagggccattgtgacaaggaaaacagatggtgtgtcccccgggatctcactgggtggaggagggagttgctgccctcgggccattcagttggtcattaagaagtggaaattggctgggtgcggtggctcacgcctgtaatcccagcactttgggaggccgaggcgggtggatcatgaggtcaggagttcgagaccagcctggccagcatggtgaaaccccatctatactaaaaatacaaaaaattgaccaggcgtggtggctcacgcctgtaatcccagcactttgggaggctgaggtgggcggatcacctcaggtcaggagttcgagaccagcctgaccaacatagagaaaccccatctctactaaaaatacaaaattagccgggcatggtgacacatgcctgtaatcccaggtacgcgggaggctgaggcaggagaattgcttgaacccgggaggtggaggttgtggtgagctgagatcacgccattgcactccagcttgggctcgaaactccatctcaaaaaaaaatatatatatatatattagctgggcatcatgcacctgtagtcccagctactcgggaggctgaggcaggagaactgcttgaactcagcaggtggaggttgcatgagccaagatcaagccactgcactccagcctaggtgacagaacgagaccctgtctcaaataaataaattaattaaataaaaaataatgaaaaaggaaattatatggagaaggccttacatctgggtatgtcacagttaatgcccagtgacagaagaatgtccaatattattctgagaatttctctcaggaaagggacctccaagttttgaagaagtgtgatgtagtacaatattagttaggacagcctgggcaacatattgagaccttgtctctacaaaaataaaaaattgctcaggcgtagtggcatgcgcctctagtcccagcttctggggaggctgagtgggaggattgcttgaacccaggagttggaggcttctgtgagccgtgattgtaccactgcactctagcctgggcaatggagccagactgtgtctggaaaaaaaagaaagaaagacagagagaaagagagagagagagagggagggagggagagagagagagagagagaaagaaaaaacagatggacagggaacaaagcggaggcatatgtggtcattttgcacaggagttgggccggaggaggcgaggctgagcagcctggggctggacaagatgtcctccctttcagtgcattctgcctgtcctcatggctgcttggagcattgagaatgaaaaacgctgcagagggaatattgctttgattgtaaaacgctgcagagggaatattgctttgattgttgctagatgtgaactgtgcccttagccagtcaggttagcctgaggtgggtgggaggatgggtttagttgctgggccacgtgcctggaaagctgtgaatatgtacccgaaggttgatcttgagaatggcttcaggaagtggttggcttttcctgtgcaaggtgtgggacacccctcttttcctgtgtgttttttttttttttttttttgagacagagtcttgctctgtcacccaggctagagtgcagtgttgtgatctcggctcattgcagcctccgcctcctgggttcaagcaattctgcctcagcctcccgagtagctgggattacaggcacctgccaccacgcctggctaatttttgtatttttagtaaagacagggtttcatcatgttggccagtctggtctcaaactcctgacctctagtgatccgcctgcctcggcctcccaaaatgctgggattacaggcgtgagccaccgcgcccggcctcctttctgcttctgagccaggactatggaggtgtctgagaggccgccgctctcccggaaaggtgggggccaggtggattgatgagacttcagcagaccctgggcttcggggagggaaggagaagtgaggggaaagaaagatgccctcatgcagaaggccttcgttgaggtctgccctggttcctccagggcgcgctctgagtcagtacagcgccaccctccacccgaagtccttgttaaggtgcactttctgactgagccactagcatggggcctgggattctgcacttctcacaagctcccaggtgatgtggatcccactggctgtgagtagccagggccttgggtagggaccgggagtagatctatggtagccccaaaccacattaacatgggtggtgaagtgaggtgttgttttttttgtttgtttgttttgttttttttttttacaaatagagggtaaaaattgtttacaaatagagggtaaaaaaacacacatagagggtaaatcagaacatccaggagtcgttgcctacgtgagggctttacaggacataacttgttcttccctgccatgtgcagctaactgacccccttccctgtcaccggcacccctaccggtatacatgtctctcatggacgcccagacacccctcccccgactaagtgctcaaaggcctttgagatgaagccctcccatgtttctgtctctcctgcccccaggcagaaagggtgggcacagagttatggaagcgggtggtgtggcttgcccaggaggccacagttgggggcgtgggcagccatgctacttgccgggcctgtcacctctttgtccctgctagaattctaacatgttggtggagacattttgcagccaccaatgcagtaattaattcaggcaaaaatcatcactggatgccaaaaccattagatgtaaggtcgttggggacagaatattcacaaagtctccaaatattaccccaaattacctgtgaatcaggaagggaaactgcgtctttacagaggagagatctggcagctgccacctggaccatgtgatcaaacagcctccccaacagtggggcagcctgaccctgccagccgccagatgcagggctggggaggagacatacagcatctcctgcaaggtgctcttgtcaaaacgctcagcctgaatctcaccgcgggaatgaatcaggcaaattcagactctggcgcattctataaggactggtctcttccaagaagtcattcccattaaagtaaaaaatatatatatttttttctagattagagaggagacataataactagagacctaacaaccgaatgtaatatgtgtgcttcttgattgaatcctagattttttgtttgtttgttttgtttttgagatggagtctctctgtgtcacccaggctggagtgtgatggtgtgatctcagctcacttcaacctctgcttcctgggttcaatcaattctcctgcctcagcctcccaagtagctgggaccataggctgcaccaccacgcctcgctttttttttttttttttttttttttgagatggagtcttgctctgtcgcccaggctggagtgcagtggcacgatctcggctcactgcaacctcctccgccacccgggttcaagtgattctcctgcctcagcctccctagtagctggaactacaggtgcaagccaccacgcccggctaatttttgtatttttagtagagacggggtttcaccatattggccatgctggtctcgaactcctgaccttgtgatctgcccgcctcagcctcccaaagtgctgggattacaggcatgagccattgtgcccagcctcaaatcctagatttttaaaaaaagctataagggtgttagcgggacagctggggagatgtgaggctggcccattgtatgagtgcggaattccgtgctaagggtgttgtggttccacggagaatgggactgatggcatcttgctttcaaatgcttctgcacatgtgtgtgtagaaaccccgagagcaggtgtggggaatctgcagatgttcccacatgcttgtgggcggacaattttcaaaatcccgagctggggaaacatgaatggggactttgctgggtcactgagtgggtgaatgtagtgagcctgcggcttctcctttctcctctgatgctctactcgttgggagatcccccgatgcctgacttggcctggaagctacagtcacaactgcttccaaggtgtcctggatactccagacggcagagctgagagccagcaggcaggtcagagctcggccccgggcagaggataacttcctgtctctgtccttccccagcttgtttcctactctacagcagtggggtaaggggagtccgaaggtggcagcccccccacctccgtggcagccacgggggcccctggaagtgatgtggcttcacctcccatcccgcgcgttgccagtgagagtgaaaggggtcgcaggcgccgtgtgacaagcacttgggattgcgagtctcccaggccacaactgttttcttagcctctccggcctctcttctcggcttcccagagattcctgatcagcaagagggcgtcgcgccccacccggctgtgcgcctgccaccgctgggtgcaggagggtgcctggggcagagcctggaaacagagctcagcctccgacggggttggcggggcgggcgggcaggagtcctgccaatacagccaccagcgtggcggcgccgggacgagtgtggtccgccctgctcccgcagccgcagccaccccgccgccgtcgcggcgcgctctttgtctgcggctccgggctcagggggcggggcgagcgcgcctggggctccgccctctccgcctagggcgccccgcttcccgcgtcccctaaggcccgccagtcccttgcccagcgggagatcgccgccccacagcgactgcccgtggggccgacttcgcgtcatgcctgcctcgcctgcccggtgttgccccctcccctgtccctgtgtcccccctcccttgcccgcatgtccccctcatgcggggaaagcggtgccagcactttccctggccttgcgaattgctcttccatcggtattcagccgcccctctgatgttcctgaaaacccaacctgctccttctctgcaaaaagctccggaaggctgtgtcgatgcaggtcgagcttccccacccggccccctcccaccttttagcaaatccagaggccccaccttcgccctcccctcccgggctccgacccagtgcattgagcagctcctcggcttccctcccgggactttctagtctctctccccaaccggctcagtgtcagggtgccccaggactctccttgggcctctcctgttcttgactacattcactccctaggtgagctcctccatctcatgcttttgctttttaaatttttatttatttatttttaaatttttattatttttgagacagggtctcagtccgttgctcaggctggagtggagtggcacaatcacggctcactgcagccttgacctcccaatgctcaggtgatcctcttgcctcagccctaccgcctgccccctacctcctccaccacttggggctacaggagcgagacaccacgcccagcttcatctcatgattctttttttgtttgagacggagtcttgctctgttgcccaggctggagtacagtggtgtgatctgggctcactgcaacctccacctcctgggttccagtggttctcctgcctcagcctcccaagtagttgggattacaggtgcctgccaccacgccctgctaatttttgtatttttcgtagagatagggtttcgccatgttggccaagctggtctcgaactcctgacctcaagtgatccgtctgtctcggcctcccaaagtgctgggactacaggcttgagccaccgtgcctggccgtcatcttatgattttaaataaagaaaaattcctagtttaattgaacagcaatggtcacatgccacccagttagctgacttgggcttgggccagacatttggagtggggcactggagatgtccacatgcctcgggaagttcaagctagagataaaaaccttccatttcctgccctgggcctaatccctgagtccttccttcctcggtcttcctcactgctgtgaggatacccctggtccttgtggtcctgtgtggcaattttatgttttcttgtggtaagatacgcataacataacatttaccactagtgacttttagtctattctcaatgttgtgcagccgtggccactgtctagttccagaacaggttcatcgccccaaaagggacctcatatccctcagcagtgactccccaggccccccttcctccaggtcctggcaaccattcgtctgctttctgtctgcctctttgccttggctagactgtgctcatgcagtcgtgtgtgccggtcgttcattctttttatgtcgggatgggtgtaccatgttgtgctcgctcatccattcatccactggtggacacgggttgcctccgagtcttggttactatggatactctgctgtgagcatttgagtataagttttctttgcatgcctgttctcaactatggatactctgctgtgagcatttgagtgtaagttttctttgcacgcctgttctcagttctttggggattgctgggtcatgtacataagctacacctaaccttgtgaggagccaccagactgcttccctggctgcactattttacatgcccagcagcaaggcgtgaggctccagggtccccgcgtcctctccaatactcgtgcttcctttcactgattccagcctcctcgtggtgtgcggcggtatctcactgtggtttgggtgtgtgtttcctctgtgcgtactggccggtgctgacgcgtcttttcctgcgcttattcgatgtcttcttcaagccctcactgtcccttgcccccagcccaacagcaggtcctggcagcctacctctaaaacccaagctgactctgaccacatcccaccacctctactgccacccctggggtcatgccaccatcatctgtggtctggaccactgccgttgcctgctggtctggcccttacagtctgttctcctgggagctcccttcgctacaaggaaggaagcatggctggtttcttgtcatcatttaggtctcagctcaagtgtcaccgacccagagaggctgtcctgaccactctacccacccaggcagctttgtctctgtcccctcccaccttccaaccaagccccttggggagcggaacgggatggggggtgtgttctggatccaccgtctctcccttcagctccttggcactcctttcctatggggcaccctgtccagggcaggtggggcaggattcccccctcttccctcatctcccgtgcttcccgggcccaccccccagcatctccagcctgcccgggagtcacatgtcctcggcccacagaatccccagcacacgccccacccacaggcctagccccagccctggggtccctggcaccccacctgccagggcccctcccctgccttgctcaccccccaacacacctgattgttggaaaggtcttcccatgcccaccacgaccccctcccactcatctgtgggcgggagagcttggtccctgccgcacgttgcccccctagcatccaggcccaccaccgagcccccgacaggcctgggagccccactggtgggtggggacccaccagctgggggtcttgctcacaccgaggggctgggggtggcggtggctttctcagggcaccctgccttgggctgcaggccgctgggtgggcaccggctccctcggaaggcagcgcaacccgggatcctgccggccctggcccccaccctgccgaccgggcctggggcgatcagtgccccagctcctgtcctcttctgctcagatgctgggttgggagatcaggggccacagctcggccactcagagccctttccgcaagtcttagagggaccagctgcggggtgtgtgcagaggggctgcgctgtggggagggcgcatggctcagtcctcctggcctgaggcccgcctagcctaagtggcctccaggacccatggccaggcccttctgcagccttccagaaagaaccagcttcccagggttccctggggaaggcctggggccacctcctctggaggggtggggcctgtgcttcattcctccttccccaggtccccttccaggccgccaggtcccctccccgacctggagcccacagccttgtaattaaattgtaaacgtccttgtaattaaattcatgtaatatccattattattattactgttttagactaaattacttagagcacattgactggatcaaaggctaccatgaacgttttcaagggtttttatagttattgacaaattcttctccagaaatttgaccactttacactctggggtaagattcagactaagtgtgtctagaaagggtgatggggtcggctgggaggaggaactgggcttgcaggggacctggggcagtgagtgctctcagtgtgcaaaggggaactgggctgtcccaagcaggatgtgagggccacttgggccacattcaggcagaggggccctgctaaggcttgagtcccctgttcagagcagggaccatggtggaaattaaggacgttcatgtcaactgtggttgagattggagctgcagtcctagagtcagccctcttgggcccatcttggcagcaaatcaggaaggaagtagatctgtgtgctgaagagtcgccatggggcacgtcaagcccctggctgagccgtggtgtgctcacaggctgctgcactccccggggcagcggagtgccagggacttgtattttcatctttgtgctcctccgcctcctcagtgtggcgctctgagcacttcgattatttgaaaggaaatgcgaaaatttgtacaaaatctattgtgctagcacgtgatggaggaggggtctttgtgaacaggctttgagggtttgcttggctcacagctcactacccagtcaacagggttgactgccacggggtgacctcgctaaggtgaagcatgatgcccagcacgtggtcaggatggcacgggagcactggagaagatgagagtcgctgggaacctgggcgaggggggacaaggggcatttgagtgggcttcaggtacgtgaagtgttgcaagataaagtgggtttcttctggattgttccaaaggagggaggttgctctcaatgaaggaaacattcaatagtgagagttttccgataatgagctcagtcaacaatccccactctccccatactagagaagcaaagtggatttcttctggattgttccaaaggagagaagtttgcacttgatgaaggagacttttttttggggggggggtggggggtggatggagtctgactctgttgcccaggctggagtgcagtggtgcaatctcagctcactgcagcctccacctcccaggttcaagtgattctcctgcctcagcctctcaagtagctgagattacaggcgtgcaccaccatgcccggctaagttttgtatttttagttgagacggggtttcactgtgttggccaggctggtctcgaactcctgacctcaggtgatctgcctgccttggcctcccaaagtgctgggattacaggcgtgagcctccgtgctgggcaatttttgtatttttagtagagtccgggtacatcagactcaggggctgggtcatgcctgtaatctcaacacttttggggggactaagcagatggcttgagcccaggagttcgagactagcctgggcaacatggtgaaaccccatctcttattattattattttttaaaaggtagatcagataaattacaggtccttaatatatattcaacaaattacagaaatatataaaattttaattcagccaagaaacatattaaagttttatcttcagcaaactgttaggagttgggatggaagtagaactcagggtgaagccctcttggggtttgttgtctaatgaaagggaggtaattagacaatcacacataaaaggctgagctccagcctgggtatcttgaggcctcctggacttgctgtagcatctggagaagtatggggcatcatctcgcatcacttagcaccagcactgccacccagccttgatgtgggtcctgttggcctgagcgtttttccttgaagaaggtattaaaagcagattgaagccgcctgtgcccacccatcccctacgcacttcatctgctcgcctctctgccgtgttttccaccaagtacatactacgaatgagcctccattatgtgcgcctccattaactgcacatgcggaataccaggaattgtttgttcgactgctggcagacctttgggctgtccctggtgtttggccactgtggccttcatgcccacatcctcctggtcctcctggtggtggttctgaagggcatctcctctcatctcatggctccaagtgcttgctagtgggtcccctttgccctgagcacctgttgatatcctttgcccatgttcttcttgagttgtttgtgtctgtgttttcttgttgttttgtaggaattctttgcatattctggaaaacccattatgaggtccatgcattgtaaggctctcctctgagcccgcctttttactgtgtttagggtgtcttttgtcgtctagaagttttacatctcttccattattgcttccccatttgaaatattgagaatttcgtctctatcccacaccataaagatattgttctcttgttttgctttgtccctgtaggtctttgatccaattggaattgcttggccagggcttggactaggtcttctgtcttggtggggcgagctcccagggtgtggaaacgtttgcaggtggggcaggagggagagtctggtgggaagcaagcctggggttggccatgttgagtgtttgtgccttttagagactggagtggtcgagtaggcaatccgagggttggggcattacaggggtggctttaccagtgtgctacctcaggatggttgggggtggggcggggaggcaaggctctgagcaggactggaagagctgctgtcatcagaagggccacagtgtggctccttaccatgtgcctggccctatacctctttgctcatggccccatattttcccaccttgttggtagcccttagcccttccccagaggggagctcatttcttccttgggggtccagcatgaccgatgaggaggagagagagagagagcgagaaggcttcaggagcccgtggcttccacccaaatacctgcctggctgtcacaggcgatcactctggttgctgctgatccgaggtgctgaggctgtgcccacgcccatccccctcttgacatcccagcctccgccagcccgcccagcaagcgctcctcagtttccatagcaacactgctgctcggtaatgattccgggtagaaaggcattcgtgcgttctctgtcatctctgtcacctgagcatcccactgcctgcttgctgtcctgccccgggagttcaggaagaaaccctgaggacagctccgagcccttctgcttgtgtgttggcttctcctcaagggcagtggtaaggtggtaaatgttcccagacaaaaagccctgatttggagcatttgccgatttccctggtgtaaatgctgccactatagccgatttcaagccaccactgcgatgtcactgaacttggagttgggggaatgcacacatagtatttccatctcccataccagatgtgaataaccccaaaagcacagatgacagaaaagtgtagtaagataattagacagtgatgtgttccgaggatttattgcctttgttgttaatatcattcagttacctgtacatttctacggttaaaataccaataatcgctgtgtttgacaactggcttccaaatttcccagcttcagttggctctagccactgctgctgagagtgtcgaggccattccatcatgtccctttgtctacagccttcctgaacccacactctgctgccgcccaccctcttccatcctgcctttctaactgtagcctctccaccaagcacagcatgccctgtcctgactgacattcttacggtcttccaacaaataccttcttggctgaaagctgtttcctttatagtatttgatccagaaattccacctcaagaaattttctccaccttgacaaccactggttacacaaagatttaagtatgaaaaatgtataaaatggaccccagaatgtgtctttgccacattctttataataaaaaatcaaagccacccttactgatgtgatgatgaacatgatggtccactggtgtgttggtgtggatggaccttaaggggcctgcagctgcaaaatggcacacatagaaaacagactggaaggaaacaggccgcatggccaggtgcggtggctcatgcctataatcccagcactttgggaggctgaggcaggaggattacttgaggtcaggagtttgagaccatcctggccaacatagtgaaaccccatctctactaaaaatacaaaaattatccaggcgtggtggtgggtgcctgtaatcctagctattggggaggctgaggcaggagaatcacttgaacccaggaggcagaggttgcagtgagccaagattatgccactgcacttcagcctggatgacagagcaagactctgtctaaaaaaaaaaaaacaacagctgggtgtggtggcacacacctgtagtcccagctacttgggaggctgaggcaggagaattgcttgagcccaggaggtggaggttgcagtgagccaagatcgtgccactgcaccccagcctgggcaacagagcaagactccatctcaacaaaaaaaagcccccaaaaaacaaaaaaatgaactgtgtttcttttataatcggacaaaactgattttgacaaaaagctcttttcagaatatgaaaattttggggagaagggagacatagaaaacttcaatgattatctacaaggacatagtcaaatagaaaaaaagtaatgcaggagccgctgctgaggccacaggggttccgaggacaagctgggctctcctcagatagctgtcttcccgaaaagactcgtacagcggtggttctactgtatcgcgggcactaagacaagattttgccgtcagaattgacatctctgtgagaaacccggggtgggaggtgccgccgtgagaatgcaggacagagagttcttctaaacttgctaatattcgcacaactcggaaaagcagagggctccgtgcaggcgcagccacctgcgcccatgcccagggcccttctgccctctcatctggcacaagctcccagcctgctccatccctaggcggactctgggtctcctcgccctgccctctctgtgctgactgggggctttgcttccaactgcaaaccagcctccctgggtcttttcttggccctgttccctttgcctgatggaggccaggtgtcccctgctccagaagccttccccgcctcccaccgaggcgtgcatggccagccgtgtgctcccttagctgtgggtaaggtctgtccccacgctcacctgcggggcatagccatttgggcataatgctagtgtgtagcctccccaggcccagaacagcccttccataagccgctgagcccatgaggagaccctgcacgcctgcctcgagctgcctcctcctagaagtgcttcctgctgacccttgctggccccatggcacgtgccctgaattctggtggagtctgttcagtccttcttggtccttagtcattcgtcccttctctacttgcctcccttccccaaggaggacttgaaggtcgcagcatactgtcccagggtgctgcggaagcagccttcgaccttgtgggcactgcttgccccaccacctgcgctgtgcgtaatgggcttccttctgctacccttcattgtccttccttcacccctacagcatcccgcagagctgcttaggtcctacttccgccttgggccctggcccgcgatggcctcctcctccctgacccctccttctggccaccgggcagcctgtcctggctcatgaccttgactcagtgccacaaccttgctgagcttgctgacatggtttcctcatctgcaataatggcatctccctcaaggttgttgggggttaggattttgtggagacccacatcaggggtctttcccagaatgtagcacatggcacgtgcccaaaaaacagtagtggcatttttttttctttgagacggagtctcgctctgtcgcccaagctggagtacagtggtgcgatctcggctcactgcaagctccgcctcctgggttcatgccattttcctgcctcagcctcccgaggagctgggactacaggcgcccaccaccacgcccggctaattttttgtatttttagtagagatggggtttcactgtgtttagccaggatggtctcgatctcctgacctcgtgatctgcccgcctaggcctcccaaagtgctgggattacaggcgtgagccaccgcacccggcctagtggtggctttataaggaccactttcttggcacctcttttaggctactttgcagttccagggggcttcttgtacatcaaggccttttctcttgggcaagtcagttgtcactgtgaggacacaacactgtatctttaggcatcttcctacttgtcccccaacctgaccctggccctccctagtgagtagacatttgttgagagactcggctcatctgaagagtcaaggtcatcctcttgcttgatgctgaatgagcacaacacagatgctcactgagtgttggctgttatggtccagtcattgccaaggaactcaatgggatcttcatgctagctctggcctcagtgccgccctagaaagaagtgggtccggatggggagaggccaggagagctcaagcagtgtctggaggacgttgtagggcggtatcacagcctccagacccagtgcacagaggctgggtcccccagtccttggtgtgacttggtgatccccagctggccttcagtgggatgaaggctgagcagtggggcttgcctgggaacaggggcaccaaaggtagccagggctgcagacagcagattccttgcttgagtggcttggggtgctggttgtcagcccaggtcctgccagctagggcctctgccttgacctcagaggggaggagcaagcctttgagggttcttacggaggcgtgtctctgccgcaggtgaacgggaaggagctctccaagctgtctcaggagcaaactctgcaggccctgcgctcctccaaggagcccctggtgatccaggtgctgagacgcagcccccgcctccggggggacagctcctgtcacgacctgcagctggtggacagtggcactcagaccgacatcaccttcgagcatatcatggcgctgggcaagctgcgtccgcccaccccgcccatggtcatcctggagccgtacgtcctctctgagctgtgagtcgccctcaggagggccccgggccctgcctccagagaggacaggccacctggagcggccatccgcacgccaccctctcgggcaggaagcaggcccctcggcctccagaactgaccgtggtacccaagggctccaaaacctccaggcctctagccttgggccgggctccagcaggcgccccgttgtatctacccccagggccgagggaggaccctcctgtccgggacgtcgctgccggaagtgccagggttgagggcctcagctcctcctcctccatcctctctcctctgccgcctcacaagcatcactccttgaatcttcttgcatcccttgtctgtctcattcctctacctgctctgaatttcctccatctcttcagcttctttctttggcccgaccggaagaagggcctttcatccaggcctggtggctcatgaccgcgtgagcgctgcctcattctgctaatcttagcccgggctgcggggaggtaggccacagggccatgagcagccaaccttagttttggggccaggagggcagcccctggaggtagggtgggcccccctctgctctgcagaagtcctccagggcctggataactcctgggggcgttgcatgagtggggccagtgctgggcgggcgggtgggcacccggagattggagaagttggtccctgccagctggcgtggttggaggagttctggtctgggggacgggaacgctagaggcatgcgcaggtcctctgcgtggacgctgcacactcaggtgcgagaagtgcccccggtctttgcatggctgcatgttgcccaggaaggggctctgcaggaggcaactgggccacccacccttgagagcacaagcagagcaggcctccgtgccaggcacgctgggatcggcctgcctgggagctggggctgaggtgtgagaggatggccagctggtctgacccccaccttctcctgggcagccccccaatcagccatgagtattatgacccggcggagtttat

SEQ ID NO: 4032 - DNA, 24983 bp, human
cgcgcccgcccatcccccgctgccctttttctcctggccgggtgcgagggagcatgcccgcgcctggcctcggccagcgaagagttaacctgaggggcgagccgctgcccccacctcgggggcgtgcccccctcccccgctaggcggcccgccccccgcgccagggtatggcccctggccccggcccgggacccgaggtcccgcgcccgggtcagtgaaaggcgtcttcccgttcccgccctccgcctcctctcgccggccagcaacatgggatgtaatatgtgcgtggtccagaaaccggaggagcagtacaaagtgatgctgcaggtagggccgccggcgctgcggcgggggcgcggccctccgcggggaggagcgggccagtggggaggcccggagcggcgggcgtgggagagcgggagggctcgaggaggacaaggtagggagccgtccgcaccctcccatcctggggctgttgggtgttggcgctccgtgggaaccagccacgggtggggtgggaagttggggttggcccgggtggggcgcgcttccgtcccgggaggcgcggtgcggcgggcgcgggatggaggttgcatagcaacgagcgcagttccccgcacacgctctccccgcaggacccagggcgggggagggagccaggctcccgccgtgcggggggcgccgaatctagatcccggcgggcctggagcgtgggagtgcgtgggcgtccccgggcgcggtccaagtccgtccgggggctgggtgcccaccccgacacccactcccgcctggccctgcccgaacgatgggctcccgggccttaggcgtctcgggtgagtgggcgccgccgggatcagcgggttgggctctctgcgggtggcagtgcctggccgggctttgcggggcgtggaccagcagggccccgcggggagggaaggagacgcggggcccggagctcggacctggagcccagccccgcggcccggaacggggcttcttgcctgtgcgtggcgtgactacgtgagtgcgttcctgtgccccgtctctgtgtgcgcggaggctcccccggccccgcatttgtgtactttctgtgtgcaccctgcagactgtctagagaaatgtcccggatgctgtgggctgagacctcctagggctaagtggagggaggtcaaggtcaaggcacccaggagcagacagggctcagacaggtatgcgtttagtggcctggattcaactcccgggtttattggtctggactgggaaggaatcaagtgctttgcaggaggggtgttggcttgggagaacgtgggggaacccgtgcagggatcggcgagaactccggggcgggggcgggggcgggggaaggaggggctgggcacgggggagaattcccaggaatccggggactgacttcacgctgtgagccgagctcctctggccacctggtgcgggagccgaggggcagggcggggacgcaaatcttgccccaccctggcggagctcctggtcctctctccccggcccttctccgggggtgcgcggggccctcggcttctcccgttcgctgtcctccgccttcttccctctcagttcccggctgccactcctcgtctcttgttcccgctgtttggaaaccttgtgtggccattgccagccccctagcgggataggaatgcgaccgagagggcgtcctgtggaatccgtgttggattccagggctgggatggttggttgacggggactctggatcccatcctcctgcttccttttcgggagtcattccatcaaacggcaagcgatttctccaagcgattcctccggggccgttttgactttcctggagaaggattggtgtcgcacttcatttaaggccaacctcgtggggacgtgtggataggggagagcgacccgagctgcaccccaggcctgaaatgagccatgggacgacaccggtagcccttggggctccccacagccctccgggaaggcctcggcaggtcgggctgggcctgccttcagggaggtgaacttgggtgggccctccctgctctgcgccctaagctctccttcatggaagggacttgcccaccccaaggagacccgccaggaggagggccactgccgcatgcgccctctgtgcgctttcctgctgggctccctttgaaaccgtgggagtttggctgcaaactttcactttctacattcctccttggcccaatcaaagccgggattttacgaggagaaccatccttcacaactaagggaaaacaagaggactgaaaaaagtagatacggaaagcagtgcaagccatgagctgtcccaggggactgcgcttctgggggtggacgcatcaccaggtcccagcctcttcagaggagaaggagcttttgttccaaaagacaggtcagcttctgggaccccgtgcctgcctcccggcctccttaaacacgggtgctcccccatctttagggggcacttctccctgtcccccctgagtaacctcgtccgcaccttgtcagggtgaggcacttcatgggcctgattttcagaaagaagcacatgtgcatctgcagcgccttccatctacaatccacagaggcctgggatccccaggccaggaacccccaagtctctagcctagccttgtgttccaagccattttctgccaatgactcacaacacttccaaaattacagctgtattgagctatcattctcctactgcacaacttaccctttcaaagtgtacaagtcagtggtttttagtatactcacaaggttgtgcagcccacaccagtaattccagaacgttttcatcaccccaaaagaaaccctgcactccttagcaatcacatccccatttctccctcaaacttcctagcccctggcacccaccaatctacttcctgtctctatggatttgtttattctaaacatttcatagaaactgaccttttgtgtctggctttcattaatcataatgttttcaaggttcatccatgtatcaatagtcaatttctttttattgccaaataatatttcattttgtgatatacaacatatttatccattcgtcagttgatgagcatttggggtgcttccacccttgggctgttgtgaatagcgctgctgtgaacactggtctacttgtatctgtttgagtccttgcttttaattctttggagtgtgtgcctgtagccattgaactgttttccacagtggctggaaccagtttacattcccaccagcaacatataagggttccaatttctctatatctttgccaacagttgttattttctgggtttttgttatggccgtcctgctgggtgtgaagtggtatctcattgtgattttgatttgcacttcctgttagctaaatgatgagcaccttttcttgtgcttgttggccatttgtggatcttctttagaaaaatgtctgttcttaagccagcgccacactgctttcattactgcagctttgtagtaagttttgaagtaaggaaatgagagtcctccaactttgtacgtctttttcaagactgttttgtctattctaagtccctcaagtttccatattaatttcaggatcaggttgttaatttctggaaagaagccagttggcattttgatagagattgcatcaaatttgtggatcaatttgggtagtattgttcatgagcatggggtgcgttttccatttatttaggtctttaatttctttacatgatgttttgcacttttgtttaagtttattcatgagtattttctttatgatgctatcataaatggaatcgttttcttaattttactttcagccttctcattgctactgtatagaaatacaattgattggctgagcgtgttggctcacacctgtaatcccagcactttgggaggccaaggcgggtggctcacctgtgcttaggagttcaagaccagcctggccaacatagtggaaccccgtctctactaaaaatacaaaaaaaattaacggggcatggtgatgtgtgcctgtaatcccagctactcaggagactgaggcaagagaatcgcatgaaccccagaggcagaggttgcagtgagctgagattgcaccgctgcactccagcctgggtgacagggcaggactctgtctcaaaaaaaaaattgatttttatacattgatcctatatcttgcgaccttactaaaattgtttattaagtataatttgtttagtagattcctcaggattatctacatattaggatcatgtcattggcaaatagaaatcgtttttcttcttcctttccaatctggatggctttgatttcttttcttttctttctttctttttttttttttttttgagacacagtctcactttgtcacccagactggagtgcagtggtgcaatctcggctcactgcagcctccgcctcccgggttcaagtgattctcctgcctcagcttcccatgtagctaggattacaggcacacactaccacacccagctaatttttgtatttttagcagagacgagcttttgccatgttggccaggctagtcttgaactcctggcctcaagcaatcctgcccgcctcggcctcccaaagtgctgggattaccggtgtaaaccaccgttcctggcccttcgatttctttttcttgttaatttgctctggctggagtctctagtacaatgttgaatagaagtgcctgtgaatgtctttcccttgttcctcatcttaaaggtaaagaagcttccagtctttcactagggggtataaagttagctgtggctttttcatagctgtcctttatcagggtaaggaagttcccattctattcctagtgtgtttttatcatgagaggcattggattgtgcagtgctgcttctgtggctagtgagatgaccacatggttcctttattccacggatgtgggttgtcacaggcactttcgtgtgtcatgtcggaacctcagccccattcctatattccaatcatgtcctcctagtttggaaaatctgggacctcccctgaaaatggaggattactgcgtgttgagttaggaaaaggaagcaggctggttgcccagaatggaaggcaggaaacagcatgtccccagctccggagccttttctgcagcccatgtccctccactgccaccaggcccccttgtcatatatctcatcgtggtccacactctgctgaacttgtcttggccttggcaccccctctctgacaccatgatgtgcttgctagcatccgagcacgccggagatggtcaggggataaacccctggtacttaggactggtctcccgcccatcctactcaggctttacagggggagtgggtcaggaccgcctgtcatctcccctctgtccacatcgagggaggccaaaggacagctggccagcccttctggtgatctcccaggcattcttgcctaaagcacctgcatgtgagcccccatggtgctggcagccatcctgggtgcgtggcattcagcagggagacactgcagacagggccttgcccctcccccagactccccttttgttgttgttgttgttgttgtttgagacagagtttcgctcttgttgcccaggctggagtgcaatggtacgatctgggctcaccaaaacctccgcctccagggttcaagcgattctcctgcctcagcctcccgagtagctgggattacaggcatgcgccaccatgcctggctaattttgtatttttagtagagatggggtttctccatgttggtcaggctggtcttgaactcccgacctcaggtgatccacccacaccggcctcccaaagtgctgggattacaggagtgagccaccacgcctggccccaggctcccctttttgtaagggggagaccatcgccaacatgtaggcaactgcgggggagagaaagtactgcttgagtgcgggagcgtggctggcagccagtgtcccctcttcagcgacgtcttcctccaaactgctctcccacccaccaagccaggtggcttctctggctccctcctgcttgcatgggggcttcctgtgagcagggatttgggtctggcatgggcactctgcctccccgcctcaccagcaccagatgctgccagcacatccacgctggcctccacccttccaggggaaagctggactctcagtcaactcagtggttctgccgcagaagctgactggggaagaagcaggctctgagaaagtccttgtggagtggaagaacagagggctggacactgaattctgactgccatcttctggaccaggtcatcctgttttgtgtcattgtcccaagattgtagaatgccctttcccctctcatctcggggttcctgaggactgtccagtctgctgaaatgaaattcgatagtgccagagagcagattcgtggttgcagggatgggcagaggggcatgaggacacttttggggaagatagaaatggccactgtcctgacggtggtgatggttccccaggttcatgtatgacatatgaacacctgccctttgcacactgaagatgtgcaggttaccacccagcaacagacctcaccaaagctttagaacaggaactccatggccacatgcacgcatcctggggagaaaggtgtcctttccttccttctacttcaggggccctgccagagaaggcagtgcagtgtggagataggaatggaggcagccaccaactgacagctgtgtggccaggggcaagtcgctgcatggcccactggctcagtgactcagtttcctcaactgtgaaatggcagtgaagagtgcttgcgtccgagggccattgtgacaaggaaaacagatggtgtgtcccccgggatctcactgggtggaggagggagttgctgccctcgggccattcagttggtcattaagaagtggaaattggctgggtgcggtggctcacgcctgtaatcccagcactttgggaggccgaggcgggtggatcatgaggtcaggagttcgagaccagcctggccagcatggtgaaaccccatctatactaaaaatacaaaaaattgaccaggcgtggtggctcacgcctgtaatcccagcactttgggaggctgaggtgggcggatcacctcaggtcaggagttcgagaccagcctgaccaacatagagaaaccccatctctactaaaaatacaaaattagccgggcatggtgacacatgcctgtaatcccaggtacgcgggaggctgaggcaggagaattgcttgaacccgggaggtggaggttgtggtgagctgagatcacgccattgcactccagcttgggctcgaaactccatctcaaaaaaaaatatatatatatatattagctgggcatcatgcacctgtagtcccagctactcgggaggctgaggcaggagaactgcttgaactcagcaggtggaggttgcatgagccaagatcaagccactgcactccagcctaggtgacagaacgagaccctgtctcaaataaataaattaattaaataaaaaataatgaaaaaggaaattatatggagaaggccttacatctgggtatgtcacagttaatgcccagtgacagaagaatgtccaatattattctgagaatttctctcaggaaagggacctccaagttttgaagaagtgtgatgtagtacaatattagttaggacagcctgggcaacatattgagaccttgtctctacaaaaataaaaaattgctcaggcgtagtggcatgcgcctctagtcccagcttctggggaggctgagtgggaggattgcttgaacccaggagttggaggcttctgtgagccgtgattgtaccactgcactctagcctgggcaatggagccagactgtgtctggaaaaaaaagaaagaaagacagagagaaagagagagagagagagggagggagggagagagagagagagagagaaagaaaaaacagatggacagggaacaaagcggaggcatatgtggtcattttgcacaggagttgggccggaggaggcgaggctgagcagcctggggctggacaagatgtcctccctttcagtgcattctgcctgtcctcatggctgcttggagcattgagaatgaaaaacgctgcagagggaatattgctttgattgtaaaacgctgcagagggaatattgctttgattgttgctagatgtgaactgtgcccttagccagtcaggttagcctgaggtgggtgggaggatgggtttagttgctgggccacgtgcctggaaagctgtgaatatgtacccgaaggttgatcttgagaatggcttcaggaagtggttggcttttcctgtgcaaggtgtgggacacccctcttttcctgtgtgttttttttttttttttttttgagacagagtcttgctctgtcacccaggctagagtgcagtgttgtgatctcggctcattgcagcctccgcctcctgggttcaagcaattctgcctcagcctcccgagtagctgggattacaggcacctgccaccacgcctggctaatttttgtatttttagtaaagacagggtttcatcatgttggccagtctggtctcaaactcctgacctctagtgatccgcctgcctcggcctcccaaaatgctgggattacaggcgtgagccaccgcgcccggcctcctttctgcttctgagccaggactatggaggtgtctgagaggccgccgctctcccggaaaggtgggggccaggtggattgatgagacttcagcagaccctgggcttcggggagggaaggagaagtgaggggaaagaaagatgccctcatgcagaaggccttcgttgaggtctgccctggttcctccagggcgcgctctgagtcagtacagcgccaccctccacccgaagtccttgttaaggtgcactttctgactgagccactagcatggggcctgggattctgcacttctcacaagctcccaggtgatgtggatcccactggctgtgagtagccagggccttgggtagggaccgggagtagatctatggtagccccaaaccacattaacatgggtggtgaagtgaggtgttgttttttttgtttgtttgttttgttttttttttttacaaatagagggtaaaaattgtttacaaatagagggtaaaaaaacacacatagagggtaaatcagaacatccaggagtcgttgcctacgtgagggctttacaggacataacttgttcttccctgccatgtgcagctaactgacccccttccctgtcaccggcacccctaccggtatacatgtctctcatggacgcccagacacccctcccccgactaagtgctcaaaggcctttgagatgaagccctcccatgtttctgtctctcctgcccccaggcagaaagggtgggcacagagttatggaagcgggtggtgtggcttgcccaggaggccacagttgggggcgtgggcagccatgctacttgccgggcctgtcacctctttgtccctgctagaattctaacatgttggtggagacattttgcagccaccaatgcagtaattaattcaggcaaaaatcatcactggatgccaaaaccattagatgtaaggtcgttggggacagaatattcacaaagtctccaaatattaccccaaattacctgtgaatcaggaagggaaactgcgtctttacagaggagagatctggcagctgccacctggaccatgtgatcaaacagcctccccaacagtggggcagcctgaccctgccagccgccagatgcagggctggggaggagacatacagcatctcctgcaaggtgctcttgtcaaaacgctcagcctgaatctcaccgcgggaatgaatcaggcaaattcagactctggcgcattctataaggactggtctcttccaagaagtcattcccattaaagtaaaaaatatatatatttttttctagattagagaggagacataataactagagacctaacaaccgaatgtaatatgtgtgcttcttgattgaatcctagattttttgtttgtttgttttgtttttgagatggagtctctctgtgtcacccaggctggagtgtgatggtgtgatctcagctcacttcaacctctgcttcctgggttcaatcaattctcctgcctcagcctcccaagtagctgggaccataggctgcaccaccacgcctcgctttttttttttttttttttttttttgagatggagtcttgctctgtcgcccaggctggagtgcagtggcacgatctcggctcactgcaacctcctccgccacccgggttcaagtgattctcctgcctcagcctccctagtagctggaactacaggtgcaagccaccacgcccggctaatttttgtatttttagtagagacggggtttcaccatattggccatgctggtctcgaactcctgaccttgtgatctgcccgcctcagcctcccaaagtgctgggattacaggcatgagccattgtgcccagcctcaaatcctagatttttaaaaaaagctataagggtgttagcgggacagctggggagatgtgaggctggcccattgtatgagtgcggaattccgtgctaagggtgttgtggttccacggagaatgggactgatggcatcttgctttcaaatgcttctgcacatgtgtgtgtagaaaccccgagagcaggtgtggggaatctgcagatgttcccacatgcttgtgggcggacaattttcaaaatcccgagctggggaaacatgaatggggactttgctgggtcactgagtgggtgaatgtagtgagcctgcggcttctcctttctcctctgatgctctactcgttgggagatcccccgatgcctgacttggcctggaagctacagtcacaactgcttccaaggtgtcctggatactccagacggcagagctgagagccagcaggcaggtcagagctcggccccgggcagaggataacttcctgtctctgtccttccccagcttgtttcctactctacagcagtggggtaaggggagtccgaaggtggcagcccccccacctccgtggcagccacgggggcccctggaagtgatgtggcttcacctcccatcccgcgcgttgccagtgagagtgaaaggggtcgcaggcgccgtgtgacaagcacttgggattgcgagtctcccaggccacaactgttttcttagcctctccggcctctcttctcggcttcccagagattcctgatcagcaagagggcgtcgcgccccacccggctgtgcgcctgccaccgctgggtgcaggagggtgcctggggcagagcctggaaacagagctcagcctccgacggggttggcggggcgggcgggcaggagtcctgccaatacagccaccagcgtggcggcgccgggacgagtgtggtccgccctgctcccgcagccgcagccaccccgccgccgtcgcggcgcgctctttgtctgcggctccgggctcagggggcggggcgagcgcgcctggggctccgccctctccgcctagggcgccccgcttcccgcgtcccctaaggcccgccagtcccttgcccagcgggagatcgccgccccacagcgactgcccgtggggccgacttcgcgtcatgcctgcctcgcctgcccggtgttgccccctcccctgtccctgtgtcccccctcccttgcccgcatgtccccctcatgcggggaaagcggtgccagcactttccctggccttgcgaattgctcttccatcggtattcagccgcccctctgatgttcctgaaaacccaacctgctccttctctgcaaaaagctccggaaggctgtgtcgatgcaggtcgagcttccccacccggccccctcccaccttttagcaaatccagaggccccaccttcgccctcccctcccgggctccgacccagtgcattgagcagctcctcggcttccctcccgggactttctagtctctctccccaaccggctcagtgtcagggtgccccaggactctccttgggcctctcctgttcttgactacattcactccctaggtgagctcctccatctcatgcttttgctttttaaatttttatttatttatttttaaatttttattatttttgagacagggtctcagtccgttgctcaggctggagtggagtggcacaatcacggctcactgcagccttgacctcccaatgctcaggtgatcctcttgcctcagccctaccgcctgccccctacctcctccaccacttggggctacaggagcgagacaccacgcccagcttcatctcatgattctttttttgtttgagacggagtcttgctctgttgcccaggctggagtacagtggtgtgatctgggctcactgcaacctccacctcctgggttccagtggttctcctgcctcagcctcccaagtagttgggattacaggtgcctgccaccacgccctgctaatttttgtatttttcgtagagatagggtttcgccatgttggccaagctggtctcgaactcctgacctcaagtgatccgtctgtctcggcctcccaaagtgctgggactacaggcttgagccaccgtgcctggccgtcatcttatgattttaaataaagaaaaattcctagtttaattgaacagcaatggtcacatgccacccagttagctgacttgggcttgggccagacatttggagtggggcactggagatgtccacatgcctcgggaagttcaagctagagataaaaaccttccatttcctgccctgggcctaatccctgagtccttccttcctcggtcttcctcactgctgtgaggatacccctggtccttgtggtcctgtgtggcaattttatgttttcttgtggtaagatacgcataacataacatttaccactagtgacttttagtctattctcaatgttgtgcagccgtggccactgtctagttccagaacaggttcatcgccccaaaagggacctcatatccctcagcagtgactccccaggccccccttcctccaggtcctggcaaccattcgtctgctttctgtctgcctctttgccttggctagactgtgctcatgcagtcgtgtgtgccggtcgttcattctttttatgtcgggatgggtgtaccatgttgtgctcgctcatccattcatccactggtggacacgggttgcctccgagtcttggttactatggatactctgctgtgagcatttgagtataagttttctttgcatgcctgttctcaactatggatactctgctgtgagcatttgagtgtaagttttctttgcacgcctgttctcagttctttggggattgctgggtcatgtacataagctacacctaaccttgtgaggagccaccagactgcttccctggctgcactattttacatgcccagcagcaaggcgtgaggctccagggtccccgcgtcctctccaatactcgtgcttcctttcactgattccagcctcctcgtggtgtgcggcggtatctcactgtggtttgggtgtgtgtttcctctgtgcgtactggccggtgctgacgcgtcttttcctgcgcttattcgatgtcttcttcaagccctcactgtcccttgcccccagcccaacagcaggtcctggcagcctacctctaaaacccaagctgactctgaccacatcccaccacctctactgccacccctggggtcatgccaccatcatctgtggtctggaccactgccgttgcctgctggtctggcccttacagtctgttctcctgggagctcccttcgctacaaggaaggaagcatggctggtttcttgtcatcatttaggtctcagctcaagtgtcaccgacccagagaggctgtcctgaccactctacccacccaggcagctttgtctctgtcccctcccaccttccaaccaagccccttggggagcggaacgggatggggggtgtgttctggatccaccgtctctcccttcagctccttggcactcctttcctatggggcaccctgtccagggcaggtggggcaggattcccccctcttccctcatctcccgtgcttcccgggcccaccccccagcatctccagcctgcccgggagtcacatgtcctcggcccacagaatccccagcacacgccccacccacaggcctagccccagccctggggtccctggcaccccacctgccagggcccctcccctgccttgctcaccccccaacacacctgattgttggaaaggtcttcccatgcccaccacgaccccctcccactcatctgtgggcgggagagcttggtccctgccgcacgttgcccccctagcatccaggcccaccaccgagcccccgacaggcctgggagccccactggtgggtggggacccaccagctgggggtcttgctcacaccgaggggctgggggtggcggtggctttctcagggcaccctgccttgggctgcaggccgctgggtgggcaccggctccctcggaaggcagcgcaacccgggatcctgccggccctggcccccaccctgccgaccgggcctggggcgatcagtgccccagctcctgtcctcttctgctcagatgctgggttgggagatcaggggccacagctcggccactcagagccctttccgcaagtcttagagggaccagctgcggggtgtgtgcagaggggctgcgctgtggggagggcgcatggctcagtcctcctggcctgaggcccgcctagcctaagtggcctccaggacccatggccaggcccttctgcagccttccagaaagaaccagcttcccagggttccctggggaaggcctggggccacctcctctggaggggtggggcctgtgcttcattcctccttccccaggtccccttccaggccgccaggtcccctccccgacctggagcccacagccttgtaattaaattgtaaacgtccttgtaattaaattcatgtaatatccattattattattactgttttagactaaattacttagagcacattgactggatcaaaggctaccatgaacgttttcaagggtttttatagttattgacaaattcttctccagaaatttgaccactttacactctggggtaagattcagactaagtgtgtctagaaagggtgatggggtcggctgggaggaggaactgggcttgcaggggacctggggcagtgagtgctctcagtgtgcaaaggggaactgggctgtcccaagcaggatgtgagggccacttgggccacattcaggcagaggggccctgctaaggcttgagtcccctgttcagagcagggaccatggtggaaattaaggacgttcatgtcaactgtggttgagattggagctgcagtcctagagtcagccctcttgggcccatcttggcagcaaatcaggaaggaagtagatctgtgtgctgaagagtcgccatggggcacgtcaagcccctggctgagccgtggtgtgctcacaggctgctgcactccccggggcagcggagtgccagggacttgtattttcatctttgtgctcctccgcctcctcagtgtggcgctctgagcacttcgattatttgaaaggaaatgcgaaaatttgtacaaaatctattgtgctagcacgtgatggaggaggggtctttgtgaacaggctttgagggtttgcttggctcacagctcactacccagtcaacagggttgactgccacggggtgacctcgctaaggtgaagcatgatgcccagcacgtggtcaggatggcacgggagcactggagaagatgagagtcgctgggaacctgggcgaggggggacaaggggcatttgagtgggcttcaggtacgtgaagtgttgcaagataaagtgggtttcttctggattgttccaaaggagggaggttgctctcaatgaaggaaacattcaatagtgagagttttccgataatgagctcagtcaacaatccccactctccccatactagagaagcaaagtggatttcttctggattgttccaaaggagagaagtttgcacttgatgaaggagacttttttttggggggggggtggggggtggatggagtctgactctgttgcccaggctggagtgcagtggtgcaatctcagctcactgcagcctccacctcccaggttcaagtgattctcctgcctcagcctctcaagtagctgagattacaggcgtgcaccaccatgcccggctaagttttgtatttttagttgagacggggtttcactgtgttggccaggctggtctcgaactcctgacctcaggtgatctgcctgccttggcctcccaaagtgctgggattacaggcgtgagcctccgtgctgggcaatttttgtatttttagtagagtccgggtacatcagactcaggggctgggtcatgcctgtaatctcaacacttttggggggactaagcagatggcttgagcccaggagttcgagactagcctgggcaacatggtgaaaccccatctcttattattattattttttaaaaggtagatcagataaattacaggtccttaatatatattcaacaaattacagaaatatataaaattttaattcagccaagaaacatattaaagttttatcttcagcaaactgttaggagttgggatggaagtagaactcagggtgaagccctcttggggtttgttgtctaatgaaagggaggtaattagacaatcacacataaaaggctgagctccagcctgggtatcttgaggcctcctggacttgctgtagcatctggagaagtatggggcatcatctcgcatcacttagcaccagcactgccacccagccttgatgtgggtcctgttggcctgagcgtttttccttgaagaaggtattaaaagcagattgaagccgcctgtgcccacccatcccctacgcacttcatctgctcgcctctctgccgtgttttccaccaagtacatactacgaatgagcctccattatgtgcgcctccattaactgcacatgcggaataccaggaattgtttgttcgactgctggcagacctttgggctgtccctggtgtttggccactgtggccttcatgcccacatcctcctggtcctcctggtggtggttctgaagggcatctcctctcatctcatggctccaagtgcttgctagtgggtcccctttgccctgagcacctgttgatatcctttgcccatgttcttcttgagttgtttgtgtctgtgttttcttgttgttttgtaggaattctttgcatattctggaaaacccattatgaggtccatgcattgtaaggctctcctctgagcccgcctttttactgtgtttagggtgtcttttgtcgtctagaagttttacatctcttccattattgcttccccatttgaaatattgagaatttcgtctctatcccacaccataaagatattgttctcttgttttgctttgtccctgtaggtctttgatccaattggaattgcttggccagggcttggactaggtcttctgtcttggtggggcgagctcccagggtgtggaaacgtttgcaggtggggcaggagggagagtctggtgggaagcaagcctggggttggccatgttgagtgtttgtgccttttagagactggagtggtcgagtaggcaatccgagggttggggcattacaggggtggctttaccagtgtgctacctcaggatggttgggggtggggcggggaggcaaggctctgagcaggactggaagagctgctgtcatcagaagggccacagtgtggctccttaccatgtgcctggccctatacctctttgctcatggccccatattttcccaccttgttggtagcccttagcccttccccagaggggagctcatttcttccttgggggtccagcatgaccgatgaggaggagagagagagagagcgagaaggcttcaggagcccgtggcttccacccaaatacctgcctggctgtcacaggcgatcactctggttgctgctgatccgaggtgctgaggctgtgcccacgcccatccccctcttgacatcccagcctccgccagcccgcccagcaagcgctcctcagtttccatagcaacactgctgctcggtaatgattccgggtagaaaggcattcgtgcgttctctgtcatctctgtcacctgagcatcccactgcctgcttgctgtcctgccccgggagttcaggaagaaaccctgaggacagctccgagcccttctgcttgtgtgttggcttctcctcaagggcagtggtaaggtggtaaatgttcccagacaaaaagccctgatttggagcatttgccgatttccctggtgtaaatgctgccactatagccgatttcaagccaccactgcgatgtcactgaacttggagttgggggaatgcacacatagtatttccatctcccataccagatgtgaataaccccaaaagcacagatgacagaaaagtgtagtaagataattagacagtgatgtgttccgaggatttattgcctttgttgttaatatcattcagttacctgtacatttctacggttaaaataccaataatcgctgtgtttgacaactggcttccaaatttcccagcttcagttggctctagccactgctgctgagagtgtcgaggccattccatcatgtccctttgtctacagccttcctgaacccacactctgctgccgcccaccctcttccatcctgcctttctaactgtagcctctccaccaagcacagcatgccctgtcctgactgacattcttacggtcttccaacaaataccttcttggctgaaagctgtttcctttatagtatttgatccagaaattccacctcaagaaattttctccaccttgacaaccactggttacacaaagatttaagtatgaaaaatgtataaaatggaccccagaatgtgtctttgccacattctttataataaaaaatcaaagccacccttactgatgtgatgatgaacatgatggtccactggtgtgttggtgtggatggaccttaaggggcctgcagctgcaaaatggcacacatagaaaacagactggaaggaaacaggccgcatggccaggtgcggtggctcatgcctataatcccagcactttgggaggctgaggcaggaggattacttgaggtcaggagtttgagaccatcctggccaacatagtgaaaccccatctctactaaaaatacaaaaattatccaggcgtggtggtgggtgcctgtaatcctagctattggggaggctgaggcaggagaatcacttgaacccaggaggcagaggttgcagtgagccaagattatgccactgcacttcagcctggatgacagagcaagactctgtctaaaaaaaaaaaaacaacagctgggtgtggtggcacacacctgtagtcccagctacttgggaggctgaggcaggagaattgcttgagcccaggaggtggaggttgcagtgagccaagatcgtgccactgcaccccagcctgggcaacagagcaagactccatctcaacaaaaaaaagcccccaaaaaacaaaaaaatgaactgtgtttcttttataatcggacaaaactgattttgacaaaaagctcttttcagaatatgaaaattttggggagaagggagacatagaaaacttcaatgattatctacaaggacatagtcaaatagaaaaaaagtaatgcaggagccgctgctgaggccacaggggttccgaggacaagctgggctctcctcagatagctgtcttcccgaaaagactcgtacagcggtggttctactgtatcgcgggcactaagacaagattttgccgtcagaattgacatctctgtgagaaacccggggtgggaggtgccgccgtgagaatgcaggacagagagttcttctaaacttgctaatattcgcacaactcggaaaagcagagggctccgtgcaggcgcagccacctgcgcccatgcccagggcccttctgccctctcatctggcacaagctcccagcctgctccatccctaggcggactctgggtctcctcgccctgccctctctgtgctgactgggggctttgcttccaactgcaaaccagcctccctgggtcttttcttggccctgttccctttgcctgatggaggccaggtgtcccctgctccagaagccttccccgcctcccaccgaggcgtgcatggccagccgtgtgctcccttagctgtgggtaaggtctgtccccacgctcacctgcggggcatagccatttgggcataatgctagtgtgtagcctccccaggcccagaacagcccttccataagccgctgagcccatgaggagaccctgcacgcctgcctcgagctgcctcctcctagaagtgcttcctgctgacccttgctggccccatggcacgtgccctgaattctggtggagtctgttcagtccttcttggtccttagtcattcgtcccttctctacttgcctcccttccccaaggaggacttgaaggtcgcagcatactgtcccagggtgctgcggaagcagccttcgaccttgtgggcactgcttgccccaccacctgcgctgtgcgtaatgggcttccttctgctacccttcattgtccttccttcacccctacagcatcccgcagagctgcttaggtcctacttccgccttgggccctggcccgcgatggcctcctcctccctgacccctccttctggccaccgggcagcctgtcctggctcatgaccttgactcagtgccacaaccttgctgagcttgctgacatggtttcctcatctgcaataatggcatctccctcaaggttgttgggggttaggattttgtggagacccacatcaggggtctttcccagaatgtagcacatggcacgtgcccaaaaaacagtagtggcatttttttttctttgagacggagtctcgctctgtcgcccaagctggagtacagtggtgcgatctcggctcactgcaagctccgcctcctgggttcatgccattttcctgcctcagcctcccgaggagctgggactacaggcgcccaccaccacgcccggctaattttttgtatttttagtagagatggggtttcactgtgtttagccaggatggtctcgatctcctgacctcgtgatctgcccgcctaggcctcccaaagtgctgggattacaggcgtgagccaccgcacccggcctagtggtggctttataaggaccactttcttggcacctcttttaggctactttgcagttccagggggcttcttgtacatcaaggccttttctcttgggcaagtcagttgtcactgtgaggacacaacactgtatctttaggcatcttcctacttgtcccccaacctgaccctggccctccctagtgagtagacatttgttgagagactcggctcatctgaagagtcaaggtcatcctcttgcttgatgctgaatgagcacaacacagatgctcactgagtgttggctgttatggtccagtcattgccaaggaactcaatgggatcttcatgctagctctggcctcagtgccgccctagaaagaagtgggtccggatggggagaggccaggagagctcaagcagtgtctggaggacgttgtagggcggtatcacagcctccagacccagtgcacagaggctgggtcccccagtccttggtgtgacttggtgatccccagctggccttcagtgggatgaaggctgagcagtggggcttgcctgggaacaggggcaccaaaggtagccagggctgcagacagcagattccttgcttgagtggcttggggtgctggttgtcagcccaggtcctgccagctagggcctctgccttgacctcagaggggaggagcaagcctttgagggttcttacggaggcgtgtctctgccgcaggtgaacgggaaggagctctccaagctgtctcaggagcaaactctgcaggccctgcgctcctccaaggagcccctggtgatccaggtgctgagacgcagcccccgcctccggggggacagctcctgtcacgacctgcagctggtggacagtggcactcagaccgacatcaccttcgagcatatcatggcgctgggcaagctgcgtccgcccaccccgcccatggtcatcctggagccgtacgtcctctctgagctgtgagtcgccctcaggagggccccgggccctgcctccagagaggacaggccacctggagcggccatccgcacgccaccctctcgggcaggaagcaggcccctcggcctccagaactgaccgtggtacccaagggctccaaaacctccaggcctctagccttgggccgggctccagcaggcgccccgttgtatctacccccagggccgagggaggaccctcctgtccgggacgtcgctgccggaagtgccagggttgagggcctcagctcctcctcctccatcctctctcctctgccgcctcacaagcatcactccttgaatcttcttgcatcccttgtctgtctcattcctctacctgctctgaatttcctccatctcttcagcttctttctttggcccgaccggaagaagggcctttcatccaggcctggtggctcatgaccgcgtgagcgctgcctcattctgctaatcttagcccgggctgcggggaggtaggccacagggccatgagcagccaaccttagttttggggccaggagggcagcccctggaggtagggtgggcccccctctgctctgcagaagtcctccagggcctggataactcctgggggcgttgcatgagtggggccagtgctgggcgggcgggtgggcacccggagattggagaagttggtccctgccagctggcgtggttggaggagttctggtctgggggacgggaacgctagaggcatgcgcaggtcctctgcgtggacgctgcacactcaggtgcgagaagtgcccccggtctttgcatggctgcatgttgcccaggaaggggctctgcaggaggcaactgggccacccacccttgagagcacaagcagagcaggcctccgtgccaggcacgctgggatcggcctgcctgggagctggggctgaggtgtgagaggatggccagctggtctgacccccaccttctcctgggcagccccccaatcagccatgagtattatgacccggcggagtttatggagggcggcccgcaggaggcagaccgcttggatgagctggagtatgaggtgagccgggtggccaggccagggcccgcagccagctgcgggagccgccccgacgcctgtgtgccttcctgcccaggcccaaccccgtggccctcctggcacgcatctggctgagtcagggagggtgcgggtgaggttacgtgttccgtccatgtcggtgagtccacgtcccatgcacgtctgtcttctgtgtcctgtgcctgtgtgtgcctcgtgcatttcctgggagggagaccactgagtacgtgcgccacgtgggatggtaagagagaccctcaaagcggggcctggaaactgagctcagggggctccagaggaagctgaggggctgcgggctgaggggttgcgggctgaggggctgggctgtgctgcctgctccctcactcacgcatttctggggctttctacctctgcttcctcccggacccctcgtggcaggaggtggagctgtataaaagcagccaccgggacaagctgggcctgatggtttgctaccgcacggacgacgaggaggacctgggcatttatgtcggagaggtatgcagacgggtatgccccagccccgaggcccatccacatggcctgcctgtggctcagaggctgcccttaaggtcccagctaccagaaacagggcatcacagctagggtgctgcgtggtgaggcgatgatggtcgacggcttcagccactgtccagtgaggtagtcatctgcagaaagaggcctgtgcctgggtgggacagcagatgggcctgagaactagcaacagggttgctgtctagccttctcccgaacccatcttgggcagatgtcttgtgtatccccaggagggggatggcccctcgctcccctccctactagtagcatcccactaaagccacccttccagatggacaatgtcctacttcccaccaatgcccggggctgaccaaaagcacaggcttccgtgcagaagagcctaggagtgcagggcaggggcggggagaggtgactactccacagcctctgcctctgcttcctggggctcagagctggaaggggagccagagagccttcagcttgctttgggggcccctgaggtgagcctgcccccttctaccgaaagggcatgttaggcaccaagtccccaagatgcgtgtgtcctgcaggtaaatcccaacagcattgcagccaaagacggccggatccgtgagggagaccgcatcatccaggtgagcacttgcaggctgcaggcctggcccaaggccccgctgtgcccgtcggcccagccacctctctttagccagtccctagctctctcccactaagagctaaccctgaggcccagcagcctgccgtgtcctaaacccgggctgagtctcatctctctcctgcccactcaccccagtggctcccgtgtgcctatgggatctgctggcatccagggcccctgctgctctgaaacctcctggcccctctccctctgccccactccatgctctcctgagcacacatttgctcttgcaagagtcaggccgccctctccctggtaccttccacttagttacatcctcccagagctcaagccccagcctagcccagccgagcccagagtgcttgggctccctgcacccgcccagggtccgccccagggccagccctagcatgcttgttgattgtatcctgcctgcctcagattaacggtgtagacgtccagaac

SEQ ID NO: 4033 - DNA, 22354 bp, human
cccgttcccgccctccgcctcctctcgccggccagcaacatgggatgtaatatgtgcgtggtccagaaaccggaggagcagtacaaagtgatgctgcaggtagggccgccggcgctgcggcgggggcgcggccctccgcggggaggagcgggccagtggggaggcccggagcggcgggcgtgggagagcgggagggctcgaggaggacaaggtagggagccgtccgcaccctcccatcctggggctgttgggtgttggcgctccgtgggaaccagccacgggtggggtgggaagttggggttggcccgggtggggcgcgcttccgtcccgggaggcgcggtgcggcgggcgcgggatggaggttgcatagcaacgagcgcagttccccgcacacgctctccccgcaggacccagggcgggggagggagccaggctcccgccgtgcggggggcgccgaatctagatcccggcgggcctggagcgtgggagtgcgtgggcgtccccgggcgcggtccaagtccgtccgggggctgggtgcccaccccgacacccactcccgcctggccctgcccgaacgatgggctcccgggccttaggcgtctcgggtgagtgggcgccgccgggatcagcgggttgggctctctgcgggtggcagtgcctggccgggctttgcggggcgtggaccagcagggccccgcggggagggaaggagacgcggggcccggagctcggacctggagcccagccccgcggcccggaacggggcttcttgcctgtgcgtggcgtgactacgtgagtgcgttcctgtgccccgtctctgtgtgcgcggaggctcccccggccccgcatttgtgtactttctgtgtgcaccctgcagactgtctagagaaatgtcccggatgctgtgggctgagacctcctagggctaagtggagggaggtcaaggtcaaggcacccaggagcagacagggctcagacaggtatgcgtttagtggcctggattcaactcccgggtttattggtctggactgggaaggaatcaagtgctttgcaggaggggtgttggcttgggagaacgtgggggaacccgtgcagggatcggcgagaactccggggcgggggcgggggcgggggaaggaggggctgggcacgggggagaattcccaggaatccggggactgacttcacgctgtgagccgagctcctctggccacctggtgcgggagccgaggggcagggcggggacgcaaatcttgccccaccctggcggagctcctggtcctctctccccggcccttctccgggggtgcgcggggccctcggcttctcccgttcgctgtcctccgccttcttccctctcagttcccggctgccactcctcgtctcttgttcccgctgtttggaaaccttgtgtggccattgccagccccctagcgggataggaatgcgaccgagagggcgtcctgtggaatccgtgttggattccagggctgggatggttggttgacggggactctggatcccatcctcctgcttccttttcgggagtcattccatcaaacggcaagcgatttctccaagcgattcctccggggccgttttgactttcctggagaaggattggtgtcgcacttcatttaaggccaacctcgtggggacgtgtggataggggagagcgacccgagctgcaccccaggcctgaaatgagccatgggacgacaccggtagcccttggggctccccacagccctccgggaaggcctcggcaggtcgggctgggcctgccttcagggaggtgaacttgggtgggccctccctgctctgcgccctaagctctccttcatggaagggacttgcccaccccaaggagacccgccaggaggagggccactgccgcatgcgccctctgtgcgctttcctgctgggctccctttgaaaccgtgggagtttggctgcaaactttcactttctacattcctccttggcccaatcaaagccgggattttacgaggagaaccatccttcacaactaagggaaaacaagaggactgaaaaaagtagatacggaaagcagtgcaagccatgagctgtcccaggggactgcgcttctgggggtggacgcatcaccaggtcccagcctcttcagaggagaaggagcttttgttccaaaagacaggtcagcttctgggaccccgtgcctgcctcccggcctccttaaacacgggtgctcccccatctttagggggcacttctccctgtcccccctgagtaacctcgtccgcaccttgtcagggtgaggcacttcatgggcctgattttcagaaagaagcacatgtgcatctgcagcgccttccatctacaatccacagaggcctgggatccccaggccaggaacccccaagtctctagcctagccttgtgttccaagccattttctgccaatgactcacaacacttccaaaattacagctgtattgagctatcattctcctactgcacaacttaccctttcaaagtgtacaagtcagtggtttttagtatactcacaaggttgtgcagcccacaccagtaattccagaacgttttcatcaccccaaaagaaaccctgcactccttagcaatcacatccccatttctccctcaaacttcctagcccctggcacccaccaatctacttcctgtctctatggatttgtttattctaaacatttcatagaaactgaccttttgtgtctggctttcattaatcataatgttttcaaggttcatccatgtatcaatagtcaatttctttttattgccaaataatatttcattttgtgatatacaacatatttatccattcgtcagttgatgagcatttggggtgcttccacccttgggctgttgtgaatagcgctgctgtgaacactggtctacttgtatctgtttgagtccttgcttttaattctttggagtgtgtgcctgtagccattgaactgttttccacagtggctggaaccagtttacattcccaccagcaacatataagggttccaatttctctatatctttgccaacagttgttattttctgggtttttgttatggccgtcctgctgggtgtgaagtggtatctcattgtgattttgatttgcacttcctgttagctaaatgatgagcaccttttcttgtgcttgttggccatttgtggatcttctttagaaaaatgtctgttcttaagccagcgccacactgctttcattactgcagctttgtagtaagttttgaagtaaggaaatgagagtcctccaactttgtacgtctttttcaagactgttttgtctattctaagtccctcaagtttccatattaatttcaggatcaggttgttaatttctggaaagaagccagttggcattttgatagagattgcatcaaatttgtggatcaatttgggtagtattgttcatgagcatggggtgcgttttccatttatttaggtctttaatttctttacatgatgttttgcacttttgtttaagtttattcatgagtattttctttatgatgctatcataaatggaatcgttttcttaattttactttcagccttctcattgctactgtatagaaatacaattgattggctgagcgtgttggctcacacctgtaatcccagcactttgggaggccaaggcgggtggctcacctgtgcttaggagttcaagaccagcctggccaacatagtggaaccccgtctctactaaaaatacaaaaaaaattaacggggcatggtgatgtgtgcctgtaatcccagctactcaggagactgaggcaagagaatcgcatgaaccccagaggcagaggttgcagtgagctgagattgcaccgctgcactccagcctgggtgacagggcaggactctgtctcaaaaaaaaaattgatttttatacattgatcctatatcttgcgaccttactaaaattgtttattaagtataatttgtttagtagattcctcaggattatctacatattaggatcatgtcattggcaaatagaaatcgtttttcttcttcctttccaatctggatggctttgatttcttttcttttctttctttctttttttttttttttttgagacacagtctcactttgtcacccagactggagtgcagtggtgcaatctcggctcactgcagcctccgcctcccgggttcaagtgattctcctgcctcagcttcccatgtagctaggattacaggcacacactaccacacccagctaatttttgtatttttagcagagacgagcttttgccatgttggccaggctagtcttgaactcctggcctcaagcaatcctgcccgcctcggcctcccaaagtgctgggattaccggtgtaaaccaccgttcctggcccttcgatttctttttcttgttaatttgctctggctggagtctctagtacaatgttgaatagaagtgcctgtgaatgtctttcccttgttcctcatcttaaaggtaaagaagcttccagtctttcactagggggtataaagttagctgtggctttttcatagctgtcctttatcagggtaaggaagttcccattctattcctagtgtgtttttatcatgagaggcattggattgtgcagtgctgcttctgtggctagtgagatgaccacatggttcctttattccacggatgtgggttgtcacaggcactttcgtgtgtcatgtcggaacctcagccccattcctatattccaatcatgtcctcctagtttggaaaatctgggacctcccctgaaaatggaggattactgcgtgttgagttaggaaaaggaagcaggctggttgcccagaatggaaggcaggaaacagcatgtccccagctccggagccttttctgcagcccatgtccctccactgccaccaggcccccttgtcatatatctcatcgtggtccacactctgctgaacttgtcttggccttggcaccccctctctgacaccatgatgtgcttgctagcatccgagcacgccggagatggtcaggggataaacccctggtacttaggactggtctcccgcccatcctactcaggctttacagggggagtgggtcaggaccgcctgtcatctcccctctgtccacatcgagggaggccaaaggacagctggccagcccttctggtgatctcccaggcattcttgcctaaagcacctgcatgtgagcccccatggtgctggcagccatcctgggtgcgtggcattcagcagggagacactgcagacagggccttgcccctcccccagactccccttttgttgttgttgttgttgttgtttgagacagagtttcgctcttgttgcccaggctggagtgcaatggtacgatctgggctcaccaaaacctccgcctccagggttcaagcgattctcctgcctcagcctcccgagtagctgggattacaggcatgcgccaccatgcctggctaattttgtatttttagtagagatggggtttctccatgttggtcaggctggtcttgaactcccgacctcaggtgatccacccacaccggcctcccaaagtgctgggattacaggagtgagccaccacgcctggccccaggctcccctttttgtaagggggagaccatcgccaacatgtaggcaactgcgggggagagaaagtactgcttgagtgcgggagcgtggctggcagccagtgtcccctcttcagcgacgtcttcctccaaactgctctcccacccaccaagccaggtggcttctctggctccctcctgcttgcatgggggcttcctgtgagcagggatttgggtctggcatgggcactctgcctccccgcctcaccagcaccagatgctgccagcacatccacgctggcctccacccttccaggggaaagctggactctcagtcaactcagtggttctgccgcagaagctgactggggaagaagcaggctctgagaaagtccttgtggagtggaagaacagagggctggacactgaattctgactgccatcttctggaccaggtcatcctgttttgtgtcattgtcccaagattgtagaatgccctttcccctctcatctcggggttcctgaggactgtccagtctgctgaaatgaaattcgatagtgccagagagcagattcgtggttgcagggatgggcagaggggcatgaggacacttttggggaagatagaaatggccactgtcctgacggtggtgatggttccccaggttcatgtatgacatatgaacacctgccctttgcacactgaagatgtgcaggttaccacccagcaacagacctcaccaaagctttagaacaggaactccatggccacatgcacgcatcctggggagaaaggtgtcctttccttccttctacttcaggggccctgccagagaaggcagtgcagtgtggagataggaatggaggcagccaccaactgacagctgtgtggccaggggcaagtcgctgcatggcccactggctcagtgactcagtttcctcaactgtgaaatggcagtgaagagtgcttgcgtccgagggccattgtgacaaggaaaacagatggtgtgtcccccgggatctcactgggtggaggagggagttgctgccctcgggccattcagttggtcattaagaagtggaaattggctgggtgcggtggctcacgcctgtaatcccagcactttgggaggccgaggcgggtggatcatgaggtcaggagttcgagaccagcctggccagcatggtgaaaccccatctatactaaaaatacaaaaaattgaccaggcgtggtggctcacgcctgtaatcccagcactttgggaggctgaggtgggcggatcacctcaggtcaggagttcgagaccagcctgaccaacatagagaaaccccatctctactaaaaatacaaaattagccgggcatggtgacacatgcctgtaatcccaggtacgcgggaggctgaggcaggagaattgcttgaacccgggaggtggaggttgtggtgagctgagatcacgccattgcactccagcttgggctcgaaactccatctcaaaaaaaaatatatatatatatattagctgggcatcatgcacctgtagtcccagctactcgggaggctgaggcaggagaactgcttgaactcagcaggtggaggttgcatgagccaagatcaagccactgcactccagcctaggtgacagaacgagaccctgtctcaaataaataaattaattaaataaaaaataatgaaaaaggaaattatatggagaaggccttacatctgggtatgtcacagttaatgcccagtgacagaagaatgtccaatattattctgagaatttctctcaggaaagggacctccaagttttgaagaagtgtgatgtagtacaatattagttaggacagcctgggcaacatattgagaccttgtctctacaaaaataaaaaattgctcaggcgtagtggcatgcgcctctagtcccagcttctggggaggctgagtgggaggattgcttgaacccaggagttggaggcttctgtgagccgtgattgtaccactgcactctagcctgggcaatggagccagactgtgtctggaaaaaaaagaaagaaagacagagagaaagagagagagagagagggagggagggagagagagagagagagagaaagaaaaaacagatggacagggaacaaagcggaggcatatgtggtcattttgcacaggagttgggccggaggaggcgaggctgagcagcctggggctggacaagatgtcctccctttcagtgcattctgcctgtcctcatggctgcttggagcattgagaatgaaaaacgctgcagagggaatattgctttgattgtaaaacgctgcagagggaatattgctttgattgttgctagatgtgaactgtgcccttagccagtcaggttagcctgaggtgggtgggaggatgggtttagttgctgggccacgtgcctggaaagctgtgaatatgtacccgaaggttgatcttgagaatggcttcaggaagtggttggcttttcctgtgcaaggtgtgggacacccctcttttcctgtgtgttttttttttttttttttttgagacagagtcttgctctgtcacccaggctagagtgcagtgttgtgatctcggctcattgcagcctccgcctcctgggttcaagcaattctgcctcagcctcccgagtagctgggattacaggcacctgccaccacgcctggctaatttttgtatttttagtaaagacagggtttcatcatgttggccagtctggtctcaaactcctgacctctagtgatccgcctgcctcggcctcccaaaatgctgggattacaggcgtgagccaccgcgcccggcctcctttctgcttctgagccaggactatggaggtgtctgagaggccgccgctctcccggaaaggtgggggccaggtggattgatgagacttcagcagaccctgggcttcggggagggaaggagaagtgaggggaaagaaagatgccctcatgcagaaggccttcgttgaggtctgccctggttcctccagggcgcgctctgagtcagtacagcgccaccctccacccgaagtccttgttaaggtgcactttctgactgagccactagcatggggcctgggattctgcacttctcacaagctcccaggtgatgtggatcccactggctgtgagtagccagggccttgggtagggaccgggagtagatctatggtagccccaaaccacattaacatgggtggtgaagtgaggtgttgttttttttgtttgtttgttttgttttttttttttacaaatagagggtaaaaattgtttacaaatagagggtaaaaaaacacacatagagggtaaatcagaacatccaggagtcgttgcctacgtgagggctttacaggacataacttgttcttccctgccatgtgcagctaactgacccccttccctgtcaccggcacccctaccggtatacatgtctctcatggacgcccagacacccctcccccgactaagtgctcaaaggcctttgagatgaagccctcccatgtttctgtctctcctgcccccaggcagaaagggtgggcacagagttatggaagcgggtggtgtggcttgcccaggaggccacagttgggggcgtgggcagccatgctacttgccgggcctgtcacctctttgtccctgctagaattctaacatgttggtggagacattttgcagccaccaatgcagtaattaattcaggcaaaaatcatcactggatgccaaaaccattagatgtaaggtcgttggggacagaatattcacaaagtctccaaatattaccccaaattacctgtgaatcaggaagggaaactgcgtctttacagaggagagatctggcagctgccacctggaccatgtgatcaaacagcctccccaacagtggggcagcctgaccctgccagccgccagatgcagggctggggaggagacatacagcatctcctgcaaggtgctcttgtcaaaacgctcagcctgaatctcaccgcgggaatgaatcaggcaaattcagactctggcgcattctataaggactggtctcttccaagaagtcattcccattaaagtaaaaaatatatatatttttttctagattagagaggagacataataactagagacctaacaaccgaatgtaatatgtgtgcttcttgattgaatcctagattttttgtttgtttgttttgtttttgagatggagtctctctgtgtcacccaggctggagtgtgatggtgtgatctcagctcacttcaacctctgcttcctgggttcaatcaattctcctgcctcagcctcccaagtagctgggaccataggctgcaccaccacgcctcgctttttttttttttttttttttttttgagatggagtcttgctctgtcgcccaggctggagtgcagtggcacgatctcggctcactgcaacctcctccgccacccgggttcaagtgattctcctgcctcagcctccctagtagctggaactacaggtgcaagccaccacgcccggctaatttttgtatttttagtagagacggggtttcaccatattggccatgctggtctcgaactcctgaccttgtgatctgcccgcctcagcctcccaaagtgctgggattacaggcatgagccattgtgcccagcctcaaatcctagatttttaaaaaaagctataagggtgttagcgggacagctggggagatgtgaggctggcccattgtatgagtgcggaattccgtgctaagggtgttgtggttccacggagaatgggactgatggcatcttgctttcaaatgcttctgcacatgtgtgtgtagaaaccccgagagcaggtgtggggaatctgcagatgttcccacatgcttgtgggcggacaattttcaaaatcccgagctggggaaacatgaatggggactttgctgggtcactgagtgggtgaatgtagtgagcctgcggcttctcctttctcctctgatgctctactcgttgggagatcccccgatgcctgacttggcctggaagctacagtcacaactgcttccaaggtgtcctggatactccagacggcagagctgagagccagcaggcaggtcagagctcggccccgggcagaggataacttcctgtctctgtccttccccagcttgtttcctactctacagcagtggggtaaggggagtccgaaggtggcagcccccccacctccgtggcagccacgggggcccctggaagtgatgtggcttcacctcccatcccgcgcgttgccagtgagagtgaaaggggtcgcaggcgccgtgtgacaagcacttgggattgcgagtctcccaggccacaactgttttcttagcctctccggcctctcttctcggcttcccagagattcctgatcagcaagagggcgtcgcgccccacccggctgtgcgcctgccaccgctgggtgcaggagggtgcctggggcagagcctggaaacagagctcagcctccgacggggttggcggggcgggcgggcaggagtcctgccaatacagccaccagcgtggcggcgccgggacgagtgtggtccgccctgctcccgcagccgcagccaccccgccgccgtcgcggcgcgctctttgtctgcggctccgggctcagggggcggggcgagcgcgcctggggctccgccctctccgcctagggcgccccgcttcccgcgtcccctaaggcccgccagtcccttgcccagcgggagatcgccgccccacagcgactgcccgtggggccgacttcgcgtcatgcctgcctcgcctgcccggtgttgccccctcccctgtccctgtgtcccccctcccttgcccgcatgtccccctcatgcggggaaagcggtgccagcactttccctggccttgcgaattgctcttccatcggtattcagccgcccctctgatgttcctgaaaacccaacctgctccttctctgcaaaaagctccggaaggctgtgtcgatgcaggtcgagcttccccacccggccccctcccaccttttagcaaatccagaggccccaccttcgccctcccctcccgggctccgacccagtgcattgagcagctcctcggcttccctcccgggactttctagtctctctccccaaccggctcagtgtcagggtgccccaggactctccttgggcctctcctgttcttgactacattcactccctaggtgagctcctccatctcatgcttttgctttttaaatttttatttatttatttttaaatttttattatttttgagacagggtctcagtccgttgctcaggctggagtggagtggcacaatcacggctcactgcagccttgacctcccaatgctcaggtgatcctcttgcctcagccctaccgcctgccccctacctcctccaccacttggggctacaggagcgagacaccacgcccagcttcatctcatgattctttttttgtttgagacggagtcttgctctgttgcccaggctggagtacagtggtgtgatctgggctcactgcaacctccacctcctgggttccagtggttctcctgcctcagcctcccaagtagttgggattacaggtgcctgccaccacgccctgctaatttttgtatttttcgtagagatagggtttcgccatgttggccaagctggtctcgaactcctgacctcaagtgatccgtctgtctcggcctcccaaagtgctgggactacaggcttgagccaccgtgcctggccgtcatcttatgattttaaataaagaaaaattcctagtttaattgaacagcaatggtcacatgccacccagttagctgacttgggcttgggccagacatttggagtggggcactggagatgtccacatgcctcgggaagttcaagctagagataaaaaccttccatttcctgccctgggcctaatccctgagtccttccttcctcggtcttcctcactgctgtgaggatacccctggtccttgtggtcctgtgtggcaattttatgttttcttgtggtaagatacgcataacataacatttaccactagtgacttttagtctattctcaatgttgtgcagccgtggccactgtctagttccagaacaggttcatcgccccaaaagggacctcatatccctcagcagtgactccccaggccccccttcctccaggtcctggcaaccattcgtctgctttctgtctgcctctttgccttggctagactgtgctcatgcagtcgtgtgtgccggtcgttcattctttttatgtcgggatgggtgtaccatgttgtgctcgctcatccattcatccactggtggacacgggttgcctccgagtcttggttactatggatactctgctgtgagcatttgagtataagttttctttgcatgcctgttctcaactatggatactctgctgtgagcatttgagtgtaagttttctttgcacgcctgttctcagttctttggggattgctgggtcatgtacataagctacacctaaccttgtgaggagccaccagactgcttccctggctgcactattttacatgcccagcagcaaggcgtgaggctccagggtccccgcgtcctctccaatactcgtgcttcctttcactgattccagcctcctcgtggtgtgcggcggtatctcactgtggtttgggtgtgtgtttcctctgtgcgtactggccggtgctgacgcgtcttttcctgcgcttattcgatgtcttcttcaagccctcactgtcccttgcccccagcccaacagcaggtcctggcagcctacctctaaaacccaagctgactctgaccacatcccaccacctctactgccacccctggggtcatgccaccatcatctgtggtctggaccactgccgttgcctgctggtctggcccttacagtctgttctcctgggagctcccttcgctacaaggaaggaagcatggctggtttcttgtcatcatttaggtctcagctcaagtgtcaccgacccagagaggctgtcctgaccactctacccacccaggcagctttgtctctgtcccctcccaccttccaaccaagccccttggggagcggaacgggatggggggtgtgttctggatccaccgtctctcccttcagctccttggcactcctttcctatggggcaccctgtccagggcaggtggggcaggattcccccctcttccctcatctcccgtgcttcccgggcccaccccccagcatctccagcctgcccgggagtcacatgtcctcggcccacagaatccccagcacacgccccacccacaggcctagccccagccctggggtccctggcaccccacctgccagggcccctcccctgccttgctcaccccccaacacacctgattgttggaaaggtcttcccatgcccaccacgaccccctcccactcatctgtgggcgggagagcttggtccctgccgcacgttgcccccctagcatccaggcccaccaccgagcccccgacaggcctgggagccccactggtgggtggggacccaccagctgggggtcttgctcacaccgaggggctgggggtggcggtggctttctcagggcaccctgccttgggctgcaggccgctgggtgggcaccggctccctcggaaggcagcgcaacccgggatcctgccggccctggcccccaccctgccgaccgggcctggggcgatcagtgccccagctcctgtcctcttctgctcagatgctgggttgggagatcaggggccacagctcggccactcagagccctttccgcaagtcttagagggaccagctgcggggtgtgtgcagaggggctgcgctgtggggagggcgcatggctcagtcctcctggcctgaggcccgcctagcctaagtggcctccaggacccatggccaggcccttctgcagccttccagaaagaaccagcttcccagggttccctggggaaggcctggggccacctcctctggaggggtggggcctgtgcttcattcctccttccccaggtccccttccaggccgccaggtcccctccccgacctggagcccacagccttgtaattaaattgtaaacgtccttgtaattaaattcatgtaatatccattattattattactgttttagactaaattacttagagcacattgactggatcaaaggctaccatgaacgttttcaagggtttttatagttattgacaaattcttctccagaaatttgaccactttacactctggggtaagattcagactaagtgtgtctagaaagggtgatggggtcggctgggaggaggaactgggcttgcaggggacctggggcagtgagtgctctcagtgtgcaaaggggaactgggctgtcccaagcaggatgtgagggccacttgggccacattcaggcagaggggccctgctaaggcttgagtcccctgttcagagcagggaccatggtggaaattaaggacgttcatgtcaactgtggttgagattggagctgcagtcctagagtcagccctcttgggcccatcttggcagcaaatcaggaaggaagtagatctgtgtgctgaagagtcgccatggggcacgtcaagcccctggctgagccgtggtgtgctcacaggctgctgcactccccggggcagcggagtgccagggacttgtattttcatctttgtgctcctccgcctcctcagtgtggcgctctgagcacttcgattatttgaaaggaaatgcgaaaatttgtacaaaatctattgtgctagcacgtgatggaggaggggtctttgtgaacaggctttgagggtttgcttggctcacagctcactacccagtcaacagggttgactgccacggggtgacctcgctaaggtgaagcatgatgcccagcacgtggtcaggatggcacgggagcactggagaagatgagagtcgctgggaacctgggcgaggggggacaaggggcatttgagtgggcttcaggtacgtgaagtgttgcaagataaagtgggtttcttctggattgttccaaaggagggaggttgctctcaatgaaggaaacattcaatagtgagagttttccgataatgagctcagtcaacaatccccactctccccatactagagaagcaaagtggatttcttctggattgttccaaaggagagaagtttgcacttgatgaaggagacttttttttggggggggggtggggggtggatggagtctgactctgttgcccaggctggagtgcagtggtgcaatctcagctcactgcagcctccacctcccaggttcaagtgattctcctgcctcagcctctcaagtagctgagattacaggcgtgcaccaccatgcccggctaagttttgtatttttagttgagacggggtttcactgtgttggccaggctggtctcgaactcctgacctcaggtgatctgcctgccttggcctcccaaagtgctgggattacaggcgtgagcctccgtgctgggcaatttttgtatttttagtagagtccgggtacatcagactcaggggctgggtcatgcctgtaatctcaacacttttggggggactaagcagatggcttgagcccaggagttcgagactagcctgggcaacatggtgaaaccccatctcttattattattattttttaaaaggtagatcagataaattacaggtccttaatatatattcaacaaattacagaaatatataaaattttaattcagccaagaaacatattaaagttttatcttcagcaaactgttaggagttgggatggaagtagaactcagggtgaagccctcttggggtttgttgtctaatgaaagggaggtaattagacaatcacacataaaaggctgagctccagcctgggtatcttgaggcctcctggacttgctgtagcatctggagaagtatggggcatcatctcgcatcacttagcaccagcactgccacccagccttgatgtgggtcctgttggcctgagcgtttttccttgaagaaggtattaaaagcagattgaagccgcctgtgcccacccatcccctacgcacttcatctgctcgcctctctgccgtgttttccaccaagtacatactacgaatgagcctccattatgtgcgcctccattaactgcacatgcggaataccaggaattgtttgttcgactgctggcagacctttgggctgtccctggtgtttggccactgtggccttcatgcccacatcctcctggtcctcctggtggtggttctgaagggcatctcctctcatctcatggctccaagtgcttgctagtgggtcccctttgccctgagcacctgttgatatcctttgcccatgttcttcttgagttgtttgtgtctgtgttttcttgttgttttgtaggaattctttgcatattctggaaaacccattatgaggtccatgcattgtaaggctctcctctgagcccgcctttttactgtgtttagggtgtcttttgtcgtctagaagttttacatctcttccattattgcttccccatttgaaatattgagaatttcgtctctatcccacaccataaagatattgttctcttgttttgctttgtccctgtaggtctttgatccaattggaattgcttggccagggcttggactaggtcttctgtcttggtggggcgagctcccagggtgtggaaacgtttgcaggtggggcaggagggagagtctggtgggaagcaagcctggggttggccatgttgagtgtttgtgccttttagagactggagtggtcgagtaggcaatccgagggttggggcattacaggggtggctttaccagtgtgctacctcaggatggttgggggtggggcggggaggcaaggctctgagcaggactggaagagctgctgtcatcagaagggccacagtgtggctccttaccatgtgcctggccctatacctctttgctcatggccccatattttcccaccttgttggtagcccttagcccttccccagaggggagctcatttcttccttgggggtccagcatgaccgatgaggaggagagagagagagagcgagaaggcttcaggagcccgtggcttccacccaaatacctgcctggctgtcacaggcgatcactctggttgctgctgatccgaggtgctgaggctgtgcccacgcccatccccctcttgacatcccagcctccgccagcccgcccagcaagcgctcctcagtttccatagcaacactgctgctcggtaatgattccgggtagaaaggcattcgtgcgttctctgtcatctctgtcacctgagcatcccactgcctgcttgctgtcctgccccgggagttcaggaagaaaccctgaggacagctccgagcccttctgcttgtgtgttggcttctcctcaagggcagtggtaaggtggtaaatgttcccagacaaaaagccctgatttggagcatttgccgatttccctggtgtaaatgctgccactatagccgatttcaagccaccactgcgatgtcactgaacttggagttgggggaatgcacacatagtatttccatctcccataccagatgtgaataaccccaaaagcacagatgacagaaaagtgtagtaagataattagacagtgatgtgttccgaggatttattgcctttgttgttaatatcattcagttacctgtacatttctacggttaaaataccaataatcgctgtgtttgacaactggcttccaaatttcccagcttcagttggctctagccactgctgctgagagtgtcgaggccattccatcatgtccctttgtctacagccttcctgaacccacactctgctgccgcccaccctcttccatcctgcctttctaactgtagcctctccaccaagcacagcatgccctgtcctgactgacattcttacggtcttccaacaaataccttcttggctgaaagctgtttcctttatagtatttgatccagaaattccacctcaagaaattttctccaccttgacaaccactggttacacaaagatttaagtatgaaaaatgtataaaatggaccccagaatgtgtctttgccacattctttataataaaaaatcaaagccacccttactgatgtgatgatgaacatgatggtccactggtgtgttggtgtggatggaccttaaggggcctgcagctgcaaaatggcacacatagaaaacagactggaaggaaacaggccgcatggccaggtgcggtggctcatgcctataatcccagcactttgggaggctgaggcaggaggattacttgaggtcaggagtttgagaccatcctggccaacatagtgaaaccccatctctactaaaaatacaaaaattatccaggcgtggtggtgggtgcctgtaatcctagctattggggaggctgaggcaggagaatcacttgaacccaggaggcagaggttgcagtgagccaagattatgccactgcacttcagcctggatgacagagcaagactctgtctaaaaaaaaaaaaacaacagctgggtgtggtggcacacacctgtagtcccagctacttgggaggctgaggcaggagaattgcttgagcccaggaggtggaggttgcagtgagccaagatcgtgccactgcaccccagcctgggcaacagagcaagactccatctcaacaaaaaaaagcccccaaaaaacaaaaaaatgaactgtgtttcttttataatcggacaaaactgattttgacaaaaagctcttttcagaatatgaaaattttggggagaagggagacatagaaaacttcaatgattatctacaaggacatagtcaaatagaaaaaaagtaatgcaggagccgctgctgaggccacaggggttccgaggacaagctgggctctcctcagatagctgtcttcccgaaaagactcgtacagcggtggttctactgtatcgcgggcactaagacaagattttgccgtcagaattgacatctctgtgagaaacccggggtgggaggtgccgccgtgagaatgcaggacagagagttcttctaaacttgctaatattcgcacaactcggaaaagcagagggctccgtgcaggcgcagccacctgcgcccatgcccagggcccttctgccctctcatctggcacaagctcccagcctgctccatccctaggcggactctgggtctcctcgccctgccctctctgtgctgactgggggctttgcttccaactgcaaaccagcctccctgggtcttttcttggccctgttccctttgcctgatggaggccaggtgtcccctgctccagaagccttccccgcctcccaccgaggcgtgcatggccagccgtgtgctcccttagctgtgggtaaggtctgtccccacgctcacctgcggggcatagccatttgggcataatgctagtgtgtagcctccccaggcccagaacagcccttccataagccgctgagcccatgaggagaccctgcacgcctgcctcgagctgcctcctcctagaagtgcttcctgctgacccttgctggccccatggcacgtgccctgaattctggtggagtctgttcagtccttcttggtccttagtcattcgtcccttctctacttgcctcccttccccaaggaggacttgaaggtcgcagcatactgtcccagggtgctgcggaagcagccttcgaccttgtgggcactgcttgccccaccacctgcgctgtgcgtaatgggcttccttctgctacccttcattgtccttccttcacccctacagcatcccgcagagctgcttaggtcctacttccgccttgggccctggcccgcgatggcctcctcctccctgacccctccttctggccaccgggcagcctgtcctggctcatgaccttgactcagtgccacaaccttgctgagcttgctgacatggtttcctcatctgcaataatggcatctccctcaaggttgttgggggttaggattttgtggagacccacatcaggggtctttcccagaatgtagcacatggcacgtgcccaaaaaacagtagtggcatttttttttctttgagacggagtctcgctctgtcgcccaagctggagtacagtggtgcgatctcggctcactgcaagctccgcctcctgggttcatgccattttcctgcctcagcctcccgaggagctgggactacaggcgcccaccaccacgcccggctaattttttgtatttttagtagagatggggtttcactgtgtttagccaggatggtctcgatctcctgacctcgtgatctgcccgcctaggcctcccaaagtgctgggattacaggcgtgagccaccgcacccggcctagtggtggctttataaggaccactttcttggcacctcttttaggctactttgcagttccagggggcttcttgtacatcaaggccttttctcttgggcaagtcagttgtcactgtgaggacacaacactgtatctttaggcatcttcctacttgtcccccaacctgaccctggccctccctagtgagtagacatttgttgagagactcggctcatctgaagagtcaaggtcatcctcttgcttgatgctgaatgagcacaacacagatgctcactgagtgttggctgttatggtccagtcattgccaaggaactcaatgggatcttcatgctagctctggcctcagtgccgccctagaaagaagtgggtccggatggggagaggccaggagagctcaagcagtgtctggaggacgttgtagggcggtatcacagcctccagacccagtgcacagaggctgggtcccccagtccttggtgtgacttggtgatccccagctggccttcagtgggatgaaggctgagcagtggggcttgcctgggaacaggggcaccaaaggtagccagggctgcagacagcagattccttgcttgagtggcttggggtgctggttgtcagcccaggtcctgccagctagggcctctgccttgacctcagaggggaggagcaagcctttgagggttcttacggaggcgtgtctctgccgcaggtgaacgggaaggagctctccaagctgtctcaggagcaaactctgcaggccctgcgctcctccaaggagcccctggtgatccaggtgctgagacgcagcccccgcctccggggggacagctcctgtcacgacctgcagctggtggacagtggcactcagaccgacatcaccttcgagcatatcatggcgctgggcaagctgcgtccgcccaccccgcccatggtcatcctggagccgtacgtcctctctgagctgtgagtcgccctcaggagggccccgggccctgcctccagagaggacaggccacctggagcggccatccgcacgccaccctctcgggcaggaagcaggcccctcggcctccagaactgaccgtggtacccaagggctccaaaacctccaggcctctagccttgggccgggctccagcaggcgccccgttgtatctacccccagggccgagggaggaccctcctgtccgggacgtcgctgccggaagtgccagggttgagggcctcagctcctcctcctccatcctctctcctctgccgcctcacaagcatcactccttgaatcttcttgcatcccttgtctgtctcattcctctacctg

SEQ ID NO: 4034 - DNA, 28324 bp, human
agcgaagagttaacctgaggggcgagccgctgcccccacctcgggggcgtgcccccctcccccgctaggcggcccgccccccgcgccagggtatggcccctggccccggcccgggacccgaggtcccgcgcccgggtcagtgaaaggcgtcttcccgttcccgccctccgcctcctctcgccggccagcaacatgggatgtaatatgtgcgtggtccagaaaccggaggagcagtacaaagtgatgctgcaggtagggccgccggcgctgcggcgggggcgcggccctccgcggggaggagcgggccagtggggaggcccggagcggcgggcgtgggagagcgggagggctcgaggaggacaaggtagggagccgtccgcaccctcccatcctggggctgttgggtgttggcgctccgtgggaaccagccacgggtggggtgggaagttggggttggcccgggtggggcgcgcttccgtcccgggaggcgcggtgcggcgggcgcgggatggaggttgcatagcaacgagcgcagttccccgcacacgctctccccgcaggacccagggcgggggagggagccaggctcccgccgtgcggggggcgccgaatctagatcccggcgggcctggagcgtgggagtgcgtgggcgtccccgggcgcggtccaagtccgtccgggggctgggtgcccaccccgacacccactcccgcctggccctgcccgaacgatgggctcccgggccttaggcgtctcgggtgagtgggcgccgccgggatcagcgggttgggctctctgcgggtggcagtgcctggccgggctttgcggggcgtggaccagcagggccccgcggggagggaaggagacgcggggcccggagctcggacctggagcccagccccgcggcccggaacggggcttcttgcctgtgcgtggcgtgactacgtgagtgcgttcctgtgccccgtctctgtgtgcgcggaggctcccccggccccgcatttgtgtactttctgtgtgcaccctgcagactgtctagagaaatgtcccggatgctgtgggctgagacctcctagggctaagtggagggaggtcaaggtcaaggcacccaggagcagacagggctcagacaggtatgcgtttagtggcctggattcaactcccgggtttattggtctggactgggaaggaatcaagtgctttgcaggaggggtgttggcttgggagaacgtgggggaacccgtgcagggatcggcgagaactccggggcgggggcgggggcgggggaaggaggggctgggcacgggggagaattcccaggaatccggggactgacttcacgctgtgagccgagctcctctggccacctggtgcgggagccgaggggcagggcggggacgcaaatcttgccccaccctggcggagctcctggtcctctctccccggcccttctccgggggtgcgcggggccctcggcttctcccgttcgctgtcctccgccttcttccctctcagttcccggctgccactcctcgtctcttgttcccgctgtttggaaaccttgtgtggccattgccagccccctagcgggataggaatgcgaccgagagggcgtcctgtggaatccgtgttggattccagggctgggatggttggttgacggggactctggatcccatcctcctgcttccttttcgggagtcattccatcaaacggcaagcgatttctccaagcgattcctccggggccgttttgactttcctggagaaggattggtgtcgcacttcatttaaggccaacctcgtggggacgtgtggataggggagagcgacccgagctgcaccccaggcctgaaatgagccatgggacgacaccggtagcccttggggctccccacagccctccgggaaggcctcggcaggtcgggctgggcctgccttcagggaggtgaacttgggtgggccctccctgctctgcgccctaagctctccttcatggaagggacttgcccaccccaaggagacccgccaggaggagggccactgccgcatgcgccctctgtgcgctttcctgctgggctccctttgaaaccgtgggagtttggctgcaaactttcactttctacattcctccttggcccaatcaaagccgggattttacgaggagaaccatccttcacaactaagggaaaacaagaggactgaaaaaagtagatacggaaagcagtgcaagccatgagctgtcccaggggactgcgcttctgggggtggacgcatcaccaggtcccagcctcttcagaggagaaggagcttttgttccaaaagacaggtcagcttctgggaccccgtgcctgcctcccggcctccttaaacacgggtgctcccccatctttagggggcacttctccctgtcccccctgagtaacctcgtccgcaccttgtcagggtgaggcacttcatgggcctgattttcagaaagaagcacatgtgcatctgcagcgccttccatctacaatccacagaggcctgggatccccaggccaggaacccccaagtctctagcctagccttgtgttccaagccattttctgccaatgactcacaacacttccaaaattacagctgtattgagctatcattctcctactgcacaacttaccctttcaaagtgtacaagtcagtggtttttagtatactcacaaggttgtgcagcccacaccagtaattccagaacgttttcatcaccccaaaagaaaccctgcactccttagcaatcacatccccatttctccctcaaacttcctagcccctggcacccaccaatctacttcctgtctctatggatttgtttattctaaacatttcatagaaactgaccttttgtgtctggctttcattaatcataatgttttcaaggttcatccatgtatcaatagtcaatttctttttattgccaaataatatttcattttgtgatatacaacatatttatccattcgtcagttgatgagcatttggggtgcttccacccttgggctgttgtgaatagcgctgctgtgaacactggtctacttgtatctgtttgagtccttgcttttaattctttggagtgtgtgcctgtagccattgaactgttttccacagtggctggaaccagtttacattcccaccagcaacatataagggttccaatttctctatatctttgccaacagttgttattttctgggtttttgttatggccgtcctgctgggtgtgaagtggtatctcattgtgattttgatttgcacttcctgttagctaaatgatgagcaccttttcttgtgcttgttggccatttgtggatcttctttagaaaaatgtctgttcttaagccagcgccacactgctttcattactgcagctttgtagtaagttttgaagtaaggaaatgagagtcctccaactttgtacgtctttttcaagactgttttgtctattctaagtccctcaagtttccatattaatttcaggatcaggttgttaatttctggaaagaagccagttggcattttgatagagattgcatcaaatttgtggatcaatttgggtagtattgttcatgagcatggggtgcgttttccatttatttaggtctttaatttctttacatgatgttttgcacttttgtttaagtttattcatgagtattttctttatgatgctatcataaatggaatcgttttcttaattttactttcagccttctcattgctactgtatagaaatacaattgattggctgagcgtgttggctcacacctgtaatcccagcactttgggaggccaaggcgggtggctcacctgtgcttaggagttcaagaccagcctggccaacatagtggaaccccgtctctactaaaaatacaaaaaaaattaacggggcatggtgatgtgtgcctgtaatcccagctactcaggagactgaggcaagagaatcgcatgaaccccagaggcagaggttgcagtgagctgagattgcaccgctgcactccagcctgggtgacagggcaggactctgtctcaaaaaaaaaattgatttttatacattgatcctatatcttgcgaccttactaaaattgtttattaagtataatttgtttagtagattcctcaggattatctacatattaggatcatgtcattggcaaatagaaatcgtttttcttcttcctttccaatctggatggctttgatttcttttcttttctttctttctttttttttttttttttgagacacagtctcactttgtcacccagactggagtgcagtggtgcaatctcggctcactgcagcctccgcctcccgggttcaagtgattctcctgcctcagcttcccatgtagctaggattacaggcacacactaccacacccagctaatttttgtatttttagcagagacgagcttttgccatgttggccaggctagtcttgaactcctggcctcaagcaatcctgcccgcctcggcctcccaaagtgctgggattaccggtgtaaaccaccgttcctggcccttcgatttctttttcttgttaatttgctctggctggagtctctagtacaatgttgaatagaagtgcctgtgaatgtctttcccttgttcctcatcttaaaggtaaagaagcttccagtctttcactagggggtataaagttagctgtggctttttcatagctgtcctttatcagggtaaggaagttcccattctattcctagtgtgtttttatcatgagaggcattggattgtgcagtgctgcttctgtggctagtgagatgaccacatggttcctttattccacggatgtgggttgtcacaggcactttcgtgtgtcatgtcggaacctcagccccattcctatattccaatcatgtcctcctagtttggaaaatctgggacctcccctgaaaatggaggattactgcgtgttgagttaggaaaaggaagcaggctggttgcccagaatggaaggcaggaaacagcatgtccccagctccggagccttttctgcagcccatgtccctccactgccaccaggcccccttgtcatatatctcatcgtggtccacactctgctgaacttgtcttggccttggcaccccctctctgacaccatgatgtgcttgctagcatccgagcacgccggagatggtcaggggataaacccctggtacttaggactggtctcccgcccatcctactcaggctttacagggggagtgggtcaggaccgcctgtcatctcccctctgtccacatcgagggaggccaaaggacagctggccagcccttctggtgatctcccaggcattcttgcctaaagcacctgcatgtgagcccccatggtgctggcagccatcctgggtgcgtggcattcagcagggagacactgcagacagggccttgcccctcccccagactccccttttgttgttgttgttgttgttgtttgagacagagtttcgctcttgttgcccaggctggagtgcaatggtacgatctgggctcaccaaaacctccgcctccagggttcaagcgattctcctgcctcagcctcccgagtagctgggattacaggcatgcgccaccatgcctggctaattttgtatttttagtagagatggggtttctccatgttggtcaggctggtcttgaactcccgacctcaggtgatccacccacaccggcctcccaaagtgctgggattacaggagtgagccaccacgcctggccccaggctcccctttttgtaagggggagaccatcgccaacatgtaggcaactgcgggggagagaaagtactgcttgagtgcgggagcgtggctggcagccagtgtcccctcttcagcgacgtcttcctccaaactgctctcccacccaccaagccaggtggcttctctggctccctcctgcttgcatgggggcttcctgtgagcagggatttgggtctggcatgggcactctgcctccccgcctcaccagcaccagatgctgccagcacatccacgctggcctccacccttccaggggaaagctggactctcagtcaactcagtggttctgccgcagaagctgactggggaagaagcaggctctgagaaagtccttgtggagtggaagaacagagggctggacactgaattctgactgccatcttctggaccaggtcatcctgttttgtgtcattgtcccaagattgtagaatgccctttcccctctcatctcggggttcctgaggactgtccagtctgctgaaatgaaattcgatagtgccagagagcagattcgtggttgcagggatgggcagaggggcatgaggacacttttggggaagatagaaatggccactgtcctgacggtggtgatggttccccaggttcatgtatgacatatgaacacctgccctttgcacactgaagatgtgcaggttaccacccagcaacagacctcaccaaagctttagaacaggaactccatggccacatgcacgcatcctggggagaaaggtgtcctttccttccttctacttcaggggccctgccagagaaggcagtgcagtgtggagataggaatggaggcagccaccaactgacagctgtgtggccaggggcaagtcgctgcatggcccactggctcagtgactcagtttcctcaactgtgaaatggcagtgaagagtgcttgcgtccgagggccattgtgacaaggaaaacagatggtgtgtcccccgggatctcactgggtggaggagggagttgctgccctcgggccattcagttggtcattaagaagtggaaattggctgggtgcggtggctcacgcctgtaatcccagcactttgggaggccgaggcgggtggatcatgaggtcaggagttcgagaccagcctggccagcatggtgaaaccccatctatactaaaaatacaaaaaattgaccaggcgtggtggctcacgcctgtaatcccagcactttgggaggctgaggtgggcggatcacctcaggtcaggagttcgagaccagcctgaccaacatagagaaaccccatctctactaaaaatacaaaattagccgggcatggtgacacatgcctgtaatcccaggtacgcgggaggctgaggcaggagaattgcttgaacccgggaggtggaggttgtggtgagctgagatcacgccattgcactccagcttgggctcgaaactccatctcaaaaaaaaatatatatatatatattagctgggcatcatgcacctgtagtcccagctactcgggaggctgaggcaggagaactgcttgaactcagcaggtggaggttgcatgagccaagatcaagccactgcactccagcctaggtgacagaacgagaccctgtctcaaataaataaattaattaaataaaaaataatgaaaaaggaaattatatggagaaggccttacatctgggtatgtcacagttaatgcccagtgacagaagaatgtccaatattattctgagaatttctctcaggaaagggacctccaagttttgaagaagtgtgatgtagtacaatattagttaggacagcctgggcaacatattgagaccttgtctctacaaaaataaaaaattgctcaggcgtagtggcatgcgcctctagtcccagcttctggggaggctgagtgggaggattgcttgaacccaggagttggaggcttctgtgagccgtgattgtaccactgcactctagcctgggcaatggagccagactgtgtctggaaaaaaaagaaagaaagacagagagaaagagagagagagagagggagggagggagagagagagagagagagaaagaaaaaacagatggacagggaacaaagcggaggcatatgtggtcattttgcacaggagttgggccggaggaggcgaggctgagcagcctggggctggacaagatgtcctccctttcagtgcattctgcctgtcctcatggctgcttggagcattgagaatgaaaaacgctgcagagggaatattgctttgattgtaaaacgctgcagagggaatattgctttgattgttgctagatgtgaactgtgcccttagccagtcaggttagcctgaggtgggtgggaggatgggtttagttgctgggccacgtgcctggaaagctgtgaatatgtacccgaaggttgatcttgagaatggcttcaggaagtggttggcttttcctgtgcaaggtgtgggacacccctcttttcctgtgtgttttttttttttttttttttgagacagagtcttgctctgtcacccaggctagagtgcagtgttgtgatctcggctcattgcagcctccgcctcctgggttcaagcaattctgcctcagcctcccgagtagctgggattacaggcacctgccaccacgcctggctaatttttgtatttttagtaaagacagggtttcatcatgttggccagtctggtctcaaactcctgacctctagtgatccgcctgcctcggcctcccaaaatgctgggattacaggcgtgagccaccgcgcccggcctcctttctgcttctgagccaggactatggaggtgtctgagaggccgccgctctcccggaaaggtgggggccaggtggattgatgagacttcagcagaccctgggcttcggggagggaaggagaagtgaggggaaagaaagatgccctcatgcagaaggccttcgttgaggtctgccctggttcctccagggcgcgctctgagtcagtacagcgccaccctccacccgaagtccttgttaaggtgcactttctgactgagccactagcatggggcctgggattctgcacttctcacaagctcccaggtgatgtggatcccactggctgtgagtagccagggccttgggtagggaccgggagtagatctatggtagccccaaaccacattaacatgggtggtgaagtgaggtgttgttttttttgtttgtttgttttgttttttttttttacaaatagagggtaaaaattgtttacaaatagagggtaaaaaaacacacatagagggtaaatcagaacatccaggagtcgttgcctacgtgagggctttacaggacataacttgttcttccctgccatgtgcagctaactgacccccttccctgtcaccggcacccctaccggtatacatgtctctcatggacgcccagacacccctcccccgactaagtgctcaaaggcctttgagatgaagccctcccatgtttctgtctctcctgcccccaggcagaaagggtgggcacagagttatggaagcgggtggtgtggcttgcccaggaggccacagttgggggcgtgggcagccatgctacttgccgggcctgtcacctctttgtccctgctagaattctaacatgttggtggagacattttgcagccaccaatgcagtaattaattcaggcaaaaatcatcactggatgccaaaaccattagatgtaaggtcgttggggacagaatattcacaaagtctccaaatattaccccaaattacctgtgaatcaggaagggaaactgcgtctttacagaggagagatctggcagctgccacctggaccatgtgatcaaacagcctccccaacagtggggcagcctgaccctgccagccgccagatgcagggctggggaggagacatacagcatctcctgcaaggtgctcttgtcaaaacgctcagcctgaatctcaccgcgggaatgaatcaggcaaattcagactctggcgcattctataaggactggtctcttccaagaagtcattcccattaaagtaaaaaatatatatatttttttctagattagagaggagacataataactagagacctaacaaccgaatgtaatatgtgtgcttcttgattgaatcctagattttttgtttgtttgttttgtttttgagatggagtctctctgtgtcacccaggctggagtgtgatggtgtgatctcagctcacttcaacctctgcttcctgggttcaatcaattctcctgcctcagcctcccaagtagctgggaccataggctgcaccaccacgcctcgctttttttttttttttttttttttttgagatggagtcttgctctgtcgcccaggctggagtgcagtggcacgatctcggctcactgcaacctcctccgccacccgggttcaagtgattctcctgcctcagcctccctagtagctggaactacaggtgcaagccaccacgcccggctaatttttgtatttttagtagagacggggtttcaccatattggccatgctggtctcgaactcctgaccttgtgatctgcccgcctcagcctcccaaagtgctgggattacaggcatgagccattgtgcccagcctcaaatcctagatttttaaaaaaagctataagggtgttagcgggacagctggggagatgtgaggctggcccattgtatgagtgcggaattccgtgctaagggtgttgtggttccacggagaatgggactgatggcatcttgctttcaaatgcttctgcacatgtgtgtgtagaaaccccgagagcaggtgtggggaatctgcagatgttcccacatgcttgtgggcggacaattttcaaaatcccgagctggggaaacatgaatggggactttgctgggtcactgagtgggtgaatgtagtgagcctgcggcttctcctttctcctctgatgctctactcgttgggagatcccccgatgcctgacttggcctggaagctacagtcacaactgcttccaaggtgtcctggatactccagacggcagagctgagagccagcaggcaggtcagagctcggccccgggcagaggataacttcctgtctctgtccttccccagcttgtttcctactctacagcagtggggtaaggggagtccgaaggtggcagcccccccacctccgtggcagccacgggggcccctggaagtgatgtggcttcacctcccatcccgcgcgttgccagtgagagtgaaaggggtcgcaggcgccgtgtgacaagcacttgggattgcgagtctcccaggccacaactgttttcttagcctctccggcctctcttctcggcttcccagagattcctgatcagcaagagggcgtcgcgccccacccggctgtgcgcctgccaccgctgggtgcaggagggtgcctggggcagagcctggaaacagagctcagcctccgacggggttggcggggcgggcgggcaggagtcctgccaatacagccaccagcgtggcggcgccgggacgagtgtggtccgccctgctcccgcagccgcagccaccccgccgccgtcgcggcgcgctctttgtctgcggctccgggctcagggggcggggcgagcgcgcctggggctccgccctctccgcctagggcgccccgcttcccgcgtcccctaaggcccgccagtcccttgcccagcgggagatcgccgccccacagcgactgcccgtggggccgacttcgcgtcatgcctgcctcgcctgcccggtgttgccccctcccctgtccctgtgtcccccctcccttgcccgcatgtccccctcatgcggggaaagcggtgccagcactttccctggccttgcgaattgctcttccatcggtattcagccgcccctctgatgttcctgaaaacccaacctgctccttctctgcaaaaagctccggaaggctgtgtcgatgcaggtcgagcttccccacccggccccctcccaccttttagcaaatccagaggccccaccttcgccctcccctcccgggctccgacccagtgcattgagcagctcctcggcttccctcccgggactttctagtctctctccccaaccggctcagtgtcagggtgccccaggactctccttgggcctctcctgttcttgactacattcactccctaggtgagctcctccatctcatgcttttgctttttaaatttttatttatttatttttaaatttttattatttttgagacagggtctcagtccgttgctcaggctggagtggagtggcacaatcacggctcactgcagccttgacctcccaatgctcaggtgatcctcttgcctcagccctaccgcctgccccctacctcctccaccacttggggctacaggagcgagacaccacgcccagcttcatctcatgattctttttttgtttgagacggagtcttgctctgttgcccaggctggagtacagtggtgtgatctgggctcactgcaacctccacctcctgggttccagtggttctcctgcctcagcctcccaagtagttgggattacaggtgcctgccaccacgccctgctaatttttgtatttttcgtagagatagggtttcgccatgttggccaagctggtctcgaactcctgacctcaagtgatccgtctgtctcggcctcccaaagtgctgggactacaggcttgagccaccgtgcctggccgtcatcttatgattttaaataaagaaaaattcctagtttaattgaacagcaatggtcacatgccacccagttagctgacttgggcttgggccagacatttggagtggggcactggagatgtccacatgcctcgggaagttcaagctagagataaaaaccttccatttcctgccctgggcctaatccctgagtccttccttcctcggtcttcctcactgctgtgaggatacccctggtccttgtggtcctgtgtggcaattttatgttttcttgtggtaagatacgcataacataacatttaccactagtgacttttagtctattctcaatgttgtgcagccgtggccactgtctagttccagaacaggttcatcgccccaaaagggacctcatatccctcagcagtgactccccaggccccccttcctccaggtcctggcaaccattcgtctgctttctgtctgcctctttgccttggctagactgtgctcatgcagtcgtgtgtgccggtcgttcattctttttatgtcgggatgggtgtaccatgttgtgctcgctcatccattcatccactggtggacacgggttgcctccgagtcttggttactatggatactctgctgtgagcatttgagtataagttttctttgcatgcctgttctcaactatggatactctgctgtgagcatttgagtgtaagttttctttgcacgcctgttctcagttctttggggattgctgggtcatgtacataagctacacctaaccttgtgaggagccaccagactgcttccctggctgcactattttacatgcccagcagcaaggcgtgaggctccagggtccccgcgtcctctccaatactcgtgcttcctttcactgattccagcctcctcgtggtgtgcggcggtatctcactgtggtttgggtgtgtgtttcctctgtgcgtactggccggtgctgacgcgtcttttcctgcgcttattcgatgtcttcttcaagccctcactgtcccttgcccccagcccaacagcaggtcctggcagcctacctctaaaacccaagctgactctgaccacatcccaccacctctactgccacccctggggtcatgccaccatcatctgtggtctggaccactgccgttgcctgctggtctggcccttacagtctgttctcctgggagctcccttcgctacaaggaaggaagcatggctggtttcttgtcatcatttaggtctcagctcaagtgtcaccgacccagagaggctgtcctgaccactctacccacccaggcagctttgtctctgtcccctcccaccttccaaccaagccccttggggagcggaacgggatggggggtgtgttctggatccaccgtctctcccttcagctccttggcactcctttcctatggggcaccctgtccagggcaggtggggcaggattcccccctcttccctcatctcccgtgcttcccgggcccaccccccagcatctccagcctgcccgggagtcacatgtcctcggcccacagaatccccagcacacgccccacccacaggcctagccccagccctggggtccctggcaccccacctgccagggcccctcccctgccttgctcaccccccaacacacctgattgttggaaaggtcttcccatgcccaccacgaccccctcccactcatctgtgggcgggagagcttggtccctgccgcacgttgcccccctagcatccaggcccaccaccgagcccccgacaggcctgggagccccactggtgggtggggacccaccagctgggggtcttgctcacaccgaggggctgggggtggcggtggctttctcagggcaccctgccttgggctgcaggccgctgggtgggcaccggctccctcggaaggcagcgcaacccgggatcctgccggccctggcccccaccctgccgaccgggcctggggcgatcagtgccccagctcctgtcctcttctgctcagatgctgggttgggagatcaggggccacagctcggccactcagagccctttccgcaagtcttagagggaccagctgcggggtgtgtgcagaggggctgcgctgtggggagggcgcatggctcagtcctcctggcctgaggcccgcctagcctaagtggcctccaggacccatggccaggcccttctgcagccttccagaaagaaccagcttcccagggttccctggggaaggcctggggccacctcctctggaggggtggggcctgtgcttcattcctccttccccaggtccccttccaggccgccaggtcccctccccgacctggagcccacagccttgtaattaaattgtaaacgtccttgtaattaaattcatgtaatatccattattattattactgttttagactaaattacttagagcacattgactggatcaaaggctaccatgaacgttttcaagggtttttatagttattgacaaattcttctccagaaatttgaccactttacactctggggtaagattcagactaagtgtgtctagaaagggtgatggggtcggctgggaggaggaactgggcttgcaggggacctggggcagtgagtgctctcagtgtgcaaaggggaactgggctgtcccaagcaggatgtgagggccacttgggccacattcaggcagaggggccctgctaaggcttgagtcccctgttcagagcagggaccatggtggaaattaaggacgttcatgtcaactgtggttgagattggagctgcagtcctagagtcagccctcttgggcccatcttggcagcaaatcaggaaggaagtagatctgtgtgctgaagagtcgccatggggcacgtcaagcccctggctgagccgtggtgtgctcacaggctgctgcactccccggggcagcggagtgccagggacttgtattttcatctttgtgctcctccgcctcctcagtgtggcgctctgagcacttcgattatttgaaaggaaatgcgaaaatttgtacaaaatctattgtgctagcacgtgatggaggaggggtctttgtgaacaggctttgagggtttgcttggctcacagctcactacccagtcaacagggttgactgccacggggtgacctcgctaaggtgaagcatgatgcccagcacgtggtcaggatggcacgggagcactggagaagatgagagtcgctgggaacctgggcgaggggggacaaggggcatttgagtgggcttcaggtacgtgaagtgttgcaagataaagtgggtttcttctggattgttccaaaggagggaggttgctctcaatgaaggaaacattcaatagtgagagttttccgataatgagctcagtcaacaatccccactctccccatactagagaagcaaagtggatttcttctggattgttccaaaggagagaagtttgcacttgatgaaggagacttttttttggggggggggtggggggtggatggagtctgactctgttgcccaggctggagtgcagtggtgcaatctcagctcactgcagcctccacctcccaggttcaagtgattctcctgcctcagcctctcaagtagctgagattacaggcgtgcaccaccatgcccggctaagttttgtatttttagttgagacggggtttcactgtgttggccaggctggtctcgaactcctgacctcaggtgatctgcctgccttggcctcccaaagtgctgggattacaggcgtgagcctccgtgctgggcaatttttgtatttttagtagagtccgggtacatcagactcaggggctgggtcatgcctgtaatctcaacacttttggggggactaagcagatggcttgagcccaggagttcgagactagcctgggcaacatggtgaaaccccatctcttattattattattttttaaaaggtagatcagataaattacaggtccttaatatatattcaacaaattacagaaatatataaaattttaattcagccaagaaacatattaaagttttatcttcagcaaactgttaggagttgggatggaagtagaactcagggtgaagccctcttggggtttgttgtctaatgaaagggaggtaattagacaatcacacataaaaggctgagctccagcctgggtatcttgaggcctcctggacttgctgtagcatctggagaagtatggggcatcatctcgcatcacttagcaccagcactgccacccagccttgatgtgggtcctgttggcctgagcgtttttccttgaagaaggtattaaaagcagattgaagccgcctgtgcccacccatcccctacgcacttcatctgctcgcctctctgccgtgttttccaccaagtacatactacgaatgagcctccattatgtgcgcctccattaactgcacatgcggaataccaggaattgtttgttcgactgctggcagacctttgggctgtccctggtgtttggccactgtggccttcatgcccacatcctcctggtcctcctggtggtggttctgaagggcatctcctctcatctcatggctccaagtgcttgctagtgggtcccctttgccctgagcacctgttgatatcctttgcccatgttcttcttgagttgtttgtgtctgtgttttcttgttgttttgtaggaattctttgcatattctggaaaacccattatgaggtccatgcattgtaaggctctcctctgagcccgcctttttactgtgtttagggtgtcttttgtcgtctagaagttttacatctcttccattattgcttccccatttgaaatattgagaatttcgtctctatcccacaccataaagatattgttctcttgttttgctttgtccctgtaggtctttgatccaattggaattgcttggccagggcttggactaggtcttctgtcttggtggggcgagctcccagggtgtggaaacgtttgcaggtggggcaggagggagagtctggtgggaagcaagcctggggttggccatgttgagtgtttgtgccttttagagactggagtggtcgagtaggcaatccgagggttggggcattacaggggtggctttaccagtgtgctacctcaggatggttgggggtggggcggggaggcaaggctctgagcaggactggaagagctgctgtcatcagaagggccacagtgtggctccttaccatgtgcctggccctatacctctttgctcatggccccatattttcccaccttgttggtagcccttagcccttccccagaggggagctcatttcttccttgggggtccagcatgaccgatgaggaggagagagagagagagcgagaaggcttcaggagcccgtggcttccacccaaatacctgcctggctgtcacaggcgatcactctggttgctgctgatccgaggtgctgaggctgtgcccacgcccatccccctcttgacatcccagcctccgccagcccgcccagcaagcgctcctcagtttccatagcaacactgctgctcggtaatgattccgggtagaaaggcattcgtgcgttctctgtcatctctgtcacctgagcatcccactgcctgcttgctgtcctgccccgggagttcaggaagaaaccctgaggacagctccgagcccttctgcttgtgtgttggcttctcctcaagggcagtggtaaggtggtaaatgttcccagacaaaaagccctgatttggagcatttgccgatttccctggtgtaaatgctgccactatagccgatttcaagccaccactgcgatgtcactgaacttggagttgggggaatgcacacatagtatttccatctcccataccagatgtgaataaccccaaaagcacagatgacagaaaagtgtagtaagataattagacagtgatgtgttccgaggatttattgcctttgttgttaatatcattcagttacctgtacatttctacggttaaaataccaataatcgctgtgtttgacaactggcttccaaatttcccagcttcagttggctctagccactgctgctgagagtgtcgaggccattccatcatgtccctttgtctacagccttcctgaacccacactctgctgccgcccaccctcttccatcctgcctttctaactgtagcctctccaccaagcacagcatgccctgtcctgactgacattcttacggtcttccaacaaataccttcttggctgaaagctgtttcctttatagtatttgatccagaaattccacctcaagaaattttctccaccttgacaaccactggttacacaaagatttaagtatgaaaaatgtataaaatggaccccagaatgtgtctttgccacattctttataataaaaaatcaaagccacccttactgatgtgatgatgaacatgatggtccactggtgtgttggtgtggatggaccttaaggggcctgcagctgcaaaatggcacacatagaaaacagactggaaggaaacaggccgcatggccaggtgcggtggctcatgcctataatcccagcactttgggaggctgaggcaggaggattacttgaggtcaggagtttgagaccatcctggccaacatagtgaaaccccatctctactaaaaatacaaaaattatccaggcgtggtggtgggtgcctgtaatcctagctattggggaggctgaggcaggagaatcacttgaacccaggaggcagaggttgcagtgagccaagattatgccactgcacttcagcctggatgacagagcaagactctgtctaaaaaaaaaaaaacaacagctgggtgtggtggcacacacctgtagtcccagctacttgggaggctgaggcaggagaattgcttgagcccaggaggtggaggttgcagtgagccaagatcgtgccactgcaccccagcctgggcaacagagcaagactccatctcaacaaaaaaaagcccccaaaaaacaaaaaaatgaactgtgtttcttttataatcggacaaaactgattttgacaaaaagctcttttcagaatatgaaaattttggggagaagggagacatagaaaacttcaatgattatctacaaggacatagtcaaatagaaaaaaagtaatgcaggagccgctgctgaggccacaggggttccgaggacaagctgggctctcctcagatagctgtcttcccgaaaagactcgtacagcggtggttctactgtatcgcgggcactaagacaagattttgccgtcagaattgacatctctgtgagaaacccggggtgggaggtgccgccgtgagaatgcaggacagagagttcttctaaacttgctaatattcgcacaactcggaaaagcagagggctccgtgcaggcgcagccacctgcgcccatgcccagggcccttctgccctctcatctggcacaagctcccagcctgctccatccctaggcggactctgggtctcctcgccctgccctctctgtgctgactgggggctttgcttccaactgcaaaccagcctccctgggtcttttcttggccctgttccctttgcctgatggaggccaggtgtcccctgctccagaagccttccccgcctcccaccgaggcgtgcatggccagccgtgtgctcccttagctgtgggtaaggtctgtccccacgctcacctgcggggcatagccatttgggcataatgctagtgtgtagcctccccaggcccagaacagcccttccataagccgctgagcccatgaggagaccctgcacgcctgcctcgagctgcctcctcctagaagtgcttcctgctgacccttgctggccccatggcacgtgccctgaattctggtggagtctgttcagtccttcttggtccttagtcattcgtcccttctctacttgcctcccttccccaaggaggacttgaaggtcgcagcatactgtcccagggtgctgcggaagcagccttcgaccttgtgggcactgcttgccccaccacctgcgctgtgcgtaatgggcttccttctgctacccttcattgtccttccttcacccctacagcatcccgcagagctgcttaggtcctacttccgccttgggccctggcccgcgatggcctcctcctccctgacccctccttctggccaccgggcagcctgtcctggctcatgaccttgactcagtgccacaaccttgctgagcttgctgacatggtttcctcatctgcaataatggcatctccctcaaggttgttgggggttaggattttgtggagacccacatcaggggtctttcccagaatgtagcacatggcacgtgcccaaaaaacagtagtggcatttttttttctttgagacggagtctcgctctgtcgcccaagctggagtacagtggtgcgatctcggctcactgcaagctccgcctcctgggttcatgccattttcctgcctcagcctcccgaggagctgggactacaggcgcccaccaccacgcccggctaattttttgtatttttagtagagatggggtttcactgtgtttagccaggatggtctcgatctcctgacctcgtgatctgcccgcctaggcctcccaaagtgctgggattacaggcgtgagccaccgcacccggcctagtggtggctttataaggaccactttcttggcacctcttttaggctactttgcagttccagggggcttcttgtacatcaaggccttttctcttgggcaagtcagttgtcactgtgaggacacaacactgtatctttaggcatcttcctacttgtcccccaacctgaccctggccctccctagtgagtagacatttgttgagagactcggctcatctgaagagtcaaggtcatcctcttgcttgatgctgaatgagcacaacacagatgctcactgagtgttggctgttatggtccagtcattgccaaggaactcaatgggatcttcatgctagctctggcctcagtgccgccctagaaagaagtgggtccggatggggagaggccaggagagctcaagcagtgtctggaggacgttgtagggcggtatcacagcctccagacccagtgcacagaggctgggtcccccagtccttggtgtgacttggtgatccccagctggccttcagtgggatgaaggctgagcagtggggcttgcctgggaacaggggcaccaaaggtagccagggctgcagacagcagattccttgcttgagtggcttggggtgctggttgtcagcccaggtcctgccagctagggcctctgccttgacctcagaggggaggagcaagcctttgagggttcttacggaggcgtgtctctgccgcaggtgaacgggaaggagctctccaagctgtctcaggagcaaactctgcaggccctgcgctcctccaaggagcccctggtgatccaggtgctgagacgcagcccccgcctccggggggacagctcctgtcacgacctgcagctggtggacagtggcactcagaccgacatcaccttcgagcatatcatggcgctgggcaagctgcgtccgcccaccccgcccatggtcatcctggagccgtacgtcctctctgagctgtgagtcgccctcaggagggccccgggccctgcctccagagaggacaggccacctggagcggccatccgcacgccaccctctcgggcaggaagcaggcccctcggcctccagaactgaccgtggtacccaagggctccaaaacctccaggcctctagccttgggccgggctccagcaggcgccccgttgtatctacccccagggccgagggaggaccctcctgtccgggacgtcgctgccggaagtgccagggttgagggcctcagctcctcctcctccatcctctctcctctgccgcctcacaagcatcactccttgaatcttcttgcatcccttgtctgtctcattcctctacctgctctgaatttcctccatctcttcagcttctttctttggcccgaccggaagaagggcctttcatccaggcctggtggctcatgaccgcgtgagcgctgcctcattctgctaatcttagcccgggctgcggggaggtaggccacagggccatgagcagccaaccttagttttggggccaggagggcagcccctggaggtagggtgggcccccctctgctctgcagaagtcctccagggcctggataactcctgggggcgttgcatgagtggggccagtgctgggcgggcgggtgggcacccggagattggagaagttggtccctgccagctggcgtggttggaggagttctggtctgggggacgggaacgctagaggcatgcgcaggtcctctgcgtggacgctgcacactcaggtgcgagaagtgcccccggtctttgcatggctgcatgttgcccaggaaggggctctgcaggaggcaactgggccacccacccttgagagcacaagcagagcaggcctccgtgccaggcacgctgggatcggcctgcctgggagctggggctgaggtgtgagaggatggccagctggtctgacccccaccttctcctgggcagccccccaatcagccatgagtattatgacccggcggagtttatggagggcggcccgcaggaggcagaccgcttggatgagctggagtatgaggtgagccgggtggccaggccagggcccgcagccagctgcgggagccgccccgacgcctgtgtgccttcctgcccaggcccaaccccgtggccctcctggcacgcatctggctgagtcagggagggtgcgggtgaggttacgtgttccgtccatgtcggtgagtccacgtcccatgcacgtctgtcttctgtgtcctgtgcctgtgtgtgcctcgtgcatttcctgggagggagaccactgagtacgtgcgccacgtgggatggtaagagagaccctcaaagcggggcctggaaactgagctcagggggctccagaggaagctgaggggctgcgggctgaggggttgcgggctgaggggctgggctgtgctgcctgctccctcactcacgcatttctggggctttctacctctgcttcctcccggacccctcgtggcaggaggtggagctgtataaaagcagccaccgggacaagctgggcctgatggtttgctaccgcacggacgacgaggaggacctgggcatttatgtcggagaggtatgcagacgggtatgccccagccccgaggcccatccacatggcctgcctgtggctcagaggctgcccttaaggtcccagctaccagaaacagggcatcacagctagggtgctgcgtggtgaggcgatgatggtcgacggcttcagccactgtccagtgaggtagtcatctgcagaaagaggcctgtgcctgggtgggacagcagatgggcctgagaactagcaacagggttgctgtctagccttctcccgaacccatcttgggcagatgtcttgtgtatccccaggagggggatggcccctcgctcccctccctactagtagcatcccactaaagccacccttccagatggacaatgtcctacttcccaccaatgcccggggctgaccaaaagcacaggcttccgtgcagaagagcctaggagtgcagggcaggggcggggagaggtgactactccacagcctctgcctctgcttcctggggctcagagctggaaggggagccagagagccttcagcttgctttgggggcccctgaggtgagcctgcccccttctaccgaaagggcatgttaggcaccaagtccccaagatgcgtgtgtcctgcaggtaaatcccaacagcattgcagccaaagacggccggatccgtgagggagaccgcatcatccaggtgagcacttgcaggctgcaggcctggcccaaggccccgctgtgcccgtcggcccagccacctctctttagccagtccctagctctctcccactaagagctaaccctgaggcccagcagcctgccgtgtcctaaacccgggctgagtctcatctctctcctgcccactcaccccagtggctcccgtgtgcctatgggatctgctggcatccagggcccctgctgctctgaaacctcctggcccctctccctctgccccactccatgctctcctgagcacacatttgctcttgcaagagtcaggccgccctctccctggtaccttccacttagttacatcctcccagagctcaagccccagcctagcccagccgagcccagagtgcttgggctccctgcacccgcccagggtccgccccagggccagccctagcatgcttgttgattgtatcctgcctgcctcagattaacggtgtagacgtccagaaccgggaagaggcggtggccatcctgagccaggaagagaacaccaacatctccctgctggtggcccgacctgagagtcaggtgtgtatgcctggcagggcgacccggggccacgacatcaggctttctgtcttggaagctgctggccgtgactagggcacagatgtgccaacgacctggagttgatggagggcgggtgggcaggggtctctcagggcccgtttcccctcctggcctctgaaggctgagggggctgggacgctgcccccaggttgctgagcttcaccgaaacaagccaagtgcggggtccagagcagacaagaagggtatatggggaggtccttgaagctgtggggacaccagggcctgtctccacagctggcgaaaaggtggaaggacagcgaccgggatgacttcctggatgactttggctctgagaatgagggggagctgcgtgctcgtaaactgaaatcaccccctgcccagcaggtgaggaaggaaaagggcgctggtggggagggcgaggaggagagaactgggtggaaggcgctgaggctgtgcagggtctcccaatgcttggcagggaaatgaaccaggcctgaagccccttccgatcctcctgtgacatcccgtgacatccctgtccgtgggacctaactgagcggtacttacctttctgctctagcccggaaacgaagaggagaagggggctcccgatgccggcccaggcctgagcaacagccaggagctggacagcggggtgggccggactgacgagagcacccggaacgaagagagctctgagcacgacctgctgggggacgaacccccgagctccaccaacaccccgggaagcctgcgcaagtttggcctgcaaggggacgccctgcagagccgggacttccatttcagcatggactctctgctggccgagggggcggggctgggagggggcgacgtcccgggcctcacggatgaggagtatgagcgctaccgtgagctcctggagatcaagtgccacctggagaacggcaaccagctgggcctcctctttccccgggcctccggaggcaacagcgccctggacgtcaaccgcaacgagagcctgggccacgagatggccatgctggaggaggagctaaggcacctggaattcaagtgccgcaacatactgcgggcgcagaagatgcagcagctgcgtgagcgctgcatgaaggcctggctgctggaggaggagagcctctacgacctggcggccagcgagcccaagaagcacgagctgtccgacatctccgagctgcccgagaagtcggacaaggacagcaccagcgcctacaacactggggagagctgccgcagcaccccgctgcttgtggagcccctgcccgagagccccctgcggcgggccatggccggcaactccaacttgaaccggacccctcccggccccgctgttgccacccccgccaaggcagctcctccaccggggagccccgccaagttccggtccctctcccgggatcctgaggccggccggaggcagcacgcggaggagcgcggccgccgcaaccccaagacggggttgaccctggagcgtgtgggccctgaaagcagcccttacctctcgcggcgccaccgcggccagggccaggagggcgagcactaccacagctgcgtgcagctggccccgacgcgaggcctggaggagctgggccacggccccctgagcttggccggtggccctcgggtgggcggggtggcggccgcggccactgaagcaccgcgcatggagtggaaagtgaaggtgcgcagcgacggaacccgctacgtggccaagcggcccgtgcgagatcggctgctgaaagcccgtgccctgaagatccgggaggagcgcagcggtatgacgaccgacgacgacgcggtgagcgagatgaagatgggccgctactggagcaaggaggagcggaagcagcacctgatccgggcccgtgagcagcggaagcggcgcgagttcatgatgcagagccggctggagtgcctgcgggagcagcagaatggcgacagcaagcccgagctcaacatcattgccctgagccaccgcaaaaccatgaagaagcggaacaagaagatcctggacaactggatcaccatccaggagatgctggcccacggcgcgcgctccgccgatggcaagcgggtctacaaccctcttctctcagtcaccaccgtgtgagctgcccgggcgggtacacggcccaggcccagggaaccccctggggccccggccctcactctcctatagagattgtgtgtgtgtgtgtgtgcgcgcgcgcgtgctcgctgtgcgcacgcacacatctcctcgtctgggtgtgcgcacagggctttgttagcagagagaagcccctgaggagaagggacgcttttcttccttctgcccaagtaaagtgaccatgccagtggccagcactgggggcacacctgtgatgggcaccccttcagctgtgcgtgtgcattccccatcccccatgctcttgcgtgtgcttgcacgtgcacgcacacacacacccagtgctctctccacccgacccgtgtacttgcagacagggaagctgagctgaaaggagcacaagagagtgtccggcttcgctgctgagcgcggcctctccccgccgctgcgcactgcagttatttgtagacaaaggcacccctgatttttgtggtttttctccctttctgtgcttgccaatagttgttttgttttgtggacctgccctgggggctggcagctccttcaggcagcctggcagaagtggaactcccctctccactgatggctgggaagggagttggggaggaagagtgggagggagggctggggatggatgggagggaaggggagggaaaggtgggaggaatgggaagcagctgttctggtggcttccactctgaggtgtgggaacggggagcctctggggggcacctgtttccccagtgactcagagagagcaagactgcaggaacggaggggtcctgcagggtgtccaccaagaagtcacagagcccgttctgcgccccacaccatctggagcaggggcttctcttctgagtgaactgaggaaggtgcttagatggtgagggctctagaaaccaagccccatgagcagcagtggaagacctcgggccatgcggcctggggaggacttggtggcgatccgcaacctggaccccagtgagaggcggtgggctgactgggaaggagaggcccccaacctcctcaggatttgcacgtgtgaactaggctgcctgtggggtgccccttaggcttggagagccccagattggaggcagacagactgcaccaccccttccccccctgcatctcaagaataaagcaagctgcctttgtacttggttga

SEQ ID NO: 4035 - DNA, 27071 bp, human
cgggtcagtgaaaggcgtcttcccgttcccgccctccgcctcctctcgccggccagcaacatgggatgtaatatgtgcgtggtccagaaaccggaggagcagtacaaagtgatgctgcaggtagggccgccggcgctgcggcgggggcgcggccctccgcggggaggagcgggccagtggggaggcccggagcggcgggcgtgggagagcgggagggctcgaggaggacaaggtagggagccgtccgcaccctcccatcctggggctgttgggtgttggcgctccgtgggaaccagccacgggtggggtgggaagttggggttggcccgggtggggcgcgcttccgtcccgggaggcgcggtgcggcgggcgcgggatggaggttgcatagcaacgagcgcagttccccgcacacgctctccccgcaggacccagggcgggggagggagccaggctcccgccgtgcggggggcgccgaatctagatcccggcgggcctggagcgtgggagtgcgtgggcgtccccgggcgcggtccaagtccgtccgggggctgggtgcccaccccgacacccactcccgcctggccctgcccgaacgatgggctcccgggccttaggcgtctcgggtgagtgggcgccgccgggatcagcgggttgggctctctgcgggtggcagtgcctggccgggctttgcggggcgtggaccagcagggccccgcggggagggaaggagacgcggggcccggagctcggacctggagcccagccccgcggcccggaacggggcttcttgcctgtgcgtggcgtgactacgtgagtgcgttcctgtgccccgtctctgtgtgcgcggaggctcccccggccccgcatttgtgtactttctgtgtgcaccctgcagactgtctagagaaatgtcccggatgctgtgggctgagacctcctagggctaagtggagggaggtcaaggtcaaggcacccaggagcagacagggctcagacaggtatgcgtttagtggcctggattcaactcccgggtttattggtctggactgggaaggaatcaagtgctttgcaggaggggtgttggcttgggagaacgtgggggaacccgtgcagggatcggcgagaactccggggcgggggcgggggcgggggaaggaggggctgggcacgggggagaattcccaggaatccggggactgacttcacgctgtgagccgagctcctctggccacctggtgcgggagccgaggggcagggcggggacgcaaatcttgccccaccctggcggagctcctggtcctctctccccggcccttctccgggggtgcgcggggccctcggcttctcccgttcgctgtcctccgccttcttccctctcagttcccggctgccactcctcgtctcttgttcccgctgtttggaaaccttgtgtggccattgccagccccctagcgggataggaatgcgaccgagagggcgtcctgtggaatccgtgttggattccagggctgggatggttggttgacggggactctggatcccatcctcctgcttccttttcgggagtcattccatcaaacggcaagcgatttctccaagcgattcctccggggccgttttgactttcctggagaaggattggtgtcgcacttcatttaaggccaacctcgtggggacgtgtggataggggagagcgacccgagctgcaccccaggcctgaaatgagccatgggacgacaccggtagcccttggggctccccacagccctccgggaaggcctcggcaggtcgggctgggcctgccttcagggaggtgaacttgggtgggccctccctgctctgcgccctaagctctccttcatggaagggacttgcccaccccaaggagacccgccaggaggagggccactgccgcatgcgccctctgtgcgctttcctgctgggctccctttgaaaccgtgggagtttggctgcaaactttcactttctacattcctccttggcccaatcaaagccgggattttacgaggagaaccatccttcacaactaagggaaaacaagaggactgaaaaaagtagatacggaaagcagtgcaagccatgagctgtcccaggggactgcgcttctgggggtggacgcatcaccaggtcccagcctcttcagaggagaaggagcttttgttccaaaagacaggtcagcttctgggaccccgtgcctgcctcccggcctccttaaacacgggtgctcccccatctttagggggcacttctccctgtcccccctgagtaacctcgtccgcaccttgtcagggtgaggcacttcatgggcctgattttcagaaagaagcacatgtgcatctgcagcgccttccatctacaatccacagaggcctgggatccccaggccaggaacccccaagtctctagcctagccttgtgttccaagccattttctgccaatgactcacaacacttccaaaattacagctgtattgagctatcattctcctactgcacaacttaccctttcaaagtgtacaagtcagtggtttttagtatactcacaaggttgtgcagcccacaccagtaattccagaacgttttcatcaccccaaaagaaaccctgcactccttagcaatcacatccccatttctccctcaaacttcctagcccctggcacccaccaatctacttcctgtctctatggatttgtttattctaaacatttcatagaaactgaccttttgtgtctggctttcattaatcataatgttttcaaggttcatccatgtatcaatagtcaatttctttttattgccaaataatatttcattttgtgatatacaacatatttatccattcgtcagttgatgagcatttggggtgcttccacccttgggctgttgtgaatagcgctgctgtgaacactggtctacttgtatctgtttgagtccttgcttttaattctttggagtgtgtgcctgtagccattgaactgttttccacagtggctggaaccagtttacattcccaccagcaacatataagggttccaatttctctatatctttgccaacagttgttattttctgggtttttgttatggccgtcctgctgggtgtgaagtggtatctcattgtgattttgatttgcacttcctgttagctaaatgatgagcaccttttcttgtgcttgttggccatttgtggatcttctttagaaaaatgtctgttcttaagccagcgccacactgctttcattactgcagctttgtagtaagttttgaagtaaggaaatgagagtcctccaactttgtacgtctttttcaagactgttttgtctattctaagtccctcaagtttccatattaatttcaggatcaggttgttaatttctggaaagaagccagttggcattttgatagagattgcatcaaatttgtggatcaatttgggtagtattgttcatgagcatggggtgcgttttccatttatttaggtctttaatttctttacatgatgttttgcacttttgtttaagtttattcatgagtattttctttatgatgctatcataaatggaatcgttttcttaattttactttcagccttctcattgctactgtatagaaatacaattgattggctgagcgtgttggctcacacctgtaatcccagcactttgggaggccaaggcgggtggctcacctgtgcttaggagttcaagaccagcctggccaacatagtggaaccccgtctctactaaaaatacaaaaaaaattaacggggcatggtgatgtgtgcctgtaatcccagctactcaggagactgaggcaagagaatcgcatgaaccccagaggcagaggttgcagtgagctgagattgcaccgctgcactccagcctgggtgacagggcaggactctgtctcaaaaaaaaaattgatttttatacattgatcctatatcttgcgaccttactaaaattgtttattaagtataatttgtttagtagattcctcaggattatctacatattaggatcatgtcattggcaaatagaaatcgtttttcttcttcctttccaatctggatggctttgatttcttttcttttctttctttctttttttttttttttttgagacacagtctcactttgtcacccagactggagtgcagtggtgcaatctcggctcactgcagcctccgcctcccgggttcaagtgattctcctgcctcagcttcccatgtagctaggattacaggcacacactaccacacccagctaatttttgtatttttagcagagacgagcttttgccatgttggccaggctagtcttgaactcctggcctcaagcaatcctgcccgcctcggcctcccaaagtgctgggattaccggtgtaaaccaccgttcctggcccttcgatttctttttcttgttaatttgctctggctggagtctctagtacaatgttgaatagaagtgcctgtgaatgtctttcccttgttcctcatcttaaaggtaaagaagcttccagtctttcactagggggtataaagttagctgtggctttttcatagctgtcctttatcagggtaaggaagttcccattctattcctagtgtgtttttatcatgagaggcattggattgtgcagtgctgcttctgtggctagtgagatgaccacatggttcctttattccacggatgtgggttgtcacaggcactttcgtgtgtcatgtcggaacctcagccccattcctatattccaatcatgtcctcctagtttggaaaatctgggacctcccctgaaaatggaggattactgcgtgttgagttaggaaaaggaagcaggctggttgcccagaatggaaggcaggaaacagcatgtccccagctccggagccttttctgcagcccatgtccctccactgccaccaggcccccttgtcatatatctcatcgtggtccacactctgctgaacttgtcttggccttggcaccccctctctgacaccatgatgtgcttgctagcatccgagcacgccggagatggtcaggggataaacccctggtacttaggactggtctcccgcccatcctactcaggctttacagggggagtgggtcaggaccgcctgtcatctcccctctgtccacatcgagggaggccaaaggacagctggccagcccttctggtgatctcccaggcattcttgcctaaagcacctgcatgtgagcccccatggtgctggcagccatcctgggtgcgtggcattcagcagggagacactgcagacagggccttgcccctcccccagactccccttttgttgttgttgttgttgttgtttgagacagagtttcgctcttgttgcccaggctggagtgcaatggtacgatctgggctcaccaaaacctccgcctccagggttcaagcgattctcctgcctcagcctcccgagtagctgggattacaggcatgcgccaccatgcctggctaattttgtatttttagtagagatggggtttctccatgttggtcaggctggtcttgaactcccgacctcaggtgatccacccacaccggcctcccaaagtgctgggattacaggagtgagccaccacgcctggccccaggctcccctttttgtaagggggagaccatcgccaacatgtaggcaactgcgggggagagaaagtactgcttgagtgcgggagcgtggctggcagccagtgtcccctcttcagcgacgtcttcctccaaactgctctcccacccaccaagccaggtggcttctctggctccctcctgcttgcatgggggcttcctgtgagcagggatttgggtctggcatgggcactctgcctccccgcctcaccagcaccagatgctgccagcacatccacgctggcctccacccttccaggggaaagctggactctcagtcaactcagtggttctgccgcagaagctgactggggaagaagcaggctctgagaaagtccttgtggagtggaagaacagagggctggacactgaattctgactgccatcttctggaccaggtcatcctgttttgtgtcattgtcccaagattgtagaatgccctttcccctctcatctcggggttcctgaggactgtccagtctgctgaaatgaaattcgatagtgccagagagcagattcgtggttgcagggatgggcagaggggcatgaggacacttttggggaagatagaaatggccactgtcctgacggtggtgatggttccccaggttcatgtatgacatatgaacacctgccctttgcacactgaagatgtgcaggttaccacccagcaacagacctcaccaaagctttagaacaggaactccatggccacatgcacgcatcctggggagaaaggtgtcctttccttccttctacttcaggggccctgccagagaaggcagtgcagtgtggagataggaatggaggcagccaccaactgacagctgtgtggccaggggcaagtcgctgcatggcccactggctcagtgactcagtttcctcaactgtgaaatggcagtgaagagtgcttgcgtccgagggccattgtgacaaggaaaacagatggtgtgtcccccgggatctcactgggtggaggagggagttgctgccctcgggccattcagttggtcattaagaagtggaaattggctgggtgcggtggctcacgcctgtaatcccagcactttgggaggccgaggcgggtggatcatgaggtcaggagttcgagaccagcctggccagcatggtgaaaccccatctatactaaaaatacaaaaaattgaccaggcgtggtggctcacgcctgtaatcccagcactttgggaggctgaggtgggcggatcacctcaggtcaggagttcgagaccagcctgaccaacatagagaaaccccatctctactaaaaatacaaaattagccgggcatggtgacacatgcctgtaatcccaggtacgcgggaggctgaggcaggagaattgcttgaacccgggaggtggaggttgtggtgagctgagatcacgccattgcactccagcttgggctcgaaactccatctcaaaaaaaaatatatatatatatattagctgggcatcatgcacctgtagtcccagctactcgggaggctgaggcaggagaactgcttgaactcagcaggtggaggttgcatgagccaagatcaagccactgcactccagcctaggtgacagaacgagaccctgtctcaaataaataaattaattaaataaaaaataatgaaaaaggaaattatatggagaaggccttacatctgggtatgtcacagttaatgcccagtgacagaagaatgtccaatattattctgagaatttctctcaggaaagggacctccaagttttgaagaagtgtgatgtagtacaatattagttaggacagcctgggcaacatattgagaccttgtctctacaaaaataaaaaattgctcaggcgtagtggcatgcgcctctagtcccagcttctggggaggctgagtgggaggattgcttgaacccaggagttggaggcttctgtgagccgtgattgtaccactgcactctagcctgggcaatggagccagactgtgtctggaaaaaaaagaaagaaagacagagagaaagagagagagagagagggagggagggagagagagagagagagagaaagaaaaaacagatggacagggaacaaagcggaggcatatgtggtcattttgcacaggagttgggccggaggaggcgaggctgagcagcctggggctggacaagatgtcctccctttcagtgcattctgcctgtcctcatggctgcttggagcattgagaatgaaaaacgctgcagagggaatattgctttgattgtaaaacgctgcagagggaatattgctttgattgttgctagatgtgaactgtgcccttagccagtcaggttagcctgaggtgggtgggaggatgggtttagttgctgggccacgtgcctggaaagctgtgaatatgtacccgaaggttgatcttgagaatggcttcaggaagtggttggcttttcctgtgcaaggtgtgggacacccctcttttcctgtgtgttttttttttttttttttttgagacagagtcttgctctgtcacccaggctagagtgcagtgttgtgatctcggctcattgcagcctccgcctcctgggttcaagcaattctgcctcagcctcccgagtagctgggattacaggcacctgccaccacgcctggctaatttttgtatttttagtaaagacagggtttcatcatgttggccagtctggtctcaaactcctgacctctagtgatccgcctgcctcggcctcccaaaatgctgggattacaggcgtgagccaccgcgcccggcctcctttctgcttctgagccaggactatggaggtgtctgagaggccgccgctctcccggaaaggtgggggccaggtggattgatgagacttcagcagaccctgggcttcggggagggaaggagaagtgaggggaaagaaagatgccctcatgcagaaggccttcgttgaggtctgccctggttcctccagggcgcgctctgagtcagtacagcgccaccctccacccgaagtccttgttaaggtgcactttctgactgagccactagcatggggcctgggattctgcacttctcacaagctcccaggtgatgtggatcccactggctgtgagtagccagggccttgggtagggaccgggagtagatctatggtagccccaaaccacattaacatgggtggtgaagtgaggtgttgttttttttgtttgtttgttttgttttttttttttacaaatagagggtaaaaattgtttacaaatagagggtaaaaaaacacacatagagggtaaatcagaacatccaggagtcgttgcctacgtgagggctttacaggacataacttgttcttccctgccatgtgcagctaactgacccccttccctgtcaccggcacccctaccggtatacatgtctctcatggacgcccagacacccctcccccgactaagtgctcaaaggcctttgagatgaagccctcccatgtttctgtctctcctgcccccaggcagaaagggtgggcacagagttatggaagcgggtggtgtggcttgcccaggaggccacagttgggggcgtgggcagccatgctacttgccgggcctgtcacctctttgtccctgctagaattctaacatgttggtggagacattttgcagccaccaatgcagtaattaattcaggcaaaaatcatcactggatgccaaaaccattagatgtaaggtcgttggggacagaatattcacaaagtctccaaatattaccccaaattacctgtgaatcaggaagggaaactgcgtctttacagaggagagatctggcagctgccacctggaccatgtgatcaaacagcctccccaacagtggggcagcctgaccctgccagccgccagatgcagggctggggaggagacatacagcatctcctgcaaggtgctcttgtcaaaacgctcagcctgaatctcaccgcgggaatgaatcaggcaaattcagactctggcgcattctataaggactggtctcttccaagaagtcattcccattaaagtaaaaaatatatatatttttttctagattagagaggagacataataactagagacctaacaaccgaatgtaatatgtgtgcttcttgattgaatcctagattttttgtttgtttgttttgtttttgagatggagtctctctgtgtcacccaggctggagtgtgatggtgtgatctcagctcacttcaacctctgcttcctgggttcaatcaattctcctgcctcagcctcccaagtagctgggaccataggctgcaccaccacgcctcgctttttttttttttttttttttttttgagatggagtcttgctctgtcgcccaggctggagtgcagtggcacgatctcggctcactgcaacctcctccgccacccgggttcaagtgattctcctgcctcagcctccctagtagctggaactacaggtgcaagccaccacgcccggctaatttttgtatttttagtagagacggggtttcaccatattggccatgctggtctcgaactcctgaccttgtgatctgcccgcctcagcctcccaaagtgctgggattacaggcatgagccattgtgcccagcctcaaatcctagatttttaaaaaaagctataagggtgttagcgggacagctggggagatgtgaggctggcccattgtatgagtgcggaattccgtgctaagggtgttgtggttccacggagaatgggactgatggcatcttgctttcaaatgcttctgcacatgtgtgtgtagaaaccccgagagcaggtgtggggaatctgcagatgttcccacatgcttgtgggcggacaattttcaaaatcccgagctggggaaacatgaatggggactttgctgggtcactgagtgggtgaatgtagtgagcctgcggcttctcctttctcctctgatgctctactcgttgggagatcccccgatgcctgacttggcctggaagctacagtcacaactgcttccaaggtgtcctggatactccagacggcagagctgagagccagcaggcaggtcagagctcggccccgggcagaggataacttcctgtctctgtccttccccagcttgtttcctactctacagcagtggggtaaggggagtccgaaggtggcagcccccccacctccgtggcagccacgggggcccctggaagtgatgtggcttcacctcccatcccgcgcgttgccagtgagagtgaaaggggtcgcaggcgccgtgtgacaagcacttgggattgcgagtctcccaggccacaactgttttcttagcctctccggcctctcttctcggcttcccagagattcctgatcagcaagagggcgtcgcgccccacccggctgtgcgcctgccaccgctgggtgcaggagggtgcctggggcagagcctggaaacagagctcagcctccgacggggttggcggggcgggcgggcaggagtcctgccaatacagccaccagcgtggcggcgccgggacgagtgtggtccgccctgctcccgcagccgcagccaccccgccgccgtcgcggcgcgctctttgtctgcggctccgggctcagggggcggggcgagcgcgcctggggctccgccctctccgcctagggcgccccgcttcccgcgtcccctaaggcccgccagtcccttgcccagcgggagatcgccgccccacagcgactgcccgtggggccgacttcgcgtcatgcctgcctcgcctgcccggtgttgccccctcccctgtccctgtgtcccccctcccttgcccgcatgtccccctcatgcggggaaagcggtgccagcactttccctggccttgcgaattgctcttccatcggtattcagccgcccctctgatgttcctgaaaacccaacctgctccttctctgcaaaaagctccggaaggctgtgtcgatgcaggtcgagcttccccacccggccccctcccaccttttagcaaatccagaggccccaccttcgccctcccctcccgggctccgacccagtgcattgagcagctcctcggcttccctcccgggactttctagtctctctccccaaccggctcagtgtcagggtgccccaggactctccttgggcctctcctgttcttgactacattcactccctaggtgagctcctccatctcatgcttttgctttttaaatttttatttatttatttttaaatttttattatttttgagacagggtctcagtccgttgctcaggctggagtggagtggcacaatcacggctcactgcagccttgacctcccaatgctcaggtgatcctcttgcctcagccctaccgcctgccccctacctcctccaccacttggggctacaggagcgagacaccacgcccagcttcatctcatgattctttttttgtttgagacggagtcttgctctgttgcccaggctggagtacagtggtgtgatctgggctcactgcaacctccacctcctgggttccagtggttctcctgcctcagcctcccaagtagttgggattacaggtgcctgccaccacgccctgctaatttttgtatttttcgtagagatagggtttcgccatgttggccaagctggtctcgaactcctgacctcaagtgatccgtctgtctcggcctcccaaagtgctgggactacaggcttgagccaccgtgcctggccgtcatcttatgattttaaataaagaaaaattcctagtttaattgaacagcaatggtcacatgccacccagttagctgacttgggcttgggccagacatttggagtggggcactggagatgtccacatgcctcgggaagttcaagctagagataaaaaccttccatttcctgccctgggcctaatccctgagtccttccttcctcggtcttcctcactgctgtgaggatacccctggtccttgtggtcctgtgtggcaattttatgttttcttgtggtaagatacgcataacataacatttaccactagtgacttttagtctattctcaatgttgtgcagccgtggccactgtctagttccagaacaggttcatcgccccaaaagggacctcatatccctcagcagtgactccccaggccccccttcctccaggtcctggcaaccattcgtctgctttctgtctgcctctttgccttggctagactgtgctcatgcagtcgtgtgtgccggtcgttcattctttttatgtcgggatgggtgtaccatgttgtgctcgctcatccattcatccactggtggacacgggttgcctccgagtcttggttactatggatactctgctgtgagcatttgagtataagttttctttgcatgcctgttctcaactatggatactctgctgtgagcatttgagtgtaagttttctttgcacgcctgttctcagttctttggggattgctgggtcatgtacataagctacacctaaccttgtgaggagccaccagactgcttccctggctgcactattttacatgcccagcagcaaggcgtgaggctccagggtccccgcgtcctctccaatactcgtgcttcctttcactgattccagcctcctcgtggtgtgcggcggtatctcactgtggtttgggtgtgtgtttcctctgtgcgtactggccggtgctgacgcgtcttttcctgcgcttattcgatgtcttcttcaagccctcactgtcccttgcccccagcccaacagcaggtcctggcagcctacctctaaaacccaagctgactctgaccacatcccaccacctctactgccacccctggggtcatgccaccatcatctgtggtctggaccactgccgttgcctgctggtctggcccttacagtctgttctcctgggagctcccttcgctacaaggaaggaagcatggctggtttcttgtcatcatttaggtctcagctcaagtgtcaccgacccagagaggctgtcctgaccactctacccacccaggcagctttgtctctgtcccctcccaccttccaaccaagccccttggggagcggaacgggatggggggtgtgttctggatccaccgtctctcccttcagctccttggcactcctttcctatggggcaccctgtccagggcaggtggggcaggattcccccctcttccctcatctcccgtgcttcccgggcccaccccccagcatctccagcctgcccgggagtcacatgtcctcggcccacagaatccccagcacacgccccacccacaggcctagccccagccctggggtccctggcaccccacctgccagggcccctcccctgccttgctcaccccccaacacacctgattgttggaaaggtcttcccatgcccaccacgaccccctcccactcatctgtgggcgggagagcttggtccctgccgcacgttgcccccctagcatccaggcccaccaccgagcccccgacaggcctgggagccccactggtgggtggggacccaccagctgggggtcttgctcacaccgaggggctgggggtggcggtggctttctcagggcaccctgccttgggctgcaggccgctgggtgggcaccggctccctcggaaggcagcgcaacccgggatcctgccggccctggcccccaccctgccgaccgggcctggggcgatcagtgccccagctcctgtcctcttctgctcagatgctgggttgggagatcaggggccacagctcggccactcagagccctttccgcaagtcttagagggaccagctgcggggtgtgtgcagaggggctgcgctgtggggagggcgcatggctcagtcctcctggcctgaggcccgcctagcctaagtggcctccaggacccatggccaggcccttctgcagccttccagaaagaaccagcttcccagggttccctggggaaggcctggggccacctcctctggaggggtggggcctgtgcttcattcctccttccccaggtccccttccaggccgccaggtcccctccccgacctggagcccacagccttgtaattaaattgtaaacgtccttgtaattaaattcatgtaatatccattattattattactgttttagactaaattacttagagcacattgactggatcaaaggctaccatgaacgttttcaagggtttttatagttattgacaaattcttctccagaaatttgaccactttacactctggggtaagattcagactaagtgtgtctagaaagggtgatggggtcggctgggaggaggaactgggcttgcaggggacctggggcagtgagtgctctcagtgtgcaaaggggaactgggctgtcccaagcaggatgtgagggccacttgggccacattcaggcagaggggccctgctaaggcttgagtcccctgttcagagcagggaccatggtggaaattaaggacgttcatgtcaactgtggttgagattggagctgcagtcctagagtcagccctcttgggcccatcttggcagcaaatcaggaaggaagtagatctgtgtgctgaagagtcgccatggggcacgtcaagcccctggctgagccgtggtgtgctcacaggctgctgcactccccggggcagcggagtgccagggacttgtattttcatctttgtgctcctccgcctcctcagtgtggcgctctgagcacttcgattatttgaaaggaaatgcgaaaatttgtacaaaatctattgtgctagcacgtgatggaggaggggtctttgtgaacaggctttgagggtttgcttggctcacagctcactacccagtcaacagggttgactgccacggggtgacctcgctaaggtgaagcatgatgcccagcacgtggtcaggatggcacgggagcactggagaagatgagagtcgctgggaacctgggcgaggggggacaaggggcatttgagtgggcttcaggtacgtgaagtgttgcaagataaagtgggtttcttctggattgttccaaaggagggaggttgctctcaatgaaggaaacattcaatagtgagagttttccgataatgagctcagtcaacaatccccactctccccatactagagaagcaaagtggatttcttctggattgttccaaaggagagaagtttgcacttgatgaaggagacttttttttggggggggggtggggggtggatggagtctgactctgttgcccaggctggagtgcagtggtgcaatctcagctcactgcagcctccacctcccaggttcaagtgattctcctgcctcagcctctcaagtagctgagattacaggcgtgcaccaccatgcccggctaagttttgtatttttagttgagacggggtttcactgtgttggccaggctggtctcgaactcctgacctcaggtgatctgcctgccttggcctcccaaagtgctgggattacaggcgtgagcctccgtgctgggcaatttttgtatttttagtagagtccgggtacatcagactcaggggctgggtcatgcctgtaatctcaacacttttggggggactaagcagatggcttgagcccaggagttcgagactagcctgggcaacatggtgaaaccccatctcttattattattattttttaaaaggtagatcagataaattacaggtccttaatatatattcaacaaattacagaaatatataaaattttaattcagccaagaaacatattaaagttttatcttcagcaaactgttaggagttgggatggaagtagaactcagggtgaagccctcttggggtttgttgtctaatgaaagggaggtaattagacaatcacacataaaaggctgagctccagcctgggtatcttgaggcctcctggacttgctgtagcatctggagaagtatggggcatcatctcgcatcacttagcaccagcactgccacccagccttgatgtgggtcctgttggcctgagcgtttttccttgaagaaggtattaaaagcagattgaagccgcctgtgcccacccatcccctacgcacttcatctgctcgcctctctgccgtgttttccaccaagtacatactacgaatgagcctccattatgtgcgcctccattaactgcacatgcggaataccaggaattgtttgttcgactgctggcagacctttgggctgtccctggtgtttggccactgtggccttcatgcccacatcctcctggtcctcctggtggtggttctgaagggcatctcctctcatctcatggctccaagtgcttgctagtgggtcccctttgccctgagcacctgttgatatcctttgcccatgttcttcttgagttgtttgtgtctgtgttttcttgttgttttgtaggaattctttgcatattctggaaaacccattatgaggtccatgcattgtaaggctctcctctgagcccgcctttttactgtgtttagggtgtcttttgtcgtctagaagttttacatctcttccattattgcttccccatttgaaatattgagaatttcgtctctatcccacaccataaagatattgttctcttgttttgctttgtccctgtaggtctttgatccaattggaattgcttggccagggcttggactaggtcttctgtcttggtggggcgagctcccagggtgtggaaacgtttgcaggtggggcaggagggagagtctggtgggaagcaagcctggggttggccatgttgagtgtttgtgccttttagagactggagtggtcgagtaggcaatccgagggttggggcattacaggggtggctttaccagtgtgctacctcaggatggttgggggtggggcggggaggcaaggctctgagcaggactggaagagctgctgtcatcagaagggccacagtgtggctccttaccatgtgcctggccctatacctctttgctcatggccccatattttcccaccttgttggtagcccttagcccttccccagaggggagctcatttcttccttgggggtccagcatgaccgatgaggaggagagagagagagagcgagaaggcttcaggagcccgtggcttccacccaaatacctgcctggctgtcacaggcgatcactctggttgctgctgatccgaggtgctgaggctgtgcccacgcccatccccctcttgacatcccagcctccgccagcccgcccagcaagcgctcctcagtttccatagcaacactgctgctcggtaatgattccgggtagaaaggcattcgtgcgttctctgtcatctctgtcacctgagcatcccactgcctgcttgctgtcctgccccgggagttcaggaagaaaccctgaggacagctccgagcccttctgcttgtgtgttggcttctcctcaagggcagtggtaaggtggtaaatgttcccagacaaaaagccctgatttggagcatttgccgatttccctggtgtaaatgctgccactatagccgatttcaagccaccactgcgatgtcactgaacttggagttgggggaatgcacacatagtatttccatctcccataccagatgtgaataaccccaaaagcacagatgacagaaaagtgtagtaagataattagacagtgatgtgttccgaggatttattgcctttgttgttaatatcattcagttacctgtacatttctacggttaaaataccaataatcgctgtgtttgacaactggcttccaaatttcccagcttcagttggctctagccactgctgctgagagtgtcgaggccattccatcatgtccctttgtctacagccttcctgaacccacactctgctgccgcccaccctcttccatcctgcctttctaactgtagcctctccaccaagcacagcatgccctgtcctgactgacattcttacggtcttccaacaaataccttcttggctgaaagctgtttcctttatagtatttgatccagaaattccacctcaagaaattttctccaccttgacaaccactggttacacaaagatttaagtatgaaaaatgtataaaatggaccccagaatgtgtctttgccacattctttataataaaaaatcaaagccacccttactgatgtgatgatgaacatgatggtccactggtgtgttggtgtggatggaccttaaggggcctgcagctgcaaaatggcacacatagaaaacagactggaaggaaacaggccgcatggccaggtgcggtggctcatgcctataatcccagcactttgggaggctgaggcaggaggattacttgaggtcaggagtttgagaccatcctggccaacatagtgaaaccccatctctactaaaaatacaaaaattatccaggcgtggtggtgggtgcctgtaatcctagctattggggaggctgaggcaggagaatcacttgaacccaggaggcagaggttgcagtgagccaagattatgccactgcacttcagcctggatgacagagcaagactctgtctaaaaaaaaaaaaacaacagctgggtgtggtggcacacacctgtagtcccagctacttgggaggctgaggcaggagaattgcttgagcccaggaggtggaggttgcagtgagccaagatcgtgccactgcaccccagcctgggcaacagagcaagactccatctcaacaaaaaaaagcccccaaaaaacaaaaaaatgaactgtgtttcttttataatcggacaaaactgattttgacaaaaagctcttttcagaatatgaaaattttggggagaagggagacatagaaaacttcaatgattatctacaaggacatagtcaaatagaaaaaaagtaatgcaggagccgctgctgaggccacaggggttccgaggacaagctgggctctcctcagatagctgtcttcccgaaaagactcgtacagcggtggttctactgtatcgcgggcactaagacaagattttgccgtcagaattgacatctctgtgagaaacccggggtgggaggtgccgccgtgagaatgcaggacagagagttcttctaaacttgctaatattcgcacaactcggaaaagcagagggctccgtgcaggcgcagccacctgcgcccatgcccagggcccttctgccctctcatctggcacaagctcccagcctgctccatccctaggcggactctgggtctcctcgccctgccctctctgtgctgactgggggctttgcttccaactgcaaaccagcctccctgggtcttttcttggccctgttccctttgcctgatggaggccaggtgtcccctgctccagaagccttccccgcctcccaccgaggcgtgcatggccagccgtgtgctcccttagctgtgggtaaggtctgtccccacgctcacctgcggggcatagccatttgggcataatgctagtgtgtagcctccccaggcccagaacagcccttccataagccgctgagcccatgaggagaccctgcacgcctgcctcgagctgcctcctcctagaagtgcttcctgctgacccttgctggccccatggcacgtgccctgaattctggtggagtctgttcagtccttcttggtccttagtcattcgtcccttctctacttgcctcccttccccaaggaggacttgaaggtcgcagcatactgtcccagggtgctgcggaagcagccttcgaccttgtgggcactgcttgccccaccacctgcgctgtgcgtaatgggcttccttctgctacccttcattgtccttccttcacccctacagcatcccgcagagctgcttaggtcctacttccgccttgggccctggcccgcgatggcctcctcctccctgacccctccttctggccaccgggcagcctgtcctggctcatgaccttgactcagtgccacaaccttgctgagcttgctgacatggtttcctcatctgcaataatggcatctccctcaaggttgttgggggttaggattttgtggagacccacatcaggggtctttcccagaatgtagcacatggcacgtgcccaaaaaacagtagtggcatttttttttctttgagacggagtctcgctctgtcgcccaagctggagtacagtggtgcgatctcggctcactgcaagctccgcctcctgggttcatgccattttcctgcctcagcctcccgaggagctgggactacaggcgcccaccaccacgcccggctaattttttgtatttttagtagagatggggtttcactgtgtttagccaggatggtctcgatctcctgacctcgtgatctgcccgcctaggcctcccaaagtgctgggattacaggcgtgagccaccgcacccggcctagtggtggctttataaggaccactttcttggcacctcttttaggctactttgcagttccagggggcttcttgtacatcaaggccttttctcttgggcaagtcagttgtcactgtgaggacacaacactgtatctttaggcatcttcctacttgtcccccaacctgaccctggccctccctagtgagtagacatttgttgagagactcggctcatctgaagagtcaaggtcatcctcttgcttgatgctgaatgagcacaacacagatgctcactgagtgttggctgttatggtccagtcattgccaaggaactcaatgggatcttcatgctagctctggcctcagtgccgccctagaaagaagtgggtccggatggggagaggccaggagagctcaagcagtgtctggaggacgttgtagggcggtatcacagcctccagacccagtgcacagaggctgggtcccccagtccttggtgtgacttggtgatccccagctggccttcagtgggatgaaggctgagcagtggggcttgcctgggaacaggggcaccaaaggtagccagggctgcagacagcagattccttgcttgagtggcttggggtgctggttgtcagcccaggtcctgccagctagggcctctgccttgacctcagaggggaggagcaagcctttgagggttcttacggaggcgtgtctctgccgcaggtgaacgggaaggagctctccaagctgtctcaggagcaaactctgcaggccctgcgctcctccaaggagcccctggtgatccaggtgctgagacgcagcccccgcctccggggggacagctcctgtcacgacctgcagctggtggacagtggcactcagaccgacatcaccttcgagcatatcatggcgctgggcaagctgcgtccgcccaccccgcccatggtcatcctggagccgtacgtcctctctgagctgtgagtcgccctcaggagggccccgggccctgcctccagagaggacaggccacctggagcggccatccgcacgccaccctctcgggcaggaagcaggcccctcggcctccagaactgaccgtggtacccaagggctccaaaacctccaggcctctagccttgggccgggctccagcaggcgccccgttgtatctacccccagggccgagggaggaccctcctgtccgggacgtcgctgccggaagtgccagggttgagggcctcagctcctcctcctccatcctctctcctctgccgcctcacaagcatcactccttgaatcttcttgcatcccttgtctgtctcattcctctacctgctctgaatttcctccatctcttcagcttctttctttggcccgaccggaagaagggcctttcatccaggcctggtggctcatgaccgcgtgagcgctgcctcattctgctaatcttagcccgggctgcggggaggtaggccacagggccatgagcagccaaccttagttttggggccaggagggcagcccctggaggtagggtgggcccccctctgctctgcagaagtcctccagggcctggataactcctgggggcgttgcatgagtggggccagtgctgggcgggcgggtgggcacccggagattggagaagttggtccctgccagctggcgtggttggaggagttctggtctgggggacgggaacgctagaggcatgcgcaggtcctctgcgtggacgctgcacactcaggtgcgagaagtgcccccggtctttgcatggctgcatgttgcccaggaaggggctctgcaggaggcaactgggccacccacccttgagagcacaagcagagcaggcctccgtgccaggcacgctgggatcggcctgcctgggagctggggctgaggtgtgagaggatggccagctggtctgacccccaccttctcctgggcagccccccaatcagccatgagtattatgacccggcggagtttatggagggcggcccgcaggaggcagaccgcttggatgagctggagtatgaggtgagccgggtggccaggccagggcccgcagccagctgcgggagccgccccgacgcctgtgtgccttcctgcccaggcccaaccccgtggccctcctggcacgcatctggctgagtcagggagggtgcgggtgaggttacgtgttccgtccatgtcggtgagtccacgtcccatgcacgtctgtcttctgtgtcctgtgcctgtgtgtgcctcgtgcatttcctgggagggagaccactgagtacgtgcgccacgtgggatggtaagagagaccctcaaagcggggcctggaaactgagctcagggggctccagaggaagctgaggggctgcgggctgaggggttgcgggctgaggggctgggctgtgctgcctgctccctcactcacgcatttctggggctttctacctctgcttcctcccggacccctcgtggcaggaggtggagctgtataaaagcagccaccgggacaagctgggcctgatggtttgctaccgcacggacgacgaggaggacctgggcatttatgtcggagaggtatgcagacgggtatgccccagccccgaggcccatccacatggcctgcctgtggctcagaggctgcccttaaggtcccagctaccagaaacagggcatcacagctagggtgctgcgtggtgaggcgatgatggtcgacggcttcagccactgtccagtgaggtagtcatctgcagaaagaggcctgtgcctgggtgggacagcagatgggcctgagaactagcaacagggttgctgtctagccttctcccgaacccatcttgggcagatgtcttgtgtatccccaggagggggatggcccctcgctcccctccctactagtagcatcccactaaagccacccttccagatggacaatgtcctacttcccaccaatgcccggggctgaccaaaagcacaggcttccgtgcagaagagcctaggagtgcagggcaggggcggggagaggtgactactccacagcctctgcctctgcttcctggggctcagagctggaaggggagccagagagccttcagcttgctttgggggcccctgaggtgagcctgcccccttctaccgaaagggcatgttaggcaccaagtccccaagatgcgtgtgtcctgcaggtaaatcccaacagcattgcagccaaagacggccggatccgtgagggagaccgcatcatccaggtgagcacttgcaggctgcaggcctggcccaaggccccgctgtgcccgtcggcccagccacctctctttagccagtccctagctctctcccactaagagctaaccctgaggcccagcagcctgccgtgtcctaaacccgggctgagtctcatctctctcctgcccactcaccccagtggctcccgtgtgcctatgggatctgctggcatccagggcccctgctgctctgaaacctcctggcccctctccctctgccccactccatgctctcctgagcacacatttgctcttgcaagagtcaggccgccctctccctggtaccttccacttagttacatcctcccagagctcaagccccagcctagcccagccgagcccagagtgcttgggctccctgcacccgcccagggtccgccccagggccagccctagcatgcttgttgattgtatcctgcctgcctcagattaacggtgtagacgtccagaaccgggaagaggcggtggccatcctgagccaggaagagaacaccaacatctccctgctggtggcccgacctgagagtcaggtgtgtatgcctggcagggcgacccggggccacgacatcaggctttctgtcttggaagctgctggccgtgactagggcacagatgtgccaacgacctggagttgatggagggcgggtgggcaggggtctctcagggcccgtttcccctcctggcctctgaaggctgagggggctgggacgctgcccccaggttgctgagcttcaccgaaacaagccaagtgcggggtccagagcagacaagaagggtatatggggaggtccttgaagctgtggggacaccagggcctgtctccacagctggcgaaaaggtggaaggacagcgaccgggatgacttcctggatgactttggctctgagaatgagggggagctgcgtgctcgtaaactgaaatcaccccctgcccagcaggtgaggaaggaaaagggcgctggtggggagggcgaggaggagagaactgggtggaaggcgctgaggctgtgcagggtctcccaatgcttggcagggaaatgaaccaggcctgaagccccttccgatcctcctgtgacatcccgtgacatccctgtccgtgggacctaactgagcggtacttacctttctgctctagcccggaaacgaagaggagaagggggctcccgatgccggcccaggcctgagcaacagccaggagctggacagcggggtgggccggactgacgagagcacccggaacgaagagagctctgagcacgacctgctgggggacgaacccccgagctccaccaacaccccgggaagcctgcgcaagtttggcctgcaaggggacgccctgcagagccgggacttccatttcagcatggactctctgctggccgagggggcggggctgggagggggcgacgtcccgggcctcacggatgaggagtatgagcgctaccgtgagctcctggagatcaagtgccacctggagaacggcaaccagctgggcctcctctttccccgggcctccggaggcaacagcgccctggacgtcaaccgcaacgagagcctgggccacgagatggccatgctggaggaggagctaaggcacctggaattcaagtgccgcaacatactgcgggcgcagaagatgcagcagctgcgtgagcgctgcatgaaggcctggctgctggaggaggagagcctctacgacctggcggccagcgagcccaagaagcacgagctgtccgacatctccgagctgcccgagaagtcggacaaggacagcaccagcgcctacaacactggggagagctgccgcagcaccccgctgcttgtggagcccctgcccgagagccccctgcggcgggccatggccggcaactccaacttgaaccggacccctcccggccccgctgttgccacccccgccaaggcagctcctccaccggggagccccgccaagttccggtccctctcccgggatcctgaggccggccggaggcagcacgcggaggagcgcggccgccgcaaccccaagacggggttgaccctggagcgtgtgggccctgaaagcagcccttacctctcgcggcgccaccgcggccagggccaggagggcgagcactaccacagctgcgtgcagctggccccgacgcgaggcctggaggagctgggccacggccccctgagcttggccggtggccctcgggtgggcggggtggcggccgcggccactgaagcaccgcgcatggagtggaaagtgaaggtgcgcagcgacggaacccgctacgtggccaagcggcccgtgcgagatcggctgctgaaagcccgtgccctgaagatccgggaggagcgcagcggtatgacgaccgacgacgacgcggtgagcgagatgaagatgggccgctactggagcaaggaggagcggaagcagcacctgatccgggcccgtgagcagcggaagcggcgcgagttcatgatgcagagccggctggagtgcctgcgggagcagcagaatggcgacagcaagcccgagctcaacatcattgccctgagccaccgcaaaaccatgaagaagcggaacaagaagatcctggacaactggatcaccatccaggagatgctggcccacggcgcgcgctccgccgatggcaagcgggtctacaaccctcttctctcagtcaccaccgtgtgagctgcccgggcgggtacacggcccaggcccagggaaccccctggggccccggccctcactctcct

SEQ ID NO: 4036 - DNA, 24598 bp, human
ggctcgaggaggacaaggtagggagccgtccgcaccctcccatcctggggctgttgggtgttggcgctccgtgggaaccagccacgggtggggtgggaagttggggttggcccgggtggggcgcgcttccgtcccgggaggcgcggtgcggcgggcgcgggatggaggttgcatagcaacgagcgcagttccccgcacacgctctccccgcaggacccagggcgggggagggagccaggctcccgccgtgcggggggcgccgaatctagatcccggcgggcctggagcgtgggagtgcgtgggcgtccccgggcgcggtccaagtccgtccgggggctgggtgcccaccccgacacccactcccgcctggccctgcccgaacgatgggctcccgggccttaggcgtctcgggtgagtgggcgccgccgggatcagcgggttgggctctctgcgggtggcagtgcctggccgggctttgcggggcgtggaccagcagggccccgcggggagggaaggagacgcggggcccggagctcggacctggagcccagccccgcggcccggaacggggcttcttgcctgtgcgtggcgtgactacgtgagtgcgttcctgtgccccgtctctgtgtgcgcggaggctcccccggccccgcatttgtgtactttctgtgtgcaccctgcagactgtctagagaaatgtcccggatgctgtgggctgagacctcctagggctaagtggagggaggtcaaggtcaaggcacccaggagcagacagggctcagacaggtatgcgtttagtggcctggattcaactcccgggtttattggtctggactgggaaggaatcaagtgctttgcaggaggggtgttggcttgggagaacgtgggggaacccgtgcagggatcggcgagaactccggggcgggggcgggggcgggggaaggaggggctgggcacgggggagaattcccaggaatccggggactgacttcacgctgtgagccgagctcctctggccacctggtgcgggagccgaggggcagggcggggacgcaaatcttgccccaccctggcggagctcctggtcctctctccccggcccttctccgggggtgcgcggggccctcggcttctcccgttcgctgtcctccgccttcttccctctcagttcccggctgccactcctcgtctcttgttcccgctgtttggaaaccttgtgtggccattgccagccccctagcgggataggaatgcgaccgagagggcgtcctgtggaatccgtgttggattccagggctgggatggttggttgacggggactctggatcccatcctcctgcttccttttcgggagtcattccatcaaacggcaagcgatttctccaagcgattcctccggggccgttttgactttcctggagaaggattggtgtcgcacttcatttaaggccaacctcgtggggacgtgtggataggggagagcgacccgagctgcaccccaggcctgaaatgagccatgggacgacaccggtagcccttggggctccccacagccctccgggaaggcctcggcaggtcgggctgggcctgccttcagggaggtgaacttgggtgggccctccctgctctgcgccctaagctctccttcatggaagggacttgcccaccccaaggagacccgccaggaggagggccactgccgcatgcgccctctgtgcgctttcctgctgggctccctttgaaaccgtgggagtttggctgcaaactttcactttctacattcctccttggcccaatcaaagccgggattttacgaggagaaccatccttcacaactaagggaaaacaagaggactgaaaaaagtagatacggaaagcagtgcaagccatgagctgtcccaggggactgcgcttctgggggtggacgcatcaccaggtcccagcctcttcagaggagaaggagcttttgttccaaaagacaggtcagcttctgggaccccgtgcctgcctcccggcctccttaaacacgggtgctcccccatctttagggggcacttctccctgtcccccctgagtaacctcgtccgcaccttgtcagggtgaggcacttcatgggcctgattttcagaaagaagcacatgtgcatctgcagcgccttccatctacaatccacagaggcctgggatccccaggccaggaacccccaagtctctagcctagccttgtgttccaagccattttctgccaatgactcacaacacttccaaaattacagctgtattgagctatcattctcctactgcacaacttaccctttcaaagtgtacaagtcagtggtttttagtatactcacaaggttgtgcagcccacaccagtaattccagaacgttttcatcaccccaaaagaaaccctgcactccttagcaatcacatccccatttctccctcaaacttcctagcccctggcacccaccaatctacttcctgtctctatggatttgtttattctaaacatttcatagaaactgaccttttgtgtctggctttcattaatcataatgttttcaaggttcatccatgtatcaatagtcaatttctttttattgccaaataatatttcattttgtgatatacaacatatttatccattcgtcagttgatgagcatttggggtgcttccacccttgggctgttgtgaatagcgctgctgtgaacactggtctacttgtatctgtttgagtccttgcttttaattctttggagtgtgtgcctgtagccattgaactgttttccacagtggctggaaccagtttacattcccaccagcaacatataagggttccaatttctctatatctttgccaacagttgttattttctgggtttttgttatggccgtcctgctgggtgtgaagtggtatctcattgtgattttgatttgcacttcctgttagctaaatgatgagcaccttttcttgtgcttgttggccatttgtggatcttctttagaaaaatgtctgttcttaagccagcgccacactgctttcattactgcagctttgtagtaagttttgaagtaaggaaatgagagtcctccaactttgtacgtctttttcaagactgttttgtctattctaagtccctcaagtttccatattaatttcaggatcaggttgttaatttctggaaagaagccagttggcattttgatagagattgcatcaaatttgtggatcaatttgggtagtattgttcatgagcatggggtgcgttttccatttatttaggtctttaatttctttacatgatgttttgcacttttgtttaagtttattcatgagtattttctttatgatgctatcataaatggaatcgttttcttaattttactttcagccttctcattgctactgtatagaaatacaattgattggctgagcgtgttggctcacacctgtaatcccagcactttgggaggccaaggcgggtggctcacctgtgcttaggagttcaagaccagcctggccaacatagtggaaccccgtctctactaaaaatacaaaaaaaattaacggggcatggtgatgtgtgcctgtaatcccagctactcaggagactgaggcaagagaatcgcatgaaccccagaggcagaggttgcagtgagctgagattgcaccgctgcactccagcctgggtgacagggcaggactctgtctcaaaaaaaaaattgatttttatacattgatcctatatcttgcgaccttactaaaattgtttattaagtataatttgtttagtagattcctcaggattatctacatattaggatcatgtcattggcaaatagaaatcgtttttcttcttcctttccaatctggatggctttgatttcttttcttttctttctttctttttttttttttttttgagacacagtctcactttgtcacccagactggagtgcagtggtgcaatctcggctcactgcagcctccgcctcccgggttcaagtgattctcctgcctcagcttcccatgtagctaggattacaggcacacactaccacacccagctaatttttgtatttttagcagagacgagcttttgccatgttggccaggctagtcttgaactcctggcctcaagcaatcctgcccgcctcggcctcccaaagtgctgggattaccggtgtaaaccaccgttcctggcccttcgatttctttttcttgttaatttgctctggctggagtctctagtacaatgttgaatagaagtgcctgtgaatgtctttcccttgttcctcatcttaaaggtaaagaagcttccagtctttcactagggggtataaagttagctgtggctttttcatagctgtcctttatcagggtaaggaagttcccattctattcctagtgtgtttttatcatgagaggcattggattgtgcagtgctgcttctgtggctagtgagatgaccacatggttcctttattccacggatgtgggttgtcacaggcactttcgtgtgtcatgtcggaacctcagccccattcctatattccaatcatgtcctcctagtttggaaaatctgggacctcccctgaaaatggaggattactgcgtgttgagttaggaaaaggaagcaggctggttgcccagaatggaaggcaggaaacagcatgtccccagctccggagccttttctgcagcccatgtccctccactgccaccaggcccccttgtcatatatctcatcgtggtccacactctgctgaacttgtcttggccttggcaccccctctctgacaccatgatgtgcttgctagcatccgagcacgccggagatggtcaggggataaacccctggtacttaggactggtctcccgcccatcctactcaggctttacagggggagtgggtcaggaccgcctgtcatctcccctctgtccacatcgagggaggccaaaggacagctggccagcccttctggtgatctcccaggcattcttgcctaaagcacctgcatgtgagcccccatggtgctggcagccatcctgggtgcgtggcattcagcagggagacactgcagacagggccttgcccctcccccagactccccttttgttgttgttgttgttgttgtttgagacagagtttcgctcttgttgcccaggctggagtgcaatggtacgatctgggctcaccaaaacctccgcctccagggttcaagcgattctcctgcctcagcctcccgagtagctgggattacaggcatgcgccaccatgcctggctaattttgtatttttagtagagatggggtttctccatgttggtcaggctggtcttgaactcccgacctcaggtgatccacccacaccggcctcccaaagtgctgggattacaggagtgagccaccacgcctggccccaggctcccctttttgtaagggggagaccatcgccaacatgtaggcaactgcgggggagagaaagtactgcttgagtgcgggagcgtggctggcagccagtgtcccctcttcagcgacgtcttcctccaaactgctctcccacccaccaagccaggtggcttctctggctccctcctgcttgcatgggggcttcctgtgagcagggatttgggtctggcatgggcactctgcctccccgcctcaccagcaccagatgctgccagcacatccacgctggcctccacccttccaggggaaagctggactctcagtcaactcagtggttctgccgcagaagctgactggggaagaagcaggctctgagaaagtccttgtggagtggaagaacagagggctggacactgaattctgactgccatcttctggaccaggtcatcctgttttgtgtcattgtcccaagattgtagaatgccctttcccctctcatctcggggttcctgaggactgtccagtctgctgaaatgaaattcgatagtgccagagagcagattcgtggttgcagggatgggcagaggggcatgaggacacttttggggaagatagaaatggccactgtcctgacggtggtgatggttccccaggttcatgtatgacatatgaacacctgccctttgcacactgaagatgtgcaggttaccacccagcaacagacctcaccaaagctttagaacaggaactccatggccacatgcacgcatcctggggagaaaggtgtcctttccttccttctacttcaggggccctgccagagaaggcagtgcagtgtggagataggaatggaggcagccaccaactgacagctgtgtggccaggggcaagtcgctgcatggcccactggctcagtgactcagtttcctcaactgtgaaatggcagtgaagagtgcttgcgtccgagggccattgtgacaaggaaaacagatggtgtgtcccccgggatctcactgggtggaggagggagttgctgccctcgggccattcagttggtcattaagaagtggaaattggctgggtgcggtggctcacgcctgtaatcccagcactttgggaggccgaggcgggtggatcatgaggtcaggagttcgagaccagcctggccagcatggtgaaaccccatctatactaaaaatacaaaaaattgaccaggcgtggtggctcacgcctgtaatcccagcactttgggaggctgaggtgggcggatcacctcaggtcaggagttcgagaccagcctgaccaacatagagaaaccccatctctactaaaaatacaaaattagccgggcatggtgacacatgcctgtaatcccaggtacgcgggaggctgaggcaggagaattgcttgaacccgggaggtggaggttgtggtgagctgagatcacgccattgcactccagcttgggctcgaaactccatctcaaaaaaaaatatatatatatatattagctgggcatcatgcacctgtagtcccagctactcgggaggctgaggcaggagaactgcttgaactcagcaggtggaggttgcatgagccaagatcaagccactgcactccagcctaggtgacagaacgagaccctgtctcaaataaataaattaattaaataaaaaataatgaaaaaggaaattatatggagaaggccttacatctgggtatgtcacagttaatgcccagtgacagaagaatgtccaatattattctgagaatttctctcaggaaagggacctccaagttttgaagaagtgtgatgtagtacaatattagttaggacagcctgggcaacatattgagaccttgtctctacaaaaataaaaaattgctcaggcgtagtggcatgcgcctctagtcccagcttctggggaggctgagtgggaggattgcttgaacccaggagttggaggcttctgtgagccgtgattgtaccactgcactctagcctgggcaatggagccagactgtgtctggaaaaaaaagaaagaaagacagagagaaagagagagagagagagggagggagggagagagagagagagagagaaagaaaaaacagatggacagggaacaaagcggaggcatatgtggtcattttgcacaggagttgggccggaggaggcgaggctgagcagcctggggctggacaagatgtcctccctttcagtgcattctgcctgtcctcatggctgcttggagcattgagaatgaaaaacgctgcagagggaatattgctttgattgtaaaacgctgcagagggaatattgctttgattgttgctagatgtgaactgtgcccttagccagtcaggttagcctgaggtgggtgggaggatgggtttagttgctgggccacgtgcctggaaagctgtgaatatgtacccgaaggttgatcttgagaatggcttcaggaagtggttggcttttcctgtgcaaggtgtgggacacccctcttttcctgtgtgttttttttttttttttttttgagacagagtcttgctctgtcacccaggctagagtgcagtgttgtgatctcggctcattgcagcctccgcctcctgggttcaagcaattctgcctcagcctcccgagtagctgggattacaggcacctgccaccacgcctggctaatttttgtatttttagtaaagacagggtttcatcatgttggccagtctggtctcaaactcctgacctctagtgatccgcctgcctcggcctcccaaaatgctgggattacaggcgtgagccaccgcgcccggcctcctttctgcttctgagccaggactatggaggtgtctgagaggccgccgctctcccggaaaggtgggggccaggtggattgatgagacttcagcagaccctgggcttcggggagggaaggagaagtgaggggaaagaaagatgccctcatgcagaaggccttcgttgaggtctgccctggttcctccagggcgcgctctgagtcagtacagcgccaccctccacccgaagtccttgttaaggtgcactttctgactgagccactagcatggggcctgggattctgcacttctcacaagctcccaggtgatgtggatcccactggctgtgagtagccagggccttgggtagggaccgggagtagatctatggtagccccaaaccacattaacatgggtggtgaagtgaggtgttgttttttttgtttgtttgttttgttttttttttttacaaatagagggtaaaaattgtttacaaatagagggtaaaaaaacacacatagagggtaaatcagaacatccaggagtcgttgcctacgtgagggctttacaggacataacttgttcttccctgccatgtgcagctaactgacccccttccctgtcaccggcacccctaccggtatacatgtctctcatggacgcccagacacccctcccccgactaagtgctcaaaggcctttgagatgaagccctcccatgtttctgtctctcctgcccccaggcagaaagggtgggcacagagttatggaagcgggtggtgtggcttgcccaggaggccacagttgggggcgtgggcagccatgctacttgccgggcctgtcacctctttgtccctgctagaattctaacatgttggtggagacattttgcagccaccaatgcagtaattaattcaggcaaaaatcatcactggatgccaaaaccattagatgtaaggtcgttggggacagaatattcacaaagtctccaaatattaccccaaattacctgtgaatcaggaagggaaactgcgtctttacagaggagagatctggcagctgccacctggaccatgtgatcaaacagcctccccaacagtggggcagcctgaccctgccagccgccagatgcagggctggggaggagacatacagcatctcctgcaaggtgctcttgtcaaaacgctcagcctgaatctcaccgcgggaatgaatcaggcaaattcagactctggcgcattctataaggactggtctcttccaagaagtcattcccattaaagtaaaaaatatatatatttttttctagattagagaggagacataataactagagacctaacaaccgaatgtaatatgtgtgcttcttgattgaatcctagattttttgtttgtttgttttgtttttgagatggagtctctctgtgtcacccaggctggagtgtgatggtgtgatctcagctcacttcaacctctgcttcctgggttcaatcaattctcctgcctcagcctcccaagtagctgggaccataggctgcaccaccacgcctcgctttttttttttttttttttttttttgagatggagtcttgctctgtcgcccaggctggagtgcagtggcacgatctcggctcactgcaacctcctccgccacccgggttcaagtgattctcctgcctcagcctccctagtagctggaactacaggtgcaagccaccacgcccggctaatttttgtatttttagtagagacggggtttcaccatattggccatgctggtctcgaactcctgaccttgtgatctgcccgcctcagcctcccaaagtgctgggattacaggcatgagccattgtgcccagcctcaaatcctagatttttaaaaaaagctataagggtgttagcgggacagctggggagatgtgaggctggcccattgtatgagtgcggaattccgtgctaagggtgttgtggttccacggagaatgggactgatggcatcttgctttcaaatgcttctgcacatgtgtgtgtagaaaccccgagagcaggtgtggggaatctgcagatgttcccacatgcttgtgggcggacaattttcaaaatcccgagctggggaaacatgaatggggactttgctgggtcactgagtgggtgaatgtagtgagcctgcggcttctcctttctcctctgatgctctactcgttgggagatcccccgatgcctgacttggcctggaagctacagtcacaactgcttccaaggtgtcctggatactccagacggcagagctgagagccagcaggcaggtcagagctcggccccgggcagaggataacttcctgtctctgtccttccccagcttgtttcctactctacagcagtggggtaaggggagtccgaaggtggcagcccccccacctccgtggcagccacgggggcccctggaagtgatgtggcttcacctcccatcccgcgcgttgccagtgagagtgaaaggggtcgcaggcgccgtgtgacaagcacttgggattgcgagtctcccaggccacaactgttttcttagcctctccggcctctcttctcggcttcccagagattcctgatcagcaagagggcgtcgcgccccacccggctgtgcgcctgccaccgctgggtgcaggagggtgcctggggcagagcctggaaacagagctcagcctccgacggggttggcggggcgggcgggcaggagtcctgccaatacagccaccagcgtggcggcgccgggacgagtgtggtccgccctgctcccgcagccgcagccaccccgccgccgtcgcggcgcgctctttgtctgcggctccgggctcagggggcggggcgagcgcgcctggggctccgccctctccgcctagggcgccccgcttcccgcgtcccctaaggcccgccagtcccttgcccagcgggagatcgccgccccacagcgactgcccgtggggccgacttcgcgtcatgcctgcctcgcctgcccggtgttgccccctcccctgtccctgtgtcccccctcccttgcccgcatgtccccctcatgcggggaaagcggtgccagcactttccctggccttgcgaattgctcttccatcggtattcagccgcccctctgatgttcctgaaaacccaacctgctccttctctgcaaaaagctccggaaggctgtgtcgatgcaggtcgagcttccccacccggccccctcccaccttttagcaaatccagaggccccaccttcgccctcccctcccgggctccgacccagtgcattgagcagctcctcggcttccctcccgggactttctagtctctctccccaaccggctcagtgtcagggtgccccaggactctccttgggcctctcctgttcttgactacattcactccctaggtgagctcctccatctcatgcttttgctttttaaatttttatttatttatttttaaatttttattatttttgagacagggtctcagtccgttgctcaggctggagtggagtggcacaatcacggctcactgcagccttgacctcccaatgctcaggtgatcctcttgcctcagccctaccgcctgccccctacctcctccaccacttggggctacaggagcgagacaccacgcccagcttcatctcatgattctttttttgtttgagacggagtcttgctctgttgcccaggctggagtacagtggtgtgatctgggctcactgcaacctccacctcctgggttccagtggttctcctgcctcagcctcccaagtagttgggattacaggtgcctgccaccacgccctgctaatttttgtatttttcgtagagatagggtttcgccatgttggccaagctggtctcgaactcctgacctcaagtgatccgtctgtctcggcctcccaaagtgctgggactacaggcttgagccaccgtgcctggccgtcatcttatgattttaaataaagaaaaattcctagtttaattgaacagcaatggtcacatgccacccagttagctgacttgggcttgggccagacatttggagtggggcactggagatgtccacatgcctcgggaagttcaagctagagataaaaaccttccatttcctgccctgggcctaatccctgagtccttccttcctcggtcttcctcactgctgtgaggatacccctggtccttgtggtcctgtgtggcaattttatgttttcttgtggtaagatacgcataacataacatttaccactagtgacttttagtctattctcaatgttgtgcagccgtggccactgtctagttccagaacaggttcatcgccccaaaagggacctcatatccctcagcagtgactccccaggccccccttcctccaggtcctggcaaccattcgtctgctttctgtctgcctctttgccttggctagactgtgctcatgcagtcgtgtgtgccggtcgttcattctttttatgtcgggatgggtgtaccatgttgtgctcgctcatccattcatccactggtggacacgggttgcctccgagtcttggttactatggatactctgctgtgagcatttgagtataagttttctttgcatgcctgttctcaactatggatactctgctgtgagcatttgagtgtaagttttctttgcacgcctgttctcagttctttggggattgctgggtcatgtacataagctacacctaaccttgtgaggagccaccagactgcttccctggctgcactattttacatgcccagcagcaaggcgtgaggctccagggtccccgcgtcctctccaatactcgtgcttcctttcactgattccagcctcctcgtggtgtgcggcggtatctcactgtggtttgggtgtgtgtttcctctgtgcgtactggccggtgctgacgcgtcttttcctgcgcttattcgatgtcttcttcaagccctcactgtcccttgcccccagcccaacagcaggtcctggcagcctacctctaaaacccaagctgactctgaccacatcccaccacctctactgccacccctggggtcatgccaccatcatctgtggtctggaccactgccgttgcctgctggtctggcccttacagtctgttctcctgggagctcccttcgctacaaggaaggaagcatggctggtttcttgtcatcatttaggtctcagctcaagtgtcaccgacccagagaggctgtcctgaccactctacccacccaggcagctttgtctctgtcccctcccaccttccaaccaagccccttggggagcggaacgggatggggggtgtgttctggatccaccgtctctcccttcagctccttggcactcctttcctatggggcaccctgtccagggcaggtggggcaggattcccccctcttccctcatctcccgtgcttcccgggcccaccccccagcatctccagcctgcccgggagtcacatgtcctcggcccacagaatccccagcacacgccccacccacaggcctagccccagccctggggtccctggcaccccacctgccagggcccctcccctgccttgctcaccccccaacacacctgattgttggaaaggtcttcccatgcccaccacgaccccctcccactcatctgtgggcgggagagcttggtccctgccgcacgttgcccccctagcatccaggcccaccaccgagcccccgacaggcctgggagccccactggtgggtggggacccaccagctgggggtcttgctcacaccgaggggctgggggtggcggtggctttctcagggcaccctgccttgggctgcaggccgctgggtgggcaccggctccctcggaaggcagcgcaacccgggatcctgccggccctggcccccaccctgccgaccgggcctggggcgatcagtgccccagctcctgtcctcttctgctcagatgctgggttgggagatcaggggccacagctcggccactcagagccctttccgcaagtcttagagggaccagctgcggggtgtgtgcagaggggctgcgctgtggggagggcgcatggctcagtcctcctggcctgaggcccgcctagcctaagtggcctccaggacccatggccaggcccttctgcagccttccagaaagaaccagcttcccagggttccctggggaaggcctggggccacctcctctggaggggtggggcctgtgcttcattcctccttccccaggtccccttccaggccgccaggtcccctccccgacctggagcccacagccttgtaattaaattgtaaacgtccttgtaattaaattcatgtaatatccattattattattactgttttagactaaattacttagagcacattgactggatcaaaggctaccatgaacgttttcaagggtttttatagttattgacaaattcttctccagaaatttgaccactttacactctggggtaagattcagactaagtgtgtctagaaagggtgatggggtcggctgggaggaggaactgggcttgcaggggacctggggcagtgagtgctctcagtgtgcaaaggggaactgggctgtcccaagcaggatgtgagggccacttgggccacattcaggcagaggggccctgctaaggcttgagtcccctgttcagagcagggaccatggtggaaattaaggacgttcatgtcaactgtggttgagattggagctgcagtcctagagtcagccctcttgggcccatcttggcagcaaatcaggaaggaagtagatctgtgtgctgaagagtcgccatggggcacgtcaagcccctggctgagccgtggtgtgctcacaggctgctgcactccccggggcagcggagtgccagggacttgtattttcatctttgtgctcctccgcctcctcagtgtggcgctctgagcacttcgattatttgaaaggaaatgcgaaaatttgtacaaaatctattgtgctagcacgtgatggaggaggggtctttgtgaacaggctttgagggtttgcttggctcacagctcactacccagtcaacagggttgactgccacggggtgacctcgctaaggtgaagcatgatgcccagcacgtggtcaggatggcacgggagcactggagaagatgagagtcgctgggaacctgggcgaggggggacaaggggcatttgagtgggcttcaggtacgtgaagtgttgcaagataaagtgggtttcttctggattgttccaaaggagggaggttgctctcaatgaaggaaacattcaatagtgagagttttccgataatgagctcagtcaacaatccccactctccccatactagagaagcaaagtggatttcttctggattgttccaaaggagagaagtttgcacttgatgaaggagacttttttttggggggggggtggggggtggatggagtctgactctgttgcccaggctggagtgcagtggtgcaatctcagctcactgcagcctccacctcccaggttcaagtgattctcctgcctcagcctctcaagtagctgagattacaggcgtgcaccaccatgcccggctaagttttgtatttttagttgagacggggtttcactgtgttggccaggctggtctcgaactcctgacctcaggtgatctgcctgccttggcctcccaaagtgctgggattacaggcgtgagcctccgtgctgggcaatttttgtatttttagtagagtccgggtacatcagactcaggggctgggtcatgcctgtaatctcaacacttttggggggactaagcagatggcttgagcccaggagttcgagactagcctgggcaacatggtgaaaccccatctcttattattattattttttaaaaggtagatcagataaattacaggtccttaatatatattcaacaaattacagaaatatataaaattttaattcagccaagaaacatattaaagttttatcttcagcaaactgttaggagttgggatggaagtagaactcagggtgaagccctcttggggtttgttgtctaatgaaagggaggtaattagacaatcacacataaaaggctgagctccagcctgggtatcttgaggcctcctggacttgctgtagcatctggagaagtatggggcatcatctcgcatcacttagcaccagcactgccacccagccttgatgtgggtcctgttggcctgagcgtttttccttgaagaaggtattaaaagcagattgaagccgcctgtgcccacccatcccctacgcacttcatctgctcgcctctctgccgtgttttccaccaagtacatactacgaatgagcctccattatgtgcgcctccattaactgcacatgcggaataccaggaattgtttgttcgactgctggcagacctttgggctgtccctggtgtttggccactgtggccttcatgcccacatcctcctggtcctcctggtggtggttctgaagggcatctcctctcatctcatggctccaagtgcttgctagtgggtcccctttgccctgagcacctgttgatatcctttgcccatgttcttcttgagttgtttgtgtctgtgttttcttgttgttttgtaggaattctttgcatattctggaaaacccattatgaggtccatgcattgtaaggctctcctctgagcccgcctttttactgtgtttagggtgtcttttgtcgtctagaagttttacatctcttccattattgcttccccatttgaaatattgagaatttcgtctctatcccacaccataaagatattgttctcttgttttgctttgtccctgtaggtctttgatccaattggaattgcttggccagggcttggactaggtcttctgtcttggtggggcgagctcccagggtgtggaaacgtttgcaggtggggcaggagggagagtctggtgggaagcaagcctggggttggccatgttgagtgtttgtgccttttagagactggagtggtcgagtaggcaatccgagggttggggcattacaggggtggctttaccagtgtgctacctcaggatggttgggggtggggcggggaggcaaggctctgagcaggactggaagagctgctgtcatcagaagggccacagtgtggctccttaccatgtgcctggccctatacctctttgctcatggccccatattttcccaccttgttggtagcccttagcccttccccagaggggagctcatttcttccttgggggtccagcatgaccgatgaggaggagagagagagagagcgagaaggcttcaggagcccgtggcttccacccaaatacctgcctggctgtcacaggcgatcactctggttgctgctgatccgaggtgctgaggctgtgcccacgcccatccccctcttgacatcccagcctccgccagcccgcccagcaagcgctcctcagtttccatagcaacactgctgctcggtaatgattccgggtagaaaggcattcgtgcgttctctgtcatctctgtcacctgagcatcccactgcctgcttgctgtcctgccccgggagttcaggaagaaaccctgaggacagctccgagcccttctgcttgtgtgttggcttctcctcaagggcagtggtaaggtggtaaatgttcccagacaaaaagccctgatttggagcatttgccgatttccctggtgtaaatgctgccactatagccgatttcaagccaccactgcgatgtcactgaacttggagttgggggaatgcacacatagtatttccatctcccataccagatgtgaataaccccaaaagcacagatgacagaaaagtgtagtaagataattagacagtgatgtgttccgaggatttattgcctttgttgttaatatcattcagttacctgtacatttctacggttaaaataccaataatcgctgtgtttgacaactggcttccaaatttcccagcttcagttggctctagccactgctgctgagagtgtcgaggccattccatcatgtccctttgtctacagccttcctgaacccacactctgctgccgcccaccctcttccatcctgcctttctaactgtagcctctccaccaagcacagcatgccctgtcctgactgacattcttacggtcttccaacaaataccttcttggctgaaagctgtttcctttatagtatttgatccagaaattccacctcaagaaattttctccaccttgacaaccactggttacacaaagatttaagtatgaaaaatgtataaaatggaccccagaatgtgtctttgccacattctttataataaaaaatcaaagccacccttactgatgtgatgatgaacatgatggtccactggtgtgttggtgtggatggaccttaaggggcctgcagctgcaaaatggcacacatagaaaacagactggaaggaaacaggccgcatggccaggtgcggtggctcatgcctataatcccagcactttgggaggctgaggcaggaggattacttgaggtcaggagtttgagaccatcctggccaacatagtgaaaccccatctctactaaaaatacaaaaattatccaggcgtggtggtgggtgcctgtaatcctagctattggggaggctgaggcaggagaatcacttgaacccaggaggcagaggttgcagtgagccaagattatgccactgcacttcagcctggatgacagagcaagactctgtctaaaaaaaaaaaaacaacagctgggtgtggtggcacacacctgtagtcccagctacttgggaggctgaggcaggagaattgcttgagcccaggaggtggaggttgcagtgagccaagatcgtgccactgcaccccagcctgggcaacagagcaagactccatctcaacaaaaaaaagcccccaaaaaacaaaaaaatgaactgtgtttcttttataatcggacaaaactgattttgacaaaaagctcttttcagaatatgaaaattttggggagaagggagacatagaaaacttcaatgattatctacaaggacatagtcaaatagaaaaaaagtaatgcaggagccgctgctgaggccacaggggttccgaggacaagctgggctctcctcagatagctgtcttcccgaaaagactcgtacagcggtggttctactgtatcgcgggcactaagacaagattttgccgtcagaattgacatctctgtgagaaacccggggtgggaggtgccgccgtgagaatgcaggacagagagttcttctaaacttgctaatattcgcacaactcggaaaagcagagggctccgtgcaggcgcagccacctgcgcccatgcccagggcccttctgccctctcatctggcacaagctcccagcctgctccatccctaggcggactctgggtctcctcgccctgccctctctgtgctgactgggggctttgcttccaactgcaaaccagcctccctgggtcttttcttggccctgttccctttgcctgatggaggccaggtgtcccctgctccagaagccttccccgcctcccaccgaggcgtgcatggccagccgtgtgctcccttagctgtgggtaaggtctgtccccacgctcacctgcggggcatagccatttgggcataatgctagtgtgtagcctccccaggcccagaacagcccttccataagccgctgagcccatgaggagaccctgcacgcctgcctcgagctgcctcctcctagaagtgcttcctgctgacccttgctggccccatggcacgtgccctgaattctggtggagtctgttcagtccttcttggtccttagtcattcgtcccttctctacttgcctcccttccccaaggaggacttgaaggtcgcagcatactgtcccagggtgctgcggaagcagccttcgaccttgtgggcactgcttgccccaccacctgcgctgtgcgtaatgggcttccttctgctacccttcattgtccttccttcacccctacagcatcccgcagagctgcttaggtcctacttccgccttgggccctggcccgcgatggcctcctcctccctgacccctccttctggccaccgggcagcctgtcctggctcatgaccttgactcagtgccacaaccttgctgagcttgctgacatggtttcctcatctgcaataatggcatctccctcaaggttgttgggggttaggattttgtggagacccacatcaggggtctttcccagaatgtagcacatggcacgtgcccaaaaaacagtagtggcatttttttttctttgagacggagtctcgctctgtcgcccaagctggagtacagtggtgcgatctcggctcactgcaagctccgcctcctgggttcatgccattttcctgcctcagcctcccgaggagctgggactacaggcgcccaccaccacgcccggctaattttttgtatttttagtagagatggggtttcactgtgtttagccaggatggtctcgatctcctgacctcgtgatctgcccgcctaggcctcccaaagtgctgggattacaggcgtgagccaccgcacccggcctagtggtggctttataaggaccactttcttggcacctcttttaggctactttgcagttccagggggcttcttgtacatcaaggccttttctcttgggcaagtcagttgtcactgtgaggacacaacactgtatctttaggcatcttcctacttgtcccccaacctgaccctggccctccctagtgagtagacatttgttgagagactcggctcatctgaagagtcaaggtcatcctcttgcttgatgctgaatgagcacaacacagatgctcactgagtgttggctgttatggtccagtcattgccaaggaactcaatgggatcttcatgctagctctggcctcagtgccgccctagaaagaagtgggtccggatggggagaggccaggagagctcaagcagtgtctggaggacgttgtagggcggtatcacagcctccagacccagtgcacagaggctgggtcccccagtccttggtgtgacttggtgatccccagctggccttcagtgggatgaaggctgagcagtggggcttgcctgggaacaggggcaccaaaggtagccagggctgcagacagcagattccttgcttgagtggcttggggtgctggttgtcagcccaggtcctgccagctagggcctctgccttgacctcagaggggaggagcaagcctttgagggttcttacggaggcgtgtctctgccgcaggtgaacgggaaggagctctccaagctgtctcaggagcaaactctgcaggccctgcgctcctccaaggagcccctggtgatccaggtgctgagacgcagcccccgcctccggggggacagctcctgtcacgacctgcagctggtggacagtggcactcagaccgacatcaccttcgagcatatcatggcgctgggcaagctgcgtccgcccaccccgcccatggtcatcctggagccgtacgtcctctctgagctgtgagtcgccctcaggagggccccgggccctgcctccagagaggacaggccacctggagcggccatccgcacgccaccctctcgggcaggaagcaggcccctcggcctccagaactgaccgtggtacccaagggctccaaaacctccaggcctctagccttgggccgggctccagcaggcgccccgttgtatctacccccagggccgagggaggaccctcctgtccgggacgtcgctgccggaagtgccagggttgagggcctcagctcctcctcctccatcctctctcctctgccgcctcacaagcatcactccttgaatcttcttgcatcccttgtctgtctcattcctctacctgctctgaatttcctccatctcttcagcttctttctttggcccgaccggaagaagggcctttcatccaggcctggtggctcatgaccgcgtgagcgctgcctcattctgctaatcttagcccgggctgcggggaggtaggccacagggccatgagcagccaaccttagttttggggccaggagggcagcccctggaggtagggtgggcccccctctgctctgcagaagtcctccagggcctggataactcctgggggcgttgcatgagtggggccagtgctgggcgggcgggtgggcacccggagattggagaagttggtccctgccagctggcgtggttggaggagttctggtctgggggacgggaacgctagaggcatgcgcaggtcctctgcgtggacgctgcacactcaggtgcgagaagtgcccccggtctttgcatggctgcatgttgcccaggaaggggctctgcaggaggcaactgggccacccacccttgagagcacaagcagagcaggcctccgtgccaggcacgctgggatcggcctgcctgggagctggggctgaggtgtgagaggatggccagctggtctgacccccaccttctcctgggcagccccccaatcagccatgagtattatgacccggcggagtttatggagggcggcccgcaggaggcagaccgcttggatgagctggagtatgaggtgagccgggtggccaggccagggcccgcagccagctgcgggagccgccccgacgcctgtgtgccttcctgcccaggcccaaccccgtggccctcctggcacgcatctggctgagtcagggagggtgcgggtgaggttacgtgttccgtccatgtcggtgagtccacgtcccatgcacgtctgtcttctgtgtcctgtgcctgtgtgtgcctcgtgcatttcctgggagggagaccactgagtacgtgcgccacgtgggatggtaagagagaccctcaaagcggggcctggaaactgagctcagggggctccagaggaagctgaggggctgcgggctgaggggttgcgggctgaggggctgggctgtgctgcctgctccctcactcacgcatttctggggctttctacctctgcttcctcccggacccctcgtggcaggaggtggagctgtataaaagcagccaccgggacaagctgggcctgatggtttgctaccgcacggacgacgaggaggacctgggcatttatgtcggagaggtatgcagacgggtatgccccagccccgaggcccatccacatggcctgcctgtggctcagaggctgcccttaaggtcccagctaccagaaacagggcatcacagctagggtgctgcgtggtgaggcgatgatggtcgacggcttcagccactgtccagtgaggtagtcatctgcagaaagaggcctgtgcctgggtgggacagcagatgggcctgagaactagcaacagggttgctgtctagccttctcccgaacccatcttgggcagatgtcttgtgtatccccaggagggggatggcccctcgctcccctccctactagtagcatcccactaaagccacccttccagatggacaatgtcctacttcccaccaatgcccggggctgaccaaaagcacaggcttccgtgcagaagagcctaggagtgcagggcaggggcggggagaggtgactactccacagcctctgcctctgcttcctggggctcagagctggaaggggagccagagagccttcagcttgctttgggggcccctgaggtgagcctgcccccttctaccgaaagggcatgttaggcaccaagtccccaagatgcgtgtgtcctgcaggtaaatcccaacagcattgcagccaaagacggccggatccgtgagggagaccgcatcatccaggtgagcacttgcaggctgcaggcctggcccaaggccccgctgtgcccgtcggcccagccacctctctttagccagtccctagctctctcccactaagagctaaccctgaggcccagcagcctgccgtgtcctaaacccgggctgagtctcatctctctcctgcccactcaccccagtggctcccgtgtgcctatgggatctgctggcatccagggcccctgctgctctgaaacctcctggcccctctccctctgccccactccatgctctcctgagcacacatttgctcttgcaagagtcaggccgccctctccctggtaccttccacttagttacatcctcccagagctcaagccccagcctagcccagccgagcccagagtgcttgggctccctgcacccgcccagggtccgccccagggccagccctagcatgcttgttgattgtatcctgcctgcctcagattaacggtgtagacgtccagaaccgggaagaggcggtggccatcctgagccaggaagaga

SEQ ID NO: 4037 - DNA, 27728 bp, human
gtgcggggggcgccgaatctagatcccggcgggcctggagcgtgggagtgcgtgggcgtccccgggcgcggtccaagtccgtccgggggctgggtgcccaccccgacacccactcccgcctggccctgcccgaacgatgggctcccgggccttaggcgtctcgggtgagtgggcgccgccgggatcagcgggttgggctctctgcgggtggcagtgcctggccgggctttgcggggcgtggaccagcagggccccgcggggagggaaggagacgcggggcccggagctcggacctggagcccagccccgcggcccggaacggggcttcttgcctgtgcgtggcgtgactacgtgagtgcgttcctgtgccccgtctctgtgtgcgcggaggctcccccggccccgcatttgtgtactttctgtgtgcaccctgcagactgtctagagaaatgtcccggatgctgtgggctgagacctcctagggctaagtggagggaggtcaaggtcaaggcacccaggagcagacagggctcagacaggtatgcgtttagtggcctggattcaactcccgggtttattggtctggactgggaaggaatcaagtgctttgcaggaggggtgttggcttgggagaacgtgggggaacccgtgcagggatcggcgagaactccggggcgggggcgggggcgggggaaggaggggctgggcacgggggagaattcccaggaatccggggactgacttcacgctgtgagccgagctcctctggccacctggtgcgggagccgaggggcagggcggggacgcaaatcttgccccaccctggcggagctcctggtcctctctccccggcccttctccgggggtgcgcggggccctcggcttctcccgttcgctgtcctccgccttcttccctctcagttcccggctgccactcctcgtctcttgttcccgctgtttggaaaccttgtgtggccattgccagccccctagcgggataggaatgcgaccgagagggcgtcctgtggaatccgtgttggattccagggctgggatggttggttgacggggactctggatcccatcctcctgcttccttttcgggagtcattccatcaaacggcaagcgatttctccaagcgattcctccggggccgttttgactttcctggagaaggattggtgtcgcacttcatttaaggccaacctcgtggggacgtgtggataggggagagcgacccgagctgcaccccaggcctgaaatgagccatgggacgacaccggtagcccttggggctccccacagccctccgggaaggcctcggcaggtcgggctgggcctgccttcagggaggtgaacttgggtgggccctccctgctctgcgccctaagctctccttcatggaagggacttgcccaccccaaggagacccgccaggaggagggccactgccgcatgcgccctctgtgcgctttcctgctgggctccctttgaaaccgtgggagtttggctgcaaactttcactttctacattcctccttggcccaatcaaagccgggattttacgaggagaaccatccttcacaactaagggaaaacaagaggactgaaaaaagtagatacggaaagcagtgcaagccatgagctgtcccaggggactgcgcttctgggggtggacgcatcaccaggtcccagcctcttcagaggagaaggagcttttgttccaaaagacaggtcagcttctgggaccccgtgcctgcctcccggcctccttaaacacgggtgctcccccatctttagggggcacttctccctgtcccccctgagtaacctcgtccgcaccttgtcagggtgaggcacttcatgggcctgattttcagaaagaagcacatgtgcatctgcagcgccttccatctacaatccacagaggcctgggatccccaggccaggaacccccaagtctctagcctagccttgtgttccaagccattttctgccaatgactcacaacacttccaaaattacagctgtattgagctatcattctcctactgcacaacttaccctttcaaagtgtacaagtcagtggtttttagtatactcacaaggttgtgcagcccacaccagtaattccagaacgttttcatcaccccaaaagaaaccctgcactccttagcaatcacatccccatttctccctcaaacttcctagcccctggcacccaccaatctacttcctgtctctatggatttgtttattctaaacatttcatagaaactgaccttttgtgtctggctttcattaatcataatgttttcaaggttcatccatgtatcaatagtcaatttctttttattgccaaataatatttcattttgtgatatacaacatatttatccattcgtcagttgatgagcatttggggtgcttccacccttgggctgttgtgaatagcgctgctgtgaacactggtctacttgtatctgtttgagtccttgcttttaattctttggagtgtgtgcctgtagccattgaactgttttccacagtggctggaaccagtttacattcccaccagcaacatataagggttccaatttctctatatctttgccaacagttgttattttctgggtttttgttatggccgtcctgctgggtgtgaagtggtatctcattgtgattttgatttgcacttcctgttagctaaatgatgagcaccttttcttgtgcttgttggccatttgtggatcttctttagaaaaatgtctgttcttaagccagcgccacactgctttcattactgcagctttgtagtaagttttgaagtaaggaaatgagagtcctccaactttgtacgtctttttcaagactgttttgtctattctaagtccctcaagtttccatattaatttcaggatcaggttgttaatttctggaaagaagccagttggcattttgatagagattgcatcaaatttgtggatcaatttgggtagtattgttcatgagcatggggtgcgttttccatttatttaggtctttaatttctttacatgatgttttgcacttttgtttaagtttattcatgagtattttctttatgatgctatcataaatggaatcgttttcttaattttactttcagccttctcattgctactgtatagaaatacaattgattggctgagcgtgttggctcacacctgtaatcccagcactttgggaggccaaggcgggtggctcacctgtgcttaggagttcaagaccagcctggccaacatagtggaaccccgtctctactaaaaatacaaaaaaaattaacggggcatggtgatgtgtgcctgtaatcccagctactcaggagactgaggcaagagaatcgcatgaaccccagaggcagaggttgcagtgagctgagattgcaccgctgcactccagcctgggtgacagggcaggactctgtctcaaaaaaaaaattgatttttatacattgatcctatatcttgcgaccttactaaaattgtttattaagtataatttgtttagtagattcctcaggattatctacatattaggatcatgtcattggcaaatagaaatcgtttttcttcttcctttccaatctggatggctttgatttcttttcttttctttctttctttttttttttttttttgagacacagtctcactttgtcacccagactggagtgcagtggtgcaatctcggctcactgcagcctccgcctcccgggttcaagtgattctcctgcctcagcttcccatgtagctaggattacaggcacacactaccacacccagctaatttttgtatttttagcagagacgagcttttgccatgttggccaggctagtcttgaactcctggcctcaagcaatcctgcccgcctcggcctcccaaagtgctgggattaccggtgtaaaccaccgttcctggcccttcgatttctttttcttgttaatttgctctggctggagtctctagtacaatgttgaatagaagtgcctgtgaatgtctttcccttgttcctcatcttaaaggtaaagaagcttccagtctttcactagggggtataaagttagctgtggctttttcatagctgtcctttatcagggtaaggaagttcccattctattcctagtgtgtttttatcatgagaggcattggattgtgcagtgctgcttctgtggctagtgagatgaccacatggttcctttattccacggatgtgggttgtcacaggcactttcgtgtgtcatgtcggaacctcagccccattcctatattccaatcatgtcctcctagtttggaaaatctgggacctcccctgaaaatggaggattactgcgtgttgagttaggaaaaggaagcaggctggttgcccagaatggaaggcaggaaacagcatgtccccagctccggagccttttctgcagcccatgtccctccactgccaccaggcccccttgtcatatatctcatcgtggtccacactctgctgaacttgtcttggccttggcaccccctctctgacaccatgatgtgcttgctagcatccgagcacgccggagatggtcaggggataaacccctggtacttaggactggtctcccgcccatcctactcaggctttacagggggagtgggtcaggaccgcctgtcatctcccctctgtccacatcgagggaggccaaaggacagctggccagcccttctggtgatctcccaggcattcttgcctaaagcacctgcatgtgagcccccatggtgctggcagccatcctgggtgcgtggcattcagcagggagacactgcagacagggccttgcccctcccccagactccccttttgttgttgttgttgttgttgtttgagacagagtttcgctcttgttgcccaggctggagtgcaatggtacgatctgggctcaccaaaacctccgcctccagggttcaagcgattctcctgcctcagcctcccgagtagctgggattacaggcatgcgccaccatgcctggctaattttgtatttttagtagagatggggtttctccatgttggtcaggctggtcttgaactcccgacctcaggtgatccacccacaccggcctcccaaagtgctgggattacaggagtgagccaccacgcctggccccaggctcccctttttgtaagggggagaccatcgccaacatgtaggcaactgcgggggagagaaagtactgcttgagtgcgggagcgtggctggcagccagtgtcccctcttcagcgacgtcttcctccaaactgctctcccacccaccaagccaggtggcttctctggctccctcctgcttgcatgggggcttcctgtgagcagggatttgggtctggcatgggcactctgcctccccgcctcaccagcaccagatgctgccagcacatccacgctggcctccacccttccaggggaaagctggactctcagtcaactcagtggttctgccgcagaagctgactggggaagaagcaggctctgagaaagtccttgtggagtggaagaacagagggctggacactgaattctgactgccatcttctggaccaggtcatcctgttttgtgtcattgtcccaagattgtagaatgccctttcccctctcatctcggggttcctgaggactgtccagtctgctgaaatgaaattcgatagtgccagagagcagattcgtggttgcagggatgggcagaggggcatgaggacacttttggggaagatagaaatggccactgtcctgacggtggtgatggttccccaggttcatgtatgacatatgaacacctgccctttgcacactgaagatgtgcaggttaccacccagcaacagacctcaccaaagctttagaacaggaactccatggccacatgcacgcatcctggggagaaaggtgtcctttccttccttctacttcaggggccctgccagagaaggcagtgcagtgtggagataggaatggaggcagccaccaactgacagctgtgtggccaggggcaagtcgctgcatggcccactggctcagtgactcagtttcctcaactgtgaaatggcagtgaagagtgcttgcgtccgagggccattgtgacaaggaaaacagatggtgtgtcccccgggatctcactgggtggaggagggagttgctgccctcgggccattcagttggtcattaagaagtggaaattggctgggtgcggtggctcacgcctgtaatcccagcactttgggaggccgaggcgggtggatcatgaggtcaggagttcgagaccagcctggccagcatggtgaaaccccatctatactaaaaatacaaaaaattgaccaggcgtggtggctcacgcctgtaatcccagcactttgggaggctgaggtgggcggatcacctcaggtcaggagttcgagaccagcctgaccaacatagagaaaccccatctctactaaaaatacaaaattagccgggcatggtgacacatgcctgtaatcccaggtacgcgggaggctgaggcaggagaattgcttgaacccgggaggtggaggttgtggtgagctgagatcacgccattgcactccagcttgggctcgaaactccatctcaaaaaaaaatatatatatatatattagctgggcatcatgcacctgtagtcccagctactcgggaggctgaggcaggagaactgcttgaactcagcaggtggaggttgcatgagccaagatcaagccactgcactccagcctaggtgacagaacgagaccctgtctcaaataaataaattaattaaataaaaaataatgaaaaaggaaattatatggagaaggccttacatctgggtatgtcacagttaatgcccagtgacagaagaatgtccaatattattctgagaatttctctcaggaaagggacctccaagttttgaagaagtgtgatgtagtacaatattagttaggacagcctgggcaacatattgagaccttgtctctacaaaaataaaaaattgctcaggcgtagtggcatgcgcctctagtcccagcttctggggaggctgagtgggaggattgcttgaacccaggagttggaggcttctgtgagccgtgattgtaccactgcactctagcctgggcaatggagccagactgtgtctggaaaaaaaagaaagaaagacagagagaaagagagagagagagagggagggagggagagagagagagagagagaaagaaaaaacagatggacagggaacaaagcggaggcatatgtggtcattttgcacaggagttgggccggaggaggcgaggctgagcagcctggggctggacaagatgtcctccctttcagtgcattctgcctgtcctcatggctgcttggagcattgagaatgaaaaacgctgcagagggaatattgctttgattgtaaaacgctgcagagggaatattgctttgattgttgctagatgtgaactgtgcccttagccagtcaggttagcctgaggtgggtgggaggatgggtttagttgctgggccacgtgcctggaaagctgtgaatatgtacccgaaggttgatcttgagaatggcttcaggaagtggttggcttttcctgtgcaaggtgtgggacacccctcttttcctgtgtgttttttttttttttttttttgagacagagtcttgctctgtcacccaggctagagtgcagtgttgtgatctcggctcattgcagcctccgcctcctgggttcaagcaattctgcctcagcctcccgagtagctgggattacaggcacctgccaccacgcctggctaatttttgtatttttagtaaagacagggtttcatcatgttggccagtctggtctcaaactcctgacctctagtgatccgcctgcctcggcctcccaaaatgctgggattacaggcgtgagccaccgcgcccggcctcctttctgcttctgagccaggactatggaggtgtctgagaggccgccgctctcccggaaaggtgggggccaggtggattgatgagacttcagcagaccctgggcttcggggagggaaggagaagtgaggggaaagaaagatgccctcatgcagaaggccttcgttgaggtctgccctggttcctccagggcgcgctctgagtcagtacagcgccaccctccacccgaagtccttgttaaggtgcactttctgactgagccactagcatggggcctgggattctgcacttctcacaagctcccaggtgatgtggatcccactggctgtgagtagccagggccttgggtagggaccgggagtagatctatggtagccccaaaccacattaacatgggtggtgaagtgaggtgttgttttttttgtttgtttgttttgttttttttttttacaaatagagggtaaaaattgtttacaaatagagggtaaaaaaacacacatagagggtaaatcagaacatccaggagtcgttgcctacgtgagggctttacaggacataacttgttcttccctgccatgtgcagctaactgacccccttccctgtcaccggcacccctaccggtatacatgtctctcatggacgcccagacacccctcccccgactaagtgctcaaaggcctttgagatgaagccctcccatgtttctgtctctcctgcccccaggcagaaagggtgggcacagagttatggaagcgggtggtgtggcttgcccaggaggccacagttgggggcgtgggcagccatgctacttgccgggcctgtcacctctttgtccctgctagaattctaacatgttggtggagacattttgcagccaccaatgcagtaattaattcaggcaaaaatcatcactggatgccaaaaccattagatgtaaggtcgttggggacagaatattcacaaagtctccaaatattaccccaaattacctgtgaatcaggaagggaaactgcgtctttacagaggagagatctggcagctgccacctggaccatgtgatcaaacagcctccccaacagtggggcagcctgaccctgccagccgccagatgcagggctggggaggagacatacagcatctcctgcaaggtgctcttgtcaaaacgctcagcctgaatctcaccgcgggaatgaatcaggcaaattcagactctggcgcattctataaggactggtctcttccaagaagtcattcccattaaagtaaaaaatatatatatttttttctagattagagaggagacataataactagagacctaacaaccgaatgtaatatgtgtgcttcttgattgaatcctagattttttgtttgtttgttttgtttttgagatggagtctctctgtgtcacccaggctggagtgtgatggtgtgatctcagctcacttcaacctctgcttcctgggttcaatcaattctcctgcctcagcctcccaagtagctgggaccataggctgcaccaccacgcctcgctttttttttttttttttttttttttgagatggagtcttgctctgtcgcccaggctggagtgcagtggcacgatctcggctcactgcaacctcctccgccacccgggttcaagtgattctcctgcctcagcctccctagtagctggaactacaggtgcaagccaccacgcccggctaatttttgtatttttagtagagacggggtttcaccatattggccatgctggtctcgaactcctgaccttgtgatctgcccgcctcagcctcccaaagtgctgggattacaggcatgagccattgtgcccagcctcaaatcctagatttttaaaaaaagctataagggtgttagcgggacagctggggagatgtgaggctggcccattgtatgagtgcggaattccgtgctaagggtgttgtggttccacggagaatgggactgatggcatcttgctttcaaatgcttctgcacatgtgtgtgtagaaaccccgagagcaggtgtggggaatctgcagatgttcccacatgcttgtgggcggacaattttcaaaatcccgagctggggaaacatgaatggggactttgctgggtcactgagtgggtgaatgtagtgagcctgcggcttctcctttctcctctgatgctctactcgttgggagatcccccgatgcctgacttggcctggaagctacagtcacaactgcttccaaggtgtcctggatactccagacggcagagctgagagccagcaggcaggtcagagctcggccccgggcagaggataacttcctgtctctgtccttccccagcttgtttcctactctacagcagtggggtaaggggagtccgaaggtggcagcccccccacctccgtggcagccacgggggcccctggaagtgatgtggcttcacctcccatcccgcgcgttgccagtgagagtgaaaggggtcgcaggcgccgtgtgacaagcacttgggattgcgagtctcccaggccacaactgttttcttagcctctccggcctctcttctcggcttcccagagattcctgatcagcaagagggcgtcgcgccccacccggctgtgcgcctgccaccgctgggtgcaggagggtgcctggggcagagcctggaaacagagctcagcctccgacggggttggcggggcgggcgggcaggagtcctgccaatacagccaccagcgtggcggcgccgggacgagtgtggtccgccctgctcccgcagccgcagccaccccgccgccgtcgcggcgcgctctttgtctgcggctccgggctcagggggcggggcgagcgcgcctggggctccgccctctccgcctagggcgccccgcttcccgcgtcccctaaggcccgccagtcccttgcccagcgggagatcgccgccccacagcgactgcccgtggggccgacttcgcgtcatgcctgcctcgcctgcccggtgttgccccctcccctgtccctgtgtcccccctcccttgcccgcatgtccccctcatgcggggaaagcggtgccagcactttccctggccttgcgaattgctcttccatcggtattcagccgcccctctgatgttcctgaaaacccaacctgctccttctctgcaaaaagctccggaaggctgtgtcgatgcaggtcgagcttccccacccggccccctcccaccttttagcaaatccagaggccccaccttcgccctcccctcccgggctccgacccagtgcattgagcagctcctcggcttccctcccgggactttctagtctctctccccaaccggctcagtgtcagggtgccccaggactctccttgggcctctcctgttcttgactacattcactccctaggtgagctcctccatctcatgcttttgctttttaaatttttatttatttatttttaaatttttattatttttgagacagggtctcagtccgttgctcaggctggagtggagtggcacaatcacggctcactgcagccttgacctcccaatgctcaggtgatcctcttgcctcagccctaccgcctgccccctacctcctccaccacttggggctacaggagcgagacaccacgcccagcttcatctcatgattctttttttgtttgagacggagtcttgctctgttgcccaggctggagtacagtggtgtgatctgggctcactgcaacctccacctcctgggttccagtggttctcctgcctcagcctcccaagtagttgggattacaggtgcctgccaccacgccctgctaatttttgtatttttcgtagagatagggtttcgccatgttggccaagctggtctcgaactcctgacctcaagtgatccgtctgtctcggcctcccaaagtgctgggactacaggcttgagccaccgtgcctggccgtcatcttatgattttaaataaagaaaaattcctagtttaattgaacagcaatggtcacatgccacccagttagctgacttgggcttgggccagacatttggagtggggcactggagatgtccacatgcctcgggaagttcaagctagagataaaaaccttccatttcctgccctgggcctaatccctgagtccttccttcctcggtcttcctcactgctgtgaggatacccctggtccttgtggtcctgtgtggcaattttatgttttcttgtggtaagatacgcataacataacatttaccactagtgacttttagtctattctcaatgttgtgcagccgtggccactgtctagttccagaacaggttcatcgccccaaaagggacctcatatccctcagcagtgactccccaggccccccttcctccaggtcctggcaaccattcgtctgctttctgtctgcctctttgccttggctagactgtgctcatgcagtcgtgtgtgccggtcgttcattctttttatgtcgggatgggtgtaccatgttgtgctcgctcatccattcatccactggtggacacgggttgcctccgagtcttggttactatggatactctgctgtgagcatttgagtataagttttctttgcatgcctgttctcaactatggatactctgctgtgagcatttgagtgtaagttttctttgcacgcctgttctcagttctttggggattgctgggtcatgtacataagctacacctaaccttgtgaggagccaccagactgcttccctggctgcactattttacatgcccagcagcaaggcgtgaggctccagggtccccgcgtcctctccaatactcgtgcttcctttcactgattccagcctcctcgtggtgtgcggcggtatctcactgtggtttgggtgtgtgtttcctctgtgcgtactggccggtgctgacgcgtcttttcctgcgcttattcgatgtcttcttcaagccctcactgtcccttgcccccagcccaacagcaggtcctggcagcctacctctaaaacccaagctgactctgaccacatcccaccacctctactgccacccctggggtcatgccaccatcatctgtggtctggaccactgccgttgcctgctggtctggcccttacagtctgttctcctgggagctcccttcgctacaaggaaggaagcatggctggtttcttgtcatcatttaggtctcagctcaagtgtcaccgacccagagaggctgtcctgaccactctacccacccaggcagctttgtctctgtcccctcccaccttccaaccaagccccttggggagcggaacgggatggggggtgtgttctggatccaccgtctctcccttcagctccttggcactcctttcctatggggcaccctgtccagggcaggtggggcaggattcccccctcttccctcatctcccgtgcttcccgggcccaccccccagcatctccagcctgcccgggagtcacatgtcctcggcccacagaatccccagcacacgccccacccacaggcctagccccagccctggggtccctggcaccccacctgccagggcccctcccctgccttgctcaccccccaacacacctgattgttggaaaggtcttcccatgcccaccacgaccccctcccactcatctgtgggcgggagagcttggtccctgccgcacgttgcccccctagcatccaggcccaccaccgagcccccgacaggcctgggagccccactggtgggtggggacccaccagctgggggtcttgctcacaccgaggggctgggggtggcggtggctttctcagggcaccctgccttgggctgcaggccgctgggtgggcaccggctccctcggaaggcagcgcaacccgggatcctgccggccctggcccccaccctgccgaccgggcctggggcgatcagtgccccagctcctgtcctcttctgctcagatgctgggttgggagatcaggggccacagctcggccactcagagccctttccgcaagtcttagagggaccagctgcggggtgtgtgcagaggggctgcgctgtggggagggcgcatggctcagtcctcctggcctgaggcccgcctagcctaagtggcctccaggacccatggccaggcccttctgcagccttccagaaagaaccagcttcccagggttccctggggaaggcctggggccacctcctctggaggggtggggcctgtgcttcattcctccttccccaggtccccttccaggccgccaggtcccctccccgacctggagcccacagccttgtaattaaattgtaaacgtccttgtaattaaattcatgtaatatccattattattattactgttttagactaaattacttagagcacattgactggatcaaaggctaccatgaacgttttcaagggtttttatagttattgacaaattcttctccagaaatttgaccactttacactctggggtaagattcagactaagtgtgtctagaaagggtgatggggtcggctgggaggaggaactgggcttgcaggggacctggggcagtgagtgctctcagtgtgcaaaggggaactgggctgtcccaagcaggatgtgagggccacttgggccacattcaggcagaggggccctgctaaggcttgagtcccctgttcagagcagggaccatggtggaaattaaggacgttcatgtcaactgtggttgagattggagctgcagtcctagagtcagccctcttgggcccatcttggcagcaaatcaggaaggaagtagatctgtgtgctgaagagtcgccatggggcacgtcaagcccctggctgagccgtggtgtgctcacaggctgctgcactccccggggcagcggagtgccagggacttgtattttcatctttgtgctcctccgcctcctcagtgtggcgctctgagcacttcgattatttgaaaggaaatgcgaaaatttgtacaaaatctattgtgctagcacgtgatggaggaggggtctttgtgaacaggctttgagggtttgcttggctcacagctcactacccagtcaacagggttgactgccacggggtgacctcgctaaggtgaagcatgatgcccagcacgtggtcaggatggcacgggagcactggagaagatgagagtcgctgggaacctgggcgaggggggacaaggggcatttgagtgggcttcaggtacgtgaagtgttgcaagataaagtgggtttcttctggattgttccaaaggagggaggttgctctcaatgaaggaaacattcaatagtgagagttttccgataatgagctcagtcaacaatccccactctccccatactagagaagcaaagtggatttcttctggattgttccaaaggagagaagtttgcacttgatgaaggagacttttttttggggggggggtggggggtggatggagtctgactctgttgcccaggctggagtgcagtggtgcaatctcagctcactgcagcctccacctcccaggttcaagtgattctcctgcctcagcctctcaagtagctgagattacaggcgtgcaccaccatgcccggctaagttttgtatttttagttgagacggggtttcactgtgttggccaggctggtctcgaactcctgacctcaggtgatctgcctgccttggcctcccaaagtgctgggattacaggcgtgagcctccgtgctgggcaatttttgtatttttagtagagtccgggtacatcagactcaggggctgggtcatgcctgtaatctcaacacttttggggggactaagcagatggcttgagcccaggagttcgagactagcctgggcaacatggtgaaaccccatctcttattattattattttttaaaaggtagatcagataaattacaggtccttaatatatattcaacaaattacagaaatatataaaattttaattcagccaagaaacatattaaagttttatcttcagcaaactgttaggagttgggatggaagtagaactcagggtgaagccctcttggggtttgttgtctaatgaaagggaggtaattagacaatcacacataaaaggctgagctccagcctgggtatcttgaggcctcctggacttgctgtagcatctggagaagtatggggcatcatctcgcatcacttagcaccagcactgccacccagccttgatgtgggtcctgttggcctgagcgtttttccttgaagaaggtattaaaagcagattgaagccgcctgtgcccacccatcccctacgcacttcatctgctcgcctctctgccgtgttttccaccaagtacatactacgaatgagcctccattatgtgcgcctccattaactgcacatgcggaataccaggaattgtttgttcgactgctggcagacctttgggctgtccctggtgtttggccactgtggccttcatgcccacatcctcctggtcctcctggtggtggttctgaagggcatctcctctcatctcatggctccaagtgcttgctagtgggtcccctttgccctgagcacctgttgatatcctttgcccatgttcttcttgagttgtttgtgtctgtgttttcttgttgttttgtaggaattctttgcatattctggaaaacccattatgaggtccatgcattgtaaggctctcctctgagcccgcctttttactgtgtttagggtgtcttttgtcgtctagaagttttacatctcttccattattgcttccccatttgaaatattgagaatttcgtctctatcccacaccataaagatattgttctcttgttttgctttgtccctgtaggtctttgatccaattggaattgcttggccagggcttggactaggtcttctgtcttggtggggcgagctcccagggtgtggaaacgtttgcaggtggggcaggagggagagtctggtgggaagcaagcctggggttggccatgttgagtgtttgtgccttttagagactggagtggtcgagtaggcaatccgagggttggggcattacaggggtggctttaccagtgtgctacctcaggatggttgggggtggggcggggaggcaaggctctgagcaggactggaagagctgctgtcatcagaagggccacagtgtggctccttaccatgtgcctggccctatacctctttgctcatggccccatattttcccaccttgttggtagcccttagcccttccccagaggggagctcatttcttccttgggggtccagcatgaccgatgaggaggagagagagagagagcgagaaggcttcaggagcccgtggcttccacccaaatacctgcctggctgtcacaggcgatcactctggttgctgctgatccgaggtgctgaggctgtgcccacgcccatccccctcttgacatcccagcctccgccagcccgcccagcaagcgctcctcagtttccatagcaacactgctgctcggtaatgattccgggtagaaaggcattcgtgcgttctctgtcatctctgtcacctgagcatcccactgcctgcttgctgtcctgccccgggagttcaggaagaaaccctgaggacagctccgagcccttctgcttgtgtgttggcttctcctcaagggcagtggtaaggtggtaaatgttcccagacaaaaagccctgatttggagcatttgccgatttccctggtgtaaatgctgccactatagccgatttcaagccaccactgcgatgtcactgaacttggagttgggggaatgcacacatagtatttccatctcccataccagatgtgaataaccccaaaagcacagatgacagaaaagtgtagtaagataattagacagtgatgtgttccgaggatttattgcctttgttgttaatatcattcagttacctgtacatttctacggttaaaataccaataatcgctgtgtttgacaactggcttccaaatttcccagcttcagttggctctagccactgctgctgagagtgtcgaggccattccatcatgtccctttgtctacagccttcctgaacccacactctgctgccgcccaccctcttccatcctgcctttctaactgtagcctctccaccaagcacagcatgccctgtcctgactgacattcttacggtcttccaacaaataccttcttggctgaaagctgtttcctttatagtatttgatccagaaattccacctcaagaaattttctccaccttgacaaccactggttacacaaagatttaagtatgaaaaatgtataaaatggaccccagaatgtgtctttgccacattctttataataaaaaatcaaagccacccttactgatgtgatgatgaacatgatggtccactggtgtgttggtgtggatggaccttaaggggcctgcagctgcaaaatggcacacatagaaaacagactggaaggaaacaggccgcatggccaggtgcggtggctcatgcctataatcccagcactttgggaggctgaggcaggaggattacttgaggtcaggagtttgagaccatcctggccaacatagtgaaaccccatctctactaaaaatacaaaaattatccaggcgtggtggtgggtgcctgtaatcctagctattggggaggctgaggcaggagaatcacttgaacccaggaggcagaggttgcagtgagccaagattatgccactgcacttcagcctggatgacagagcaagactctgtctaaaaaaaaaaaaacaacagctgggtgtggtggcacacacctgtagtcccagctacttgggaggctgaggcaggagaattgcttgagcccaggaggtggaggttgcagtgagccaagatcgtgccactgcaccccagcctgggcaacagagcaagactccatctcaacaaaaaaaagcccccaaaaaacaaaaaaatgaactgtgtttcttttataatcggacaaaactgattttgacaaaaagctcttttcagaatatgaaaattttggggagaagggagacatagaaaacttcaatgattatctacaaggacatagtcaaatagaaaaaaagtaatgcaggagccgctgctgaggccacaggggttccgaggacaagctgggctctcctcagatagctgtcttcccgaaaagactcgtacagcggtggttctactgtatcgcgggcactaagacaagattttgccgtcagaattgacatctctgtgagaaacccggggtgggaggtgccgccgtgagaatgcaggacagagagttcttctaaacttgctaatattcgcacaactcggaaaagcagagggctccgtgcaggcgcagccacctgcgcccatgcccagggcccttctgccctctcatctggcacaagctcccagcctgctccatccctaggcggactctgggtctcctcgccctgccctctctgtgctgactgggggctttgcttccaactgcaaaccagcctccctgggtcttttcttggccctgttccctttgcctgatggaggccaggtgtcccctgctccagaagccttccccgcctcccaccgaggcgtgcatggccagccgtgtgctcccttagctgtgggtaaggtctgtccccacgctcacctgcggggcatagccatttgggcataatgctagtgtgtagcctccccaggcccagaacagcccttccataagccgctgagcccatgaggagaccctgcacgcctgcctcgagctgcctcctcctagaagtgcttcctgctgacccttgctggccccatggcacgtgccctgaattctggtggagtctgttcagtccttcttggtccttagtcattcgtcccttctctacttgcctcccttccccaaggaggacttgaaggtcgcagcatactgtcccagggtgctgcggaagcagccttcgaccttgtgggcactgcttgccccaccacctgcgctgtgcgtaatgggcttccttctgctacccttcattgtccttccttcacccctacagcatcccgcagagctgcttaggtcctacttccgccttgggccctggcccgcgatggcctcctcctccctgacccctccttctggccaccgggcagcctgtcctggctcatgaccttgactcagtgccacaaccttgctgagcttgctgacatggtttcctcatctgcaataatggcatctccctcaaggttgttgggggttaggattttgtggagacccacatcaggggtctttcccagaatgtagcacatggcacgtgcccaaaaaacagtagtggcatttttttttctttgagacggagtctcgctctgtcgcccaagctggagtacagtggtgcgatctcggctcactgcaagctccgcctcctgggttcatgccattttcctgcctcagcctcccgaggagctgggactacaggcgcccaccaccacgcccggctaattttttgtatttttagtagagatggggtttcactgtgtttagccaggatggtctcgatctcctgacctcgtgatctgcccgcctaggcctcccaaagtgctgggattacaggcgtgagccaccgcacccggcctagtggtggctttataaggaccactttcttggcacctcttttaggctactttgcagttccagggggcttcttgtacatcaaggccttttctcttgggcaagtcagttgtcactgtgaggacacaacactgtatctttaggcatcttcctacttgtcccccaacctgaccctggccctccctagtgagtagacatttgttgagagactcggctcatctgaagagtcaaggtcatcctcttgcttgatgctgaatgagcacaacacagatgctcactgagtgttggctgttatggtccagtcattgccaaggaactcaatgggatcttcatgctagctctggcctcagtgccgccctagaaagaagtgggtccggatggggagaggccaggagagctcaagcagtgtctggaggacgttgtagggcggtatcacagcctccagacccagtgcacagaggctgggtcccccagtccttggtgtgacttggtgatccccagctggccttcagtgggatgaaggctgagcagtggggcttgcctgggaacaggggcaccaaaggtagccagggctgcagacagcagattccttgcttgagtggcttggggtgctggttgtcagcccaggtcctgccagctagggcctctgccttgacctcagaggggaggagcaagcctttgagggttcttacggaggcgtgtctctgccgcaggtgaacgggaaggagctctccaagctgtctcaggagcaaactctgcaggccctgcgctcctccaaggagcccctggtgatccaggtgctgagacgcagcccccgcctccggggggacagctcctgtcacgacctgcagctggtggacagtggcactcagaccgacatcaccttcgagcatatcatggcgctgggcaagctgcgtccgcccaccccgcccatggtcatcctggagccgtacgtcctctctgagctgtgagtcgccctcaggagggccccgggccctgcctccagagaggacaggccacctggagcggccatccgcacgccaccctctcgggcaggaagcaggcccctcggcctccagaactgaccgtggtacccaagggctccaaaacctccaggcctctagccttgggccgggctccagcaggcgccccgttgtatctacccccagggccgagggaggaccctcctgtccgggacgtcgctgccggaagtgccagggttgagggcctcagctcctcctcctccatcctctctcctctgccgcctcacaagcatcactccttgaatcttcttgcatcccttgtctgtctcattcctctacctgctctgaatttcctccatctcttcagcttctttctttggcccgaccggaagaagggcctttcatccaggcctggtggctcatgaccgcgtgagcgctgcctcattctgctaatcttagcccgggctgcggggaggtaggccacagggccatgagcagccaaccttagttttggggccaggagggcagcccctggaggtagggtgggcccccctctgctctgcagaagtcctccagggcctggataactcctgggggcgttgcatgagtggggccagtgctgggcgggcgggtgggcacccggagattggagaagttggtccctgccagctggcgtggttggaggagttctggtctgggggacgggaacgctagaggcatgcgcaggtcctctgcgtggacgctgcacactcaggtgcgagaagtgcccccggtctttgcatggctgcatgttgcccaggaaggggctctgcaggaggcaactgggccacccacccttgagagcacaagcagagcaggcctccgtgccaggcacgctgggatcggcctgcctgggagctggggctgaggtgtgagaggatggccagctggtctgacccccaccttctcctgggcagccccccaatcagccatgagtattatgacccggcggagtttatggagggcggcccgcaggaggcagaccgcttggatgagctggagtatgaggtgagccgggtggccaggccagggcccgcagccagctgcgggagccgccccgacgcctgtgtgccttcctgcccaggcccaaccccgtggccctcctggcacgcatctggctgagtcagggagggtgcgggtgaggttacgtgttccgtccatgtcggtgagtccacgtcccatgcacgtctgtcttctgtgtcctgtgcctgtgtgtgcctcgtgcatttcctgggagggagaccactgagtacgtgcgccacgtgggatggtaagagagaccctcaaagcggggcctggaaactgagctcagggggctccagaggaagctgaggggctgcgggctgaggggttgcgggctgaggggctgggctgtgctgcctgctccctcactcacgcatttctggggctttctacctctgcttcctcccggacccctcgtggcaggaggtggagctgtataaaagcagccaccgggacaagctgggcctgatggtttgctaccgcacggacgacgaggaggacctgggcatttatgtcggagaggtatgcagacgggtatgccccagccccgaggcccatccacatggcctgcctgtggctcagaggctgcccttaaggtcccagctaccagaaacagggcatcacagctagggtgctgcgtggtgaggcgatgatggtcgacggcttcagccactgtccagtgaggtagtcatctgcagaaagaggcctgtgcctgggtgggacagcagatgggcctgagaactagcaacagggttgctgtctagccttctcccgaacccatcttgggcagatgtcttgtgtatccccaggagggggatggcccctcgctcccctccctactagtagcatcccactaaagccacccttccagatggacaatgtcctacttcccaccaatgcccggggctgaccaaaagcacaggcttccgtgcagaagagcctaggagtgcagggcaggggcggggagaggtgactactccacagcctctgcctctgcttcctggggctcagagctggaaggggagccagagagccttcagcttgctttgggggcccctgaggtgagcctgcccccttctaccgaaagggcatgttaggcaccaagtccccaagatgcgtgtgtcctgcaggtaaatcccaacagcattgcagccaaagacggccggatccgtgagggagaccgcatcatccaggtgagcacttgcaggctgcaggcctggcccaaggccccgctgtgcccgtcggcccagccacctctctttagccagtccctagctctctcccactaagagctaaccctgaggcccagcagcctgccgtgtcctaaacccgggctgagtctcatctctctcctgcccactcaccccagtggctcccgtgtgcctatgggatctgctggcatccagggcccctgctgctctgaaacctcctggcccctctccctctgccccactccatgctctcctgagcacacatttgctcttgcaagagtcaggccgccctctccctggtaccttccacttagttacatcctcccagagctcaagccccagcctagcccagccgagcccagagtgcttgggctccctgcacccgcccagggtccgccccagggccagccctagcatgcttgttgattgtatcctgcctgcctcagattaacggtgtagacgtccagaaccgggaagaggcggtggccatcctgagccaggaagagaacaccaacatctccctgctggtggcccgacctgagagtcaggtgtgtatgcctggcagggcgacccggggccacgacatcaggctttctgtcttggaagctgctggccgtgactagggcacagatgtgccaacgacctggagttgatggagggcgggtgggcaggggtctctcagggcccgtttcccctcctggcctctgaaggctgagggggctgggacgctgcccccaggttgctgagcttcaccgaaacaagccaagtgcggggtccagagcagacaagaagggtatatggggaggtccttgaagctgtggggacaccagggcctgtctccacagctggcgaaaaggtggaaggacagcgaccgggatgacttcctggatgactttggctctgagaatgagggggagctgcgtgctcgtaaactgaaatcaccccctgcccagcaggtgaggaaggaaaagggcgctggtggggagggcgaggaggagagaactgggtggaaggcgctgaggctgtgcagggtctcccaatgcttggcagggaaatgaaccaggcctgaagccccttccgatcctcctgtgacatcccgtgacatccctgtccgtgggacctaactgagcggtacttacctttctgctctagcccggaaacgaagaggagaagggggctcccgatgccggcccaggcctgagcaacagccaggagctggacagcggggtgggccggactgacgagagcacccggaacgaagagagctctgagcacgacctgctgggggacgaacccccgagctccaccaacaccccgggaagcctgcgcaagtttggcctgcaaggggacgccctgcagagccgggacttccatttcagcatggactctctgctggccgagggggcggggctgggagggggcgacgtcccgggcctcacggatgaggagtatgagcgctaccgtgagctcctggagatcaagtgccacctggagaacggcaaccagctgggcctcctctttccccgggcctccggaggcaacagcgccctggacgtcaaccgcaacgagagcctgggccacgagatggccatgctggaggaggagctaaggcacctggaattcaagtgccgcaacatactgcgggcgcagaagatgcagcagctgcgtgagcgctgcatgaaggcctggctgctggaggaggagagcctctacgacctggcggccagcgagcccaagaagcacgagctgtccgacatctccgagctgcccgagaagtcggacaaggacagcaccagcgcctacaacactggggagagctgccgcagcaccccgctgcttgtggagcccctgcccgagagccccctgcggcgggccatggccggcaactccaacttgaaccggacccctcccggccccgctgttgccacccccgccaaggcagctcctccaccggggagccccgccaagttccggtccctctcccgggatcctgaggccggccggaggcagcacgcggaggagcgcggccgccgcaaccccaagacggggttgaccctggagcgtgtgggccctgaaagcagcccttacctctcgcggcgccaccgcggccagggccaggagggcgagcactaccacagctgcgtgcagctggccccgacgcgaggcctggaggagctgggccacggccccctgagcttggccggtggccctcgggtgggcggggtggcggccgcggccactgaagcaccgcgcatggagtggaaagtgaaggtgcgcagcgacggaacccgctacgtggccaagcggcccgtgcgagatcggctgctgaaagcccgtgccctgaagatccgggaggagcgcagcggtatgacgaccgacgacgacgcggtgagcgagatgaagatgggccgctactggagcaaggaggagcggaagcagcacctgatccgggcccgtgagcagcggaagcggcgcgagttcatgatgcagagccggctggagtgcctgcgggagcagcagaatggcgacagcaagcccgagctcaacatcattgccctgagccaccgcaaaaccatgaagaagcggaacaagaagatcctggacaactggatcaccatccaggagatgctggcccacggcgcgcgctccgccgatggcaagcgggtctacaaccctcttctctcagtcaccaccgtgtgagctgcccgggcgggtacacggcccaggcccagggaaccccctggggccccggccctcactctcctatagagattgtgtgtgtgtgtgtgtgcgcgcgcgcgtgctcgctgtgcgcacgcacacatctcctcgtctgggtgtgcgcacagggctttgttagcagagagaagcccctgaggagaagggacgcttttcttccttctgcccaagtaaagtgaccatgccagtggccagcactgggggcacacctgtgatgggcaccccttcagctgtgcgtgtgcattccccatcccccatgctcttgcgtgtgcttgcacgtgcacgcacacacacacccagtgctctctccacccgacccgtgtacttgcagacagggaagctgagctgaaaggagcacaagagagtgtccggcttcgctgctgagcgcggcctctccccgccgctgcgcactgcagttatttgtagacaaaggcacccctgatttttgtggtttttctccctttctgtgcttgccaatagttgttttgttttgtggacctgccctgggggctggcagctccttcaggcagcctggcagaagtggaactcccctctccactgatggctgggaagggagttggggaggaagagtgggagggagggctggggatggatgggagggaaggggagggaaaggtgggaggaatgggaagcagctgttctggtggcttccactctgaggtgtgggaacggggagcctctggggggcacctgtttccccagtgactcagagagagcaagactgcaggaacggaggggtcctgcagggtgtccaccaagaagtcacagagcccgttctgcgccccacaccatctggagcaggggcttctcttctgagtgaactgaggaaggtgcttagatggtgagggctctagaaaccaagccccatgagcagcagtggaagacctcgggccatgcggcctggggaggacttggtggcgatccgcaacctggaccccagtgagaggcggtgggctgactgggaaggagaggcccccaacctcctcaggatttgcacgtgtgaactaggctgcctgtggggtgccccttaggcttggagagccccagattggaggcagacagactgcaccaccccttccccccctgcatctcaagaataaagcaagctgcctttgtacttggtt

SEQ ID NO: 4038 - DNA, 24763 bp, human
cgtgggagtgcgtgggcgtccccgggcgcggtccaagtccgtccgggggctgggtgcccaccccgacacccactcccgcctggccctgcccgaacgatgggctcccgggccttaggcgtctcgggtgagtgggcgccgccgggatcagcgggttgggctctctgcgggtggcagtgcctggccgggctttgcggggcgtggaccagcagggccccgcggggagggaaggagacgcggggcccggagctcggacctggagcccagccccgcggcccggaacggggcttcttgcctgtgcgtggcgtgactacgtgagtgcgttcctgtgccccgtctctgtgtgcgcggaggctcccccggccccgcatttgtgtactttctgtgtgcaccctgcagactgtctagagaaatgtcccggatgctgtgggctgagacctcctagggctaagtggagggaggtcaaggtcaaggcacccaggagcagacagggctcagacaggtatgcgtttagtggcctggattcaactcccgggtttattggtctggactgggaaggaatcaagtgctttgcaggaggggtgttggcttgggagaacgtgggggaacccgtgcagggatcggcgagaactccggggcgggggcgggggcgggggaaggaggggctgggcacgggggagaattcccaggaatccggggactgacttcacgctgtgagccgagctcctctggccacctggtgcgggagccgaggggcagggcggggacgcaaatcttgccccaccctggcggagctcctggtcctctctccccggcccttctccgggggtgcgcggggccctcggcttctcccgttcgctgtcctccgccttcttccctctcagttcccggctgccactcctcgtctcttgttcccgctgtttggaaaccttgtgtggccattgccagccccctagcgggataggaatgcgaccgagagggcgtcctgtggaatccgtgttggattccagggctgggatggttggttgacggggactctggatcccatcctcctgcttccttttcgggagtcattccatcaaacggcaagcgatttctccaagcgattcctccggggccgttttgactttcctggagaaggattggtgtcgcacttcatttaaggccaacctcgtggggacgtgtggataggggagagcgacccgagctgcaccccaggcctgaaatgagccatgggacgacaccggtagcccttggggctccccacagccctccgggaaggcctcggcaggtcgggctgggcctgccttcagggaggtgaacttgggtgggccctccctgctctgcgccctaagctctccttcatggaagggacttgcccaccccaaggagacccgccaggaggagggccactgccgcatgcgccctctgtgcgctttcctgctgggctccctttgaaaccgtgggagtttggctgcaaactttcactttctacattcctccttggcccaatcaaagccgggattttacgaggagaaccatccttcacaactaagggaaaacaagaggactgaaaaaagtagatacggaaagcagtgcaagccatgagctgtcccaggggactgcgcttctgggggtggacgcatcaccaggtcccagcctcttcagaggagaaggagcttttgttccaaaagacaggtcagcttctgggaccccgtgcctgcctcccggcctccttaaacacgggtgctcccccatctttagggggcacttctccctgtcccccctgagtaacctcgtccgcaccttgtcagggtgaggcacttcatgggcctgattttcagaaagaagcacatgtgcatctgcagcgccttccatctacaatccacagaggcctgggatccccaggccaggaacccccaagtctctagcctagccttgtgttccaagccattttctgccaatgactcacaacacttccaaaattacagctgtattgagctatcattctcctactgcacaacttaccctttcaaagtgtacaagtcagtggtttttagtatactcacaaggttgtgcagcccacaccagtaattccagaacgttttcatcaccccaaaagaaaccctgcactccttagcaatcacatccccatttctccctcaaacttcctagcccctggcacccaccaatctacttcctgtctctatggatttgtttattctaaacatttcatagaaactgaccttttgtgtctggctttcattaatcataatgttttcaaggttcatccatgtatcaatagtcaatttctttttattgccaaataatatttcattttgtgatatacaacatatttatccattcgtcagttgatgagcatttggggtgcttccacccttgggctgttgtgaatagcgctgctgtgaacactggtctacttgtatctgtttgagtccttgcttttaattctttggagtgtgtgcctgtagccattgaactgttttccacagtggctggaaccagtttacattcccaccagcaacatataagggttccaatttctctatatctttgccaacagttgttattttctgggtttttgttatggccgtcctgctgggtgtgaagtggtatctcattgtgattttgatttgcacttcctgttagctaaatgatgagcaccttttcttgtgcttgttggccatttgtggatcttctttagaaaaatgtctgttcttaagccagcgccacactgctttcattactgcagctttgtagtaagttttgaagtaaggaaatgagagtcctccaactttgtacgtctttttcaagactgttttgtctattctaagtccctcaagtttccatattaatttcaggatcaggttgttaatttctggaaagaagccagttggcattttgatagagattgcatcaaatttgtggatcaatttgggtagtattgttcatgagcatggggtgcgttttccatttatttaggtctttaatttctttacatgatgttttgcacttttgtttaagtttattcatgagtattttctttatgatgctatcataaatggaatcgttttcttaattttactttcagccttctcattgctactgtatagaaatacaattgattggctgagcgtgttggctcacacctgtaatcccagcactttgggaggccaaggcgggtggctcacctgtgcttaggagttcaagaccagcctggccaacatagtggaaccccgtctctactaaaaatacaaaaaaaattaacggggcatggtgatgtgtgcctgtaatcccagctactcaggagactgaggcaagagaatcgcatgaaccccagaggcagaggttgcagtgagctgagattgcaccgctgcactccagcctgggtgacagggcaggactctgtctcaaaaaaaaaattgatttttatacattgatcctatatcttgcgaccttactaaaattgtttattaagtataatttgtttagtagattcctcaggattatctacatattaggatcatgtcattggcaaatagaaatcgtttttcttcttcctttccaatctggatggctttgatttcttttcttttctttctttctttttttttttttttttgagacacagtctcactttgtcacccagactggagtgcagtggtgcaatctcggctcactgcagcctccgcctcccgggttcaagtgattctcctgcctcagcttcccatgtagctaggattacaggcacacactaccacacccagctaatttttgtatttttagcagagacgagcttttgccatgttggccaggctagtcttgaactcctggcctcaagcaatcctgcccgcctcggcctcccaaagtgctgggattaccggtgtaaaccaccgttcctggcccttcgatttctttttcttgttaatttgctctggctggagtctctagtacaatgttgaatagaagtgcctgtgaatgtctttcccttgttcctcatcttaaaggtaaagaagcttccagtctttcactagggggtataaagttagctgtggctttttcatagctgtcctttatcagggtaaggaagttcccattctattcctagtgtgtttttatcatgagaggcattggattgtgcagtgctgcttctgtggctagtgagatgaccacatggttcctttattccacggatgtgggttgtcacaggcactttcgtgtgtcatgtcggaacctcagccccattcctatattccaatcatgtcctcctagtttggaaaatctgggacctcccctgaaaatggaggattactgcgtgttgagttaggaaaaggaagcaggctggttgcccagaatggaaggcaggaaacagcatgtccccagctccggagccttttctgcagcccatgtccctccactgccaccaggcccccttgtcatatatctcatcgtggtccacactctgctgaacttgtcttggccttggcaccccctctctgacaccatgatgtgcttgctagcatccgagcacgccggagatggtcaggggataaacccctggtacttaggactggtctcccgcccatcctactcaggctttacagggggagtgggtcaggaccgcctgtcatctcccctctgtccacatcgagggaggccaaaggacagctggccagcccttctggtgatctcccaggcattcttgcctaaagcacctgcatgtgagcccccatggtgctggcagccatcctgggtgcgtggcattcagcagggagacactgcagacagggccttgcccctcccccagactccccttttgttgttgttgttgttgttgtttgagacagagtttcgctcttgttgcccaggctggagtgcaatggtacgatctgggctcaccaaaacctccgcctccagggttcaagcgattctcctgcctcagcctcccgagtagctgggattacaggcatgcgccaccatgcctggctaattttgtatttttagtagagatggggtttctccatgttggtcaggctggtcttgaactcccgacctcaggtgatccacccacaccggcctcccaaagtgctgggattacaggagtgagccaccacgcctggccccaggctcccctttttgtaagggggagaccatcgccaacatgtaggcaactgcgggggagagaaagtactgcttgagtgcgggagcgtggctggcagccagtgtcccctcttcagcgacgtcttcctccaaactgctctcccacccaccaagccaggtggcttctctggctccctcctgcttgcatgggggcttcctgtgagcagggatttgggtctggcatgggcactctgcctccccgcctcaccagcaccagatgctgccagcacatccacgctggcctccacccttccaggggaaagctggactctcagtcaactcagtggttctgccgcagaagctgactggggaagaagcaggctctgagaaagtccttgtggagtggaagaacagagggctggacactgaattctgactgccatcttctggaccaggtcatcctgttttgtgtcattgtcccaagattgtagaatgccctttcccctctcatctcggggttcctgaggactgtccagtctgctgaaatgaaattcgatagtgccagagagcagattcgtggttgcagggatgggcagaggggcatgaggacacttttggggaagatagaaatggccactgtcctgacggtggtgatggttccccaggttcatgtatgacatatgaacacctgccctttgcacactgaagatgtgcaggttaccacccagcaacagacctcaccaaagctttagaacaggaactccatggccacatgcacgcatcctggggagaaaggtgtcctttccttccttctacttcaggggccctgccagagaaggcagtgcagtgtggagataggaatggaggcagccaccaactgacagctgtgtggccaggggcaagtcgctgcatggcccactggctcagtgactcagtttcctcaactgtgaaatggcagtgaagagtgcttgcgtccgagggccattgtgacaaggaaaacagatggtgtgtcccccgggatctcactgggtggaggagggagttgctgccctcgggccattcagttggtcattaagaagtggaaattggctgggtgcggtggctcacgcctgtaatcccagcactttgggaggccgaggcgggtggatcatgaggtcaggagttcgagaccagcctggccagcatggtgaaaccccatctatactaaaaatacaaaaaattgaccaggcgtggtggctcacgcctgtaatcccagcactttgggaggctgaggtgggcggatcacctcaggtcaggagttcgagaccagcctgaccaacatagagaaaccccatctctactaaaaatacaaaattagccgggcatggtgacacatgcctgtaatcccaggtacgcgggaggctgaggcaggagaattgcttgaacccgggaggtggaggttgtggtgagctgagatcacgccattgcactccagcttgggctcgaaactccatctcaaaaaaaaatatatatatatatattagctgggcatcatgcacctgtagtcccagctactcgggaggctgaggcaggagaactgcttgaactcagcaggtggaggttgcatgagccaagatcaagccactgcactccagcctaggtgacagaacgagaccctgtctcaaataaataaattaattaaataaaaaataatgaaaaaggaaattatatggagaaggccttacatctgggtatgtcacagttaatgcccagtgacagaagaatgtccaatattattctgagaatttctctcaggaaagggacctccaagttttgaagaagtgtgatgtagtacaatattagttaggacagcctgggcaacatattgagaccttgtctctacaaaaataaaaaattgctcaggcgtagtggcatgcgcctctagtcccagcttctggggaggctgagtgggaggattgcttgaacccaggagttggaggcttctgtgagccgtgattgtaccactgcactctagcctgggcaatggagccagactgtgtctggaaaaaaaagaaagaaagacagagagaaagagagagagagagagggagggagggagagagagagagagagagaaagaaaaaacagatggacagggaacaaagcggaggcatatgtggtcattttgcacaggagttgggccggaggaggcgaggctgagcagcctggggctggacaagatgtcctccctttcagtgcattctgcctgtcctcatggctgcttggagcattgagaatgaaaaacgctgcagagggaatattgctttgattgtaaaacgctgcagagggaatattgctttgattgttgctagatgtgaactgtgcccttagccagtcaggttagcctgaggtgggtgggaggatgggtttagttgctgggccacgtgcctggaaagctgtgaatatgtacccgaaggttgatcttgagaatggcttcaggaagtggttggcttttcctgtgcaaggtgtgggacacccctcttttcctgtgtgttttttttttttttttttttgagacagagtcttgctctgtcacccaggctagagtgcagtgttgtgatctcggctcattgcagcctccgcctcctgggttcaagcaattctgcctcagcctcccgagtagctgggattacaggcacctgccaccacgcctggctaatttttgtatttttagtaaagacagggtttcatcatgttggccagtctggtctcaaactcctgacctctagtgatccgcctgcctcggcctcccaaaatgctgggattacaggcgtgagccaccgcgcccggcctcctttctgcttctgagccaggactatggaggtgtctgagaggccgccgctctcccggaaaggtgggggccaggtggattgatgagacttcagcagaccctgggcttcggggagggaaggagaagtgaggggaaagaaagatgccctcatgcagaaggccttcgttgaggtctgccctggttcctccagggcgcgctctgagtcagtacagcgccaccctccacccgaagtccttgttaaggtgcactttctgactgagccactagcatggggcctgggattctgcacttctcacaagctcccaggtgatgtggatcccactggctgtgagtagccagggccttgggtagggaccgggagtagatctatggtagccccaaaccacattaacatgggtggtgaagtgaggtgttgttttttttgtttgtttgttttgttttttttttttacaaatagagggtaaaaattgtttacaaatagagggtaaaaaaacacacatagagggtaaatcagaacatccaggagtcgttgcctacgtgagggctttacaggacataacttgttcttccctgccatgtgcagctaactgacccccttccctgtcaccggcacccctaccggtatacatgtctctcatggacgcccagacacccctcccccgactaagtgctcaaaggcctttgagatgaagccctcccatgtttctgtctctcctgcccccaggcagaaagggtgggcacagagttatggaagcgggtggtgtggcttgcccaggaggccacagttgggggcgtgggcagccatgctacttgccgggcctgtcacctctttgtccctgctagaattctaacatgttggtggagacattttgcagccaccaatgcagtaattaattcaggcaaaaatcatcactggatgccaaaaccattagatgtaaggtcgttggggacagaatattcacaaagtctccaaatattaccccaaattacctgtgaatcaggaagggaaactgcgtctttacagaggagagatctggcagctgccacctggaccatgtgatcaaacagcctccccaacagtggggcagcctgaccctgccagccgccagatgcagggctggggaggagacatacagcatctcctgcaaggtgctcttgtcaaaacgctcagcctgaatctcaccgcgggaatgaatcaggcaaattcagactctggcgcattctataaggactggtctcttccaagaagtcattcccattaaagtaaaaaatatatatatttttttctagattagagaggagacataataactagagacctaacaaccgaatgtaatatgtgtgcttcttgattgaatcctagattttttgtttgtttgttttgtttttgagatggagtctctctgtgtcacccaggctggagtgtgatggtgtgatctcagctcacttcaacctctgcttcctgggttcaatcaattctcctgcctcagcctcccaagtagctgggaccataggctgcaccaccacgcctcgctttttttttttttttttttttttttgagatggagtcttgctctgtcgcccaggctggagtgcagtggcacgatctcggctcactgcaacctcctccgccacccgggttcaagtgattctcctgcctcagcctccctagtagctggaactacaggtgcaagccaccacgcccggctaatttttgtatttttagtagagacggggtttcaccatattggccatgctggtctcgaactcctgaccttgtgatctgcccgcctcagcctcccaaagtgctgggattacaggcatgagccattgtgcccagcctcaaatcctagatttttaaaaaaagctataagggtgttagcgggacagctggggagatgtgaggctggcccattgtatgagtgcggaattccgtgctaagggtgttgtggttccacggagaatgggactgatggcatcttgctttcaaatgcttctgcacatgtgtgtgtagaaaccccgagagcaggtgtggggaatctgcagatgttcccacatgcttgtgggcggacaattttcaaaatcccgagctggggaaacatgaatggggactttgctgggtcactgagtgggtgaatgtagtgagcctgcggcttctcctttctcctctgatgctctactcgttgggagatcccccgatgcctgacttggcctggaagctacagtcacaactgcttccaaggtgtcctggatactccagacggcagagctgagagccagcaggcaggtcagagctcggccccgggcagaggataacttcctgtctctgtccttccccagcttgtttcctactctacagcagtggggtaaggggagtccgaaggtggcagcccccccacctccgtggcagccacgggggcccctggaagtgatgtggcttcacctcccatcccgcgcgttgccagtgagagtgaaaggggtcgcaggcgccgtgtgacaagcacttgggattgcgagtctcccaggccacaactgttttcttagcctctccggcctctcttctcggcttcccagagattcctgatcagcaagagggcgtcgcgccccacccggctgtgcgcctgccaccgctgggtgcaggagggtgcctggggcagagcctggaaacagagctcagcctccgacggggttggcggggcgggcgggcaggagtcctgccaatacagccaccagcgtggcggcgccgggacgagtgtggtccgccctgctcccgcagccgcagccaccccgccgccgtcgcggcgcgctctttgtctgcggctccgggctcagggggcggggcgagcgcgcctggggctccgccctctccgcctagggcgccccgcttcccgcgtcccctaaggcccgccagtcccttgcccagcgggagatcgccgccccacagcgactgcccgtggggccgacttcgcgtcatgcctgcctcgcctgcccggtgttgccccctcccctgtccctgtgtcccccctcccttgcccgcatgtccccctcatgcggggaaagcggtgccagcactttccctggccttgcgaattgctcttccatcggtattcagccgcccctctgatgttcctgaaaacccaacctgctccttctctgcaaaaagctccggaaggctgtgtcgatgcaggtcgagcttccccacccggccccctcccaccttttagcaaatccagaggccccaccttcgccctcccctcccgggctccgacccagtgcattgagcagctcctcggcttccctcccgggactttctagtctctctccccaaccggctcagtgtcagggtgccccaggactctccttgggcctctcctgttcttgactacattcactccctaggtgagctcctccatctcatgcttttgctttttaaatttttatttatttatttttaaatttttattatttttgagacagggtctcagtccgttgctcaggctggagtggagtggcacaatcacggctcactgcagccttgacctcccaatgctcaggtgatcctcttgcctcagccctaccgcctgccccctacctcctccaccacttggggctacaggagcgagacaccacgcccagcttcatctcatgattctttttttgtttgagacggagtcttgctctgttgcccaggctggagtacagtggtgtgatctgggctcactgcaacctccacctcctgggttccagtggttctcctgcctcagcctcccaagtagttgggattacaggtgcctgccaccacgccctgctaatttttgtatttttcgtagagatagggtttcgccatgttggccaagctggtctcgaactcctgacctcaagtgatccgtctgtctcggcctcccaaagtgctgggactacaggcttgagccaccgtgcctggccgtcatcttatgattttaaataaagaaaaattcctagtttaattgaacagcaatggtcacatgccacccagttagctgacttgggcttgggccagacatttggagtggggcactggagatgtccacatgcctcgggaagttcaagctagagataaaaaccttccatttcctgccctgggcctaatccctgagtccttccttcctcggtcttcctcactgctgtgaggatacccctggtccttgtggtcctgtgtggcaattttatgttttcttgtggtaagatacgcataacataacatttaccactagtgacttttagtctattctcaatgttgtgcagccgtggccactgtctagttccagaacaggttcatcgccccaaaagggacctcatatccctcagcagtgactccccaggccccccttcctccaggtcctggcaaccattcgtctgctttctgtctgcctctttgccttggctagactgtgctcatgcagtcgtgtgtgccggtcgttcattctttttatgtcgggatgggtgtaccatgttgtgctcgctcatccattcatccactggtggacacgggttgcctccgagtcttggttactatggatactctgctgtgagcatttgagtataagttttctttgcatgcctgttctcaactatggatactctgctgtgagcatttgagtgtaagttttctttgcacgcctgttctcagttctttggggattgctgggtcatgtacataagctacacctaaccttgtgaggagccaccagactgcttccctggctgcactattttacatgcccagcagcaaggcgtgaggctccagggtccccgcgtcctctccaatactcgtgcttcctttcactgattccagcctcctcgtggtgtgcggcggtatctcactgtggtttgggtgtgtgtttcctctgtgcgtactggccggtgctgacgcgtcttttcctgcgcttattcgatgtcttcttcaagccctcactgtcccttgcccccagcccaacagcaggtcctggcagcctacctctaaaacccaagctgactctgaccacatcccaccacctctactgccacccctggggtcatgccaccatcatctgtggtctggaccactgccgttgcctgctggtctggcccttacagtctgttctcctgggagctcccttcgctacaaggaaggaagcatggctggtttcttgtcatcatttaggtctcagctcaagtgtcaccgacccagagaggctgtcctgaccactctacccacccaggcagctttgtctctgtcccctcccaccttccaaccaagccccttggggagcggaacgggatggggggtgtgttctggatccaccgtctctcccttcagctccttggcactcctttcctatggggcaccctgtccagggcaggtggggcaggattcccccctcttccctcatctcccgtgcttcccgggcccaccccccagcatctccagcctgcccgggagtcacatgtcctcggcccacagaatccccagcacacgccccacccacaggcctagccccagccctggggtccctggcaccccacctgccagggcccctcccctgccttgctcaccccccaacacacctgattgttggaaaggtcttcccatgcccaccacgaccccctcccactcatctgtgggcgggagagcttggtccctgccgcacgttgcccccctagcatccaggcccaccaccgagcccccgacaggcctgggagccccactggtgggtggggacccaccagctgggggtcttgctcacaccgaggggctgggggtggcggtggctttctcagggcaccctgccttgggctgcaggccgctgggtgggcaccggctccctcggaaggcagcgcaacccgggatcctgccggccctggcccccaccctgccgaccgggcctggggcgatcagtgccccagctcctgtcctcttctgctcagatgctgggttgggagatcaggggccacagctcggccactcagagccctttccgcaagtcttagagggaccagctgcggggtgtgtgcagaggggctgcgctgtggggagggcgcatggctcagtcctcctggcctgaggcccgcctagcctaagtggcctccaggacccatggccaggcccttctgcagccttccagaaagaaccagcttcccagggttccctggggaaggcctggggccacctcctctggaggggtggggcctgtgcttcattcctccttccccaggtccccttccaggccgccaggtcccctccccgacctggagcccacagccttgtaattaaattgtaaacgtccttgtaattaaattcatgtaatatccattattattattactgttttagactaaattacttagagcacattgactggatcaaaggctaccatgaacgttttcaagggtttttatagttattgacaaattcttctccagaaatttgaccactttacactctggggtaagattcagactaagtgtgtctagaaagggtgatggggtcggctgggaggaggaactgggcttgcaggggacctggggcagtgagtgctctcagtgtgcaaaggggaactgggctgtcccaagcaggatgtgagggccacttgggccacattcaggcagaggggccctgctaaggcttgagtcccctgttcagagcagggaccatggtggaaattaaggacgttcatgtcaactgtggttgagattggagctgcagtcctagagtcagccctcttgggcccatcttggcagcaaatcaggaaggaagtagatctgtgtgctgaagagtcgccatggggcacgtcaagcccctggctgagccgtggtgtgctcacaggctgctgcactccccggggcagcggagtgccagggacttgtattttcatctttgtgctcctccgcctcctcagtgtggcgctctgagcacttcgattatttgaaaggaaatgcgaaaatttgtacaaaatctattgtgctagcacgtgatggaggaggggtctttgtgaacaggctttgagggtttgcttggctcacagctcactacccagtcaacagggttgactgccacggggtgacctcgctaaggtgaagcatgatgcccagcacgtggtcaggatggcacgggagcactggagaagatgagagtcgctgggaacctgggcgaggggggacaaggggcatttgagtgggcttcaggtacgtgaagtgttgcaagataaagtgggtttcttctggattgttccaaaggagggaggttgctctcaatgaaggaaacattcaatagtgagagttttccgataatgagctcagtcaacaatccccactctccccatactagagaagcaaagtggatttcttctggattgttccaaaggagagaagtttgcacttgatgaaggagacttttttttggggggggggtggggggtggatggagtctgactctgttgcccaggctggagtgcagtggtgcaatctcagctcactgcagcctccacctcccaggttcaagtgattctcctgcctcagcctctcaagtagctgagattacaggcgtgcaccaccatgcccggctaagttttgtatttttagttgagacggggtttcactgtgttggccaggctggtctcgaactcctgacctcaggtgatctgcctgccttggcctcccaaagtgctgggattacaggcgtgagcctccgtgctgggcaatttttgtatttttagtagagtccgggtacatcagactcaggggctgggtcatgcctgtaatctcaacacttttggggggactaagcagatggcttgagcccaggagttcgagactagcctgggcaacatggtgaaaccccatctcttattattattattttttaaaaggtagatcagataaattacaggtccttaatatatattcaacaaattacagaaatatataaaattttaattcagccaagaaacatattaaagttttatcttcagcaaactgttaggagttgggatggaagtagaactcagggtgaagccctcttggggtttgttgtctaatgaaagggaggtaattagacaatcacacataaaaggctgagctccagcctgggtatcttgaggcctcctggacttgctgtagcatctggagaagtatggggcatcatctcgcatcacttagcaccagcactgccacccagccttgatgtgggtcctgttggcctgagcgtttttccttgaagaaggtattaaaagcagattgaagccgcctgtgcccacccatcccctacgcacttcatctgctcgcctctctgccgtgttttccaccaagtacatactacgaatgagcctccattatgtgcgcctccattaactgcacatgcggaataccaggaattgtttgttcgactgctggcagacctttgggctgtccctggtgtttggccactgtggccttcatgcccacatcctcctggtcctcctggtggtggttctgaagggcatctcctctcatctcatggctccaagtgcttgctagtgggtcccctttgccctgagcacctgttgatatcctttgcccatgttcttcttgagttgtttgtgtctgtgttttcttgttgttttgtaggaattctttgcatattctggaaaacccattatgaggtccatgcattgtaaggctctcctctgagcccgcctttttactgtgtttagggtgtcttttgtcgtctagaagttttacatctcttccattattgcttccccatttgaaatattgagaatttcgtctctatcccacaccataaagatattgttctcttgttttgctttgtccctgtaggtctttgatccaattggaattgcttggccagggcttggactaggtcttctgtcttggtggggcgagctcccagggtgtggaaacgtttgcaggtggggcaggagggagagtctggtgggaagcaagcctggggttggccatgttgagtgtttgtgccttttagagactggagtggtcgagtaggcaatccgagggttggggcattacaggggtggctttaccagtgtgctacctcaggatggttgggggtggggcggggaggcaaggctctgagcaggactggaagagctgctgtcatcagaagggccacagtgtggctccttaccatgtgcctggccctatacctctttgctcatggccccatattttcccaccttgttggtagcccttagcccttccccagaggggagctcatttcttccttgggggtccagcatgaccgatgaggaggagagagagagagagcgagaaggcttcaggagcccgtggcttccacccaaatacctgcctggctgtcacaggcgatcactctggttgctgctgatccgaggtgctgaggctgtgcccacgcccatccccctcttgacatcccagcctccgccagcccgcccagcaagcgctcctcagtttccatagcaacactgctgctcggtaatgattccgggtagaaaggcattcgtgcgttctctgtcatctctgtcacctgagcatcccactgcctgcttgctgtcctgccccgggagttcaggaagaaaccctgaggacagctccgagcccttctgcttgtgtgttggcttctcctcaagggcagtggtaaggtggtaaatgttcccagacaaaaagccctgatttggagcatttgccgatttccctggtgtaaatgctgccactatagccgatttcaagccaccactgcgatgtcactgaacttggagttgggggaatgcacacatagtatttccatctcccataccagatgtgaataaccccaaaagcacagatgacagaaaagtgtagtaagataattagacagtgatgtgttccgaggatttattgcctttgttgttaatatcattcagttacctgtacatttctacggttaaaataccaataatcgctgtgtttgacaactggcttccaaatttcccagcttcagttggctctagccactgctgctgagagtgtcgaggccattccatcatgtccctttgtctacagccttcctgaacccacactctgctgccgcccaccctcttccatcctgcctttctaactgtagcctctccaccaagcacagcatgccctgtcctgactgacattcttacggtcttccaacaaataccttcttggctgaaagctgtttcctttatagtatttgatccagaaattccacctcaagaaattttctccaccttgacaaccactggttacacaaagatttaagtatgaaaaatgtataaaatggaccccagaatgtgtctttgccacattctttataataaaaaatcaaagccacccttactgatgtgatgatgaacatgatggtccactggtgtgttggtgtggatggaccttaaggggcctgcagctgcaaaatggcacacatagaaaacagactggaaggaaacaggccgcatggccaggtgcggtggctcatgcctataatcccagcactttgggaggctgaggcaggaggattacttgaggtcaggagtttgagaccatcctggccaacatagtgaaaccccatctctactaaaaatacaaaaattatccaggcgtggtggtgggtgcctgtaatcctagctattggggaggctgaggcaggagaatcacttgaacccaggaggcagaggttgcagtgagccaagattatgccactgcacttcagcctggatgacagagcaagactctgtctaaaaaaaaaaaaacaacagctgggtgtggtggcacacacctgtagtcccagctacttgggaggctgaggcaggagaattgcttgagcccaggaggtggaggttgcagtgagccaagatcgtgccactgcaccccagcctgggcaacagagcaagactccatctcaacaaaaaaaagcccccaaaaaacaaaaaaatgaactgtgtttcttttataatcggacaaaactgattttgacaaaaagctcttttcagaatatgaaaattttggggagaagggagacatagaaaacttcaatgattatctacaaggacatagtcaaatagaaaaaaagtaatgcaggagccgctgctgaggccacaggggttccgaggacaagctgggctctcctcagatagctgtcttcccgaaaagactcgtacagcggtggttctactgtatcgcgggcactaagacaagattttgccgtcagaattgacatctctgtgagaaacccggggtgggaggtgccgccgtgagaatgcaggacagagagttcttctaaacttgctaatattcgcacaactcggaaaagcagagggctccgtgcaggcgcagccacctgcgcccatgcccagggcccttctgccctctcatctggcacaagctcccagcctgctccatccctaggcggactctgggtctcctcgccctgccctctctgtgctgactgggggctttgcttccaactgcaaaccagcctccctgggtcttttcttggccctgttccctttgcctgatggaggccaggtgtcccctgctccagaagccttccccgcctcccaccgaggcgtgcatggccagccgtgtgctcccttagctgtgggtaaggtctgtccccacgctcacctgcggggcatagccatttgggcataatgctagtgtgtagcctccccaggcccagaacagcccttccataagccgctgagcccatgaggagaccctgcacgcctgcctcgagctgcctcctcctagaagtgcttcctgctgacccttgctggccccatggcacgtgccctgaattctggtggagtctgttcagtccttcttggtccttagtcattcgtcccttctctacttgcctcccttccccaaggaggacttgaaggtcgcagcatactgtcccagggtgctgcggaagcagccttcgaccttgtgggcactgcttgccccaccacctgcgctgtgcgtaatgggcttccttctgctacccttcattgtccttccttcacccctacagcatcccgcagagctgcttaggtcctacttccgccttgggccctggcccgcgatggcctcctcctccctgacccctccttctggccaccgggcagcctgtcctggctcatgaccttgactcagtgccacaaccttgctgagcttgctgacatggtttcctcatctgcaataatggcatctccctcaaggttgttgggggttaggattttgtggagacccacatcaggggtctttcccagaatgtagcacatggcacgtgcccaaaaaacagtagtggcatttttttttctttgagacggagtctcgctctgtcgcccaagctggagtacagtggtgcgatctcggctcactgcaagctccgcctcctgggttcatgccattttcctgcctcagcctcccgaggagctgggactacaggcgcccaccaccacgcccggctaattttttgtatttttagtagagatggggtttcactgtgtttagccaggatggtctcgatctcctgacctcgtgatctgcccgcctaggcctcccaaagtgctgggattacaggcgtgagccaccgcacccggcctagtggtggctttataaggaccactttcttggcacctcttttaggctactttgcagttccagggggcttcttgtacatcaaggccttttctcttgggcaagtcagttgtcactgtgaggacacaacactgtatctttaggcatcttcctacttgtcccccaacctgaccctggccctccctagtgagtagacatttgttgagagactcggctcatctgaagagtcaaggtcatcctcttgcttgatgctgaatgagcacaacacagatgctcactgagtgttggctgttatggtccagtcattgccaaggaactcaatgggatcttcatgctagctctggcctcagtgccgccctagaaagaagtgggtccggatggggagaggccaggagagctcaagcagtgtctggaggacgttgtagggcggtatcacagcctccagacccagtgcacagaggctgggtcccccagtccttggtgtgacttggtgatccccagctggccttcagtgggatgaaggctgagcagtggggcttgcctgggaacaggggcaccaaaggtagccagggctgcagacagcagattccttgcttgagtggcttggggtgctggttgtcagcccaggtcctgccagctagggcctctgccttgacctcagaggggaggagcaagcctttgagggttcttacggaggcgtgtctctgccgcaggtgaacgggaaggagctctccaagctgtctcaggagcaaactctgcaggccctgcgctcctccaaggagcccctggtgatccaggtgctgagacgcagcccccgcctccggggggacagctcctgtcacgacctgcagctggtggacagtggcactcagaccgacatcaccttcgagcatatcatggcgctgggcaagctgcgtccgcccaccccgcccatggtcatcctggagccgtacgtcctctctgagctgtgagtcgccctcaggagggccccgggccctgcctccagagaggacaggccacctggagcggccatccgcacgccaccctctcgggcaggaagcaggcccctcggcctccagaactgaccgtggtacccaagggctccaaaacctccaggcctctagccttgggccgggctccagcaggcgccccgttgtatctacccccagggccgagggaggaccctcctgtccgggacgtcgctgccggaagtgccagggttgagggcctcagctcctcctcctccatcctctctcctctgccgcctcacaagcatcactccttgaatcttcttgcatcccttgtctgtctcattcctctacctgctctgaatttcctccatctcttcagcttctttctttggcccgaccggaagaagggcctttcatccaggcctggtggctcatgaccgcgtgagcgctgcctcattctgctaatcttagcccgggctgcggggaggtaggccacagggccatgagcagccaaccttagttttggggccaggagggcagcccctggaggtagggtgggcccccctctgctctgcagaagtcctccagggcctggataactcctgggggcgttgcatgagtggggccagtgctgggcgggcgggtgggcacccggagattggagaagttggtccctgccagctggcgtggttggaggagttctggtctgggggacgggaacgctagaggcatgcgcaggtcctctgcgtggacgctgcacactcaggtgcgagaagtgcccccggtctttgcatggctgcatgttgcccaggaaggggctctgcaggaggcaactgggccacccacccttgagagcacaagcagagcaggcctccgtgccaggcacgctgggatcggcctgcctgggagctggggctgaggtgtgagaggatggccagctggtctgacccccaccttctcctgggcagccccccaatcagccatgagtattatgacccggcggagtttatggagggcggcccgcaggaggcagaccgcttggatgagctggagtatgaggtgagccgggtggccaggccagggcccgcagccagctgcgggagccgccccgacgcctgtgtgccttcctgcccaggcccaaccccgtggccctcctggcacgcatctggctgagtcagggagggtgcgggtgaggttacgtgttccgtccatgtcggtgagtccacgtcccatgcacgtctgtcttctgtgtcctgtgcctgtgtgtgcctcgtgcatttcctgggagggagaccactgagtacgtgcgccacgtgggatggtaagagagaccctcaaagcggggcctggaaactgagctcagggggctccagaggaagctgaggggctgcgggctgaggggttgcgggctgaggggctgggctgtgctgcctgctccctcactcacgcatttctggggctttctacctctgcttcctcccggacccctcgtggcaggaggtggagctgtataaaagcagccaccgggacaagctgggcctgatggtttgctaccgcacggacgacgaggaggacctgggcatttatgtcggagaggtatgcagacgggtatgccccagccccgaggcccatccacatggcctgcctgtggctcagaggctgcccttaaggtcccagctaccagaaacagggcatcacagctagggtgctgcgtggtgaggcgatgatggtcgacggcttcagccactgtccagtgaggtagtcatctgcagaaagaggcctgtgcctgggtgggacagcagatgggcctgagaactagcaacagggttgctgtctagccttctcccgaacccatcttgggcagatgtcttgtgtatccccaggagggggatggcccctcgctcccctccctactagtagcatcccactaaagccacccttccagatggacaatgtcctacttcccaccaatgcccggggctgaccaaaagcacaggcttccgtgcagaagagcctaggagtgcagggcaggggcggggagaggtgactactccacagcctctgcctctgcttcctggggctcagagctggaaggggagccagagagccttcagcttgctttgggggcccctgaggtgagcctgcccccttctaccgaaagggcatgttaggcaccaagtccccaagatgcgtgtgtcctgcaggtaaatcccaacagcattgcagccaaagacggccggatccgtgagggagaccgcatcatccaggtgagcacttgcaggctgcaggcctggcccaaggccccgctgtgcccgtcggcccagccacctctctttagccagtccctagctctctcccactaagagctaaccctgaggcccagcagcctgccgtgtcctaaacccgggctgagtctcatctctctcctgcccactcaccccagtggctcccgtgtgcctatgggatctgctggcatccagggcccctgctgctctgaaacctcctggcccctctccctctgccccactccatgctctcctgagcacacatttgctcttgcaagagtcaggccgccctctccctggtaccttccacttagttacatcctcccagagctcaagccccagcctagcccagccgagcccagagtgcttgggctccctgcacccgcccagggtccgccccagggccagccctagcatgcttgttgattgtatcctgcctgcctcagattaacggtgtagacgtccagaaccgggaagaggcggtggccatcctgagccaggaagagaacaccaacatctccctgctggtggcccgacctgagagtcaggtgtgtatgcctggcagggcgacccggggccacgacatcaggctttctgtcttggaagctgctggccgtgactagggcacagatgtgccaacgacctggagttgatggagggcgggtgggcaggggtctctcagggcccgtttcccctcctggcctctgaaggctgagggggctgggacgctgcccccaggttgctgagcttcaccgaaacaagccaagtgcggggtccagagcagacaagaagggtatatggggaggtccttgaagctgtggggacaccagggcctgtctccacagctggcgaaaaggtggaaggacagcgaccgggatgacttcctggatgactttggctctgagaatgagggggagctgcgtgctcgtaaactgaaatcaccccctgcccagcaggtg

SEQ ID NO: 4039 - DNA, 22343 bp, human; identical to SEQ ID NO: 4031

SEQ ID NO: 4040 - DNA, 24983 bp, human; identical to SEQ ID NO: 4032

SEQ ID NO: 4041 - DNA, 22354 bp, human; identical to SEQ ID NO: 4033

SEQ ID NO: 4042 - DNA, 28324 bp, human; identical to SEQ ID NO: 4034

SEQ ID NO: 4043 - DNA, 27071 bp, human; identical to SEQ ID NO: 4035

SEQ ID NO: 4044 - DNA, 24598 bp, human; identical to SEQ ID NO: 4036

SEQ ID NO: 4045 - DNA, 27728 bp, human; identical to SEQ ID NO: 4037

SEQ ID NO: 4046 - DNA, 24763 bp, human; identical to SEQ ID NO: 4038

SEQ ID NO: 4047 - DNA, 22343 bp, human; identical to SEQ ID NO: 4031

SEQ ID NO: 4048 - DNA, 24983 bp, human; identical to SEQ ID NO: 4032

SEQ ID NO: 4049 - DNA, 22354 bp, human; identical to SEQ ID NO: 4033

SEQ ID NO: 4050 - DNA, 28324 bp, human; identical to SEQ ID NO: 4034

SEQ ID NO: 4051 - DNA, 27071 bp, human; identical to SEQ ID NO: 4035

SEQ ID NO: 4052 - DNA, 24598 bp, human; identical to SEQ ID NO: 4036

SEQ ID NO: 4053 - DNA, 27728 bp, human; identical to SEQ ID NO: 4037

SEQ ID NO: 4054 - DNA, 24763 bp, human; identical to SEQ ID NO: 4038

SEQ ID NO: 4055 - DNA, 22343 bp, human; identical to SEQ ID NO: 4031

SEQ ID NO: 4056 - DNA, 24983 bp, human; identical to SEQ ID NO: 4032

SEQ ID NO: 4057 - DNA, 22354 bp, human; identical to SEQ ID NO: 4033

SEQ ID NO: 4058 - DNA, 28324 bp, human; identical to SEQ ID NO: 4034

SEQ ID NO: 4059 - DNA, 27071 bp, human; identical to SEQ ID NO: 4035

SEQ ID NO: 4060 - DNA, 24598 bp, human; identical to SEQ ID NO: 4036

SEQ ID NO: 4061 - DNA, 27728 bp, human; identical to SEQ ID NO: 4037

SEQ ID NO: 4062 - DNA, 24763 bp, human; identical to SEQ ID NO: 4038

SEQ ID NO: 4063 - DNA, 1605 bp, human
ttgacccctccttgcagcccagcatcacctggcgtggggacggtcgagacctccaggagcttggggacagtgacaagtgaggacagtgacggtgaaagggggcagagtgggaaaagctggaagtccagacctcttggcctcgtccttgctttgatggggaaggctctgacaggagcgggggaaggagacaggagggagggatgggaggggagaagagcccagatggcaggaaagacagacacggctcctccgcaggtacttcatagaggatgggcgcctggtcatccacagcctggactacagcgaccagggcaactacagctgcgtggccagtaccgaactggatgtggtggagagtagggcacagctcttggtggtgggtaagtcctagggtggaagcctccactccagaaggccggggctcacatccctgggccctttcaagcaccgaccctccccaccctcagggagccctgggccggtgccacggctggtgctgtccgacctgcacctgctgacgcagagccaggtgcgcgtgtcctggagtcctgcagaagaccacaatgcccccattgagagtaagaggcttgagctcagtgccaccccaccgtcacttctgccagccctggcccctcctggggtcctccctcctcctggagccttcctggggggacacggtttggggggactcacggttcctcatgggaatctggagatgccagttggcctgggtaatcagggacccagactgtacccaacccctccacagcccttcccccaaagccacatgctgatcactccattgtcggttcatttcttggcagaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcaggtgagtcagggtggcacccactcccatgccacctggaaggggctccgggctgtgaagggagggcttagagaggtgccatgcccaagttcctctgcttccaaatttccagggggagcgcgagggggctggactcccttggtgccagaatgagccatttgttccttggccctcggtcctcgtggctctccaaaagaggctgcagcattgatgtgttaatactttcctttccagccccagagaagaaccctgtggatgtgaagggggaaggaaatgagaccaccaatatggtcatcacgtggaaggtgagagtccctgggctgagctgcctgggggacatgaggccatgacctgggtgtctgttgctcccccttggctatgcaaaggaaggggctgatgtctggggatgctggtttgtgctggggggcgggccaaagaatgctggtgttcttggccaaccaactcctcttctgctggcctcctccagccgctccggtggatggactggaacgccccccaggttcagtaccgcgtgcagtggcgccctcaggggacacgagggccctggcaggagcagattgtcagc

SEQ ID NO: 4064 - DNA, 2045 bp, human
gaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggtgaggcgccgggggcccgccatcacctgccagggaagcatgggggctgcacaattcatgtccttctgtcccctgaatggccactactgcccaggctccctccacggctcctgtctgcttctcctcccagaatctgggtgtccccgaatcagccccctttcataccctttccgcagatgcccttttccctgtccctgtcactccttagccccccagagggccccaactttaagagcatacttcagggcctcaggtcgggttctggcttgggcggcagcacggggggctggtgtctcaccctcaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcaggtagcctctgagccccacgtgacgggggtggagccgagggcagagaggagcacctcgccccttccacccttctgcaaggcctcctggattccccgagctccccacaagatgacaggcgcatggtgggggcaggcagggggatcatcctcccaggccggggttggggcaacaggcaagtggtggctggaccgcagggggtgagcggtttctttcaaggcctcttgcctctgggcgctgttgagacagagtgctgggggtgcggggcgtagaggggcctggagccccgggtcaggctggggcgggagaagaagctgtccctctctgtgtctccagtgaaggataaggaggacacccaggtggactctgaggcccgaccgatgaaagatgagaccttcggcgagtacaggtgagccggggcaggagtgggtgctggcactcagctccaccctggccttcacatctcaccccctctctctcttctctgtgctgccgggtgacttcaggtccctggagaggtaaggcaggggcggtggggaggggccaacagcaaggtctccctatagacaatgtgcgcctggtgtgccattgtcccctggctgccggggctctgacaggactctcacttcccagcccccaggcccggcagctcctcatttcagggagaggccaacacgccccagcccctcctctccacacagataccttcactgctcccctctccccaagggaggccccagacagcttcccagacaggaaccaggccccataatcccctggccgagcgcacattttctccctcacagtccccaggatctggggaatgcccaaagatgacagctccagacctgcctgccagggtggccagagctgctctttctgagcgcattctaaacaaatggaaggcaggcgggcgtctgcctcacccccagccaggctcctgcaggggctcggcagtgctctcactcgcacctgccctgtgcctctgcagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgg

SEQ ID NO: 4065 - DNA, 1177 bp, human
tcggctttgtgagtgccatcatcctcctgctcctcgtcctgctcatcctctgcttcatcaagcgcagcaagggcggcaaatactcaggtagcctctgagccccacgtgacgggggtggagccgagggcagagaggagcacctcgccccttccacccttctgcaaggcctcctggattccccgagctccccacaagatgacaggcgcatggtgggggcaggcagggggatcatcctcccaggccggggttggggcaacaggcaagtggtggctggaccgcagggggtgagcggtttctttcaaggcctcttgcctctgggcgctgttgagacagagtgctgggggtgcggggcgtagaggggcctggagccccgggtcaggctggggcgggagaagaagctgtccctctctgtgtctccagtgaaggataaggaggacacccaggtggactctgaggcccgaccgatgaaagatgagaccttcggcgagtacaggtgagccggggcaggagtgggtgctggcactcagctccaccctggccttcacatctcaccccctctctctcttctctgtgctgccgggtgacttcaggtccctggagaggtaaggcaggggcggtggggaggggccaacagcaaggtctccctatagacaatgtgcgcctggtgtgccattgtcccctggctgccggggctctgacaggactctcacttcccagcccccaggcccggcagctcctcatttcagggagaggccaacacgccccagcccctcctctccacacagataccttcactgctcccctctccccaagggaggccccagacagcttcccagacaggaaccaggccccataatcccctggccgagcgcacattttctccctcacagtccccaggatctggggaatgcccaaagatgacagctccagacctgcctgccagggtggccagagctgctctttctgagcgcattctaaacaaatggaaggcaggcgggcgtctgcctcacccccagccaggctcctgcaggggctcggcagtgctctcactcgcacctgccctgtgcctctgcagtgacaacgaggagaaggcctttggcagcagccagccatcgctcaacggggacatcaagcccctgggcagtgacgacagcctggccgattatgggggcagcgt

SEQ ID NO: 4066 - DNA, 951 bp, human
atccgaattcgtcttctctgtgtgtaggggcttgggcctggcctcagggctggggtgagagcctatggctctatccaagtcactggtggtttccagacccccaggcaatccctgagctggaaggcattgaaatcctcaactcaagtgccgtgctggtcaagtggcggccggtggacctggcccaggtcaagggccacctccgcggatacaatgtaagggttgaaggcatgggggcccaggagggtgatcactgaggtaaagcgacaggatggtgagggggctttgccacctgccagccgctctcctggaagacttgggttgagaggagggtccccattaagggtggtgggggtgtgcgctgggggccctgctgggtgccttctgcccctgcgaggtctcctgttcgcttgtgcaggtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggaggtgagtcctgcaccccacgcctcatcccctgccctcctccccagacctgggcgaggacctacctgccactcggttctgtgccctgcagtgcctggccaccccgaggcgttgcacctggagtgccagtcgaacaccagcctgctgctgcgctggcagcccccactcagccacaacggcgtgctcaccggctacgtgctctcctaccacccccgtgcgtgcgccgccccagcagggaagggaggtggaggggccacggggagggggcagagctgcagccacagccaacccctgtctgtccccacagtggatgaggggggcaaggggcaactgtcct

SEQ ID NO: 4067 - DNA, 24200 bp, human
catcggcatcgcagacgcgctcgggcggcgggtccgaggccggcgtgcgcggaggctgggcgggcagcccgagcggtggccgcagcgcaggtaaggcgggctggcctccccgtgcgacccgggccgcggccgcgatcccccggcgacaccacaccgctctgcccggggtgcacggaccagggagtcccggcccggtccggcccgcggtaaccggcgttgctgccggagccccacccatgccgggcgtcgggctccgggcaccgcgggctgtaagcggggcgggggagggatgccgggtgcccgagcccgacaggtgaggggtaacctgcggggccccagatgctggcctgggcgggagaacagggcggggggcgtcaggcagggtctgtgtgggcaggcgggggctgaagttggcgggtccccgtgcgtgtgtgcgtgtctgagaaaggaagccagatcgggtcgagcgctcccccacaggccgccgtggggtgtggccctgggcgtggctgcccctcatccccagccgagagctcagtttggttgaaaatcccggctgacagcgtggtgaggggtagatcgggataagccgcccctgcaatggggggaggggagtgaacgggactgggcgctgcctgcccctccgccccaaggttgggggggctttgttctcctccttcttctttccaaatcccagcctgggctcctccgggctcacccgaaaacctgccgcagagccaggggctcctccccggaggcgtagggcgcctctggagcccgtttccacaggctctgtggccagtcagggctggagtgggtgaggtcggttcgggcacccactgctgtgcctcccgtgcatgggtgtccatcaggtagggtccatcaggtaggggtgagggaaggtgggcctcactggctcaggcggtccctgcgcactgcaggtcttttgcccactgccacatcttcctatctctgtgcggttatgggaggggtcagcgattcctattccctccattccaggtcagacttttggggcctcttggttggcagggattgcaaagaacacgcactacaatccattgcccccgacagggtatctggaccccccacctatcactgtccctctcaggaaggcaggcctagagccatctgcccccttctccagaaggagtgggggcctggcaccccccaggtagataccctgcccctgttaaccccaccctgagggcaggggcatcggggcagcccagtgccatctctgctgactcatgtggccctgacgtaaatcagtgcagtccgcccttcttcccctgggggctgctgcccagcatcatctttctggggcgggggcctccccagggcctctcccctcccgtcagctccttgctgcaggtggtgggacttggcccagcctggcctctcccctggcacagctcccatgcagtgcccacatgtgcacacctgagggctccagagcctttgaggactcggctgtcttggccacatgggaagtttggggcagggttgggcctgggaccttcccacctccttggctcctggtcatttctctctgctgcatctgagtctctctccatatttattgatgtttgtgtgtgtatgatcccgaaagtaatacatcttattgtaggacacttgaaatatacagaaaagaacaaaagaaattaagaatcgctagtgatctgatcaccaagagggaaacacgttcagcacgccccagcctccctggtttgctacaccgcgctcctaaaaggctcctccccaagttcccagctgccagctccctgctgagcatcaggaggacaatcagcgcttcaaggtggcggggtcccctgccctgcagccagtgaagagcttccctacccaggcgctcaggatcccacgatgggcagtcgtgtactgggcagctgctcatggccagtgctcctttgggccgggctctgggctgcccatggaagagccagtgacaaactggaccagcattgtccctgtcttcgtggggtgtcacttgttttcttttttcttgatgattatctgaagggaaaagggaggcaaagagtgaggaagggcctggcctgagggctcctacagtgagcagggtgcccagattgtgcccccaatcggcctctcccaggtccgagccctttccaccactggaactacagctggcgccttccttggcatgcacctggccaggactggcaggtgagggtcgaggagacaggcctgtgtgccctaccttgatcaccaagttccctttcaaagctcgaaatggctgcactgagtgcttttctgggtgtgagggtgatgcggcctcgcagagtggcccaggctccaggagggcacgttcatgggagaacctggggtagtggtggggtcctgtgaggaggtctgccaggatggggatcccagccaagaccctggtctgccaggcatgagtgggggcatgagtgggggccctgcctccctccctcgtggttcagacagtgggggaggcggggggtctggatgcccttctagggtccccagcagggtgctcattgccctgtcctctgcccctgcaatgggctggggctgggtccctgggtggggccatctggaatgggcctgcagcatccctgcccctgcagtcgctgtcttacttgctctgatctggcccatctcggacacctccttctcctgcttcccccgcccccctgctctctcctctgcagcctcccacgtctccctgtgccccacccccagggccatcaccttcctcctccttctaggcagaagcctgctgctgccggggatggggtgcaccactccccgtctcctccctctgcctctgcctgcctggccctcccttccctcttcccccttcccgtcagggctctgctccatctctctgcttacccttttgtctgtcttccaccgctctgctcctctccttgtcccccccagctgcccctgcctcacccttgagggccctgaggttgtgccctgtccagcagccactcagcacccttctgctggactctacgccttggggttgggcccagaccccccatgggggccttgtctgagtggaaggctgtatggggggtgcctggtgagcagcagccagacgagcactgggggaggtagcccgcccagcttgcctcttccccagatatcaacagggtctttgtggcttcctgaaggctgtggctggaaaaagagggaggagctggggagggtctggccgctgttctttctagaagcttttctttgtccagtggcccccagcccaggtccccgtgttcttcccaggttggaaagctgcagagggagtgcccagccactgtcagtcagcagctcctgctcatctctggcccttacacccagcaggggcagctgcgagggccaggggttgggtggggcaggagggtggcagcgtcctgggctccatgcacttggccaaagaggacttctgaacccgtccatcccagtgcgggtctgagagtggaacttgagggaaagggactgagtcccgggagcccctctgccccctgccctccagccaggcagacttcctatctgcatgtatggggtttgtgtctctgcttgtgtgtgtgtatttgtgtgtgtgtaacctccagtattcctgtttgtctgggtggggtcatatatttggttgcatgtgtgtgtgtgttcgtgaaccagcatgcacacacatattgtcatgaggccacgtgggtctcctcagatgccccaacagggcctgtgctgggaaggggtggggctgagggtggctgctgcagtggctggatggggacagagcctctggccaacccaggctgtgcttcagtggaggggggttccctgtggccctgtctcccagccatctgcgtctgtgttcatgacttaggaatgcccaagccctggggatcacagaggccccattgtccgcccccgggcttcctgtgtccccctctgccctttaacccctcgggagtggggcccctggagggggcccgtggggcctggcagtgtctgagctgtttccaggcacccccaccccgccccccgcaaaccaacacaggctaggtatcccaggactgctgtgggccagggcctctccctgccccaggctgggctccttccctgctctccttttcaggccacagccccaggaactggatgcagtctgttccttctggcctggccgctgaagccccctctagtgctagggtcatcctagctccctgaggaggcctggggcctgagaggagccctagttttgctgccacctcatttctctcgccttctaggggtctcggaggctgaagccttgccgcctgctgggcatcagtatctccttcgacacaagaatggggccactgctgtccctaaatgctgattggagaggggcctctttgggaggggttctggagcctctggttgcaagaaaggtatcagaacaagtccagattccagagagcagaagaggggaccaagaaaccagcctgtccccaagcccaaaagggaaaggagttggccttctcttggactgagtacctggatgggggacttgggggtttgtttggtgtcgggcttcagctctgtgctgagacgtgatgttgatcacatcctacttccgcatggcctccatcccaagatgtcactccctgcccccgacatttgcctgccatctgcctggcaagtaagccctccccacggggcaggatggcttggaggccatcctcgcccaggcccctggttccctgggaagcccagcaggcacacatgttgggatgccagagcctctgagaggcagcttagggagccaccacgccctctaaaaccccacccctgctgagacccagtgccagctctgtgatcttggacacagtttccagttttctgagcctccgtgtcctcatctgtaaaatggggatgatgatagcacctccctccctgaggcaaatctggggaggagatgagtggatgtgagtggaagtgctcatgaggctttctggtacgtggtaagtccacgctgtaagttgatttaatagaacagaccacagaggcatgtgattgtggggatggagtggggctcctccctcccttccccagtagtcaagaccgtcctccctgaaccccacaaagggttaacctccgtctcttttccccatcttttaaggagaatggtccattacaggtgagttgtagttgccttggagactgaagcctcaggcgagatgagggggctgagggctcactctctcctaagggtaccctcttagggaggggtgaggttgggagtgcagggactaagcagcagtcataaaggacttctgggcccccaggtacctgtgggggctccctggagcagccccctttatgtgctgtctacataacacataacaaggctttcctctggcttcccccacctctgggacttgggctgcatcaccatagaaacccgccagccacggcctggggagcggggcggggagggccagcgggagccttaaagggacacagtgcacagggtgtaggtgacacccacaccatcgtatacacaccaacaggcacagaagccccccaggctcccaggcctgcaagcacatgggcccagcaccacactctgaccctttcatgtgccctgtgctgagcccccagccccacccccactctggcccactgagtcaccaggcaccatgtccccaggagacaagggcaggagaagccggatagtctctgctgtgctgttgaagggctctcttgttgcttctcctttgagaggaactccaggcagaacctgagaactgacaggcaggtgtgcagggcacatgtgcagggcaccgctggaggttcccttctcaaggtgtgtggtggtggtggtgatggggtgtgtgtgtgtgttttcagggaggaggcagtcactccaggtctagccaggctccacaacctcccaggtccctccctggcaagctgcttcccatcagaccaaagcaggcactttggagcagaggacagaggactccctgagggacctgcgggtgtagtgggaggccaggtggggtgggatggggcaaggctcttctggggctgaacccctccctgtaggctgctgggcgtgacccttgcctccctggccctttcccaccggggaggatgggtttgggaccggacttactcaggaatggccccatcttcaactgccccagcacagcggccactgtccactcagtgcatggtcacgcaggctcactcttggcctaacacatgtgcgtctcctccagccaggtgaccacttactcccagccagcagcaatattggaaggcttccctgggattttctgggtgcttccccctccccccgttcctacccgcagcaggaatcccccgacccccacctgttccctggcatggcatgggtcagccagcagtgtgccattcatcctgtctcacggccgtcccttgcccagtgccacaagtgggcagggccttgatgctctgttgcgtggggctttgtaggcccctccggccccagctcacagctgctccaccctctgtctgtctctctaccctgctcccaggccagcgtgacgtccacgccgggaagcccctccactgacccaggcccatcttccctcctccccgccccttgcctggcacagcccccagggacaaggacgctgtgcaggcggcctgcgcgcacgcgcacgtgcacacgcccacccccacccctcactcttctcgctctttctgccatttctcagcggcgcactctgcagctgcctctcaccctttgtgctccggtttcctcttctctccctttctctgctgcctgggtctccgtttcggaatttccccaccccctaaccatctccatcgtggttagcgctgtcttcctacgtctgtctttgtctcctgctcccccctgcctcttctcactctgtctgtcacccttggcagacccggccttggctccatctgtggaacactcccccctccccgctcctttgcccttagtggtgctggtggggggtagagggcctgctgagctgacaaccctagctgcttgctctgtaattgcctgaggaatggtgagagatcagagacccagcagcagtgggaggagaggagggagcgccccctcccagctgttatatctcgcaaccttctggctgcttcctgcctgtctccgactgcccagggcggtggcaagctaggtggcaaatactgggagaccaaaaaagaagttggatatgagcctgtggggagatgggatggggctgggatggggcagggagcggggaccaggggtttggggatattgtatttcccctgagcgtacatgccaaacaccattccaggattctagatttggaggacaaatagaggaacttgcgtggcagaaattatcgacctccagagcacccaaaagcctctgacatgcaggagggtccttctttgagcttttccttgctccggtttcctcccctccccctcctaagaccagtgctcagagctcccaaggctgctgtttgatcatctgctctctgatccgagtctcctactgctcctacaggccttgaagttgaggccagtgctgcctggggcctcccctgatccactggctttgtagggagaggccggggtggaacagatccactgttgctcttcccttctgggcccaggtccagctcttgcaggctgggaatcactcttcttaccctccaagtcatctcttggcctccaggccatgcacgctgacccaccctgctgcttctccaccaccctctgcagcaagctcttgcccagagtccccacgggatctgccgcattcacagctcttcttgggtcactctgttacacaaaactgacaaggcccagagccttagcacagcatggctgacttctctaccatcctttcggtgttcctgctgaggctcggtgcccgctttgataaggtcctggctgggcagagggaggatgcacagtatggatttaatgaaggcgtctagtctgggacttcagcctccaagctctgtcacctaacaacaccctttcttgccttgcctgcactttaaccacttcctgtttggaattgaagtggtctggccacttgggagtctgtttcctcttgtcattgtcagaggagccccctctttcagacccttagtctttggctccccttacttgtaggtgaatatggacatggccggtgtggcttgggtttggggtggacacatgcagcagttgagctctgaagactcagacaaagacctagaaattgggactttgagacacacaagaagtgttagaaacactgtcacggaaaatgtcccagagcttgtcctgacccctgtcctgaccctaacctggagcatctggaagggaggaggcctcagtggcctctcttgacccccagggggctgaggagcagcagggggttgttttcctccttcctctcttctcccacaccagttctcaagggaaggcttccttccccattctttctctcttttttttgagatggagtttcgctcttgttgcccaggctggagtgcaatggtgcgatcttggctcactgcaacttccgcctcctgggttcaagagattctcctgcctcagcctcccaagtagctgggattacaggaatgcaccaccacgccaggctaactttttttttttttttgagacagagtcttgctctgtcacccaggctggagtacaatggcgcaatctccgctcaccgcaacctctgcctcctgggttcaagtgattctcctgcctcagcctcctgagtagctgggattacaggcatgagccaccacgcctggcttttttttttttttttttttttttttttgtatttttagtagagacaggatttcaccatgttggccaggctggtctcaaactgctgacctcatgatccgcctgcctcagcctcccaaagtgctgggattacaggcgtgagccaccacgcccagccctaattttgtatttttactagagacagggtttcaccatgttggcctggctggttttgaactcctgacttcaggtgatccacccacctcggcctcccaaagtgctgggattacaggcatgagccactgtgcctggccttttatttttatttttatttatttttttagacagagtctcactccatcacccaggctggggggcagtggcacgatcttggctcactgcaacctccgcctctcaggctcaagtgattctcatgcctcagcctcccaagtagctggcattacaggcgcccaccaccaaggctaattttttttctttttgtatttttagtagagacggggttccgccatgttggccaggctggtctcaaactcccaacctcaagagatccacccacctcagcctcccaaactactgggattacaggcgtgagccaccacgcctggccctttccccattctttcttcattttcctgaaactattttgtgaaatgctgccatcttgggcccctttcctcccttctctatcccacttcccaatccccccattagctttttaggtctgtacagcacccaggcatcagttggctctgaaagctatagcaatgtgactgcaagaagaattcttctctacatgtgtgtgcacacagagataatagatacagggattcatccccacagatacataaagacatacaagaagacacacgtagctagcagacttgtgtgttgattccctcaggcacacacactaacacacccactcatgagtgcaacccctcccagagaagacacaccacagaaataccagctcacatacagctcactccctgcttgcagatccacaaccacacacatgcccacggacacctgcacatgcagacacatacggggatgtgcatgccatgcacaggggagctgatggggcaacaagttggtgctgggaaggcagctggcaggaaaggtgcagacagagagtagagagggaataaaaggcaacctagaggcccagccagggctatctcttccagatttctccctccaaggtggggaggggtgcggatggggaggggagggctggagaagccggccagctgggggcggggctgagggcggggccaagagcccgggcttacccagatgttagtcactaacgtccttccgttctctcgtctctcttcccccacccttcccttcccttctcccctctcccagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaatgtgagtagctgaagggagcctgggcgcctaccttcgccgctatgttgggcccctctttatcttctacctcctcaccttctccctgttccggaccctgactcctctccctggcctttcctgggcacagggtgggcaggagatagccaggacgttgggtacccccggagagaagggcagggtagaaggtgcggggcgtgtcaggaccatggacagggacaggcgcggccgccggggcgatttcagcaccagggacagcgaacctggagcagggccccgaggtcttgggcctcctccatgctctccttagcccgccccatctctgcccgccccactccgactcctccgcttccatcccccaccacaggggtgtggcagcaggagaatggggtcgtccccagccctcagctggcttgtgcaaaggcctgtgttcaagtcttgtccccatttctctttcccctcctgggcccttggtcaccctgtctctgaactgagacaggaaaaggtggcttgaaaaaccctggtcccagcccagcagccttctggacccttttttgtgtgtagttatttggtgggggtgggggcagggctgctggagcatgtgtctatggttgtaacatttgttgggggcacaagcaggtgagtggatgttggggagtgtggccgtagggttgtgattaagcatggatacactgtgtatgtctgtgtgttcttgtgattgactgagcgtagatattcgtgaatgtgattttgacttccttacatgggtgactgtgtgagtcactctgttacttactggccaggcttgtggaggtcgggaggtatttgaccacgacatttgattgcattgggtcatgtgtatgtgtgagtggggctgaatgtaagtacacacttgcgtgtggggggtgttaccgtgatggtgttttctcctgtaagtagctgtcaggccgtgtgaggggcatgtcacagggtatcatgtgtgagggcatttgtgtctcttgagctaccaggctccagtcccttcccagcctcaccttgacacctttgtctctgggcctggacaaggaggaggccagtgtcactgagagacgagttggcggataggggttgggaagactgtctgtgccagcagtgggacaggggctgcgagagagaggctggggaggcacctggcgttgggaggcagtgagggcttggaggaggtaaaggggctggccccttagacacatacatggagggccagggccaggcagactcccttggtacagatgcacatggacacatgcacacaggtgcatgaagacaaggcaggtgcagggatgaaggagcagagccgctgagaggccacacaggtggaaacacacaccagtgaggcttttagacccagaggacacagaggtggatacacaatataacactgtacagtggaatgcaagccgtgcattctctacagaaagatgggagtggggagagagaactaggccaaaaggccatggcagctccaaggctgccctggtcactgaccagcacttgttcttgaccctgatacgacacagtgggcagtggcaggcagccggccctccctgttggaacctgtcttccatctctccctccccagccactccagccccctttgtctcttttcctgcttcctccacctagttggctttctgcatcctgtcatccctgtcaccatctccctccccagctcagggccctctgcagtgtccccagggagccccctcctccctccctggaccttcacactgaggtcttctgcagagacaaagctttcagaggcagcctgctgctccctccctccctcttctcccttcctcgaggccgccctggccagtgctctgcagagtcctggggctgggacagcagctctggcctctgccccagagagcttggtggctgtctgggaggaaggagggagaagaggagggctggcgccaaccccgcaggctatggaaactcagaggcagcagggcctttgggatagttttcagggggagggggcagcagggctctgaaggctgggccctggtaattgaaaacactcagctgtgctaattggattaggagggaagcaggctggagcaggggacggtgccttccaaggcatcctgaatgggtggggtcagttctgcaggccctgccaggccctgccagggggctgcaaggacactccttgttaaaggcaagaatttctctctccctgtctgctagagctggaggcatggcctggctgcctctgggctacatgccctgtgtgtctatccagtggagctcctctccctgggcatctctctgtcccatctccctgggcttgacctgccactgctccagcccagcgtgtgcccccttgttgccactgccagggcctcctctcctgccattccctctccacgggggggctgcaggagcttactatgtcccctgccatctgccccactctggggctgcctgtcagtatttctctccattccctcccttgctgcctgcctggatttctcagatgaaggacaccatggtaagttggggaggggtgagagtgtttcccagaaggccaaggagaagggtaaggaggccctcagctgagcctgcacccccgccctcctgagtgccggggccctgctcggctctccctgagcaccatgtgcttctctcacctgtgtggggctggctttgttctgtctctgccccagcctgggtactctgtcaccctcactgttcctctctgccattctctctggtcccttctcccctgtctggggtttgtccttcttggtttctgtgtcttggcttttgttgcccccgcttctttctgtcataccctttttgtctttctcaggcatctctttgtaacttacgtggctgtcccctctctccctcttttcatgtcccacaagcctcttttgttcttcccctccgttcgtccccctgtggccatggggcctccaggggctctggaccctgcttccctcacgatgggacaggtgctgaggctatgacaccagccaggcagcaccctcaccaccgctctctccaccctgtcttcagtgatggagccacctgtcatcacggaacagtctccacggcgcctggttgtcttccccacagatgacatcagcctcaagtgtgaggccagtggcaagcccgaagtgcagtgagtgatctctgccgtctcagcccctgttgcctgccactgaccccggccttgtgcctccctggactgcctaacttctaagcccagaagccccaaaccttgctaatcaccccaagtcctcgccatctcccagtccatcccctgggggccctggctgcttgcacctgtccctccagcctgttccagcccccgttgggttccagggcctcaggcctctgggcctttttccgcccacaggttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcgaggcgctgcagggaccagggagggcaggtcccggagttcgtgtgggattgtgggctggaagctgctgtcagccagttgtctcgtggcgaggggcctgggtgtcctgccagccctccaccccaccccagcttctcccctggcccatcttgtttcttgtgcagtctcctcctttgccctgtctctgtctccattgcacttccggtcatctcatgccctttcactccctcaggctttcctggtgcctgcctcatggctgagcaggaaggtggcggggggaggggggggcgggctggtggggggagtgactgattctgggcagacctgcctgagtcactgcagtcatctctgtctacacctgcactccttagcagggcccctcttctctggcttttccacttggctctccatctcctcccctccacctccgacttggtctctcttgctccacggctctgtcttgatctgtgtcgccttttccctggggttttccctttgcattccatcctccctgagctttctgcttcctgagcgctctcctctcccctccccacccctccagttaccttgggaaccgttgccatggtttctgtgtcaggatgatggaagggtctgtgactcctgcatccctccacagctcccctcccccatcactgcacctcagcctcagcctccccccacccgtcctttcctagggtgggcagggagagctgagaaccgtggaaggttaacccttcctggcctcctggtctcctgctcaccctggcctccctaagtgctagtctctgctatgagtccagaaggtatccagagtgtctgcctccttttctgtgaagtttctactggcctgaccctctcgccccctcgtccatccctggtgtagcccgccacccccctgcccccacctcccttctcctgcctagcaccatctggaccaggaggagagtgtcagcccgtctgtcccttctaggtgcccccaagtggccaaaggagacagtgaagcccgtggaggtggaggaaggggagtcagtggttctgccttgcaaccctcccccaagtgcagagcctctccggatctactggatgaacagcagtgggtgccggcgagcggctgcctcgtggggtcggggtgttagcgggggtgtcttcctggacggggtcatgacttcggcctccttgccccctgcagagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccagtgagtctcagaggctctgcactctctccctgactcctttcaccctcaggcatggcccttcccaccataggtccatctgacaactccaggcttcctcaagaacagcttggctcccacctctaccctgcccagaccccttcccaggcgtcgagagcagagacaggacactctccttaatggaggaagacacagaggccccgggggctggctggagtgtcgagtccctcagccttgcaattctggggtggagggaagagtgggcagcccacccacccactttctcctggcagccaacagcatgattgacaggaagccgcgcctgctcttccccaccaactccagcagccacctggtggccttgcaggggcagccattggtcctggagtgcatcgccgagggcttgtgagtctgggaacccagggcagggcagggcagggcagggtggcggagccctagcagggagctcagaccaccgcggggtatagggggctggggtgattggccttgtcctttctcccttctgctctcttccctttgcctcccgggcagtcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggagggtatggacctcctgggacagtggcctgtgatgcccactgtcatgggggaggggagggtctgcgccgggtcaagagccagctgctggctgcgggctcagggcggctctccccttcctcccagctgccccgtactggctgcacaagccccagagccatctatatgggccaggagagactgcccgcctggactgccaagtccagggcaggccccaaccagaggtcacctggagaatcaacgggatccctgtggagggtgagcagggcctcaggcaggagtggggagtgtggcgagccctgggggctgtgggggagaggaagaggagggtgaggaagggcctcaacgcagctcaatgccgggctgtggcccatgggcccacctgctgcatgcacagagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccgtgagtgccctcccttccttacctcctaactcccagtctgtccctgcagcccactgggccaggccaccagagtggctcagctggcagctgatgtgtcctcggcctaccaggctggcgccgacctttctccttgctgacacccttcgccccatctcactcagcctcacgatagccgagggagatgtaagaggggaaaggtcttgtcactgtgactgagcggaccgctgtgccacaggatgtgaccaaggccagcccaggtggcacctctcctggaacttcagggaaggctggggactaggccaggaaggcttctggggagaggtgactgtcagttaggcctggaataacgtaaaagttgggtggctgtgaccagaggcgcatctgaggcagagggcagtgtctgaaggcagagagagacacagcctggcgggggcctcagctgggagcagggaaccaagatttgcagggctcttgggggcccgaggaagccgtgcagagggtccctggctcctggcccagctgtggtcccaagtcctgccctgtctcctgaggctgttcctcccctagagctgccagccaagatcctgactgcggacaatcagacgtacatggctgtccagggcagcactgcctaccttctgtgcaaggccttcggagcgcctgtgcccagtgttcagtggtgagtgtctcgtcctggtagtggtgagtgtcgtgtcccagtggccagggagccagggagggcagggagcccaggccagccagtcagagccaggcccgccctgctccctccaggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaaggtcaggcaacccttgccacatggctggcagtgcctctgggagggagggtctgggcctctggaggacaacagagtgacttccccacgcacgcattaccctcagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtgaggacagtgacggtgaaagggggcagagtgggaaaagctggaagtccagacctcttggcctcgtccttgctttgatggggaaggctctgacaggagcgggggaaggagacaggagggagggatgggaggggagaagagcccagatggcaggaaagacagacacggctcctccgcaggtacttcatagaggatgggcgcctggtcatccacagcctggactacagcgaccagggcaactacagctgcgtggccagtaccgaactggatgtggtggagagtagggcacagctcttggtggtgggtaagtcctagggtggaagcctccactccagaaggccggggctcacatccctgggccctttcaagcaccgaccctccccaccctcagggagccctgggccggtgccacggctggtgctgtccgacctgcacctgctgacgcagagccaggtgcgcgtgtcctggagtcctgcagaagaccacaatgcccccattgagagtaagaggcttgagctcagtgccaccccaccgtcacttctgccagccctggcccctcctggggtcctccctcctcctggagccttcctggggggacacggtttggggggactcacggttcctcatgggaatctggagatgccagttggcctgggtaatcagggacccagactgtacccaacccctccacagcccttcccccaaagccacatgctgatcactccattgtcggttcatttcttggcagaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcaggtgagtcagggtggcacccactcccatgccacctggaaggggctccgggctgtgaagggagggcttagagaggtgccatgcccaagttcctctgcttccaaatttccagggggagcgcgagggggctggactcccttggtgccagaatgagccatttgttccttggccctcggtcctcgtggctctccaaaagaggctgcagcattgatgtgttaatactttcctttccagccccagagaagaaccctgtggatgtgaagggggaaggaaatgagaccaccaatatggtcatcacgtggaaggtgagagtccctgggctgagctgcctgggggacatgaggccatgacctgggtgtctgttgctcccccttggctatgcaaaggaaggggctgatgtctggggatgctggtttgtgctggggggcgggccaaagaatgctggtgttcttggccaaccaactcctcttctgctggcctcctccagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactgtgagtatccggcagggcccctcgcccacggttgagctcgcctgcttccaccccagcccatgtccacacctctcagcattggtgtgcgcctttcctaaggatgaggatattctcttacataaccagagcgacgttatgaaattccccacacttcacatttctataattggcagcggtattccagttatatcagccaatgctgcttctttcatttccttgaatctggaacatgaccagatggtaacttgaagtacccggtcaagttttttttctggtttctcctttttttcttttcttttttcttttcttttcttttctttctttttttttttttttgagatggagtcttgctctgtcatccaggctggagtgcagtggagcggtcttggctcactgcaacctctgcctcccgggttcaagcgattctcctgcctcagcctcctgattagctgggattacaggcacgcgccaccacacccaactaattttcgtatttagtagagatgcggttgcaccatgttgatcaggttggtctcgaactccagacctcaaatgttccactcgcctctgtctcccaaagtgttgggaatacgggtgtgaaccatcacgcccagccatggtttctcctttgtataagctactattttcacctttgcaactaataagcagtccaggaagagatcttgagaccatgcaaacacacctctcctcctcaaactgtacctcataaaatatccgaattcgtcttctctgtgtgtaggggcttgggcctggcctcagggctggggtgagagcctatggctctatccaagtcactggtggtttccagacccccaggcaatccctgagctggaaggcattgaaatcctcaactcaagtgccgtgctggtcaagtggcggccggtggacctggcccaggtcaagggccacctccgcggatacaatgtaagggttgaaggcatgggggcccaggagggtgatcactgaggtaaagcgacaggatggtgagggggctttgccacctgccagccgctctcctggaagacttgggttgagaggagggtccccattaagggtggtgggggtgtgcgctgggggccctgctgggtgccttctgcccctgcgaggtctcctgttcgcttgtgcaggtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggaggtgagtcctgcaccccacgcctcatcccctgccctcctccccagacctgggcgaggacctacctgccactcggttctgtgccctgcagtgcctggccaccccgaggcgttgcacctggagtgccagtcgaacaccagcctgctgctgcgctggcagcccccactcagccacaacggcgtgctcaccggctacgtgctctcctaccacccccgtgcgtgcgccgccccagcagggaagggaggtggaggggccacggggagggggcagagctgcagccacagccaacccctgtctgtccccacagtggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctggtaagctggaggaatgacctgccaacagggaggccccggccagccgggtccaggagggagggccttagacttcctggcagctgccacactctcctcgttcccctgcatccccccagggatctcagattttggcaacatctcagccacagcgggtgaaaactacagtgtcgtctcctgggtccccaaggagggccagtgcaacttcaggttccatatcttgttcaaagccttgggaggtaagcgtgaaagggggccttggggcgtggtggggaagggggctctgggccagaggggttgcctggcactccgactcacccctgctgccaccctctctccctggcagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggtgaggcgccgggggcccgccatcacctgccagggaagcatgggggctgcacaattcatgtccttctgtcccctgaatggccactactgcccaggctccctccacggctcctgtctgcttctcctcccagaatctgggtgtccccgaatcagccccctttcataccctttccgcagatgcccttttccctgtccctgtcactccttagccccccagagggccccaactttaagagcatacttcagggcctcaggtcgggttctggcttgggcggcagcacggggggctggtgtctcaccctcaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcaggtagcctctgagccccacgtgacgggggtggagccgagggcagagaggagcacctcgccccttccacccttctgcaaggcctcctggattccccgagctccccacaagatgacaggcgcatggtgggggcaggcagggggatcatcctcccaggccggggttggggcaacaggcaagtggtggctggaccgcagggggtgagcggtttctttcaaggcctcttgcctctgggcgctgttgagacagagtgctgggggtgcggggcgtagaggggcctggagccccgggtcaggctggggcgggagaagaagctgtccctctctgtgtctccagtgaaggataaggaggacacccaggtggactctgaggcccgaccgatgaaagatgagaccttcggcgagtacaggtgagccggggcaggagtgggtgctggcactcagctccaccctggccttcacatctcaccccctctctctcttctctgtgctgccgggtgacttcaggtccctggagaggtaaggcaggggcggtggggaggggccaacagcaaggtctccctatagacaatgtgcgcctggtgtgccattgtcccctggctgccggggctctgacaggactctcacttcccagcccccaggcccggcagctcctcatttcagggagaggccaacacgccccagcccctcctctccacacagataccttcactgctcccctctccccaagggaggccccagacagcttcccagacaggaaccaggccccataatcccctggccgagcgcacattttctccctcacagtccccaggatctggggaatgcccaaagatgacagctccagacctgcctgccagggtggccagagctgctctttctgagcgcattctaaacaaatggaaggcaggcgggcgtctgcctcacccccagccaggctcctgcaggggctcggcagtgctctcactcgcacctgccctgtgcctctgcagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctc

SEQ ID NO: 4068 - DNA, 14426 bp, human
tgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaatgtgagtagctgaagggagcctgggcgcctaccttcgccgctatgttgggcccctctttatcttctacctcctcaccttctccctgttccggaccctgactcctctccctggcctttcctgggcacagggtgggcaggagatagccaggacgttgggtacccccggagagaagggcagggtagaaggtgcggggcgtgtcaggaccatggacagggacaggcgcggccgccggggcgatttcagcaccagggacagcgaacctggagcagggccccgaggtcttgggcctcctccatgctctccttagcccgccccatctctgcccgccccactccgactcctccgcttccatcccccaccacaggggtgtggcagcaggagaatggggtcgtccccagccctcagctggcttgtgcaaaggcctgtgttcaagtcttgtccccatttctctttcccctcctgggcccttggtcaccctgtctctgaactgagacaggaaaaggtggcttgaaaaaccctggtcccagcccagcagccttctggacccttttttgtgtgtagttatttggtgggggtgggggcagggctgctggagcatgtgtctatggttgtaacatttgttgggggcacaagcaggtgagtggatgttggggagtgtggccgtagggttgtgattaagcatggatacactgtgtatgtctgtgtgttcttgtgattgactgagcgtagatattcgtgaatgtgattttgacttccttacatgggtgactgtgtgagtcactctgttacttactggccaggcttgtggaggtcgggaggtatttgaccacgacatttgattgcattgggtcatgtgtatgtgtgagtggggctgaatgtaagtacacacttgcgtgtggggggtgttaccgtgatggtgttttctcctgtaagtagctgtcaggccgtgtgaggggcatgtcacagggtatcatgtgtgagggcatttgtgtctcttgagctaccaggctccagtcccttcccagcctcaccttgacacctttgtctctgggcctggacaaggaggaggccagtgtcactgagagacgagttggcggataggggttgggaagactgtctgtgccagcagtgggacaggggctgcgagagagaggctggggaggcacctggcgttgggaggcagtgagggcttggaggaggtaaaggggctggccccttagacacatacatggagggccagggccaggcagactcccttggtacagatgcacatggacacatgcacacaggtgcatgaagacaaggcaggtgcagggatgaaggagcagagccgctgagaggccacacaggtggaaacacacaccagtgaggcttttagacccagaggacacagaggtggatacacaatataacactgtacagtggaatgcaagccgtgcattctctacagaaagatgggagtggggagagagaactaggccaaaaggccatggcagctccaaggctgccctggtcactgaccagcacttgttcttgaccctgatacgacacagtgggcagtggcaggcagccggccctccctgttggaacctgtcttccatctctccctccccagccactccagccccctttgtctcttttcctgcttcctccacctagttggctttctgcatcctgtcatccctgtcaccatctccctccccagctcagggccctctgcagtgtccccagggagccccctcctccctccctggaccttcacactgaggtcttctgcagagacaaagctttcagaggcagcctgctgctccctccctccctcttctcccttcctcgaggccgccctggccagtgctctgcagagtcctggggctgggacagcagctctggcctctgccccagagagcttggtggctgtctgggaggaaggagggagaagaggagggctggcgccaaccccgcaggctatggaaactcagaggcagcagggcctttgggatagttttcagggggagggggcagcagggctctgaaggctgggccctggtaattgaaaacactcagctgtgctaattggattaggagggaagcaggctggagcaggggacggtgccttccaaggcatcctgaatgggtggggtcagttctgcaggccctgccaggccctgccagggggctgcaaggacactccttgttaaaggcaagaatttctctctccctgtctgctagagctggaggcatggcctggctgcctctgggctacatgccctgtgtgtctatccagtggagctcctctccctgggcatctctctgtcccatctccctgggcttgacctgccactgctccagcccagcgtgtgcccccttgttgccactgccagggcctcctctcctgccattccctctccacgggggggctgcaggagcttactatgtcccctgccatctgccccactctggggctgcctgtcagtatttctctccattccctcccttgctgcctgcctggatttctcagatgaaggacaccatggtaagttggggaggggtgagagtgtttcccagaaggccaaggagaagggtaaggaggccctcagctgagcctgcacccccgccctcctgagtgccggggccctgctcggctctccctgagcaccatgtgcttctctcacctgtgtggggctggctttgttctgtctctgccccagcctgggtactctgtcaccctcactgttcctctctgccattctctctggtcccttctcccctgtctggggtttgtccttcttggtttctgtgtcttggcttttgttgcccccgcttctttctgtcataccctttttgtctttctcaggcatctctttgtaacttacgtggctgtcccctctctccctcttttcatgtcccacaagcctcttttgttcttcccctccgttcgtccccctgtggccatggggcctccaggggctctggaccctgcttccctcacgatgggacaggtgctgaggctatgacaccagccaggcagcaccctcaccaccgctctctccaccctgtcttcagtgatggagccacctgtcatcacggaacagtctccacggcgcctggttgtcttccccacagatgacatcagcctcaagtgtgaggccagtggcaagcccgaagtgcagtgagtgatctctgccgtctcagcccctgttgcctgccactgaccccggccttgtgcctccctggactgcctaacttctaagcccagaagccccaaaccttgctaatcaccccaagtcctcgccatctcccagtccatcccctgggggccctggctgcttgcacctgtccctccagcctgttccagcccccgttgggttccagggcctcaggcctctgggcctttttccgcccacaggttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcgaggcgctgcagggaccagggagggcaggtcccggagttcgtgtgggattgtgggctggaagctgctgtcagccagttgtctcgtggcgaggggcctgggtgtcctgccagccctccaccccaccccagcttctcccctggcccatcttgtttcttgtgcagtctcctcctttgccctgtctctgtctccattgcacttccggtcatctcatgccctttcactccctcaggctttcctggtgcctgcctcatggctgagcaggaaggtggcggggggaggggggggcgggctggtggggggagtgactgattctgggcagacctgcctgagtcactgcagtcatctctgtctacacctgcactccttagcagggcccctcttctctggcttttccacttggctctccatctcctcccctccacctccgacttggtctctcttgctccacggctctgtcttgatctgtgtcgccttttccctggggttttccctttgcattccatcctccctgagctttctgcttcctgagcgctctcctctcccctccccacccctccagttaccttgggaaccgttgccatggtttctgtgtcaggatgatggaagggtctgtgactcctgcatccctccacagctcccctcccccatcactgcacctcagcctcagcctccccccacccgtcctttcctagggtgggcagggagagctgagaaccgtggaaggttaacccttcctggcctcctggtctcctgctcaccctggcctccctaagtgctagtctctgctatgagtccagaaggtatccagagtgtctgcctccttttctgtgaagtttctactggcctgaccctctcgccccctcgtccatccctggtgtagcccgccacccccctgcccccacctcccttctcctgcctagcaccatctggaccaggaggagagtgtcagcccgtctgtcccttctaggtgcccccaagtggccaaaggagacagtgaagcccgtggaggtggaggaaggggagtcagtggttctgccttgcaaccctcccccaagtgcagagcctctccggatctactggatgaacagcagtgggtgccggcgagcggctgcctcgtggggtcggggtgttagcgggggtgtcttcctggacggggtcatgacttcggcctccttgccccctgcagagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccagtgagtctcagaggctctgcactctctccctgactcctttcaccctcaggcatggcccttcccaccataggtccatctgacaactccaggcttcctcaagaacagcttggctcccacctctaccctgcccagaccccttcccaggcgtcgagagcagagacaggacactctccttaatggaggaagacacagaggccccgggggctggctggagtgtcgagtccctcagccttgcaattctggggtggagggaagagtgggcagcccacccacccactttctcctggcagccaacagcatgattgacaggaagccgcgcctgctcttccccaccaactccagcagccacctggtggccttgcaggggcagccattggtcctggagtgcatcgccgagggcttgtgagtctgggaacccagggcagggcagggcagggcagggtggcggagccctagcagggagctcagaccaccgcggggtatagggggctggggtgattggccttgtcctttctcccttctgctctcttccctttgcctcccgggcagtcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggagggtatggacctcctgggacagtggcctgtgatgcccactgtcatgggggaggggagggtctgcgccgggtcaagagccagctgctggctgcgggctcagggcggctctccccttcctcccagctgccccgtactggctgcacaagccccagagccatctatatgggccaggagagactgcccgcctggactgccaagtccagggcaggccccaaccagaggtcacctggagaatcaacgggatccctgtggagggtgagcagggcctcaggcaggagtggggagtgtggcgagccctgggggctgtgggggagaggaagaggagggtgaggaagggcctcaacgcagctcaatgccgggctgtggcccatgggcccacctgctgcatgcacagagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccgtgagtgccctcccttccttacctcctaactcccagtctgtccctgcagcccactgggccaggccaccagagtggctcagctggcagctgatgtgtcctcggcctaccaggctggcgccgacctttctccttgctgacacccttcgccccatctcactcagcctcacgatagccgagggagatgtaagaggggaaaggtcttgtcactgtgactgagcggaccgctgtgccacaggatgtgaccaaggccagcccaggtggcacctctcctggaacttcagggaaggctggggactaggccaggaaggcttctggggagaggtgactgtcagttaggcctggaataacgtaaaagttgggtggctgtgaccagaggcgcatctgaggcagagggcagtgtctgaaggcagagagagacacagcctggcgggggcctcagctgggagcagggaaccaagatttgcagggctcttgggggcccgaggaagccgtgcagagggtccctggctcctggcccagctgtggtcccaagtcctgccctgtctcctgaggctgttcctcccctagagctgccagccaagatcctgactgcggacaatcagacgtacatggctgtccagggcagcactgcctaccttctgtgcaaggccttcggagcgcctgtgcccagtgttcagtggtgagtgtctcgtcctggtagtggtgagtgtcgtgtcccagtggccagggagccagggagggcagggagcccaggccagccagtcagagccaggcccgccctgctccctccaggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaaggtcaggcaacccttgccacatggctggcagtgcctctgggagggagggtctgggcctctggaggacaacagagtgacttccccacgcacgcattaccctcagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtgaggacagtgacggtgaaagggggcagagtgggaaaagctggaagtccagacctcttggcctcgtccttgctttgatggggaaggctctgacaggagcgggggaaggagacaggagggagggatgggaggggagaagagcccagatggcaggaaagacagacacggctcctccgcaggtacttcatagaggatgggcgcctggtcatccacagcctggactacagcgaccagggcaactacagctgcgtggccagtaccgaactggatgtggtggagagtagggcacagctcttggtggtgggtaagtcctagggtggaagcctccactccagaaggccggggctcacatccctgggccctttcaagcaccgaccctccccaccctcagggagccctgggccggtgccacggctggtgctgtccgacctgcacctgctgacgcagagccaggtgcgcgtgtcctggagtcctgcagaagaccacaatgcccccattgagagtaagaggcttgagctcagtgccaccccaccgtcacttctgccagccctggcccctcctggggtcctccctcctcctggagccttcctggggggacacggtttggggggactcacggttcctcatgggaatctggagatgccagttggcctgggtaatcagggacccagactgtacccaacccctccacagcccttcccccaaagccacatgctgatcactccattgtcggttcatttcttggcagaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcaggtgagtcagggtggcacccactcccatgccacctggaaggggctccgggctgtgaagggagggcttagagaggtgccatgcccaagttcctctgcttccaaatttccagggggagcgcgagggggctggactcccttggtgccagaatgagccatttgttccttggccctcggtcctcgtggctctccaaaagaggctgcagcattgatgtgttaatactttcctttccagccccagagaagaaccctgtggatgtgaagggggaaggaaatgagaccaccaatatggtcatcacgtggaaggtgagagtccctgggctgagctgcctgggggacatgaggccatgacctgggtgtctgttgctcccccttggctatgcaaaggaaggggctgatgtctggggatgctggtttgtgctggggggcgggccaaagaatgctggtgttcttggccaaccaactcctcttctgctggcctcctccagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactgtgagtatccggcagggcccctcgcccacggttgagctcgcctgcttccaccccagcccatgtccacacctctcagcattggtgtgcgcctttcctaaggatgaggatattctcttacataaccagagcgacgttatgaaattccccacacttcacatttctataattggcagcggtattccagttatatcagccaatgctgcttctttcatttccttgaatctggaacatgaccagatggtaacttgaagtacccggtcaagttttttttctggtttctcctttttttcttttcttttttcttttcttttcttttctttctttttttttttttttgagatggagtcttgctctgtcatccaggctggagtgcagtggagcggtcttggctcactgcaacctctgcctcccgggttcaagcgattctcctgcctcagcctcctgattagctgggattacaggcacgcgccaccacacccaactaattttcgtatttagtagagatgcggttgcaccatgttgatcaggttggtctcgaactccagacctcaaatgttccactcgcctctgtctcccaaagtgttgggaatacgggtgtgaaccatcacgcccagccatggtttctcctttgtataagctactattttcacctttgcaactaataagcagtccaggaagagatcttgagaccatgcaaacacacctctcctcctcaaactgtacctcataaaatatccgaattcgtcttctctgtgtgtaggggcttgggcctggcctcagggctggggtgagagcctatggctctatccaagtcactggtggtttccagacccccaggcaatccctgagctggaaggcattgaaatcctcaactcaagtgccgtgctggtcaagtggcggccggtggacctggcccaggtcaagggccacctccgcggatacaatgtaagggttgaaggcatgggggcccaggagggtgatcactgaggtaaagcgacaggatggtgagggggctttgccacctgccagccgctctcctggaagacttgggttgagaggagggtccccattaagggtggtgggggtgtgcgctgggggccctgctgggtgccttctgcccctgcgaggtctcctgttcgcttgtgcaggtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggaggtgagtcctgcaccccacgcctcatcccctgccctcctccccagacctgggcgaggacctacctgccactcggttctgtgccctgcagtgcctggccaccccgaggcgttgcacctggagtgccagtcgaacaccagcctgctgctgcgctggcagcccccactcagccacaacggcgtgctcaccggctacgtgctctcctaccacccccgtgcgtgcgccgccccagcagggaagggaggtggaggggccacggggagggggcagagctgcagccacagccaacccctgtctgtccccacagtggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctggtaagctggaggaatgacctgccaacagggaggccccggccagccgggtccaggagggagggccttagacttcctggcagctgccacactctcctcgttcccctgcatccccccagggatctcagattttggcaacatctcagccacagcgggtgaaaactacagtgtcgtctcctgggtccccaaggagggccagtgcaacttcaggttccatatcttgttcaaagccttgggaggtaagcgtgaaagggggccttggggcgtggtggggaagggggctctgggccagaggggttgcctggcactccgactcacccctgctgccaccctctctccctggcagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggtgaggcgccgggggcccgccatcacctgccagggaagcatgggggctgcacaattcatgtccttctgtcccctgaatggccactactgcccaggctccctccacggctcctgtctgcttctcctcccagaatctgggtgtccccgaatcagccccctttcataccctttccgcagatgcccttttccctgtccctgtcactccttagccccccagagggccccaactttaagagcatacttcagggcctcaggtcgggttctggcttgggcggcagcacggggggctggtgtctcaccctcaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcaggtagcctctgagccccacgtgacgggggtggagccgagggcagagaggagcacctcgccccttccacccttctgcaaggcctcctggattccccgagctccccacaagatgacaggcgcatggtgggggcaggcagggggatcatcctcccaggccggggttggggcaacaggcaagtggtggctggaccgcagggggtgagcggtttctttcaaggcctcttgcctctgggcgctgttgagacagagtgctgggggtgcggggcgtagaggggcctggagccccgggtcaggctggggcgggagaagaagctgtccctctctgtgtctccagtgaaggataaggaggacacccaggtggactctgaggcccgaccgatgaaagatgagaccttcggcgagtacaggtgagccggggcaggagtgggtgctggcactcagctccaccctggccttcacatctcaccccctctctctcttctctgtgctgccgggtgacttcaggtccctggagaggtaaggcaggggcggtggggaggggccaacagcaaggtctccctatagacaatgtgcgcctggtgtgccattgtcccctggctgccggggctctgacaggactctcacttcccagcccccaggcccggcagctcctcatttcagggagaggccaacacgccccagcccctcctctccacacagataccttcactgctcccctctccccaagggaggccccagacagcttcccagacaggaaccaggccccataatcccctggccgagcgcacattttctccctcacagtccccaggatctggggaatgcccaaagatgacagctccagacctgcctgccagggtggccagagctgctctttctgagcgcattctaaacaaatggaaggcaggcgggcgtctgcctcacccccagccaggctcctgcaggggctcggcagtgctctcactcgcacctgccctgtgcctctgcagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggcctcttccagccgcccccaccccccaggaccccttagcagccctgccctccctatcgtctgaacagttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctacaaaaaaacaaaagtatatatatatatgtacataatatcagaattataacaggcaaataaaacctgaaaat

SEQ ID NO: 4069 - DNA, 13299 bp, human
cgccgggaaagatggtcgtggcgctgcggtacgtgtggcctctcctcctctgcagcccctgcctgcttatccagatccccgaggaatgtgagtagctgaagggagcctgggcgcctaccttcgccgctatgttgggcccctctttatcttctacctcctcaccttctccctgttccggaccctgactcctctccctggcctttcctgggcacagggtgggcaggagatagccaggacgttgggtacccccggagagaagggcagggtagaaggtgcggggcgtgtcaggaccatggacagggacaggcgcggccgccggggcgatttcagcaccagggacagcgaacctggagcagggccccgaggtcttgggcctcctccatgctctccttagcccgccccatctctgcccgccccactccgactcctccgcttccatcccccaccacaggggtgtggcagcaggagaatggggtcgtccccagccctcagctggcttgtgcaaaggcctgtgttcaagtcttgtccccatttctctttcccctcctgggcccttggtcaccctgtctctgaactgagacaggaaaaggtggcttgaaaaaccctggtcccagcccagcagccttctggacccttttttgtgtgtagttatttggtgggggtgggggcagggctgctggagcatgtgtctatggttgtaacatttgttgggggcacaagcaggtgagtggatgttggggagtgtggccgtagggttgtgattaagcatggatacactgtgtatgtctgtgtgttcttgtgattgactgagcgtagatattcgtgaatgtgattttgacttccttacatgggtgactgtgtgagtcactctgttacttactggccaggcttgtggaggtcgggaggtatttgaccacgacatttgattgcattgggtcatgtgtatgtgtgagtggggctgaatgtaagtacacacttgcgtgtggggggtgttaccgtgatggtgttttctcctgtaagtagctgtcaggccgtgtgaggggcatgtcacagggtatcatgtgtgagggcatttgtgtctcttgagctaccaggctccagtcccttcccagcctcaccttgacacctttgtctctgggcctggacaaggaggaggccagtgtcactgagagacgagttggcggataggggttgggaagactgtctgtgccagcagtgggacaggggctgcgagagagaggctggggaggcacctggcgttgggaggcagtgagggcttggaggaggtaaaggggctggccccttagacacatacatggagggccagggccaggcagactcccttggtacagatgcacatggacacatgcacacaggtgcatgaagacaaggcaggtgcagggatgaaggagcagagccgctgagaggccacacaggtggaaacacacaccagtgaggcttttagacccagaggacacagaggtggatacacaatataacactgtacagtggaatgcaagccgtgcattctctacagaaagatgggagtggggagagagaactaggccaaaaggccatggcagctccaaggctgccctggtcactgaccagcacttgttcttgaccctgatacgacacagtgggcagtggcaggcagccggccctccctgttggaacctgtcttccatctctccctccccagccactccagccccctttgtctcttttcctgcttcctccacctagttggctttctgcatcctgtcatccctgtcaccatctccctccccagctcagggccctctgcagtgtccccagggagccccctcctccctccctggaccttcacactgaggtcttctgcagagacaaagctttcagaggcagcctgctgctccctccctccctcttctcccttcctcgaggccgccctggccagtgctctgcagagtcctggggctgggacagcagctctggcctctgccccagagagcttggtggctgtctgggaggaaggagggagaagaggagggctggcgccaaccccgcaggctatggaaactcagaggcagcagggcctttgggatagttttcagggggagggggcagcagggctctgaaggctgggccctggtaattgaaaacactcagctgtgctaattggattaggagggaagcaggctggagcaggggacggtgccttccaaggcatcctgaatgggtggggtcagttctgcaggccctgccaggccctgccagggggctgcaaggacactccttgttaaaggcaagaatttctctctccctgtctgctagagctggaggcatggcctggctgcctctgggctacatgccctgtgtgtctatccagtggagctcctctccctgggcatctctctgtcccatctccctgggcttgacctgccactgctccagcccagcgtgtgcccccttgttgccactgccagggcctcctctcctgccattccctctccacgggggggctgcaggagcttactatgtcccctgccatctgccccactctggggctgcctgtcagtatttctctccattccctcccttgctgcctgcctggatttctcagatgaaggacaccatggtaagttggggaggggtgagagtgtttcccagaaggccaaggagaagggtaaggaggccctcagctgagcctgcacccccgccctcctgagtgccggggccctgctcggctctccctgagcaccatgtgcttctctcacctgtgtggggctggctttgttctgtctctgccccagcctgggtactctgtcaccctcactgttcctctctgccattctctctggtcccttctcccctgtctggggtttgtccttcttggtttctgtgtcttggcttttgttgcccccgcttctttctgtcataccctttttgtctttctcaggcatctctttgtaacttacgtggctgtcccctctctccctcttttcatgtcccacaagcctcttttgttcttcccctccgttcgtccccctgtggccatggggcctccaggggctctggaccctgcttccctcacgatgggacaggtgctgaggctatgacaccagccaggcagcaccctcaccaccgctctctccaccctgtcttcagtgatggagccacctgtcatcacggaacagtctccacggcgcctggttgtcttccccacagatgacatcagcctcaagtgtgaggccagtggcaagcccgaagtgcagtgagtgatctctgccgtctcagcccctgttgcctgccactgaccccggccttgtgcctccctggactgcctaacttctaagcccagaagccccaaaccttgctaatcaccccaagtcctcgccatctcccagtccatcccctgggggccctggctgcttgcacctgtccctccagcctgttccagcccccgttgggttccagggcctcaggcctctgggcctttttccgcccacaggttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcgaggcgctgcagggaccagggagggcaggtcccggagttcgtgtgggattgtgggctggaagctgctgtcagccagttgtctcgtggcgaggggcctgggtgtcctgccagccctccaccccaccccagcttctcccctggcccatcttgtttcttgtgcagtctcctcctttgccctgtctctgtctccattgcacttccggtcatctcatgccctttcactccctcaggctttcctggtgcctgcctcatggctgagcaggaaggtggcggggggaggggggggcgggctggtggggggagtgactgattctgggcagacctgcctgagtcactgcagtcatctctgtctacacctgcactccttagcagggcccctcttctctggcttttccacttggctctccatctcctcccctccacctccgacttggtctctcttgctccacggctctgtcttgatctgtgtcgccttttccctggggttttccctttgcattccatcctccctgagctttctgcttcctgagcgctctcctctcccctccccacccctccagttaccttgggaaccgttgccatggtttctgtgtcaggatgatggaagggtctgtgactcctgcatccctccacagctcccctcccccatcactgcacctcagcctcagcctccccccacccgtcctttcctagggtgggcagggagagctgagaaccgtggaaggttaacccttcctggcctcctggtctcctgctcaccctggcctccctaagtgctagtctctgctatgagtccagaaggtatccagagtgtctgcctccttttctgtgaagtttctactggcctgaccctctcgccccctcgtccatccctggtgtagcccgccacccccctgcccccacctcccttctcctgcctagcaccatctggaccaggaggagagtgtcagcccgtctgtcccttctaggtgcccccaagtggccaaaggagacagtgaagcccgtggaggtggaggaaggggagtcagtggttctgccttgcaaccctcccccaagtgcagagcctctccggatctactggatgaacagcagtgggtgccggcgagcggctgcctcgtggggtcggggtgttagcgggggtgtcttcctggacggggtcatgacttcggcctccttgccccctgcagagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccagtgagtctcagaggctctgcactctctccctgactcctttcaccctcaggcatggcccttcccaccataggtccatctgacaactccaggcttcctcaagaacagcttggctcccacctctaccctgcccagaccccttcccaggcgtcgagagcagagacaggacactctccttaatggaggaagacacagaggccccgggggctggctggagtgtcgagtccctcagccttgcaattctggggtggagggaagagtgggcagcccacccacccactttctcctggcagccaacagcatgattgacaggaagccgcgcctgctcttccccaccaactccagcagccacctggtggccttgcaggggcagccattggtcctggagtgcatcgccgagggcttgtgagtctgggaacccagggcagggcagggcagggcagggtggcggagccctagcagggagctcagaccaccgcggggtatagggggctggggtgattggccttgtcctttctcccttctgctctcttccctttgcctcccgggcagtcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggagggtatggacctcctgggacagtggcctgtgatgcccactgtcatgggggaggggagggtctgcgccgggtcaagagccagctgctggctgcgggctcagggcggctctccccttcctcccagctgccccgtactggctgcacaagccccagagccatctatatgggccaggagagactgcccgcctggactgccaagtccagggcaggccccaaccagaggtcacctggagaatcaacgggatccctgtggagggtgagcagggcctcaggcaggagtggggagtgtggcgagccctgggggctgtgggggagaggaagaggagggtgaggaagggcctcaacgcagctcaatgccgggctgtggcccatgggcccacctgctgcatgcacagagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccgtgagtgccctcccttccttacctcctaactcccagtctgtccctgcagcccactgggccaggccaccagagtggctcagctggcagctgatgtgtcctcggcctaccaggctggcgccgacctttctccttgctgacacccttcgccccatctcactcagcctcacgatagccgagggagatgtaagaggggaaaggtcttgtcactgtgactgagcggaccgctgtgccacaggatgtgaccaaggccagcccaggtggcacctctcctggaacttcagggaaggctggggactaggccaggaaggcttctggggagaggtgactgtcagttaggcctggaataacgtaaaagttgggtggctgtgaccagaggcgcatctgaggcagagggcagtgtctgaaggcagagagagacacagcctggcgggggcctcagctgggagcagggaaccaagatttgcagggctcttgggggcccgaggaagccgtgcagagggtccctggctcctggcccagctgtggtcccaagtcctgccctgtctcctgaggctgttcctcccctagagctgccagccaagatcctgactgcggacaatcagacgtacatggctgtccagggcagcactgcctaccttctgtgcaaggccttcggagcgcctgtgcccagtgttcagtggtgagtgtctcgtcctggtagtggtgagtgtcgtgtcccagtggccagggagccagggagggcagggagcccaggccagccagtcagagccaggcccgccctgctccctccaggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaaggtcaggcaacccttgccacatggctggcagtgcctctgggagggagggtctgggcctctggaggacaacagagtgacttccccacgcacgcattaccctcagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtgaggacagtgacggtgaaagggggcagagtgggaaaagctggaagtccagacctcttggcctcgtccttgctttgatggggaaggctctgacaggagcgggggaaggagacaggagggagggatgggaggggagaagagcccagatggcaggaaagacagacacggctcctccgcaggtacttcatagaggatgggcgcctggtcatccacagcctggactacagcgaccagggcaactacagctgcgtggccagtaccgaactggatgtggtggagagtagggcacagctcttggtggtgggtaagtcctagggtggaagcctccactccagaaggccggggctcacatccctgggccctttcaagcaccgaccctccccaccctcagggagccctgggccggtgccacggctggtgctgtccgacctgcacctgctgacgcagagccaggtgcgcgtgtcctggagtcctgcagaagaccacaatgcccccattgagagtaagaggcttgagctcagtgccaccccaccgtcacttctgccagccctggcccctcctggggtcctccctcctcctggagccttcctggggggacacggtttggggggactcacggttcctcatgggaatctggagatgccagttggcctgggtaatcagggacccagactgtacccaacccctccacagcccttcccccaaagccacatgctgatcactccattgtcggttcatttcttggcagaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcaggtgagtcagggtggcacccactcccatgccacctggaaggggctccgggctgtgaagggagggcttagagaggtgccatgcccaagttcctctgcttccaaatttccagggggagcgcgagggggctggactcccttggtgccagaatgagccatttgttccttggccctcggtcctcgtggctctccaaaagaggctgcagcattgatgtgttaatactttcctttccagccccagagaagaaccctgtggatgtgaagggggaaggaaatgagaccaccaatatggtcatcacgtggaaggtgagagtccctgggctgagctgcctgggggacatgaggccatgacctgggtgtctgttgctcccccttggctatgcaaaggaaggggctgatgtctggggatgctggtttgtgctggggggcgggccaaagaatgctggtgttcttggccaaccaactcctcttctgctggcctcctccagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactgtgagtatccggcagggcccctcgcccacggttgagctcgcctgcttccaccccagcccatgtccacacctctcagcattggtgtgcgcctttcctaaggatgaggatattctcttacataaccagagcgacgttatgaaattccccacacttcacatttctataattggcagcggtattccagttatatcagccaatgctgcttctttcatttccttgaatctggaacatgaccagatggtaacttgaagtacccggtcaagttttttttctggtttctcctttttttcttttcttttttcttttcttttcttttctttctttttttttttttttgagatggagtcttgctctgtcatccaggctggagtgcagtggagcggtcttggctcactgcaacctctgcctcccgggttcaagcgattctcctgcctcagcctcctgattagctgggattacaggcacgcgccaccacacccaactaattttcgtatttagtagagatgcggttgcaccatgttgatcaggttggtctcgaactccagacctcaaatgttccactcgcctctgtctcccaaagtgttgggaatacgggtgtgaaccatcacgcccagccatggtttctcctttgtataagctactattttcacctttgcaactaataagcagtccaggaagagatcttgagaccatgcaaacacacctctcctcctcaaactgtacctcataaaatatccgaattcgtcttctctgtgtgtaggggcttgggcctggcctcagggctggggtgagagcctatggctctatccaagtcactggtggtttccagacccccaggcaatccctgagctggaaggcattgaaatcctcaactcaagtgccgtgctggtcaagtggcggccggtggacctggcccaggtcaagggccacctccgcggatacaatgtaagggttgaaggcatgggggcccaggagggtgatcactgaggtaaagcgacaggatggtgagggggctttgccacctgccagccgctctcctggaagacttgggttgagaggagggtccccattaagggtggtgggggtgtgcgctgggggccctgctgggtgccttctgcccctgcgaggtctcctgttcgcttgtgcaggtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggaggtgagtcctgcaccccacgcctcatcccctgccctcctccccagacctgggcgaggacctacctgccactcggttctgtgccctgcagtgcctggccaccccgaggcgttgcacctggagtgccagtcgaacaccagcctgctgctgcgctggcagcccccactcagccacaacggcgtgctcaccggctacgtgctctcctaccacccccgtgcgtgcgccgccccagcagggaagggaggtggaggggccacggggagggggcagagctgcagccacagccaacccctgtctgtccccacagtggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctggtaagctggaggaatgacctgccaacagggaggccccggccagccgggtccaggagggagggccttagacttcctggcagctgccacactctcctcgttcccctgcatccccccagggatctcagattttggcaacatctcagccacagcgggtgaaaactacagtgtcgtctcctgggtccccaaggagggccagtgcaacttcaggttccatatcttgttcaaagccttgggaggtaagcgtgaaagggggccttggggcgtggtggggaagggggctctgggccagaggggttgcctggcactccgactcacccctgctgccaccctctctccctggcagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggtgaggcgccgggggcccgccatcacctgccagggaagcatgggggctgcacaattcatgtccttctgtcccctgaatggccactactgcccaggctccctccacggctcctgtctgcttctcctcccagaatctgggtgtccccgaatcagccccctttcataccctttccgcagatgcccttttccctgtccctgtcactccttagccccccagagggccccaactttaagagcatacttcagggcctcaggtcgggttctggcttgggcggcagcacggggggctggtgtctcaccctcaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcaggtagcctctgagccccacgtgacgggggtggagccgagggcagagaggagcacctcgccccttccacccttctgcaaggcctcctggattccccgagctccccacaagatgacaggcgcatggtgggggcaggcagggggatcatcctcccaggccggggttggggcaacaggcaagtggtggctggaccgcagggggtgagcggtttctttcaaggcctcttgcctctgggcgctgttgagacagagtgctgggggtgcggggcgtagaggggcctggagccccgggtcaggctggggcgggagaagaagctgtccctctctgtgtctccagtgaaggataaggaggacacccaggtggactctgaggcccgaccgatgaaagatgagaccttcggcgagtacaggtgagccggggcaggagtgggtgctggcactcagctccaccctggccttcacatctcaccccctctctctcttctctgtgctgccgggtgacttcaggtccctggagaggtaaggcaggggcggtggggaggggccaacagcaaggtctccctatagacaatgtgcgcctggtgtgccattgtcccctggctgccggggctctgacaggactctcacttcccagcccccaggcccggcagctcctcatttcagggagaggccaacacgccccagcccctcctctccacacagataccttcactgctcccctctccccaagggaggccccagacagcttcccagacaggaaccaggccccataatcccctggccgagcgcacattttctccctcacagtccccaggatctggggaatgcccaaagatgacagctccagacctgcctgccagggtggccagagctgctctttctgagcgcattctaaacaaatggaaggcaggcgggcgtctgcctcacccccagccaggctcctgcaggggctcggcagtgctctcactcgcacctgccctgtgcctctgcagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggat

SEQ ID NO: 4070 - DNA, 24574 bp, human
ccggcgtgcgcggaggctgggcgggcagcccgagcggtggccgcagcgcaggtaaggcgggctggcctccccgtgcgacccgggccgcggccgcgatcccccggcgacaccacaccgctctgcccggggtgcacggaccagggagtcccggcccggtccggcccgcggtaaccggcgttgctgccggagccccacccatgccgggcgtcgggctccgggcaccgcgggctgtaagcggggcgggggagggatgccgggtgcccgagcccgacaggtgaggggtaacctgcggggccccagatgctggcctgggcgggagaacagggcggggggcgtcaggcagggtctgtgtgggcaggcgggggctgaagttggcgggtccccgtgcgtgtgtgcgtgtctgagaaaggaagccagatcgggtcgagcgctcccccacaggccgccgtggggtgtggccctgggcgtggctgcccctcatccccagccgagagctcagtttggttgaaaatcccggctgacagcgtggtgaggggtagatcgggataagccgcccctgcaatggggggaggggagtgaacgggactgggcgctgcctgcccctccgccccaaggttgggggggctttgttctcctccttcttctttccaaatcccagcctgggctcctccgggctcacccgaaaacctgccgcagagccaggggctcctccccggaggcgtagggcgcctctggagcccgtttccacaggctctgtggccagtcagggctggagtgggtgaggtcggttcgggcacccactgctgtgcctcccgtgcatgggtgtccatcaggtagggtccatcaggtaggggtgagggaaggtgggcctcactggctcaggcggtccctgcgcactgcaggtcttttgcccactgccacatcttcctatctctgtgcggttatgggaggggtcagcgattcctattccctccattccaggtcagacttttggggcctcttggttggcagggattgcaaagaacacgcactacaatccattgcccccgacagggtatctggaccccccacctatcactgtccctctcaggaaggcaggcctagagccatctgcccccttctccagaaggagtgggggcctggcaccccccaggtagataccctgcccctgttaaccccaccctgagggcaggggcatcggggcagcccagtgccatctctgctgactcatgtggccctgacgtaaatcagtgcagtccgcccttcttcccctgggggctgctgcccagcatcatctttctggggcgggggcctccccagggcctctcccctcccgtcagctccttgctgcaggtggtgggacttggcccagcctggcctctcccctggcacagctcccatgcagtgcccacatgtgcacacctgagggctccagagcctttgaggactcggctgtcttggccacatgggaagtttggggcagggttgggcctgggaccttcccacctccttggctcctggtcatttctctctgctgcatctgagtctctctccatatttattgatgtttgtgtgtgtatgatcccgaaagtaatacatcttattgtaggacacttgaaatatacagaaaagaacaaaagaaattaagaatcgctagtgatctgatcaccaagagggaaacacgttcagcacgccccagcctccctggtttgctacaccgcgctcctaaaaggctcctccccaagttcccagctgccagctccctgctgagcatcaggaggacaatcagcgcttcaaggtggcggggtcccctgccctgcagccagtgaagagcttccctacccaggcgctcaggatcccacgatgggcagtcgtgtactgggcagctgctcatggccagtgctcctttgggccgggctctgggctgcccatggaagagccagtgacaaactggaccagcattgtccctgtcttcgtggggtgtcacttgttttcttttttcttgatgattatctgaagggaaaagggaggcaaagagtgaggaagggcctggcctgagggctcctacagtgagcagggtgcccagattgtgcccccaatcggcctctcccaggtccgagccctttccaccactggaactacagctggcgccttccttggcatgcacctggccaggactggcaggtgagggtcgaggagacaggcctgtgtgccctaccttgatcaccaagttccctttcaaagctcgaaatggctgcactgagtgcttttctgggtgtgagggtgatgcggcctcgcagagtggcccaggctccaggagggcacgttcatgggagaacctggggtagtggtggggtcctgtgaggaggtctgccaggatggggatcccagccaagaccctggtctgccaggcatgagtgggggcatgagtgggggccctgcctccctccctcgtggttcagacagtgggggaggcggggggtctggatgcccttctagggtccccagcagggtgctcattgccctgtcctctgcccctgcaatgggctggggctgggtccctgggtggggccatctggaatgggcctgcagcatccctgcccctgcagtcgctgtcttacttgctctgatctggcccatctcggacacctccttctcctgcttcccccgcccccctgctctctcctctgcagcctcccacgtctccctgtgccccacccccagggccatcaccttcctcctccttctaggcagaagcctgctgctgccggggatggggtgcaccactccccgtctcctccctctgcctctgcctgcctggccctcccttccctcttcccccttcccgtcagggctctgctccatctctctgcttacccttttgtctgtcttccaccgctctgctcctctccttgtcccccccagctgcccctgcctcacccttgagggccctgaggttgtgccctgtccagcagccactcagcacccttctgctggactctacgccttggggttgggcccagaccccccatgggggccttgtctgagtggaaggctgtatggggggtgcctggtgagcagcagccagacgagcactgggggaggtagcccgcccagcttgcctcttccccagatatcaacagggtctttgtggcttcctgaaggctgtggctggaaaaagagggaggagctggggagggtctggccgctgttctttctagaagcttttctttgtccagtggcccccagcccaggtccccgtgttcttcccaggttggaaagctgcagagggagtgcccagccactgtcagtcagcagctcctgctcatctctggcccttacacccagcaggggcagctgcgagggccaggggttgggtggggcaggagggtggcagcgtcctgggctccatgcacttggccaaagaggacttctgaacccgtccatcccagtgcgggtctgagagtggaacttgagggaaagggactgagtcccgggagcccctctgccccctgccctccagccaggcagacttcctatctgcatgtatggggtttgtgtctctgcttgtgtgtgtgtatttgtgtgtgtgtaacctccagtattcctgtttgtctgggtggggtcatatatttggttgcatgtgtgtgtgtgttcgtgaaccagcatgcacacacatattgtcatgaggccacgtgggtctcctcagatgccccaacagggcctgtgctgggaaggggtggggctgagggtggctgctgcagtggctggatggggacagagcctctggccaacccaggctgtgcttcagtggaggggggttccctgtggccctgtctcccagccatctgcgtctgtgttcatgacttaggaatgcccaagccctggggatcacagaggccccattgtccgcccccgggcttcctgtgtccccctctgccctttaacccctcgggagtggggcccctggagggggcccgtggggcctggcagtgtctgagctgtttccaggcacccccaccccgccccccgcaaaccaacacaggctaggtatcccaggactgctgtgggccagggcctctccctgccccaggctgggctccttccctgctctccttttcaggccacagccccaggaactggatgcagtctgttccttctggcctggccgctgaagccccctctagtgctagggtcatcctagctccctgaggaggcctggggcctgagaggagccctagttttgctgccacctcatttctctcgccttctaggggtctcggaggctgaagccttgccgcctgctgggcatcagtatctccttcgacacaagaatggggccactgctgtccctaaatgctgattggagaggggcctctttgggaggggttctggagcctctggttgcaagaaaggtatcagaacaagtccagattccagagagcagaagaggggaccaagaaaccagcctgtccccaagcccaaaagggaaaggagttggccttctcttggactgagtacctggatgggggacttgggggtttgtttggtgtcgggcttcagctctgtgctgagacgtgatgttgatcacatcctacttccgcatggcctccatcccaagatgtcactccctgcccccgacatttgcctgccatctgcctggcaagtaagccctccccacggggcaggatggcttggaggccatcctcgcccaggcccctggttccctgggaagcccagcaggcacacatgttgggatgccagagcctctgagaggcagcttagggagccaccacgccctctaaaaccccacccctgctgagacccagtgccagctctgtgatcttggacacagtttccagttttctgagcctccgtgtcctcatctgtaaaatggggatgatgatagcacctccctccctgaggcaaatctggggaggagatgagtggatgtgagtggaagtgctcatgaggctttctggtacgtggtaagtccacgctgtaagttgatttaatagaacagaccacagaggcatgtgattgtggggatggagtggggctcctccctcccttccccagtagtcaagaccgtcctccctgaaccccacaaagggttaacctccgtctcttttccccatcttttaaggagaatggtccattacaggtgagttgtagttgccttggagactgaagcctcaggcgagatgagggggctgagggctcactctctcctaagggtaccctcttagggaggggtgaggttgggagtgcagggactaagcagcagtcataaaggacttctgggcccccaggtacctgtgggggctccctggagcagccccctttatgtgctgtctacataacacataacaaggctttcctctggcttcccccacctctgggacttgggctgcatcaccatagaaacccgccagccacggcctggggagcggggcggggagggccagcgggagccttaaagggacacagtgcacagggtgtaggtgacacccacaccatcgtatacacaccaacaggcacagaagccccccaggctcccaggcctgcaagcacatgggcccagcaccacactctgaccctttcatgtgccctgtgctgagcccccagccccacccccactctggcccactgagtcaccaggcaccatgtccccaggagacaagggcaggagaagccggatagtctctgctgtgctgttgaagggctctcttgttgcttctcctttgagaggaactccaggcagaacctgagaactgacaggcaggtgtgcagggcacatgtgcagggcaccgctggaggttcccttctcaaggtgtgtggtggtggtggtgatggggtgtgtgtgtgtgttttcagggaggaggcagtcactccaggtctagccaggctccacaacctcccaggtccctccctggcaagctgcttcccatcagaccaaagcaggcactttggagcagaggacagaggactccctgagggacctgcgggtgtagtgggaggccaggtggggtgggatggggcaaggctcttctggggctgaacccctccctgtaggctgctgggcgtgacccttgcctccctggccctttcccaccggggaggatgggtttgggaccggacttactcaggaatggccccatcttcaactgccccagcacagcggccactgtccactcagtgcatggtcacgcaggctcactcttggcctaacacatgtgcgtctcctccagccaggtgaccacttactcccagccagcagcaatattggaaggcttccctgggattttctgggtgcttccccctccccccgttcctacccgcagcaggaatcccccgacccccacctgttccctggcatggcatgggtcagccagcagtgtgccattcatcctgtctcacggccgtcccttgcccagtgccacaagtgggcagggccttgatgctctgttgcgtggggctttgtaggcccctccggccccagctcacagctgctccaccctctgtctgtctctctaccctgctcccaggccagcgtgacgtccacgccgggaagcccctccactgacccaggcccatcttccctcctccccgccccttgcctggcacagcccccagggacaaggacgctgtgcaggcggcctgcgcgcacgcgcacgtgcacacgcccacccccacccctcactcttctcgctctttctgccatttctcagcggcgcactctgcagctgcctctcaccctttgtgctccggtttcctcttctctccctttctctgctgcctgggtctccgtttcggaatttccccaccccctaaccatctccatcgtggttagcgctgtcttcctacgtctgtctttgtctcctgctcccccctgcctcttctcactctgtctgtcacccttggcagacccggccttggctccatctgtggaacactcccccctccccgctcctttgcccttagtggtgctggtggggggtagagggcctgctgagctgacaaccctagctgcttgctctgtaattgcctgaggaatggtgagagatcagagacccagcagcagtgggaggagaggagggagcgccccctcccagctgttatatctcgcaaccttctggctgcttcctgcctgtctccgactgcccagggcggtggcaagctaggtggcaaatactgggagaccaaaaaagaagttggatatgagcctgtggggagatgggatggggctgggatggggcagggagcggggaccaggggtttggggatattgtatttcccctgagcgtacatgccaaacaccattccaggattctagatttggaggacaaatagaggaacttgcgtggcagaaattatcgacctccagagcacccaaaagcctctgacatgcaggagggtccttctttgagcttttccttgctccggtttcctcccctccccctcctaagaccagtgctcagagctcccaaggctgctgtttgatcatctgctctctgatccgagtctcctactgctcctacaggccttgaagttgaggccagtgctgcctggggcctcccctgatccactggctttgtagggagaggccggggtggaacagatccactgttgctcttcccttctgggcccaggtccagctcttgcaggctgggaatcactcttcttaccctccaagtcatctcttggcctccaggccatgcacgctgacccaccctgctgcttctccaccaccctctgcagcaagctcttgcccagagtccccacgggatctgccgcattcacagctcttcttgggtcactctgttacacaaaactgacaaggcccagagccttagcacagcatggctgacttctctaccatcctttcggtgttcctgctgaggctcggtgcccgctttgataaggtcctggctgggcagagggaggatgcacagtatggatttaatgaaggcgtctagtctgggacttcagcctccaagctctgtcacctaacaacaccctttcttgccttgcctgcactttaaccacttcctgtttggaattgaagtggtctggccacttgggagtctgtttcctcttgtcattgtcagaggagccccctctttcagacccttagtctttggctccccttacttgtaggtgaatatggacatggccggtgtggcttgggtttggggtggacacatgcagcagttgagctctgaagactcagacaaagacctagaaattgggactttgagacacacaagaagtgttagaaacactgtcacggaaaatgtcccagagcttgtcctgacccctgtcctgaccctaacctggagcatctggaagggaggaggcctcagtggcctctcttgacccccagggggctgaggagcagcagggggttgttttcctccttcctctcttctcccacaccagttctcaagggaaggcttccttccccattctttctctcttttttttgagatggagtttcgctcttgttgcccaggctggagtgcaatggtgcgatcttggctcactgcaacttccgcctcctgggttcaagagattctcctgcctcagcctcccaagtagctgggattacaggaatgcaccaccacgccaggctaactttttttttttttttgagacagagtcttgctctgtcacccaggctggagtacaatggcgcaatctccgctcaccgcaacctctgcctcctgggttcaagtgattctcctgcctcagcctcctgagtagctgggattacaggcatgagccaccacgcctggcttttttttttttttttttttttttttttgtatttttagtagagacaggatttcaccatgttggccaggctggtctcaaactgctgacctcatgatccgcctgcctcagcctcccaaagtgctgggattacaggcgtgagccaccacgcccagccctaattttgtatttttactagagacagggtttcaccatgttggcctggctggttttgaactcctgacttcaggtgatccacccacctcggcctcccaaagtgctgggattacaggcatgagccactgtgcctggccttttatttttatttttatttatttttttagacagagtctcactccatcacccaggctggggggcagtggcacgatcttggctcactgcaacctccgcctctcaggctcaagtgattctcatgcctcagcctcccaagtagctggcattacaggcgcccaccaccaaggctaattttttttctttttgtatttttagtagagacggggttccgccatgttggccaggctggtctcaaactcccaacctcaagagatccacccacctcagcctcccaaactactgggattacaggcgtgagccaccacgcctggccctttccccattctttcttcattttcctgaaactattttgtgaaatgctgccatcttgggcccctttcctcccttctctatcccacttcccaatccccccattagctttttaggtctgtacagcacccaggcatcagttggctctgaaagctatagcaatgtgactgcaagaagaattcttctctacatgtgtgtgcacacagagataatagatacagggattcatccccacagatacataaagacatacaagaagacacacgtagctagcagacttgtgtgttgattccctcaggcacacacactaacacacccactcatgagtgcaacccctcccagagaagacacaccacagaaataccagctcacatacagctcactccctgcttgcagatccacaaccacacacatgcccacggacacctgcacatgcagacacatacggggatgtgcatgccatgcacaggggagctgatggggcaacaagttggtgctgggaaggcagctggcaggaaaggtgcagacagagagtagagagggaataaaaggcaacctagaggcccagccagggctatctcttccagatttctccctccaaggtggggaggggtgcggatggggaggggagggctggagaagccggccagctgggggcggggctgagggcggggccaagagcccgggcttacccagatgttagtcactaacgtccttccgttctctcgtctctcttcccccacccttcccttcccttctcccctctcccagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaatgtgagtagctgaagggagcctgggcgcctaccttcgccgctatgttgggcccctctttatcttctacctcctcaccttctccctgttccggaccctgactcctctccctggcctttcctgggcacagggtgggcaggagatagccaggacgttgggtacccccggagagaagggcagggtagaaggtgcggggcgtgtcaggaccatggacagggacaggcgcggccgccggggcgatttcagcaccagggacagcgaacctggagcagggccccgaggtcttgggcctcctccatgctctccttagcccgccccatctctgcccgccccactccgactcctccgcttccatcccccaccacaggggtgtggcagcaggagaatggggtcgtccccagccctcagctggcttgtgcaaaggcctgtgttcaagtcttgtccccatttctctttcccctcctgggcccttggtcaccctgtctctgaactgagacaggaaaaggtggcttgaaaaaccctggtcccagcccagcagccttctggacccttttttgtgtgtagttatttggtgggggtgggggcagggctgctggagcatgtgtctatggttgtaacatttgttgggggcacaagcaggtgagtggatgttggggagtgtggccgtagggttgtgattaagcatggatacactgtgtatgtctgtgtgttcttgtgattgactgagcgtagatattcgtgaatgtgattttgacttccttacatgggtgactgtgtgagtcactctgttacttactggccaggcttgtggaggtcgggaggtatttgaccacgacatttgattgcattgggtcatgtgtatgtgtgagtggggctgaatgtaagtacacacttgcgtgtggggggtgttaccgtgatggtgttttctcctgtaagtagctgtcaggccgtgtgaggggcatgtcacagggtatcatgtgtgagggcatttgtgtctcttgagctaccaggctccagtcccttcccagcctcaccttgacacctttgtctctgggcctggacaaggaggaggccagtgtcactgagagacgagttggcggataggggttgggaagactgtctgtgccagcagtgggacaggggctgcgagagagaggctggggaggcacctggcgttgggaggcagtgagggcttggaggaggtaaaggggctggccccttagacacatacatggagggccagggccaggcagactcccttggtacagatgcacatggacacatgcacacaggtgcatgaagacaaggcaggtgcagggatgaaggagcagagccgctgagaggccacacaggtggaaacacacaccagtgaggcttttagacccagaggacacagaggtggatacacaatataacactgtacagtggaatgcaagccgtgcattctctacagaaagatgggagtggggagagagaactaggccaaaaggccatggcagctccaaggctgccctggtcactgaccagcacttgttcttgaccctgatacgacacagtgggcagtggcaggcagccggccctccctgttggaacctgtcttccatctctccctccccagccactccagccccctttgtctcttttcctgcttcctccacctagttggctttctgcatcctgtcatccctgtcaccatctccctccccagctcagggccctctgcagtgtccccagggagccccctcctccctccctggaccttcacactgaggtcttctgcagagacaaagctttcagaggcagcctgctgctccctccctccctcttctcccttcctcgaggccgccctggccagtgctctgcagagtcctggggctgggacagcagctctggcctctgccccagagagcttggtggctgtctgggaggaaggagggagaagaggagggctggcgccaaccccgcaggctatggaaactcagaggcagcagggcctttgggatagttttcagggggagggggcagcagggctctgaaggctgggccctggtaattgaaaacactcagctgtgctaattggattaggagggaagcaggctggagcaggggacggtgccttccaaggcatcctgaatgggtggggtcagttctgcaggccctgccaggccctgccagggggctgcaaggacactccttgttaaaggcaagaatttctctctccctgtctgctagagctggaggcatggcctggctgcctctgggctacatgccctgtgtgtctatccagtggagctcctctccctgggcatctctctgtcccatctccctgggcttgacctgccactgctccagcccagcgtgtgcccccttgttgccactgccagggcctcctctcctgccattccctctccacgggggggctgcaggagcttactatgtcccctgccatctgccccactctggggctgcctgtcagtatttctctccattccctcccttgctgcctgcctggatttctcagatgaaggacaccatggtaagttggggaggggtgagagtgtttcccagaaggccaaggagaagggtaaggaggccctcagctgagcctgcacccccgccctcctgagtgccggggccctgctcggctctccctgagcaccatgtgcttctctcacctgtgtggggctggctttgttctgtctctgccccagcctgggtactctgtcaccctcactgttcctctctgccattctctctggtcccttctcccctgtctggggtttgtccttcttggtttctgtgtcttggcttttgttgcccccgcttctttctgtcataccctttttgtctttctcaggcatctctttgtaacttacgtggctgtcccctctctccctcttttcatgtcccacaagcctcttttgttcttcccctccgttcgtccccctgtggccatggggcctccaggggctctggaccctgcttccctcacgatgggacaggtgctgaggctatgacaccagccaggcagcaccctcaccaccgctctctccaccctgtcttcagtgatggagccacctgtcatcacggaacagtctccacggcgcctggttgtcttccccacagatgacatcagcctcaagtgtgaggccagtggcaagcccgaagtgcagtgagtgatctctgccgtctcagcccctgttgcctgccactgaccccggccttgtgcctccctggactgcctaacttctaagcccagaagccccaaaccttgctaatcaccccaagtcctcgccatctcccagtccatcccctgggggccctggctgcttgcacctgtccctccagcctgttccagcccccgttgggttccagggcctcaggcctctgggcctttttccgcccacaggttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcgaggcgctgcagggaccagggagggcaggtcccggagttcgtgtgggattgtgggctggaagctgctgtcagccagttgtctcgtggcgaggggcctgggtgtcctgccagccctccaccccaccccagcttctcccctggcccatcttgtttcttgtgcagtctcctcctttgccctgtctctgtctccattgcacttccggtcatctcatgccctttcactccctcaggctttcctggtgcctgcctcatggctgagcaggaaggtggcggggggaggggggggcgggctggtggggggagtgactgattctgggcagacctgcctgagtcactgcagtcatctctgtctacacctgcactccttagcagggcccctcttctctggcttttccacttggctctccatctcctcccctccacctccgacttggtctctcttgctccacggctctgtcttgatctgtgtcgccttttccctggggttttccctttgcattccatcctccctgagctttctgcttcctgagcgctctcctctcccctccccacccctccagttaccttgggaaccgttgccatggtttctgtgtcaggatgatggaagggtctgtgactcctgcatccctccacagctcccctcccccatcactgcacctcagcctcagcctccccccacccgtcctttcctagggtgggcagggagagctgagaaccgtggaaggttaacccttcctggcctcctggtctcctgctcaccctggcctccctaagtgctagtctctgctatgagtccagaaggtatccagagtgtctgcctccttttctgtgaagtttctactggcctgaccctctcgccccctcgtccatccctggtgtagcccgccacccccctgcccccacctcccttctcctgcctagcaccatctggaccaggaggagagtgtcagcccgtctgtcccttctaggtgcccccaagtggccaaaggagacagtgaagcccgtggaggtggaggaaggggagtcagtggttctgccttgcaaccctcccccaagtgcagagcctctccggatctactggatgaacagcagtgggtgccggcgagcggctgcctcgtggggtcggggtgttagcgggggtgtcttcctggacggggtcatgacttcggcctccttgccccctgcagagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccagtgagtctcagaggctctgcactctctccctgactcctttcaccctcaggcatggcccttcccaccataggtccatctgacaactccaggcttcctcaagaacagcttggctcccacctctaccctgcccagaccccttcccaggcgtcgagagcagagacaggacactctccttaatggaggaagacacagaggccccgggggctggctggagtgtcgagtccctcagccttgcaattctggggtggagggaagagtgggcagcccacccacccactttctcctggcagccaacagcatgattgacaggaagccgcgcctgctcttccccaccaactccagcagccacctggtggccttgcaggggcagccattggtcctggagtgcatcgccgagggcttgtgagtctgggaacccagggcagggcagggcagggcagggtggcggagccctagcagggagctcagaccaccgcggggtatagggggctggggtgattggccttgtcctttctcccttctgctctcttccctttgcctcccgggcagtcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggagggtatggacctcctgggacagtggcctgtgatgcccactgtcatgggggaggggagggtctgcgccgggtcaagagccagctgctggctgcgggctcagggcggctctccccttcctcccagctgccccgtactggctgcacaagccccagagccatctatatgggccaggagagactgcccgcctggactgccaagtccagggcaggccccaaccagaggtcacctggagaatcaacgggatccctgtggagggtgagcagggcctcaggcaggagtggggagtgtggcgagccctgggggctgtgggggagaggaagaggagggtgaggaagggcctcaacgcagctcaatgccgggctgtggcccatgggcccacctgctgcatgcacagagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccgtgagtgccctcccttccttacctcctaactcccagtctgtccctgcagcccactgggccaggccaccagagtggctcagctggcagctgatgtgtcctcggcctaccaggctggcgccgacctttctccttgctgacacccttcgccccatctcactcagcctcacgatagccgagggagatgtaagaggggaaaggtcttgtcactgtgactgagcggaccgctgtgccacaggatgtgaccaaggccagcccaggtggcacctctcctggaacttcagggaaggctggggactaggccaggaaggcttctggggagaggtgactgtcagttaggcctggaataacgtaaaagttgggtggctgtgaccagaggcgcatctgaggcagagggcagtgtctgaaggcagagagagacacagcctggcgggggcctcagctgggagcagggaaccaagatttgcagggctcttgggggcccgaggaagccgtgcagagggtccctggctcctggcccagctgtggtcccaagtcctgccctgtctcctgaggctgttcctcccctagagctgccagccaagatcctgactgcggacaatcagacgtacatggctgtccagggcagcactgcctaccttctgtgcaaggccttcggagcgcctgtgcccagtgttcagtggtgagtgtctcgtcctggtagtggtgagtgtcgtgtcccagtggccagggagccagggagggcagggagcccaggccagccagtcagagccaggcccgccctgctccctccaggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaaggtcaggcaacccttgccacatggctggcagtgcctctgggagggagggtctgggcctctggaggacaacagagtgacttccccacgcacgcattaccctcagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtgaggacagtgacggtgaaagggggcagagtgggaaaagctggaagtccagacctcttggcctcgtccttgctttgatggggaaggctctgacaggagcgggggaaggagacaggagggagggatgggaggggagaagagcccagatggcaggaaagacagacacggctcctccgcaggtacttcatagaggatgggcgcctggtcatccacagcctggactacagcgaccagggcaactacagctgcgtggccagtaccgaactggatgtggtggagagtagggcacagctcttggtggtgggtaagtcctagggtggaagcctccactccagaaggccggggctcacatccctgggccctttcaagcaccgaccctccccaccctcagggagccctgggccggtgccacggctggtgctgtccgacctgcacctgctgacgcagagccaggtgcgcgtgtcctggagtcctgcagaagaccacaatgcccccattgagagtaagaggcttgagctcagtgccaccccaccgtcacttctgccagccctggcccctcctggggtcctccctcctcctggagccttcctggggggacacggtttggggggactcacggttcctcatgggaatctggagatgccagttggcctgggtaatcagggacccagactgtacccaacccctccacagcccttcccccaaagccacatgctgatcactccattgtcggttcatttcttggcagaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcaggtgagtcagggtggcacccactcccatgccacctggaaggggctccgggctgtgaagggagggcttagagaggtgccatgcccaagttcctctgcttccaaatttccagggggagcgcgagggggctggactcccttggtgccagaatgagccatttgttccttggccctcggtcctcgtggctctccaaaagaggctgcagcattgatgtgttaatactttcctttccagccccagagaagaaccctgtggatgtgaagggggaaggaaatgagaccaccaatatggtcatcacgtggaaggtgagagtccctgggctgagctgcctgggggacatgaggccatgacctgggtgtctgttgctcccccttggctatgcaaaggaaggggctgatgtctggggatgctggtttgtgctggggggcgggccaaagaatgctggtgttcttggccaaccaactcctcttctgctggcctcctccagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactgtgagtatccggcagggcccctcgcccacggttgagctcgcctgcttccaccccagcccatgtccacacctctcagcattggtgtgcgcctttcctaaggatgaggatattctcttacataaccagagcgacgttatgaaattccccacacttcacatttctataattggcagcggtattccagttatatcagccaatgctgcttctttcatttccttgaatctggaacatgaccagatggtaacttgaagtacccggtcaagttttttttctggtttctcctttttttcttttcttttttcttttcttttcttttctttctttttttttttttttgagatggagtcttgctctgtcatccaggctggagtgcagtggagcggtcttggctcactgcaacctctgcctcccgggttcaagcgattctcctgcctcagcctcctgattagctgggattacaggcacgcgccaccacacccaactaattttcgtatttagtagagatgcggttgcaccatgttgatcaggttggtctcgaactccagacctcaaatgttccactcgcctctgtctcccaaagtgttgggaatacgggtgtgaaccatcacgcccagccatggtttctcctttgtataagctactattttcacctttgcaactaataagcagtccaggaagagatcttgagaccatgcaaacacacctctcctcctcaaactgtacctcataaaatatccgaattcgtcttctctgtgtgtaggggcttgggcctggcctcagggctggggtgagagcctatggctctatccaagtcactggtggtttccagacccccaggcaatccctgagctggaaggcattgaaatcctcaactcaagtgccgtgctggtcaagtggcggccggtggacctggcccaggtcaagggccacctccgcggatacaatgtaagggttgaaggcatgggggcccaggagggtgatcactgaggtaaagcgacaggatggtgagggggctttgccacctgccagccgctctcctggaagacttgggttgagaggagggtccccattaagggtggtgggggtgtgcgctgggggccctgctgggtgccttctgcccctgcgaggtctcctgttcgcttgtgcaggtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggaggtgagtcctgcaccccacgcctcatcccctgccctcctccccagacctgggcgaggacctacctgccactcggttctgtgccctgcagtgcctggccaccccgaggcgttgcacctggagtgccagtcgaacaccagcctgctgctgcgctggcagcccccactcagccacaacggcgtgctcaccggctacgtgctctcctaccacccccgtgcgtgcgccgccccagcagggaagggaggtggaggggccacggggagggggcagagctgcagccacagccaacccctgtctgtccccacagtggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctggtaagctggaggaatgacctgccaacagggaggccccggccagccgggtccaggagggagggccttagacttcctggcagctgccacactctcctcgttcccctgcatccccccagggatctcagattttggcaacatctcagccacagcgggtgaaaactacagtgtcgtctcctgggtccccaaggagggccagtgcaacttcaggttccatatcttgttcaaagccttgggaggtaagcgtgaaagggggccttggggcgtggtggggaagggggctctgggccagaggggttgcctggcactccgactcacccctgctgccaccctctctccctggcagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggtgaggcgccgggggcccgccatcacctgccagggaagcatgggggctgcacaattcatgtccttctgtcccctgaatggccactactgcccaggctccctccacggctcctgtctgcttctcctcccagaatctgggtgtccccgaatcagccccctttcataccctttccgcagatgcccttttccctgtccctgtcactccttagccccccagagggccccaactttaagagcatacttcagggcctcaggtcgggttctggcttgggcggcagcacggggggctggtgtctcaccctcaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcaggtagcctctgagccccacgtgacgggggtggagccgagggcagagaggagcacctcgccccttccacccttctgcaaggcctcctggattccccgagctccccacaagatgacaggcgcatggtgggggcaggcagggggatcatcctcccaggccggggttggggcaacaggcaagtggtggctggaccgcagggggtgagcggtttctttcaaggcctcttgcctctgggcgctgttgagacagagtgctgggggtgcggggcgtagaggggcctggagccccgggtcaggctggggcgggagaagaagctgtccctctctgtgtctccagtgaaggataaggaggacacccaggtggactctgaggcccgaccgatgaaagatgagaccttcggcgagtacaggtgagccggggcaggagtgggtgctggcactcagctccaccctggccttcacatctcaccccctctctctcttctctgtgctgccgggtgacttcaggtccctggagaggtaaggcaggggcggtggggaggggccaacagcaaggtctccctatagacaatgtgcgcctggtgtgccattgtcccctggctgccggggctctgacaggactctcacttcccagcccccaggcccggcagctcctcatttcagggagaggccaacacgccccagcccctcctctccacacagataccttcactgctcccctctccccaagggaggccccagacagcttcccagacaggaaccaggccccataatcccctggccgagcgcacattttctccctcacagtccccaggatctggggaatgcccaaagatgacagctccagacctgcctgccagggtggccagagctgctctttctgagcgcattctaaacaaatggaaggcaggcgggcgtctgcctcacccccagccaggctcctgcaggggctcggcagtgctctcactcgcacctgccctgtgcctctgcagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggcctcttccagccgcccccaccccccaggaccccttagcagccctgccctccctatcgtctgaacagttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctacaaaaaaacaaaagtatatatatatatgtacataatatcagaattataa

SEQ ID NO: 4071 - DNA, 14426 bp, human; identical to SEQ ID NO: 4068

SEQ ID NO: 4072 - DNA, 14426 bp, human; identical to SEQ ID NO: 4068

SEQ ID NO: 4073 - DNA, 24631 bp, human
tcgcagacgcgctcgggcggcgggtccgaggccggcgtgcgcggaggctgggcgggcagcccgagcggtggccgcagcgcaggtaaggcgggctggcctccccgtgcgacccgggccgcggccgcgatcccccggcgacaccacaccgctctgcccggggtgcacggaccagggagtcccggcccggtccggcccgcggtaaccggcgttgctgccggagccccacccatgccgggcgtcgggctccgggcaccgcgggctgtaagcggggcgggggagggatgccgggtgcccgagcccgacaggtgaggggtaacctgcggggccccagatgctggcctgggcgggagaacagggcggggggcgtcaggcagggtctgtgtgggcaggcgggggctgaagttggcgggtccccgtgcgtgtgtgcgtgtctgagaaaggaagccagatcgggtcgagcgctcccccacaggccgccgtggggtgtggccctgggcgtggctgcccctcatccccagccgagagctcagtttggttgaaaatcccggctgacagcgtggtgaggggtagatcgggataagccgcccctgcaatggggggaggggagtgaacgggactgggcgctgcctgcccctccgccccaaggttgggggggctttgttctcctccttcttctttccaaatcccagcctgggctcctccgggctcacccgaaaacctgccgcagagccaggggctcctccccggaggcgtagggcgcctctggagcccgtttccacaggctctgtggccagtcagggctggagtgggtgaggtcggttcgggcacccactgctgtgcctcccgtgcatgggtgtccatcaggtagggtccatcaggtaggggtgagggaaggtgggcctcactggctcaggcggtccctgcgcactgcaggtcttttgcccactgccacatcttcctatctctgtgcggttatgggaggggtcagcgattcctattccctccattccaggtcagacttttggggcctcttggttggcagggattgcaaagaacacgcactacaatccattgcccccgacagggtatctggaccccccacctatcactgtccctctcaggaaggcaggcctagagccatctgcccccttctccagaaggagtgggggcctggcaccccccaggtagataccctgcccctgttaaccccaccctgagggcaggggcatcggggcagcccagtgccatctctgctgactcatgtggccctgacgtaaatcagtgcagtccgcccttcttcccctgggggctgctgcccagcatcatctttctggggcgggggcctccccagggcctctcccctcccgtcagctccttgctgcaggtggtgggacttggcccagcctggcctctcccctggcacagctcccatgcagtgcccacatgtgcacacctgagggctccagagcctttgaggactcggctgtcttggccacatgggaagtttggggcagggttgggcctgggaccttcccacctccttggctcctggtcatttctctctgctgcatctgagtctctctccatatttattgatgtttgtgtgtgtatgatcccgaaagtaatacatcttattgtaggacacttgaaatatacagaaaagaacaaaagaaattaagaatcgctagtgatctgatcaccaagagggaaacacgttcagcacgccccagcctccctggtttgctacaccgcgctcctaaaaggctcctccccaagttcccagctgccagctccctgctgagcatcaggaggacaatcagcgcttcaaggtggcggggtcccctgccctgcagccagtgaagagcttccctacccaggcgctcaggatcccacgatgggcagtcgtgtactgggcagctgctcatggccagtgctcctttgggccgggctctgggctgcccatggaagagccagtgacaaactggaccagcattgtccctgtcttcgtggggtgtcacttgttttcttttttcttgatgattatctgaagggaaaagggaggcaaagagtgaggaagggcctggcctgagggctcctacagtgagcagggtgcccagattgtgcccccaatcggcctctcccaggtccgagccctttccaccactggaactacagctggcgccttccttggcatgcacctggccaggactggcaggtgagggtcgaggagacaggcctgtgtgccctaccttgatcaccaagttccctttcaaagctcgaaatggctgcactgagtgcttttctgggtgtgagggtgatgcggcctcgcagagtggcccaggctccaggagggcacgttcatgggagaacctggggtagtggtggggtcctgtgaggaggtctgccaggatggggatcccagccaagaccctggtctgccaggcatgagtgggggcatgagtgggggccctgcctccctccctcgtggttcagacagtgggggaggcggggggtctggatgcccttctagggtccccagcagggtgctcattgccctgtcctctgcccctgcaatgggctggggctgggtccctgggtggggccatctggaatgggcctgcagcatccctgcccctgcagtcgctgtcttacttgctctgatctggcccatctcggacacctccttctcctgcttcccccgcccccctgctctctcctctgcagcctcccacgtctccctgtgccccacccccagggccatcaccttcctcctccttctaggcagaagcctgctgctgccggggatggggtgcaccactccccgtctcctccctctgcctctgcctgcctggccctcccttccctcttcccccttcccgtcagggctctgctccatctctctgcttacccttttgtctgtcttccaccgctctgctcctctccttgtcccccccagctgcccctgcctcacccttgagggccctgaggttgtgccctgtccagcagccactcagcacccttctgctggactctacgccttggggttgggcccagaccccccatgggggccttgtctgagtggaaggctgtatggggggtgcctggtgagcagcagccagacgagcactgggggaggtagcccgcccagcttgcctcttccccagatatcaacagggtctttgtggcttcctgaaggctgtggctggaaaaagagggaggagctggggagggtctggccgctgttctttctagaagcttttctttgtccagtggcccccagcccaggtccccgtgttcttcccaggttggaaagctgcagagggagtgcccagccactgtcagtcagcagctcctgctcatctctggcccttacacccagcaggggcagctgcgagggccaggggttgggtggggcaggagggtggcagcgtcctgggctccatgcacttggccaaagaggacttctgaacccgtccatcccagtgcgggtctgagagtggaacttgagggaaagggactgagtcccgggagcccctctgccccctgccctccagccaggcagacttcctatctgcatgtatggggtttgtgtctctgcttgtgtgtgtgtatttgtgtgtgtgtaacctccagtattcctgtttgtctgggtggggtcatatatttggttgcatgtgtgtgtgtgttcgtgaaccagcatgcacacacatattgtcatgaggccacgtgggtctcctcagatgccccaacagggcctgtgctgggaaggggtggggctgagggtggctgctgcagtggctggatggggacagagcctctggccaacccaggctgtgcttcagtggaggggggttccctgtggccctgtctcccagccatctgcgtctgtgttcatgacttaggaatgcccaagccctggggatcacagaggccccattgtccgcccccgggcttcctgtgtccccctctgccctttaacccctcgggagtggggcccctggagggggcccgtggggcctggcagtgtctgagctgtttccaggcacccccaccccgccccccgcaaaccaacacaggctaggtatcccaggactgctgtgggccagggcctctccctgccccaggctgggctccttccctgctctccttttcaggccacagccccaggaactggatgcagtctgttccttctggcctggccgctgaagccccctctagtgctagggtcatcctagctccctgaggaggcctggggcctgagaggagccctagttttgctgccacctcatttctctcgccttctaggggtctcggaggctgaagccttgccgcctgctgggcatcagtatctccttcgacacaagaatggggccactgctgtccctaaatgctgattggagaggggcctctttgggaggggttctggagcctctggttgcaagaaaggtatcagaacaagtccagattccagagagcagaagaggggaccaagaaaccagcctgtccccaagcccaaaagggaaaggagttggccttctcttggactgagtacctggatgggggacttgggggtttgtttggtgtcgggcttcagctctgtgctgagacgtgatgttgatcacatcctacttccgcatggcctccatcccaagatgtcactccctgcccccgacatttgcctgccatctgcctggcaagtaagccctccccacggggcaggatggcttggaggccatcctcgcccaggcccctggttccctgggaagcccagcaggcacacatgttgggatgccagagcctctgagaggcagcttagggagccaccacgccctctaaaaccccacccctgctgagacccagtgccagctctgtgatcttggacacagtttccagttttctgagcctccgtgtcctcatctgtaaaatggggatgatgatagcacctccctccctgaggcaaatctggggaggagatgagtggatgtgagtggaagtgctcatgaggctttctggtacgtggtaagtccacgctgtaagttgatttaatagaacagaccacagaggcatgtgattgtggggatggagtggggctcctccctcccttccccagtagtcaagaccgtcctccctgaaccccacaaagggttaacctccgtctcttttccccatcttttaaggagaatggtccattacaggtgagttgtagttgccttggagactgaagcctcaggcgagatgagggggctgagggctcactctctcctaagggtaccctcttagggaggggtgaggttgggagtgcagggactaagcagcagtcataaaggacttctgggcccccaggtacctgtgggggctccctggagcagccccctttatgtgctgtctacataacacataacaaggctttcctctggcttcccccacctctgggacttgggctgcatcaccatagaaacccgccagccacggcctggggagcggggcggggagggccagcgggagccttaaagggacacagtgcacagggtgtaggtgacacccacaccatcgtatacacaccaacaggcacagaagccccccaggctcccaggcctgcaagcacatgggcccagcaccacactctgaccctttcatgtgccctgtgctgagcccccagccccacccccactctggcccactgagtcaccaggcaccatgtccccaggagacaagggcaggagaagccggatagtctctgctgtgctgttgaagggctctcttgttgcttctcctttgagaggaactccaggcagaacctgagaactgacaggcaggtgtgcagggcacatgtgcagggcaccgctggaggttcccttctcaaggtgtgtggtggtggtggtgatggggtgtgtgtgtgtgttttcagggaggaggcagtcactccaggtctagccaggctccacaacctcccaggtccctccctggcaagctgcttcccatcagaccaaagcaggcactttggagcagaggacagaggactccctgagggacctgcgggtgtagtgggaggccaggtggggtgggatggggcaaggctcttctggggctgaacccctccctgtaggctgctgggcgtgacccttgcctccctggccctttcccaccggggaggatgggtttgggaccggacttactcaggaatggccccatcttcaactgccccagcacagcggccactgtccactcagtgcatggtcacgcaggctcactcttggcctaacacatgtgcgtctcctccagccaggtgaccacttactcccagccagcagcaatattggaaggcttccctgggattttctgggtgcttccccctccccccgttcctacccgcagcaggaatcccccgacccccacctgttccctggcatggcatgggtcagccagcagtgtgccattcatcctgtctcacggccgtcccttgcccagtgccacaagtgggcagggccttgatgctctgttgcgtggggctttgtaggcccctccggccccagctcacagctgctccaccctctgtctgtctctctaccctgctcccaggccagcgtgacgtccacgccgggaagcccctccactgacccaggcccatcttccctcctccccgccccttgcctggcacagcccccagggacaaggacgctgtgcaggcggcctgcgcgcacgcgcacgtgcacacgcccacccccacccctcactcttctcgctctttctgccatttctcagcggcgcactctgcagctgcctctcaccctttgtgctccggtttcctcttctctccctttctctgctgcctgggtctccgtttcggaatttccccaccccctaaccatctccatcgtggttagcgctgtcttcctacgtctgtctttgtctcctgctcccccctgcctcttctcactctgtctgtcacccttggcagacccggccttggctccatctgtggaacactcccccctccccgctcctttgcccttagtggtgctggtggggggtagagggcctgctgagctgacaaccctagctgcttgctctgtaattgcctgaggaatggtgagagatcagagacccagcagcagtgggaggagaggagggagcgccccctcccagctgttatatctcgcaaccttctggctgcttcctgcctgtctccgactgcccagggcggtggcaagctaggtggcaaatactgggagaccaaaaaagaagttggatatgagcctgtggggagatgggatggggctgggatggggcagggagcggggaccaggggtttggggatattgtatttcccctgagcgtacatgccaaacaccattccaggattctagatttggaggacaaatagaggaacttgcgtggcagaaattatcgacctccagagcacccaaaagcctctgacatgcaggagggtccttctttgagcttttccttgctccggtttcctcccctccccctcctaagaccagtgctcagagctcccaaggctgctgtttgatcatctgctctctgatccgagtctcctactgctcctacaggccttgaagttgaggccagtgctgcctggggcctcccctgatccactggctttgtagggagaggccggggtggaacagatccactgttgctcttcccttctgggcccaggtccagctcttgcaggctgggaatcactcttcttaccctccaagtcatctcttggcctccaggccatgcacgctgacccaccctgctgcttctccaccaccctctgcagcaagctcttgcccagagtccccacgggatctgccgcattcacagctcttcttgggtcactctgttacacaaaactgacaaggcccagagccttagcacagcatggctgacttctctaccatcctttcggtgttcctgctgaggctcggtgcccgctttgataaggtcctggctgggcagagggaggatgcacagtatggatttaatgaaggcgtctagtctgggacttcagcctccaagctctgtcacctaacaacaccctttcttgccttgcctgcactttaaccacttcctgtttggaattgaagtggtctggccacttgggagtctgtttcctcttgtcattgtcagaggagccccctctttcagacccttagtctttggctccccttacttgtaggtgaatatggacatggccggtgtggcttgggtttggggtggacacatgcagcagttgagctctgaagactcagacaaagacctagaaattgggactttgagacacacaagaagtgttagaaacactgtcacggaaaatgtcccagagcttgtcctgacccctgtcctgaccctaacctggagcatctggaagggaggaggcctcagtggcctctcttgacccccagggggctgaggagcagcagggggttgttttcctccttcctctcttctcccacaccagttctcaagggaaggcttccttccccattctttctctcttttttttgagatggagtttcgctcttgttgcccaggctggagtgcaatggtgcgatcttggctcactgcaacttccgcctcctgggttcaagagattctcctgcctcagcctcccaagtagctgggattacaggaatgcaccaccacgccaggctaactttttttttttttttgagacagagtcttgctctgtcacccaggctggagtacaatggcgcaatctccgctcaccgcaacctctgcctcctgggttcaagtgattctcctgcctcagcctcctgagtagctgggattacaggcatgagccaccacgcctggcttttttttttttttttttttttttttttgtatttttagtagagacaggatttcaccatgttggccaggctggtctcaaactgctgacctcatgatccgcctgcctcagcctcccaaagtgctgggattacaggcgtgagccaccacgcccagccctaattttgtatttttactagagacagggtttcaccatgttggcctggctggttttgaactcctgacttcaggtgatccacccacctcggcctcccaaagtgctgggattacaggcatgagccactgtgcctggccttttatttttatttttatttatttttttagacagagtctcactccatcacccaggctggggggcagtggcacgatcttggctcactgcaacctccgcctctcaggctcaagtgattctcatgcctcagcctcccaagtagctggcattacaggcgcccaccaccaaggctaattttttttctttttgtatttttagtagagacggggttccgccatgttggccaggctggtctcaaactcccaacctcaagagatccacccacctcagcctcccaaactactgggattacaggcgtgagccaccacgcctggccctttccccattctttcttcattttcctgaaactattttgtgaaatgctgccatcttgggcccctttcctcccttctctatcccacttcccaatccccccattagctttttaggtctgtacagcacccaggcatcagttggctctgaaagctatagcaatgtgactgcaagaagaattcttctctacatgtgtgtgcacacagagataatagatacagggattcatccccacagatacataaagacatacaagaagacacacgtagctagcagacttgtgtgttgattccctcaggcacacacactaacacacccactcatgagtgcaacccctcccagagaagacacaccacagaaataccagctcacatacagctcactccctgcttgcagatccacaaccacacacatgcccacggacacctgcacatgcagacacatacggggatgtgcatgccatgcacaggggagctgatggggcaacaagttggtgctgggaaggcagctggcaggaaaggtgcagacagagagtagagagggaataaaaggcaacctagaggcccagccagggctatctcttccagatttctccctccaaggtggggaggggtgcggatggggaggggagggctggagaagccggccagctgggggcggggctgagggcggggccaagagcccgggcttacccagatgttagtcactaacgtccttccgttctctcgtctctcttcccccacccttcccttcccttctcccctctcccagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaatgtgagtagctgaagggagcctgggcgcctaccttcgccgctatgttgggcccctctttatcttctacctcctcaccttctccctgttccggaccctgactcctctccctggcctttcctgggcacagggtgggcaggagatagccaggacgttgggtacccccggagagaagggcagggtagaaggtgcggggcgtgtcaggaccatggacagggacaggcgcggccgccggggcgatttcagcaccagggacagcgaacctggagcagggccccgaggtcttgggcctcctccatgctctccttagcccgccccatctctgcccgccccactccgactcctccgcttccatcccccaccacaggggtgtggcagcaggagaatggggtcgtccccagccctcagctggcttgtgcaaaggcctgtgttcaagtcttgtccccatttctctttcccctcctgggcccttggtcaccctgtctctgaactgagacaggaaaaggtggcttgaaaaaccctggtcccagcccagcagccttctggacccttttttgtgtgtagttatttggtgggggtgggggcagggctgctggagcatgtgtctatggttgtaacatttgttgggggcacaagcaggtgagtggatgttggggagtgtggccgtagggttgtgattaagcatggatacactgtgtatgtctgtgtgttcttgtgattgactgagcgtagatattcgtgaatgtgattttgacttccttacatgggtgactgtgtgagtcactctgttacttactggccaggcttgtggaggtcgggaggtatttgaccacgacatttgattgcattgggtcatgtgtatgtgtgagtggggctgaatgtaagtacacacttgcgtgtggggggtgttaccgtgatggtgttttctcctgtaagtagctgtcaggccgtgtgaggggcatgtcacagggtatcatgtgtgagggcatttgtgtctcttgagctaccaggctccagtcccttcccagcctcaccttgacacctttgtctctgggcctggacaaggaggaggccagtgtcactgagagacgagttggcggataggggttgggaagactgtctgtgccagcagtgggacaggggctgcgagagagaggctggggaggcacctggcgttgggaggcagtgagggcttggaggaggtaaaggggctggccccttagacacatacatggagggccagggccaggcagactcccttggtacagatgcacatggacacatgcacacaggtgcatgaagacaaggcaggtgcagggatgaaggagcagagccgctgagaggccacacaggtggaaacacacaccagtgaggcttttagacccagaggacacagaggtggatacacaatataacactgtacagtggaatgcaagccgtgcattctctacagaaagatgggagtggggagagagaactaggccaaaaggccatggcagctccaaggctgccctggtcactgaccagcacttgttcttgaccctgatacgacacagtgggcagtggcaggcagccggccctccctgttggaacctgtcttccatctctccctccccagccactccagccccctttgtctcttttcctgcttcctccacctagttggctttctgcatcctgtcatccctgtcaccatctccctccccagctcagggccctctgcagtgtccccagggagccccctcctccctccctggaccttcacactgaggtcttctgcagagacaaagctttcagaggcagcctgctgctccctccctccctcttctcccttcctcgaggccgccctggccagtgctctgcagagtcctggggctgggacagcagctctggcctctgccccagagagcttggtggctgtctgggaggaaggagggagaagaggagggctggcgccaaccccgcaggctatggaaactcagaggcagcagggcctttgggatagttttcagggggagggggcagcagggctctgaaggctgggccctggtaattgaaaacactcagctgtgctaattggattaggagggaagcaggctggagcaggggacggtgccttccaaggcatcctgaatgggtggggtcagttctgcaggccctgccaggccctgccagggggctgcaaggacactccttgttaaaggcaagaatttctctctccctgtctgctagagctggaggcatggcctggctgcctctgggctacatgccctgtgtgtctatccagtggagctcctctccctgggcatctctctgtcccatctccctgggcttgacctgccactgctccagcccagcgtgtgcccccttgttgccactgccagggcctcctctcctgccattccctctccacgggggggctgcaggagcttactatgtcccctgccatctgccccactctggggctgcctgtcagtatttctctccattccctcccttgctgcctgcctggatttctcagatgaaggacaccatggtaagttggggaggggtgagagtgtttcccagaaggccaaggagaagggtaaggaggccctcagctgagcctgcacccccgccctcctgagtgccggggccctgctcggctctccctgagcaccatgtgcttctctcacctgtgtggggctggctttgttctgtctctgccccagcctgggtactctgtcaccctcactgttcctctctgccattctctctggtcccttctcccctgtctggggtttgtccttcttggtttctgtgtcttggcttttgttgcccccgcttctttctgtcataccctttttgtctttctcaggcatctctttgtaacttacgtggctgtcccctctctccctcttttcatgtcccacaagcctcttttgttcttcccctccgttcgtccccctgtggccatggggcctccaggggctctggaccctgcttccctcacgatgggacaggtgctgaggctatgacaccagccaggcagcaccctcaccaccgctctctccaccctgtcttcagtgatggagccacctgtcatcacggaacagtctccacggcgcctggttgtcttccccacagatgacatcagcctcaagtgtgaggccagtggcaagcccgaagtgcagtgagtgatctctgccgtctcagcccctgttgcctgccactgaccccggccttgtgcctccctggactgcctaacttctaagcccagaagccccaaaccttgctaatcaccccaagtcctcgccatctcccagtccatcccctgggggccctggctgcttgcacctgtccctccagcctgttccagcccccgttgggttccagggcctcaggcctctgggcctttttccgcccacaggttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcgaggcgctgcagggaccagggagggcaggtcccggagttcgtgtgggattgtgggctggaagctgctgtcagccagttgtctcgtggcgaggggcctgggtgtcctgccagccctccaccccaccccagcttctcccctggcccatcttgtttcttgtgcagtctcctcctttgccctgtctctgtctccattgcacttccggtcatctcatgccctttcactccctcaggctttcctggtgcctgcctcatggctgagcaggaaggtggcggggggaggggggggcgggctggtggggggagtgactgattctgggcagacctgcctgagtcactgcagtcatctctgtctacacctgcactccttagcagggcccctcttctctggcttttccacttggctctccatctcctcccctccacctccgacttggtctctcttgctccacggctctgtcttgatctgtgtcgccttttccctggggttttccctttgcattccatcctccctgagctttctgcttcctgagcgctctcctctcccctccccacccctccagttaccttgggaaccgttgccatggtttctgtgtcaggatgatggaagggtctgtgactcctgcatccctccacagctcccctcccccatcactgcacctcagcctcagcctccccccacccgtcctttcctagggtgggcagggagagctgagaaccgtggaaggttaacccttcctggcctcctggtctcctgctcaccctggcctccctaagtgctagtctctgctatgagtccagaaggtatccagagtgtctgcctccttttctgtgaagtttctactggcctgaccctctcgccccctcgtccatccctggtgtagcccgccacccccctgcccccacctcccttctcctgcctagcaccatctggaccaggaggagagtgtcagcccgtctgtcccttctaggtgcccccaagtggccaaaggagacagtgaagcccgtggaggtggaggaaggggagtcagtggttctgccttgcaaccctcccccaagtgcagagcctctccggatctactggatgaacagcagtgggtgccggcgagcggctgcctcgtggggtcggggtgttagcgggggtgtcttcctggacggggtcatgacttcggcctccttgccccctgcagagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccagtgagtctcagaggctctgcactctctccctgactcctttcaccctcaggcatggcccttcccaccataggtccatctgacaactccaggcttcctcaagaacagcttggctcccacctctaccctgcccagaccccttcccaggcgtcgagagcagagacaggacactctccttaatggaggaagacacagaggccccgggggctggctggagtgtcgagtccctcagccttgcaattctggggtggagggaagagtgggcagcccacccacccactttctcctggcagccaacagcatgattgacaggaagccgcgcctgctcttccccaccaactccagcagccacctggtggccttgcaggggcagccattggtcctggagtgcatcgccgagggcttgtgagtctgggaacccagggcagggcagggcagggcagggtggcggagccctagcagggagctcagaccaccgcggggtatagggggctggggtgattggccttgtcctttctcccttctgctctcttccctttgcctcccgggcagtcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggagggtatggacctcctgggacagtggcctgtgatgcccactgtcatgggggaggggagggtctgcgccgggtcaagagccagctgctggctgcgggctcagggcggctctccccttcctcccagctgccccgtactggctgcacaagccccagagccatctatatgggccaggagagactgcccgcctggactgccaagtccagggcaggccccaaccagaggtcacctggagaatcaacgggatccctgtggagggtgagcagggcctcaggcaggagtggggagtgtggcgagccctgggggctgtgggggagaggaagaggagggtgaggaagggcctcaacgcagctcaatgccgggctgtggcccatgggcccacctgctgcatgcacagagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccgtgagtgccctcccttccttacctcctaactcccagtctgtccctgcagcccactgggccaggccaccagagtggctcagctggcagctgatgtgtcctcggcctaccaggctggcgccgacctttctccttgctgacacccttcgccccatctcactcagcctcacgatagccgagggagatgtaagaggggaaaggtcttgtcactgtgactgagcggaccgctgtgccacaggatgtgaccaaggccagcccaggtggcacctctcctggaacttcagggaaggctggggactaggccaggaaggcttctggggagaggtgactgtcagttaggcctggaataacgtaaaagttgggtggctgtgaccagaggcgcatctgaggcagagggcagtgtctgaaggcagagagagacacagcctggcgggggcctcagctgggagcagggaaccaagatttgcagggctcttgggggcccgaggaagccgtgcagagggtccctggctcctggcccagctgtggtcccaagtcctgccctgtctcctgaggctgttcctcccctagagctgccagccaagatcctgactgcggacaatcagacgtacatggctgtccagggcagcactgcctaccttctgtgcaaggccttcggagcgcctgtgcccagtgttcagtggtgagtgtctcgtcctggtagtggtgagtgtcgtgtcccagtggccagggagccagggagggcagggagcccaggccagccagtcagagccaggcccgccctgctccctccaggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaaggtcaggcaacccttgccacatggctggcagtgcctctgggagggagggtctgggcctctggaggacaacagagtgacttccccacgcacgcattaccctcagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtgaggacagtgacggtgaaagggggcagagtgggaaaagctggaagtccagacctcttggcctcgtccttgctttgatggggaaggctctgacaggagcgggggaaggagacaggagggagggatgggaggggagaagagcccagatggcaggaaagacagacacggctcctccgcaggtacttcatagaggatgggcgcctggtcatccacagcctggactacagcgaccagggcaactacagctgcgtggccagtaccgaactggatgtggtggagagtagggcacagctcttggtggtgggtaagtcctagggtggaagcctccactccagaaggccggggctcacatccctgggccctttcaagcaccgaccctccccaccctcagggagccctgggccggtgccacggctggtgctgtccgacctgcacctgctgacgcagagccaggtgcgcgtgtcctggagtcctgcagaagaccacaatgcccccattgagagtaagaggcttgagctcagtgccaccccaccgtcacttctgccagccctggcccctcctggggtcctccctcctcctggagccttcctggggggacacggtttggggggactcacggttcctcatgggaatctggagatgccagttggcctgggtaatcagggacccagactgtacccaacccctccacagcccttcccccaaagccacatgctgatcactccattgtcggttcatttcttggcagaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcaggtgagtcagggtggcacccactcccatgccacctggaaggggctccgggctgtgaagggagggcttagagaggtgccatgcccaagttcctctgcttccaaatttccagggggagcgcgagggggctggactcccttggtgccagaatgagccatttgttccttggccctcggtcctcgtggctctccaaaagaggctgcagcattgatgtgttaatactttcctttccagccccagagaagaaccctgtggatgtgaagggggaaggaaatgagaccaccaatatggtcatcacgtggaaggtgagagtccctgggctgagctgcctgggggacatgaggccatgacctgggtgtctgttgctcccccttggctatgcaaaggaaggggctgatgtctggggatgctggtttgtgctggggggcgggccaaagaatgctggtgttcttggccaaccaactcctcttctgctggcctcctccagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactgtgagtatccggcagggcccctcgcccacggttgagctcgcctgcttccaccccagcccatgtccacacctctcagcattggtgtgcgcctttcctaaggatgaggatattctcttacataaccagagcgacgttatgaaattccccacacttcacatttctataattggcagcggtattccagttatatcagccaatgctgcttctttcatttccttgaatctggaacatgaccagatggtaacttgaagtacccggtcaagttttttttctggtttctcctttttttcttttcttttttcttttcttttcttttctttctttttttttttttttgagatggagtcttgctctgtcatccaggctggagtgcagtggagcggtcttggctcactgcaacctctgcctcccgggttcaagcgattctcctgcctcagcctcctgattagctgggattacaggcacgcgccaccacacccaactaattttcgtatttagtagagatgcggttgcaccatgttgatcaggttggtctcgaactccagacctcaaatgttccactcgcctctgtctcccaaagtgttgggaatacgggtgtgaaccatcacgcccagccatggtttctcctttgtataagctactattttcacctttgcaactaataagcagtccaggaagagatcttgagaccatgcaaacacacctctcctcctcaaactgtacctcataaaatatccgaattcgtcttctctgtgtgtaggggcttgggcctggcctcagggctggggtgagagcctatggctctatccaagtcactggtggtttccagacccccaggcaatccctgagctggaaggcattgaaatcctcaactcaagtgccgtgctggtcaagtggcggccggtggacctggcccaggtcaagggccacctccgcggatacaatgtaagggttgaaggcatgggggcccaggagggtgatcactgaggtaaagcgacaggatggtgagggggctttgccacctgccagccgctctcctggaagacttgggttgagaggagggtccccattaagggtggtgggggtgtgcgctgggggccctgctgggtgccttctgcccctgcgaggtctcctgttcgcttgtgcaggtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggaggtgagtcctgcaccccacgcctcatcccctgccctcctccccagacctgggcgaggacctacctgccactcggttctgtgccctgcagtgcctggccaccccgaggcgttgcacctggagtgccagtcgaacaccagcctgctgctgcgctggcagcccccactcagccacaacggcgtgctcaccggctacgtgctctcctaccacccccgtgcgtgcgccgccccagcagggaagggaggtggaggggccacggggagggggcagagctgcagccacagccaacccctgtctgtccccacagtggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctggtaagctggaggaatgacctgccaacagggaggccccggccagccgggtccaggagggagggccttagacttcctggcagctgccacactctcctcgttcccctgcatccccccagggatctcagattttggcaacatctcagccacagcgggtgaaaactacagtgtcgtctcctgggtccccaaggagggccagtgcaacttcaggttccatatcttgttcaaagccttgggaggtaagcgtgaaagggggccttggggcgtggtggggaagggggctctgggccagaggggttgcctggcactccgactcacccctgctgccaccctctctccctggcagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggtgaggcgccgggggcccgccatcacctgccagggaagcatgggggctgcacaattcatgtccttctgtcccctgaatggccactactgcccaggctccctccacggctcctgtctgcttctcctcccagaatctgggtgtccccgaatcagccccctttcataccctttccgcagatgcccttttccctgtccctgtcactccttagccccccagagggccccaactttaagagcatacttcagggcctcaggtcgggttctggcttgggcggcagcacggggggctggtgtctcaccctcaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcaggtagcctctgagccccacgtgacgggggtggagccgagggcagagaggagcacctcgccccttccacccttctgcaaggcctcctggattccccgagctccccacaagatgacaggcgcatggtgggggcaggcagggggatcatcctcccaggccggggttggggcaacaggcaagtggtggctggaccgcagggggtgagcggtttctttcaaggcctcttgcctctgggcgctgttgagacagagtgctgggggtgcggggcgtagaggggcctggagccccgggtcaggctggggcgggagaagaagctgtccctctctgtgtctccagtgaaggataaggaggacacccaggtggactctgaggcccgaccgatgaaagatgagaccttcggcgagtacaggtgagccggggcaggagtgggtgctggcactcagctccaccctggccttcacatctcaccccctctctctcttctctgtgctgccgggtgacttcaggtccctggagaggtaaggcaggggcggtggggaggggccaacagcaaggtctccctatagacaatgtgcgcctggtgtgccattgtcccctggctgccggggctctgacaggactctcacttcccagcccccaggcccggcagctcctcatttcagggagaggccaacacgccccagcccctcctctccacacagataccttcactgctcccctctccccaagggaggccccagacagcttcccagacaggaaccaggccccataatcccctggccgagcgcacattttctccctcacagtccccaggatctggggaatgcccaaagatgacagctccagacctgcctgccagggtggccagagctgctctttctgagcgcattctaaacaaatggaaggcaggcgggcgtctgcctcacccccagccaggctcctgcaggggctcggcagtgctctcactcgcacctgccctgtgcctctgcagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggcctcttccagccgcccccaccccccaggaccccttagcagccctgccctccctatcgtctgaacagttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctacaaaaaaacaaaagtatatatatatatgtacataatatcagaattataacaggcaaataaaacctgaaaatcaag

SEQ ID NO: 4074 - DNA, 14426 bp, human; identical to SEQ ID NO: 4068

SEQ ID NO: 4075 - DNA, 8298 bp, human
gccgtggctggcgggtttctatggtgatgcagcccaagtcccagaggtgggggaagccagaggaaagccttgttatgtgttatgtagacagcacataaagggggctgctccagggagcccccacaggtacctgggggcccagaagtcctttatgactgctgcttagtccctgcactcccaacctcacccctccctaagagggtacccttaggagagagtgagccctcagccccctcatctcgcctgaggcttcagtctccaaggcaactacaactcacctgtaatggaccattctccttaaaagatggggaaaagagacggaggttaaccctttgtggggttcagggaggacggtcttgactactggggaagggagggaggagccccactccatccccacaatcacatgcctctgtggtctgttctattaaatcaacttacagcgtggacttaccacgtaccagaaagcctcatgagcacttccactcacatccactcatctcctccccagatttgcctcagggagggaggtgctatcatcatccccattttacagatgaggacacggaggctcagaaaactggaaactgtgtccaagatcacagagctggcactgggtctcagcaggggtggggttttagagggcgtggtggctccctaagctgcctctcagaggctctggcatcccaacatgtgtgcctgctgggcttcccagggaaccaggggcctgggcgaggatggcctccaagccatcctgccccgtggggagggcttacttgccaggcagatggcaggcaaatgtcgggggcagggagtgacatcttgggatggaggccatgcggaagtaggatgtgatcaacatcacgtctcagcacagagctgaagcccgacaccaaacaaacccccaagtcccccatccaggtactcagtccaagagaaggccaactcctttcccttttgggcttggggacaggctggtttcttggtcccctcttctgctctctggaatctggacttgttctgatacctttcttgcaaccagaggctccagaacccctcccaaagaggcccctctccaatcagcatttagggacagcagtggccccattcttgtgtcgaaggagatactgatgcccagcaggcggcaaggcttcagcctccgagacccctagaaggcgagagaaatgaggtggcagcaaaactagggctcctctcaggccccaggcctcctcagggagctaggatgaccctagcactagagggggcttcagcggccaggccagaaggaacagactgcatccagttcctggggctgtggcctgaaaaggagagcagggaaggagcccagcctggggcagggagaggccctggcccacagcagtcctgggatacctagcctgtgttggtttgcggggggcggggtgggggtgcctggaaacagctcagacactgccaggccccacgggccccctccaggggccccactcccgaggggttaaagggcagagggggacacaggaagcccgggggcggacaatggggcctctgtgatccccagggcttgggcattcctaagtcatgaacacagacgcagatggctgggagacagggccacagggaacccccctccactgaagcacagcctgggttggccagaggctctgtccccatccagccactgcagcagccaccctcagccccaccccttcccagcacaggccctgttggggcatctgaggagacccacgtggcctcatgacaatatgtgtgtgcatgctggttcacgaacacacacacacatgcaaccaaatatatgaccccacccagacaaacaggaatactggaggttacacacacacaaatacacacacacaagcagagacacaaaccccatacatgcagataggaagtctgcctggctggagggcagggggcagaggggctcccgggactcagtccctttccctcaagttccactctcagacccgcactgggatggacgggttcagaagtcctctttggccaagtgcatggagcccaggacgctgccaccctcctgccccacccaacccctggccctcgcagctgcccctgctgggtgtaagggccagagatgagcaggagctgctgactgacagtggctgggcactccctctgcagctttccaacctgggaagaacacggggacctgggctgggggccactggacaaagaaaagcttctagaaagaacagcggccagaccctccccagctcctccctctttttccagccacagccttcaggaagccacaaagaccctgttgatatctggggaagaggcaagctgggcgggctacctcccccagtgctcgtctggctgctgctcaccaggcaccccccatacagccttccactcagacaaggcccccatggggggtctgggcccaaccccaaggcgtagagtccagcagaagggtgctgagtggctgctggacagggcacaacctcagggccctcaagggtgaggcaggggcagctgggggggacaaggagaggagcagagcggtggaagacagacaaaagggtaagcagagagatggagcagagccctgacgggaagggggaagagggaagggagggccaggcaggcagaggcagagggaggagacggggagtggtgcaccccatccccggcagcagcaggcttctgcctagaaggaggaggaaggtgatggccctgggggtggggcacagggagacgtgggaggctgcagaggagagagcaggggggcgggggaagcaggagaaggaggtgtccgagatgggccagatcagagcaagtaagacagcgactgcaggggcagggatgctgcaggcccattccagatggccccacccagggacccagccccagcccattgcaggggcagaggacagggcaatgagcaccctgctggggaccctagaagggcatccagaccccccgcctcccccactgtctgaaccacgagggagggaggcagggcccccactcatgcccccactcatgcctggcagaccagggtcttggctgggatccccatcctggcagacctcctcacaggaccccaccactaccccaggttctcccatgaacgtgccctcctggagcctgggccactctgcgaggccgcatcaccctcacacccagaaaagcactcagtgcagccatttcgagctttgaaagggaacttggtgatcaaggtagggcacacaggcctgtctcctcgaccctcacctgccagtcctggccaggtgcatgccaaggaaggcgccagctgtagttccagtggtggaaagggctcggacctgggagaggccgattgggggcacaatctgggcaccctgctcactgtaggagccctcaggccaggcccttcctcactctttgcctcccttttcccttcagataatcatcaagaaaaaagaaaacaagtgacaccccacgaagacagggacaatgctggtccagtttgtcactggctcttccatgggcagcccagagcccggcccaaaggagcactggccatgagcagctgcccagtacacgactgcccatcgtgggatcctgagcgcctgggtagggaagctcttcactggctgcagggcaggggaccccgccaccttgaagcgctgattgtcctcctgatgctcagcagggagctggcagctgggaacttggggaggagccttttaggagcgcggtgtagcaaaccagggaggctggggcgtgctgaacgtgtttccctcttggtgatcagatcactagcgattcttaatttcttttgttcttttctgtatatttcaagtgtcctacaataagatgtattactttcgggatcatacacacacaaacatcaataaatatggagagagactcagatgcagcagagagaaatgaccaggagccaaggaggtgggaaggtcccaggcccaaccctgccccaaacttcccatgtggccaagacagccgagtcctcaaaggctctggagccctcaggtgtgcacatgtgggcactgcatgggagctgtgccaggggagaggccaggctgggccaagtcccaccacctgcagcaaggagctgacgggaggggagaggccctggggaggcccccgccccagaaagatgatgctgggcagcagcccccaggggaagaagggcggactgcactgatttacgtcagggccacatgagtcagcagagatggcactgggctgccccgatgcccctgccctcagggtggggttaacaggggcagggtatctacctggggggtgccaggcccccactccttctggagaagggggcagatggctctaggcctgccttcctgagagggacagtgataggtggggggtccagataccctgtcgggggcaatggattgtagtgcgtgttctttgcaatccctgccaaccaagaggccccaaaagtctgacctggaatggagggaataggaatcgctgacccctcccataaccgcacagagataggaagatgtggcagtgggcaaaagacctgcagtgcgcagggaccgcctgagccagtgaggcccaccttccctcacccctacctgatggaccctacctgatggacacccatgcacgggaggcacagcagtgggtgcccgaaccgacctcacccactccagccctgactggccacagagcctgtggaaacgggctccagaggcgccctacgcctccggggaggagcccctggctctgcggcaggttttcgggtgagcccggaggagcccaggctgggatttggaaagaagaaggaggagaacaaagcccccccaaccttggggcggaggggcaggcagcgcccagtcccgttcactcccctccccccattgcaggggcggcttatcccgatctacccctcaccacgctgtcagccgggattttcaaccaaactgagctctcggctggggatgaggggcagccacgcccagggccacaccccacggcggcctgtgggggagcgctcgacccgatctggcttcctttctcagacacgcacacacgcacggggacccgccaacttcagcccccgcctgcccacacagaccctgcctgacgccccccgccctgttctcccgcccaggccagcatctggggccccgcaggttacccctcacctgtcgggctcgggcacccggcatccctcccccgccccgcttacagcccgcggtgcccggagcccgacgcccggcatgggtggggctccggcagcaacgccggttaccgcgggccggaccgggccgggactccctggtccgtgcaccccgggcagagcggtgtggtgtcgccgggggatcgcggccgcggcccgggtcgcacggggaggccagcccgccttacctgcgctgcggccaccgctcgggctgcccgcccagcctccgcgcacgccggcctcggacccgccgcccgagcgcgtctgcgatgccgatgctgcggcagcagcggctgtggcggggcggggcgggcgtgcgcgcaggggcgggggaggggagcgccggggaggagagggagggaggagtgagatcacctccccggccgcccgccccgccccgccccgccccgccgcaccctagcccctggtgccagccgagcgcggcttgggctgggggcccccgggcagcccactccgggagctcagcgggaccccagccgacgggtcccgccagacccccttccccgcagaccgggagtctccggccggagagtgtcctcagccccagcgcaagggagcccgctgtgaaagctcggagcgggaatcgcggggcgagagtgctcccagaggcctggggccgggcggtggagagaggagtccggcaaggaaggggatgctcccttagcctcggcctggccctcgacggcgccggccagcgatgggcacctgcacgcaacgcccccccaacacacacacacagggcaggactcccgggacctctcccgaatgccccccgatcctgagggcccagtcagggtcctgttgggaggggtgcgggggcttcgtcctcagcgtgttggggaggcgccgcggagcaccggctcctgcgcaccccagagcccaggtgggcggcagggtaggaggcgagcccaggggagacagggtctgggagagggtatccctcgaactgccacccccaactcccagattttcctccagctctctggtgtcttatttctttgtcctcgggattggccccattcgacctttcccgccgactccactctctcccactctcccccgcagccctgcacaggatcgagaaggaaggagctcctccccagtgccccctcctaggctcaaggccatgacctcacaggcgaggaagcaaaatggagggggtaagaattccggagccggcgagctggctgcagcctcagggctaggaaggcctagggccccgatggcagattgcagatctggcggccacggtatttttatgggcatgcctgttgcccagtgaagcattccaggggccctcgactcagtctcacaagactccccaagtggtgtggggccctggagggcccacatgggagcagccctggcatcctggcttggatgccccacccccatagtgccagcttcagttcccctggaatgggaagcttggggtggacccatctgtgctcagagagggtctggatgccatgtttgcccagcctttaggaggagaatggacaagactaggcacctgagtgaagacggacggctagggagactgcttccagagtgggggcacttgcagggcatcttcaggtgacagcagaggaaactgagcccgcctgggtcacgaggccagcaggctcatgagctgggccaagagggcgtactttccatgaggcactgagctgtggtcagcttcctgcctttgctgatctgaactctgataggcctctctcctttccagttgctgcctccactcactccctacgttcccagcctttcctccaagccccaacttctgcaaatcctttacctaatctagggtttgatgcccatcaggatggtgaagtaagcagggaatagagcccgtttatacgcacctgctaatgtgtagtgatgggtccatttatggtaacaaaaaattcattactaggattacacgacatcacatttcctgagcacagccatggacctgccatcgttacatttcctgcacatttaaattgcacaccaacctggggaggtctgttgaagcattcgccccacgttacagatgagaaaaccaaagcccacagagctcaaggctgggtccagcaagcacagttaggaaggtctctttctctccactggctcattgcatccacacacacaccccagatgatggtgctgttattatcctcactctcccagtgaggtacccaaggtccagagaggggcagtcatgcaaccaggaagaaattggcactatcagtgcccccatttcacagatgaggaaaccaaggttcagaggggtcaaatgacccacccaagatagcccagaaggtaaatggcagaactcggacttgaattcccttctgcttgaccacgatgcccattctcacttccatgtaatgaagtggaggagccaatgggagcaagagcaagagtgacagaagaccaagggcagagcaagtcccaggagaagcaggagggactggccctgaacaagaggcaagccacccccccactgccatgtgcttgctgttggaggttagggggacaccaagtagacagatgactgtctctttcccttcaacgtcaagtgcttctcacagccctgctccctgtgacccagccctcatagacacagtggactggacaagggaagccccagactctgaccctgtgatgagcatgcagaagacgcagaagccacagacgacagtggggcagtaaggaagtgccagcaggcaggcggggtgggctcagccagacgtgtctttctctgttctcctttcaatctttctgtgtcttcatatctcaggtgtagcgcttggaaacagcacatagttgggttttggtttggtttgattctgtctaacaattcttgtctttttaaaaatcagctttgagacctgcctgggcaacacagcgagaccacgtctctacaaaaaaaattttaaaattaggcatggtggtgcatgtctgtagtcccaactactcaggaggctgaggtgggaggatcgctggagcccaagaggttgaggctacagtgagccatgatcacaccactacactccagcctgggtgacagagtgagaccctgtctc

SEQ ID NO: 4076 - DNA, 2296 bp, human
gccgcagcatcggcatcgcagacgcgctcgggcggcgggtccgaggccggcgtgcgcggaggctgggcgggcagcccgagcggtggccgcagcgcaggtaaggcgggctggcctccccgtgcgacccgggccgcggccgcgatcccccggcgacaccacaccgctctgcccggggtgcacggaccagggagtcccggcccggtccggcccgcggtaaccggcgttgctgccggagccccacccatgccgggcgtcgggctccgggcaccgcgggctgtaagcggggcgggggagggatgccgggtgcccgagcccgacaggtgaggggtaacctgcggggccccagatgctggcctgggcgggagaacagggcggggggcgtcaggcagggtctgtgtgggcaggcgggggctgaagttggcgggtccccgtgcgtgtgtgcgtgtctgagaaaggaagccagatcgggtcgagcgctcccccacaggccgccgtggggtgtggccctgggcgtggctgcccctcatccccagccgagagctcagtttggttgaaaatcccggctgacagcgtggtgaggggtagatcgggataagccgcccctgcaatggggggaggggagtgaacgggactgggcgctgcctgcccctccgccccaaggttgggggggctttgttctcctccttcttctttccaaatcccagcctgggctcctccgggctcacccgaaaacctgccgcagagccaggggctcctccccggaggcgtagggcgcctctggagcccgtttccacaggctctgtggccagtcagggctggagtgggtgaggtcggttcgggcacccactgctgtgcctcccgtgcatgggtgtccatcaggtagggtccatcaggtaggggtgagggaaggtgggcctcactggctcaggcggtccctgcgcactgcaggtcttttgcccactgccacatcttcctatctctgtgcggttatgggaggggtcagcgattcctattccctccattccaggtcagacttttggggcctcttggttggcagggattgcaaagaacacgcactacaatccattgcccccgacagggtatctggaccccccacctatcactgtccctctcaggaaggcaggcctagagccatctgcccccttctccagaaggagtgggggcctggcaccccccaggtagataccctgcccctgttaaccccaccctgagggcaggggcatcggggcagcccagtgccatctctgctgactcatgtggccctgacgtaaatcagtgcagtccgcccttcttcccctgggggctgctgcccagcatcatctttctggggcgggggcctccccagggcctctcccctcccgtcagctccttgctgcaggtggtgggacttggcccagcctggcctctcccctggcacagctcccatgcagtgcccacatgtgcacacctgagggctccagagcctttgaggactcggctgtcttggccacatgggaagtttggggcagggttgggcctgggaccttcccacctccttggctcctggtcatttctctctgctgcatctgagtctctctccatatttattgatgtttgtgtgtgtatgatcccgaaagtaatacatcttattgtaggacacttgaaatatacagaaaagaacaaaagaaattaagaatcgctagtgatctgatcaccaagagggaaacacgttcagcacgccccagcctccctggtttgctacaccgcgctcctaaaaggctcctccccaagttcccagctgccagctccctgctgagcatcaggaggacaatcagcgcttcaaggtggcggggtcccctgccctgcagccagtgaagagcttccctacccaggcgctcaggatcccacgatgggcagtcgtgtactgggcagctgctcatggccagtgctcctttgggccgggctctgggctgcccatggaagagccagtgacaaactggaccagcattgtccctgtcttcgtggggtgtcacttgttttcttttttcttgatgattatctgaagggaaaagggaggcaaagagtgaggaagggcctggcctgagggctcctacagtgagcagggtgcccagattgtgcccccaatcggcctctcccaggtccgagccctttccaccactggaactacagctggcgccttccttggcatgcacctggccaggactggcaggtgagggtcgaggagacaggcctgtgtgccctaccttgatcaccaagttccctttcaaagctcgaa

SEQ ID NO: 4077 - DNA, 8317 bp, human
gccgtggctggcgggtttctatggtgatgcagcccaagtcccagaggtgggggaagccagaggaaagccttgttatgtgttatgtagacagcacataaagggggctgctccagggagcccccacaggtacctgggggcccagaagtcctttatgactgctgcttagtccctgcactcccaacctcacccctccctaagagggtacccttaggagagagtgagccctcagccccctcatctcgcctgaggcttcagtctccaaggcaactacaactcacctgtaatggaccattctccttaaaagatggggaaaagagacggaggttaaccctttgtggggttcagggaggacggtcttgactactggggaagggagggaggagccccactccatccccacaatcacatgcctctgtggtctgttctattaaatcaacttacagcgtggacttaccacgtaccagaaagcctcatgagcacttccactcacatccactcatctcctccccagatttgcctcagggagggaggtgctatcatcatccccattttacagatgaggacacggaggctcagaaaactggaaactgtgtccaagatcacagagctggcactgggtctcagcaggggtggggttttagagggcgtggtggctccctaagctgcctctcagaggctctggcatcccaacatgtgtgcctgctgggcttcccagggaaccaggggcctgggcgaggatggcctccaagccatcctgccccgtggggagggcttacttgccaggcagatggcaggcaaatgtcgggggcagggagtgacatcttgggatggaggccatgcggaagtaggatgtgatcaacatcacgtctcagcacagagctgaagcccgacaccaaacaaacccccaagtcccccatccaggtactcagtccaagagaaggccaactcctttcccttttgggcttggggacaggctggtttcttggtcccctcttctgctctctggaatctggacttgttctgatacctttcttgcaaccagaggctccagaacccctcccaaagaggcccctctccaatcagcatttagggacagcagtggccccattcttgtgtcgaaggagatactgatgcccagcaggcggcaaggcttcagcctccgagacccctagaaggcgagagaaatgaggtggcagcaaaactagggctcctctcaggccccaggcctcctcagggagctaggatgaccctagcactagagggggcttcagcggccaggccagaaggaacagactgcatccagttcctggggctgtggcctgaaaaggagagcagggaaggagcccagcctggggcagggagaggccctggcccacagcagtcctgggatacctagcctgtgttggtttgcggggggcggggtgggggtgcctggaaacagctcagacactgccaggccccacgggccccctccaggggccccactcccgaggggttaaagggcagagggggacacaggaagcccgggggcggacaatggggcctctgtgatccccagggcttgggcattcctaagtcatgaacacagacgcagatggctgggagacagggccacagggaacccccctccactgaagcacagcctgggttggccagaggctctgtccccatccagccactgcagcagccaccctcagccccaccccttcccagcacaggccctgttggggcatctgaggagacccacgtggcctcatgacaatatgtgtgtgcatgctggttcacgaacacacacacacatgcaaccaaatatatgaccccacccagacaaacaggaatactggaggttacacacacacaaatacacacacacaagcagagacacaaaccccatacatgcagataggaagtctgcctggctggagggcagggggcagaggggctcccgggactcagtccctttccctcaagttccactctcagacccgcactgggatggacgggttcagaagtcctctttggccaagtgcatggagcccaggacgctgccaccctcctgccccacccaacccctggccctcgcagctgcccctgctgggtgtaagggccagagatgagcaggagctgctgactgacagtggctgggcactccctctgcagctttccaacctgggaagaacacggggacctgggctgggggccactggacaaagaaaagcttctagaaagaacagcggccagaccctccccagctcctccctctttttccagccacagccttcaggaagccacaaagaccctgttgatatctggggaagaggcaagctgggcgggctacctcccccagtgctcgtctggctgctgctcaccaggcaccccccatacagccttccactcagacaaggcccccatggggggtctgggcccaaccccaaggcgtagagtccagcagaagggtgctgagtggctgctggacagggcacaacctcagggccctcaagggtgaggcaggggcagctgggggggacaaggagaggagcagagcggtggaagacagacaaaagggtaagcagagagatggagcagagccctgacgggaagggggaagagggaagggagggccaggcaggcagaggcagagggaggagacggggagtggtgcaccccatccccggcagcagcaggcttctgcctagaaggaggaggaaggtgatggccctgggggtggggcacagggagacgtgggaggctgcagaggagagagcaggggggcgggggaagcaggagaaggaggtgtccgagatgggccagatcagagcaagtaagacagcgactgcaggggcagggatgctgcaggcccattccagatggccccacccagggacccagccccagcccattgcaggggcagaggacagggcaatgagcaccctgctggggaccctagaagggcatccagaccccccgcctcccccactgtctgaaccacgagggagggaggcagggcccccactcatgcccccactcatgcctggcagaccagggtcttggctgggatccccatcctggcagacctcctcacaggaccccaccactaccccaggttctcccatgaacgtgccctcctggagcctgggccactctgcgaggccgcatcaccctcacacccagaaaagcactcagtgcagccatttcgagctttgaaagggaacttggtgatcaaggtagggcacacaggcctgtctcctcgaccctcacctgccagtcctggccaggtgcatgccaaggaaggcgccagctgtagttccagtggtggaaagggctcggacctgggagaggccgattgggggcacaatctgggcaccctgctcactgtaggagccctcaggccaggcccttcctcactctttgcctcccttttcccttcagataatcatcaagaaaaaagaaaacaagtgacaccccacgaagacagggacaatgctggtccagtttgtcactggctcttccatgggcagcccagagcccggcccaaaggagcactggccatgagcagctgcccagtacacgactgcccatcgtgggatcctgagcgcctgggtagggaagctcttcactggctgcagggcaggggaccccgccaccttgaagcgctgattgtcctcctgatgctcagcagggagctggcagctgggaacttggggaggagccttttaggagcgcggtgtagcaaaccagggaggctggggcgtgctgaacgtgtttccctcttggtgatcagatcactagcgattcttaatttcttttgttcttttctgtatatttcaagtgtcctacaataagatgtattactttcgggatcatacacacacaaacatcaataaatatggagagagactcagatgcagcagagagaaatgaccaggagccaaggaggtgggaaggtcccaggcccaaccctgccccaaacttcccatgtggccaagacagccgagtcctcaaaggctctggagccctcaggtgtgcacatgtgggcactgcatgggagctgtgccaggggagaggccaggctgggccaagtcccaccacctgcagcaaggagctgacgggaggggagaggccctggggaggcccccgccccagaaagatgatgctgggcagcagcccccaggggaagaagggcggactgcactgatttacgtcagggccacatgagtcagcagagatggcactgggctgccccgatgcccctgccctcagggtggggttaacaggggcagggtatctacctggggggtgccaggcccccactccttctggagaagggggcagatggctctaggcctgccttcctgagagggacagtgataggtggggggtccagataccctgtcgggggcaatggattgtagtgcgtgttctttgcaatccctgccaaccaagaggccccaaaagtctgacctggaatggagggaataggaatcgctgacccctcccataaccgcacagagataggaagatgtggcagtgggcaaaagacctgcagtgcgcagggaccgcctgagccagtgaggcccaccttccctcacccctacctgatggaccctacctgatggacacccatgcacgggaggcacagcagtgggtgcccgaaccgacctcacccactccagccctgactggccacagagcctgtggaaacgggctccagaggcgccctacgcctccggggaggagcccctggctctgcggcaggttttcgggtgagcccggaggagcccaggctgggatttggaaagaagaaggaggagaacaaagcccccccaaccttggggcggaggggcaggcagcgcccagtcccgttcactcccctccccccattgcaggggcggcttatcccgatctacccctcaccacgctgtcagccgggattttcaaccaaactgagctctcggctggggatgaggggcagccacgcccagggccacaccccacggcggcctgtgggggagcgctcgacccgatctggcttcctttctcagacacgcacacacgcacggggacccgccaacttcagcccccgcctgcccacacagaccctgcctgacgccccccgccctgttctcccgcccaggccagcatctggggccccgcaggttacccctcacctgtcgggctcgggcacccggcatccctcccccgccccgcttacagcccgcggtgcccggagcccgacgcccggcatgggtggggctccggcagcaacgccggttaccgcgggccggaccgggccgggactccctggtccgtgcaccccgggcagagcggtgtggtgtcgccgggggatcgcggccgcggcccgggtcgcacggggaggccagcccgccttacctgcgctgcggccaccgctcgggctgcccgcccagcctccgcgcacgccggcctcggacccgccgcccgagcgcgtctgcgatgccgatgctgcggcagcagcggctgtggcggggcggggcgggcgtgcgcgcaggggcgggggaggggagcgccggggaggagagggagggaggagtgagatcacctccccggccgcccgccccgccccgccccgccccgccgcaccctagcccctggtgccagccgagcgcggcttgggctgggggcccccgggcagcccactccgggagctcagcgggaccccagccgacgggtcccgccagacccccttccccgcagaccgggagtctccggccggagagtgtcctcagccccagcgcaagggagcccgctgtgaaagctcggagcgggaatcgcggggcgagagtgctcccagaggcctggggccgggcggtggagagaggagtccggcaaggaaggggatgctcccttagcctcggcctggccctcgacggcgccggccagcgatgggcacctgcacgcaacgcccccccaacacacacacacagggcaggactcccgggacctctcccgaatgccccccgatcctgagggcccagtcagggtcctgttgggaggggtgcgggggcttcgtcctcagcgtgttggggaggcgccgcggagcaccggctcctgcgcaccccagagcccaggtgggcggcagggtaggaggcgagcccaggggagacagggtctgggagagggtatccctcgaactgccacccccaactcccagattttcctccagctctctggtgtcttatttctttgtcctcgggattggccccattcgacctttcccgccgactccactctctcccactctcccccgcagccctgcacaggatcgagaaggaaggagctcctccccagtgccccctcctaggctcaaggccatgacctcacaggcgaggaagcaaaatggagggggtaagaattccggagccggcgagctggctgcagcctcagggctaggaaggcctagggccccgatggcagattgcagatctggcggccacggtatttttatgggcatgcctgttgcccagtgaagcattccaggggccctcgactcagtctcacaagactccccaagtggtgtggggccctggagggcccacatgggagcagccctggcatcctggcttggatgccccacccccatagtgccagcttcagttcccctggaatgggaagcttggggtggacccatctgtgctcagagagggtctggatgccatgtttgcccagcctttaggaggagaatggacaagactaggcacctgagtgaagacggacggctagggagactgcttccagagtgggggcacttgcagggcatcttcaggtgacagcagaggaaactgagcccgcctgggtcacgaggccagcaggctcatgagctgggccaagagggcgtactttccatgaggcactgagctgtggtcagcttcctgcctttgctgatctgaactctgataggcctctctcctttccagttgctgcctccactcactccctacgttcccagcctttcctccaagccccaacttctgcaaatcctttacctaatctagggtttgatgcccatcaggatggtgaagtaagcagggaatagagcccgtttatacgcacctgctaatgtgtagtgatgggtccatttatggtaacaaaaaattcattactaggattacacgacatcacatttcctgagcacagccatggacctgccatcgttacatttcctgcacatttaaattgcacaccaacctggggaggtctgttgaagcattcgccccacgttacagatgagaaaaccaaagcccacagagctcaaggctgggtccagcaagcacagttaggaaggtctctttctctccactggctcattgcatccacacacacaccccagatgatggtgctgttattatcctcactctcccagtgaggtacccaaggtccagagaggggcagtcatgcaaccaggaagaaattggcactatcagtgcccccatttcacagatgaggaaaccaaggttcagaggggtcaaatgacccacccaagatagcccagaaggtaaatggcagaactcggacttgaattcccttctgcttgaccacgatgcccattctcacttccatgtaatgaagtggaggagccaatgggagcaagagcaagagtgacagaagaccaagggcagagcaagtcccaggagaagcaggagggactggccctgaacaagaggcaagccacccccccactgccatgtgcttgctgttggaggttagggggacaccaagtagacagatgactgtctctttcccttcaacgtcaagtgcttctcacagccctgctccctgtgacccagccctcatagacacagtggactggacaagggaagccccagactctgaccctgtgatgagcatgcagaagacgcagaagccacagacgacagtggggcagtaaggaagtgccagcaggcaggcggggtgggctcagccagacgtgtctttctctgttctcctttcaatctttctgtgtcttcatatctcaggtgtagcgcttggaaacagcacatagttgggttttggtttggtttgattctgtctaacaattcttgtctttttaaaaatcagctttgagacctgcctgggcaacacagcgagaccacgtctctacaaaaaaaattttaaaattaggcatggtggtgcatgtctgtagtcccaactactcaggaggctgaggtgggaggatcgctggagcccaagaggttgaggctacagtgagccatgatcacaccactacactccagcctgggtgacagagtgagaccctgtctcaaaaaaaaaaaaaaaaaaa

SEQ ID NO: 4078 - DNA, 24200 bp, human; identical to SEQ ID NO: 4067

SEQ ID NO: 4079 - DNA, 24574 bp, human; identical to SEQ ID NO: 4070

SEQ ID NO: 4080 - DNA, 13192 bp, human
agacgcgctcgggcggcgggtccgaggccggcgtgcgcggaggctgggcgggcagcccgagcggtggccgcagcgcaggtaaggcgggctggcctccccgtgcgacccgggccgcggccgcgatcccccggcgacaccacaccgctctgcccggggtgcacggaccagggagtcccggcccggtccggcccgcggtaaccggcgttgctgccggagccccacccatgccgggcgtcgggctccgggcaccgcgggctgtaagcggggcgggggagggatgccgggtgcccgagcccgacaggtgaggggtaacctgcggggccccagatgctggcctgggcgggagaacagggcggggggcgtcaggcagggtctgtgtgggcaggcgggggctgaagttggcgggtccccgtgcgtgtgtgcgtgtctgagaaaggaagccagatcgggtcgagcgctcccccacaggccgccgtggggtgtggccctgggcgtggctgcccctcatccccagccgagagctcagtttggttgaaaatcccggctgacagcgtggtgaggggtagatcgggataagccgcccctgcaatggggggaggggagtgaacgggactgggcgctgcctgcccctccgccccaaggttgggggggctttgttctcctccttcttctttccaaatcccagcctgggctcctccgggctcacccgaaaacctgccgcagagccaggggctcctccccggaggcgtagggcgcctctggagcccgtttccacaggctctgtggccagtcagggctggagtgggtgaggtcggttcgggcacccactgctgtgcctcccgtgcatgggtgtccatcaggtagggtccatcaggtaggggtgagggaaggtgggcctcactggctcaggcggtccctgcgcactgcaggtcttttgcccactgccacatcttcctatctctgtgcggttatgggaggggtcagcgattcctattccctccattccaggtcagacttttggggcctcttggttggcagggattgcaaagaacacgcactacaatccattgcccccgacagggtatctggaccccccacctatcactgtccctctcaggaaggcaggcctagagccatctgcccccttctccagaaggagtgggggcctggcaccccccaggtagataccctgcccctgttaaccccaccctgagggcaggggcatcggggcagcccagtgccatctctgctgactcatgtggccctgacgtaaatcagtgcagtccgcccttcttcccctgggggctgctgcccagcatcatctttctggggcgggggcctccccagggcctctcccctcccgtcagctccttgctgcaggtggtgggacttggcccagcctggcctctcccctggcacagctcccatgcagtgcccacatgtgcacacctgagggctccagagcctttgaggactcggctgtcttggccacatgggaagtttggggcagggttgggcctgggaccttcccacctccttggctcctggtcatttctctctgctgcatctgagtctctctccatatttattgatgtttgtgtgtgtatgatcccgaaagtaatacatcttattgtaggacacttgaaatatacagaaaagaacaaaagaaattaagaatcgctagtgatctgatcaccaagagggaaacacgttcagcacgccccagcctccctggtttgctacaccgcgctcctaaaaggctcctccccaagttcccagctgccagctccctgctgagcatcaggaggacaatcagcgcttcaaggtggcggggtcccctgccctgcagccagtgaagagcttccctacccaggcgctcaggatcccacgatgggcagtcgtgtactgggcagctgctcatggccagtgctcctttgggccgggctctgggctgcccatggaagagccagtgacaaactggaccagcattgtccctgtcttcgtggggtgtcacttgttttcttttttcttgatgattatctgaagggaaaagggaggcaaagagtgaggaagggcctggcctgagggctcctacagtgagcagggtgcccagattgtgcccccaatcggcctctcccaggtccgagccctttccaccactggaactacagctggcgccttccttggcatgcacctggccaggactggcaggtgagggtcgaggagacaggcctgtgtgccctaccttgatcaccaagttccctttcaaagctcgaaatggctgcactgagtgcttttctgggtgtgagggtgatgcggcctcgcagagtggcccaggctccaggagggcacgttcatgggagaacctggggtagtggtggggtcctgtgaggaggtctgccaggatggggatcccagccaagaccctggtctgccaggcatgagtgggggcatgagtgggggccctgcctccctccctcgtggttcagacagtgggggaggcggggggtctggatgcccttctagggtccccagcagggtgctcattgccctgtcctctgcccctgcaatgggctggggctgggtccctgggtggggccatctggaatgggcctgcagcatccctgcccctgcagtcgctgtcttacttgctctgatctggcccatctcggacacctccttctcctgcttcccccgcccccctgctctctcctctgcagcctcccacgtctccctgtgccccacccccagggccatcaccttcctcctccttctaggcagaagcctgctgctgccggggatggggtgcaccactccccgtctcctccctctgcctctgcctgcctggccctcccttccctcttcccccttcccgtcagggctctgctccatctctctgcttacccttttgtctgtcttccaccgctctgctcctctccttgtcccccccagctgcccctgcctcacccttgagggccctgaggttgtgccctgtccagcagccactcagcacccttctgctggactctacgccttggggttgggcccagaccccccatgggggccttgtctgagtggaaggctgtatggggggtgcctggtgagcagcagccagacgagcactgggggaggtagcccgcccagcttgcctcttccccagatatcaacagggtctttgtggcttcctgaaggctgtggctggaaaaagagggaggagctggggagggtctggccgctgttctttctagaagcttttctttgtccagtggcccccagcccaggtccccgtgttcttcccaggttggaaagctgcagagggagtgcccagccactgtcagtcagcagctcctgctcatctctggcccttacacccagcaggggcagctgcgagggccaggggttgggtggggcaggagggtggcagcgtcctgggctccatgcacttggccaaagaggacttctgaacccgtccatcccagtgcgggtctgagagtggaacttgagggaaagggactgagtcccgggagcccctctgccccctgccctccagccaggcagacttcctatctgcatgtatggggtttgtgtctctgcttgtgtgtgtgtatttgtgtgtgtgtaacctccagtattcctgtttgtctgggtggggtcatatatttggttgcatgtgtgtgtgtgttcgtgaaccagcatgcacacacatattgtcatgaggccacgtgggtctcctcagatgccccaacagggcctgtgctgggaaggggtggggctgagggtggctgctgcagtggctggatggggacagagcctctggccaacccaggctgtgcttcagtggaggggggttccctgtggccctgtctcccagccatctgcgtctgtgttcatgacttaggaatgcccaagccctggggatcacagaggccccattgtccgcccccgggcttcctgtgtccccctctgccctttaacccctcgggagtggggcccctggagggggcccgtggggcctggcagtgtctgagctgtttccaggcacccccaccccgccccccgcaaaccaacacaggctaggtatcccaggactgctgtgggccagggcctctccctgccccaggctgggctccttccctgctctccttttcaggccacagccccaggaactggatgcagtctgttccttctggcctggccgctgaagccccctctagtgctagggtcatcctagctccctgaggaggcctggggcctgagaggagccctagttttgctgccacctcatttctctcgccttctaggggtctcggaggctgaagccttgccgcctgctgggcatcagtatctccttcgacacaagaatggggccactgctgtccctaaatgctgattggagaggggcctctttgggaggggttctggagcctctggttgcaagaaaggtatcagaacaagtccagattccagagagcagaagaggggaccaagaaaccagcctgtccccaagcccaaaagggaaaggagttggccttctcttggactgagtacctggatgggggacttgggggtttgtttggtgtcgggcttcagctctgtgctgagacgtgatgttgatcacatcctacttccgcatggcctccatcccaagatgtcactccctgcccccgacatttgcctgccatctgcctggcaagtaagccctccccacggggcaggatggcttggaggccatcctcgcccaggcccctggttccctgggaagcccagcaggcacacatgttgggatgccagagcctctgagaggcagcttagggagccaccacgccctctaaaaccccacccctgctgagacccagtgccagctctgtgatcttggacacagtttccagttttctgagcctccgtgtcctcatctgtaaaatggggatgatgatagcacctccctccctgaggcaaatctggggaggagatgagtggatgtgagtggaagtgctcatgaggctttctggtacgtggtaagtccacgctgtaagttgatttaatagaacagaccacagaggcatgtgattgtggggatggagtggggctcctccctcccttccccagtagtcaagaccgtcctccctgaaccccacaaagggttaacctccgtctcttttccccatcttttaaggagaatggtccattacaggtgagttgtagttgccttggagactgaagcctcaggcgagatgagggggctgagggctcactctctcctaagggtaccctcttagggaggggtgaggttgggagtgcagggactaagcagcagtcataaaggacttctgggcccccaggtacctgtgggggctccctggagcagccccctttatgtgctgtctacataacacataacaaggctttcctctggcttcccccacctctgggacttgggctgcatcaccatagaaacccgccagccacggcctggggagcggggcggggagggccagcgggagccttaaagggacacagtgcacagggtgtaggtgacacccacaccatcgtatacacaccaacaggcacagaagccccccaggctcccaggcctgcaagcacatgggcccagcaccacactctgaccctttcatgtgccctgtgctgagcccccagccccacccccactctggcccactgagtcaccaggcaccatgtccccaggagacaagggcaggagaagccggatagtctctgctgtgctgttgaagggctctcttgttgcttctcctttgagaggaactccaggcagaacctgagaactgacaggcaggtgtgcagggcacatgtgcagggcaccgctggaggttcccttctcaaggtgtgtggtggtggtggtgatggggtgtgtgtgtgtgttttcagggaggaggcagtcactccaggtctagccaggctccacaacctcccaggtccctccctggcaagctgcttcccatcagaccaaagcaggcactttggagcagaggacagaggactccctgagggacctgcgggtgtagtgggaggccaggtggggtgggatggggcaaggctcttctggggctgaacccctccctgtaggctgctgggcgtgacccttgcctccctggccctttcccaccggggaggatgggtttgggaccggacttactcaggaatggccccatcttcaactgccccagcacagcggccactgtccactcagtgcatggtcacgcaggctcactcttggcctaacacatgtgcgtctcctccagccaggtgaccacttactcccagccagcagcaatattggaaggcttccctgggattttctgggtgcttccccctccccccgttcctacccgcagcaggaatcccccgacccccacctgttccctggcatggcatgggtcagccagcagtgtgccattcatcctgtctcacggccgtcccttgcccagtgccacaagtgggcagggccttgatgctctgttgcgtggggctttgtaggcccctccggccccagctcacagctgctccaccctctgtctgtctctctaccctgctcccaggccagcgtgacgtccacgccgggaagcccctccactgacccaggcccatcttccctcctccccgccccttgcctggcacagcccccagggacaaggacgctgtgcaggcggcctgcgcgcacgcgcacgtgcacacgcccacccccacccctcactcttctcgctctttctgccatttctcagcggcgcactctgcagctgcctctcaccctttgtgctccggtttcctcttctctccctttctctgctgcctgggtctccgtttcggaatttccccaccccctaaccatctccatcgtggttagcgctgtcttcctacgtctgtctttgtctcctgctcccccctgcctcttctcactctgtctgtcacccttggcagacccggccttggctccatctgtggaacactcccccctccccgctcctttgcccttagtggtgctggtggggggtagagggcctgctgagctgacaaccctagctgcttgctctgtaattgcctgaggaatggtgagagatcagagacccagcagcagtgggaggagaggagggagcgccccctcccagctgttatatctcgcaaccttctggctgcttcctgcctgtctccgactgcccagggcggtggcaagctaggtggcaaatactgggagaccaaaaaagaagttggatatgagcctgtggggagatgggatggggctgggatggggcagggagcggggaccaggggtttggggatattgtatttcccctgagcgtacatgccaaacaccattccaggattctagatttggaggacaaatagaggaacttgcgtggcagaaattatcgacctccagagcacccaaaagcctctgacatgcaggagggtccttctttgagcttttccttgctccggtttcctcccctccccctcctaagaccagtgctcagagctcccaaggctgctgtttgatcatctgctctctgatccgagtctcctactgctcctacaggccttgaagttgaggccagtgctgcctggggcctcccctgatccactggctttgtagggagaggccggggtggaacagatccactgttgctcttcccttctgggcccaggtccagctcttgcaggctgggaatcactcttcttaccctccaagtcatctcttggcctccaggccatgcacgctgacccaccctgctgcttctccaccaccctctgcagcaagctcttgcccagagtccccacgggatctgccgcattcacagctcttcttgggtcactctgttacacaaaactgacaaggcccagagccttagcacagcatggctgacttctctaccatcctttcggtgttcctgctgaggctcggtgcccgctttgataaggtcctggctgggcagagggaggatgcacagtatggatttaatgaaggcgtctagtctgggacttcagcctccaagctctgtcacctaacaacaccctttcttgccttgcctgcactttaaccacttcctgtttggaattgaagtggtctggccacttgggagtctgtttcctcttgtcattgtcagaggagccccctctttcagacccttagtctttggctccccttacttgtaggtgaatatggacatggccggtgtggcttgggtttggggtggacacatgcagcagttgagctctgaagactcagacaaagacctagaaattgggactttgagacacacaagaagtgttagaaacactgtcacggaaaatgtcccagagcttgtcctgacccctgtcctgaccctaacctggagcatctggaagggaggaggcctcagtggcctctcttgacccccagggggctgaggagcagcagggggttgttttcctccttcctctcttctcccacaccagttctcaagggaaggcttccttccccattctttctctcttttttttgagatggagtttcgctcttgttgcccaggctggagtgcaatggtgcgatcttggctcactgcaacttccgcctcctgggttcaagagattctcctgcctcagcctcccaagtagctgggattacaggaatgcaccaccacgccaggctaactttttttttttttttgagacagagtcttgctctgtcacccaggctggagtacaatggcgcaatctccgctcaccgcaacctctgcctcctgggttcaagtgattctcctgcctcagcctcctgagtagctgggattacaggcatgagccaccacgcctggcttttttttttttttttttttttttttttgtatttttagtagagacaggatttcaccatgttggccaggctggtctcaaactgctgacctcatgatccgcctgcctcagcctcccaaagtgctgggattacaggcgtgagccaccacgcccagccctaattttgtatttttactagagacagggtttcaccatgttggcctggctggttttgaactcctgacttcaggtgatccacccacctcggcctcccaaagtgctgggattacaggcatgagccactgtgcctggccttttatttttatttttatttatttttttagacagagtctcactccatcacccaggctggggggcagtggcacgatcttggctcactgcaacctccgcctctcaggctcaagtgattctcatgcctcagcctcccaagtagctggcattacaggcgcccaccaccaaggctaattttttttctttttgtatttttagtagagacggggttccgccatgttggccaggctggtctcaaactcccaacctcaagagatccacccacctcagcctcccaaactactgggattacaggcgtgagccaccacgcctggccctttccccattctttcttcattttcctgaaactattttgtgaaatgctgccatcttgggcccctttcctcccttctctatcccacttcccaatccccccattagctttttaggtctgtacagcacccaggcatcagttggctctgaaagctatagcaatgtgactgcaagaagaattcttctctacatgtgtgtgcacacagagataatagatacagggattcatccccacagatacataaagacatacaagaagacacacgtagctagcagacttgtgtgttgattccctcaggcacacacactaacacacccactcatgagtgcaacccctcccagagaagacacaccacagaaataccagctcacatacagctcactccctgcttgcagatccacaaccacacacatgcccacggacacctgcacatgcagacacatacggggatgtgcatgccatgcacaggggagctgatggggcaacaagttggtgctgggaaggcagctggcaggaaaggtgcagacagagagtagagagggaataaaaggcaacctagaggcccagccagggctatctcttccagatttctccctccaaggtggggaggggtgcggatggggaggggagggctggagaagccggccagctgggggcggggctgagggcggggccaagagcccgggcttacccagatgttagtcactaacgtccttccgttctctcgtctctcttcccccacccttcccttcccttctcccctctcccagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaatgtgagtagctgaagggagcctgggcgcctaccttcgccgctatgttgggcccctctttatcttctacctcctcaccttctccctgttccggaccctgactcctctccctggcctttcctgggcacagggtgggcaggagatagccaggacgttgggtacccccggagagaagggcagggtagaaggtgcggggcgtgtcaggaccatggacagggacaggcgcggccgccggggcgatttcagcaccagggacagcgaacctggagcagggccccgaggtcttgggcctcctccatgctctccttagcccgccccatctctgcccgccccactccgactcctccgcttccatcccccaccacaggggtgtggcagcaggagaatggggtcgtccccagccctcagctggcttgtgcaaaggcctgtgttcaagtcttgtccccatttctctttcccctcctgggcccttggtcaccctgtctctgaactgagacaggaaaaggtggcttgaaaaaccctggtcccagcccagcagccttctggacccttttttgtgtgtagttatttggtgggggtgggggcagggctgctggagcatgtgtctatggttgtaacatttgttgggggcacaagcaggtgagtggatgttggggagtgtggccgtagggttgtgattaagcatggatacactgtgtatgtctgtgtgttcttgtgattgactgagcgtagatattcgtgaatgtgattttgacttccttacatgggtgactgtgtgagtcactctgttacttactggccaggcttgtggaggtcgggaggtatttgaccacgacatttgattgcattgggtcatgtgtatgtgtgagtggggctgaatgtaagtacacacttgcgtgtggggggtgttaccgtgatggtgttttctcctgtaagtagctgtcaggccgtgtgaggggcatgtcacagggtatcatgtgtgagggcatttgtgtctcttgagctaccaggctccagtcccttcccagcctcaccttgacacctttgtctctgggcctggacaaggaggaggccagtgtcactgagagacgagttggcggataggggttgggaagactgtctgtgccagcagtgggacaggggctgcgagagagaggctggggaggcacctggcgttgggaggcagtgagggcttggaggaggtaaaggggctggccccttagacacatacatggagggccagggccaggcagactcccttggtacagatgcacatggacacatgcacacaggtgcatgaagacaaggcaggtgcagggatgaaggagcagagccgctgagaggccacacaggtggaaacacacaccagtgaggcttttagacccagaggacacagaggtggatacacaatataacactgtacagtggaatgcaagccgtgcattctctacagaaagatgggagtggggagagagaactaggccaaaaggccatggcagctccaaggctgccctggtcactgaccagcacttgttcttgaccctgatacgacacagtgggcagtggcaggcagccggccctccctgttggaacctgtcttccatctctccctccccagccactccagccccctttgtctcttttcctgcttcctccacctagttggctttctgcatcctgtcatccctgtcaccatctccctccccagctcagggccctctgcagtgtccccagggagccccctcctccctccctggaccttcacactgaggtcttctgcagagacaaagctttcagaggcagcctgctgctccctccctccctcttctcccttcctcgaggccgccctggccagtgctctgcagagtcctggggctgggacagcagctctggcctctgccccagagagcttggtggctgtctgggaggaaggagggagaagaggagggctggcgccaaccccgcaggctatggaaactcagaggcagcagggcctttgggatagttttcagggggagggggcagcagggctctgaaggctgggccctggtaattgaaaacactcagctgtgctaattggattaggagggaagcaggctggagcaggggacggtgccttccaaggcatcctgaatgggtggggtcagttctgcaggccctgccaggccctgccagggggctgcaaggacactccttgttaaaggcaagaatttctctctccctgtctgctagagctggaggcatggcctggctgcctctgggctacatgccctgtgtgtctatccagtggagctcctctccctgggcatctctctgtcccatctccctgggcttgacctgccactgctccagcccagcgtgtgcccccttgttgccactgccagggcctcctctcctgccattccctctccacgggggggctgcaggagcttactatgtcccctgccatctgccccactctggggctgcctgtcagtatttctctccattccctcccttgctgcctgcctggatttctcagatgaaggacaccatggtaagttggggaggggtgagagtgtttcccagaaggccaaggagaagggtaaggaggccctcagctgagcctgcacccccgccctcctgagtgccggggccctgctcggctctccctgagcaccatgtgcttctctcacctgtgtggggctggctttgttctgtctctgccccagcctgggtactctgtcaccctcactgttcctctctgccattctctctggtcccttctcccctgtctggggtttgtccttcttggtttctgtgtcttggcttttg
